United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 45

SEQ ID NO: 695 - DNA, 315943 bp, Homo sapiens
catggccgcccagggagagcccggctacctggcggcgcagtcggaccccggctccaacagcgagcgcagcaccgactccccagtgcccggctccgaggacgacttggtcgccggggcgaccctgcacagcccggagtggagcgaggagcgcttccgcgtggacaggaagaaacttgaggccatgttacaaggtaggcatccctcgtgttctcggactctccgactgagcctctaactccttttcggacatccccaccgcgcgctccggcgcccgctactccagcctacggccggccggtttagctccaggcccgctcccccgcggagccggaggacacccagggactggagacttcgcgggactccccacccttccacgcctctcagatttccaggcgctgggggccctgtgcgaacttgactggcttcagaaaagccgaaggccgagtttgtactggcgcgcccaagttgcgttctggactttggagatgccaactttagcccggacacctgggctgtgccatccggaccactcgggccgcacagagtatgcgtgaccctccccattccctggcagcctcgagttctgtctctctccgtctgtttcactctctccccttgtcagtatccacttcctccagctgaggggccttgtctcactattgggaaacgctctgcagatgtcaaggcttaagacaggagctcccgcccccacccctgtggtcaaggagggccaggatcggggtgagcagccaaagcgaggggggagtgtggaggcagtgctgctgtgtttgaggacagtgttcatctcttgacaggcttataaaacacatcttgagttacattcagtccataaaaatcttcctatgctatgggtgtctgactttgtctttcacaacttagaattatttttaactctttaatttctttgggactttcccaggtagaaaatcttcaaccatactggaccgaaaacagattctgatttataatacgagtgttggagtgaacgtcaaaacgtccaaggtcattttgacctttcttaaaacagataattactagcctacctgtagccaccgatgtggctcatttcccacatccaaagagagaaatgagttagtttgaatgactgttattcttaaaatacgtgtacgggaccaggcgttagtctcacttagggcgctggtgaagattcattcagtagctagtgttcttttatcatggaggagtttggagtttttcaaacgttatttgtggctttatgcataacttactttgactttatcagtcaatgcatcgcagtatgggaatgatttagccctctgtggaaatgcagtggctttttagaacaattaagcaggttattttaagagagaacaacatgttttccaaaacaataacttggtggaaacaaatagcaagagtgtttggcagacgttttttggatgtgctacaggctttcctcccttgttgcttatttttattgacaaacatccctaatgtgtgtcatgtctttctctgtctctccccttccctctctttttttctcaaattatgtaacttttgaggacagttacttctgtgataaactcttcaagtaagaccgttataagatagatttggaaattaaagccccagttgcatttcagtaactcatttcagttatttcgtctgttctgtggttctttttgcctagtttatgattataaaacaaaatattaaatttatgtcaggcatatattgtgagatcgtttggaatgaactgatagtagcacatactcatccttttcaaccagctttcagttttctacattagtttggagtgatatgaaagaatgatctgtttcacctgcgcacaaacaagtaaggacagtgatgttagcttctgggaagttcaagtgtataacctgagctttagaagtgaatttccttttttgatttaattcattttcacttcgaataaaatgaaattttgaggagactttttgaaaatttgaaggctcttttgtattaatagatgtgatactacgatctgagacggtttgaaattgctttgcagtaatagtttcttttacagaaagtcttaacatctcttgaacaaccgatatacagtcatgcagtccatgcttaaggactacgactgggataccttgttagaaatgtgtccttaggcattttcattgtgcaaacatcatggagtgtagttacacaaacctaggttgtgtagcctgctacacctactacctaagctatatggtatagtctattgctcctaggctacaaataatgttactaggctacaaggcgtgttactatacccaatactgtagacagttgtggcacagtggtatttgtgtatctaaatatatctaaacattggaaaggtaatgtgttatgttactatggctatgacatcactaggcgataggaatttttcagcttctttataatcttacgggaccattgtagtgtatgtggttagttgttgaccaaaacacaagtgtgagcactgggatcactaatacctgggttcaaaactctgtaggatctcaggaaagttgctaggcctctctttgccttcagtttgcccatctgtaaaatggagctgatactaggaccttttaggttttgggagaatcgaaagagataatgcctaacaagctaacatttgcccacagtgtttggtcaatgataagaacttaatgaatatctgttgttattattaataataaatattgcatcatggattaaaaggatttccagtgcctaccacaatgtatgaaatatagtatatacttaataaatagttggggaacaaaataattttgcaggttcataattgcagaagtaaaatagaaactaaagaagtaagtctatcaagtcaataagcattctaatattgttagatattcttgggtggaaagctttttatttgaaaagtgccaagtaagtaaagtctgtatttgagttttcaattattgtgaatttgggtgtgctatttttctatttacaattgacttaaaataggtacaggtttccaatttaaatcaggataaataagattatctgcctttaagtattcagagtgcaaattggtgattataatgcttggaatttgtttccagagagactgtcctgggggcaagttaatctttaatgagttgtatttttattagtagataaattcttctacgcaatggaccaaaaattcagtgaggttaatatatgggcaatagggtagtagtcaaataaatgaaataccattcttagatgatcattaaaacttaaaagaattgttgcagataaaaaccaccaggccaacaatgtagggaaatatcactcttttttcatggttttttactggcaggttggggtctaattactacttcgaaacaaccatgcagagtatctgatgtttttgctgtaagtgaagattatcagttttattagtttacagttttataaatggaaatttattttcaagtttaggtttttgatgggtgtggtaagtcttggaatgaataccatagacagcatttttaatgataaagaaaatccttatataatttctttatttaatactgatcttcaaatgtaaatttcatgcatcatgtgaaataatagtattgatttatgtaagccaattaaattttagttaaattaactcaaagttataagttacatatcataactcacattaactcaactgagttatcagggaggaaagggaggagagtgttatagcaggaagtctgggagaaagtaagaaataattgagtcaagagaatcagagatacagtcttggtgtttgccagagtactgaggcaatcacaggattcctatattaatacttttcttttttaaagtatttttctttgtaaaaacatatatgtgtactataaaattaaaaattcccatatataacacagcacttcaaattattatttaaaaaaaatttcccatataaaattcagaagcataggtattttcaaagtttgggaatcccttctttcagtagagaaaatggtaagtgttaaaaagtgggacctgtggtggggaggaatggcctattttcatgaaaggagattgacatctggtgggattttatgatactgctgccaaagactttaagaaccatgttgcatttttgcagtgataggcagaactggggtcatttgctactgctcggttgagtagcagagttagccactgaaacagaggttgttgtacatcattgattaacagtaggagcagcaactatgttatctctttaattcagcaaactttagtggatttttaaaatgatttgatgaacagataataatttagacttttttcatgagagcgggaagaaatatgaagccaaaaatgtgtgaaaatgggggagtactgaaagtgaagataaagagtaaagcttaaataaacagagttttctagctaatgcttgatcaaggctaataaacagcaaaaacaaatcaaatacatttatgagcttagagattaatagcacagggctgtgggccaaatctagatttgaatcttgatgctacattttaatagggagcttgggagaatccatcacttggcgacctcatttctcaaatggggcagttaatggtagtacttacctcctgaggtagttttgaaaatgaagaggaaaaaggtgtatgtaagtcatcccagtgctggcaacataggaagtgctgaataagctaataacaatattcacagtaaatcattatgtataaaatgcactttcttatattgatcatgaaaatcaagtatattggaaactttagtttggtcttaaattatcttacgattaatgaacatgcacagctatctaaatattattattggcctccctggtagcttgccatgtgttgagtatacttgtaaaggtgggtgggtaaatactaagtaaagctccattagacatgagtgtggagttctagattttgctcaggacgagagggcttttcaccctttttagttgtaaattgttcttgctttgagtatttttcattatttgactggtcctgagccattcatttctagtatggtttactaaagactagcagcgaaatcagttaatctctcttctggttgtaagttgctctgaatttgagtcattcattggtgtgtagaaagaaggttttttgaagaaaatactctgcctgggttaacatgtttcatttgctcacctgtaaaatggggataataatagtcctactttacggtgatattgtgaatgctgagtgtgagaatgtatgtaatatgcttagttcagtgccaggttgatggtgcttaataaacatcagttcagatgcagcagtactgtctcacatgatggataaagatttcaaaacactagaaagcaaatacttgccaagtctttttttcttttttcttctaattgcatgtgaatcctttgtgtatgtgtgtgttgggggggggggggtgtgtttgatgtgttttagtgaaagtcttcctcaaaaaattagaaaagtttgttatgacaatttatttgatccagagagcatagttgcaattaaaattgctttatagattaagtgaaaaaacacatcagaggttgtatagcttggcagtaaagagcccaggagctgctttcagactaacttggattgaggaggtcctcactttgcttctcgtagagttccgtgaggatgcactgagaggggcagtaaaacctcacgctcacgggcatggagcaagcactctcagtcacttatctctatgaagacttggagggttttggtgaagttgatcattgataaatacatagctagagaggtttgttataccaatgacttttacaggcaagaatgtatttggctgcgactaacaggaaacctgacacagagtggcttaaacaagccaggggtttgtccttctcacctaatgagaagtctggggctaagcagtccaggctccaagagctgctcaagggcatcaggagccccgtgtcttccctcttccctgcctccaccatcttcagcctgtggctttttgccttatttttgcactgtggctgtggctgtgttttgaggtgtgtctggtttatgcaggaaaaaggcggaagaagaaaaattattttctcttagagattttgcatttttatgtgacaaagaattctctctcctggaacttctgtctgtacttctttggccaccttttgctgcaaaagactctgggaatgtatcttctttttccagcctcactagtggaagtaggcaaagaagaagggggtcagaatggatgctgaatgttttaccccatattttcctcacagtgggcaaagtggaggagcattaggactcaaaattgcaaattgtgactgaagtcaaagcttacctgtattggagactttggactgtgctgataatctgtaggaacttatgttattcagtaacattatatatcagtagaatttctttctttcctttttttaaattataattttttttcatcaggcagcccctgaaccagaataggttctgagaggctccctagaatttctttcttggcatagtccagaagtaaacctaaataccaaagaggaaaccaactctgatcatctaaagctcttctcatcttgttactccttttatgaacagaatctaggaccactgagtactggaactatctctaaaaattctccattgttttctccatgtcaaatgtttttttttccatagaaaattacatggtacaataaaaatgcttatttcactttttattatcttaagatatcttttctgtcctccctcctcccactgtccacacatgtcagatttggtttagaattgacaggttcagtgtagttcatgcctcgcccttttggcttttcatagattggtcacttaggtataatctggccaacaaagccagaatttgttcagaaccgttttggagacagtttgatagaattatcatcccatgttttgtcgtctgaaattgtccaaaatagtgagctaataaaatagaccagttgactcattcttagttcgttttaagatactgttcttacttaaaaaatacatagggtaatagtgaccacatatattcctttatatgaaatatttaataaactaccaggaatgaggcgcaattttattgctaatttatagtggttttggtgtgtggggatgatcttggcaagaaaatcttgttatgctgcaaaagccaccaaattcaatgtctaatccttatcgtactaccatctagggcagtctccagagagcacaaaaccatcatagaagcattgtgggtgctatacatttgtaaatccttttcctacctatcaggctactaatagctgtggatgatgaaaatgtttgtatttgtaacaagtattaaatcttgttcccatttatgatgctggcatataaaaagataacactttctaggtatcaggtggtttccctgttatagtgagaatgataaaccacatattagtctgcatattgagttgatctggagcttaactgtatctcttatatagaaaggtgattaaacataggatttgaaaattagccattgctgttttttccccctcgattttaaaagtaatacaaacctatatagaatacttgaaagtataaacataagtaaaaaagaaaaaccaagtcatccctaactccagaatccagcaataaccactgatgatattttaggaatttttttcctggtcttttgaaaatatgcccacacataatttatttttgccatgcattttgagtttgtaccatatgtcaggtgcagtgttgagctttggggatgcagatgaaaccaaaagagttactggccctacccttctgtgacttaaattctacactgggatcatacctcctatctttttcacttagcgttgaatcataagtattttctgtttcattaaaggttcttgaagaacatggtttccggtgtctgtataattcttttgttgtagtatactttgtttaaacactacaacattttagaatatttttaggtggctagacagtggaatgagtccagtgtttctactcaaactgcccgggattcagatcctgattattagccatgtggcctgggacaaattaataactcatttggcttctcatctctaaaatggagataaaaagtatctatcttctaggttgtgaggattagaaatactgtatccacaagtgccaggtgcggagcaggtactcaagatatggcagatgataaatatttagcccgctgtcccaaccacttctgcctaaaagccttttatgcattttttattattctcataggaaaaaccttattagtgaaattttggggagcaaaggacatggaaattttaaggttcctgatcaattttgcaaaattattttctgggaagttttgcaggttaggcagaagagacaacaaatctgcagggtaatctgctccttatacctgcggttcccacagtccattattagaaagcaattgaattaccaatataaagttagatctccgttttgcctttttttgctgaaaaattgaagtgaattttatcttacctgcttagcatgtttgtggatcagtattttttaaaagttgtgggcatgaaaatcagccagggaatgtggtgttttttttttttttttttttttttttttttttttttttgagggagtacactttggccttccctctcagattccaactttgtaggtttgagagtggtgttggcaggattggcattttggaaagaatcttttgtgagtctaatggagatggtcccaggatcacactttgagaaacattgcaaggtggttagaggatggtgaaatcattgaagttaagaatcagactcttttctttctttgatttcctttacccttgaagctagtactttttccacattattaaaccatcttgaagcattttagtctgggaacataatttataactggtatgttgtttatagtggcttgttgtaagggacttgggggaggagcacaaatctatatattcttgcggagggcaatattgtcatattgcacagtaggctcacaatgcatttggttttcctgcagactcccattaagttaggcataatagatacctatgtaatatattatgaaataatttaaaaacacacttttcattgtagaaatttttaaagcaatacactccttagcaaatgtaaaagaacagaaattataacaaactgtctctcagaccacagtgcaatcaaactagaactcaggattaagaaactccctcaaaaccgctcaactacttggaaactgaacaacctgctcctgaatgactactgggtacataatgaaatgaaggcagaaataaacatgttctttgaaaccaacgacaacaaagacacaacataccagaatctctgggatacattcaaagcagtgtgtagagggaaatttataggactaaatgcccacaagagaaagcaggaaagatctaaaattgataccctaacatcacaattaaaagaactagagaaacgagcaaacacattcaaaagctagcagaaggcaagaaatagctaagatcagaggagaactgaaggaaatagagacacaaaaaacccttcaaaaaatcagtgaatccaggagctggttttttgaaaagaccaacaaaatggatagaccgttagcaagactaataaagaagaaaagagagaagaatcaaatggacacaataaaaaatgataaaggggatatcaccatcgatcccacagaactacagactaccatcagagaatactataaacacctctatgcaaataaactagaaaatctagaagaaatggattaattcctcgacatatacaccctcccaagactaaaccaggaagaagttgaatctctgaatagaccaataacaggctctgaaattgaggcaataattaatagcttaccaaccaaaaaaagtccagaaccagatagattcacagctgaattctaccagaggtacaaggaggagctggtaccattccttctgaaactattccaatcaatagaaaaagagggaatcctccctaactcattttatgaggccagcatcatcctgataccaaagcctggcagagcacaacaaaaaaagggaattttagaccaatatccctgatgaacatcgatgcaaaaatcctcaataaaatactgacaaaccgaatccagcagcacatcaaaaagcttatccaccacgatcaagttggcttcatccctgggattcaaggctggtttaacatacgcaaatcaataaacgtaatccaacgtataaacagaaccaacgacaaaaaccatatgattatctcaatagatgcagaaaaggcctttgacaaaattcaacaaagcttcatgctaaaaactctcaataaattaggtattgatgggacgtatctcaaaataataagagctatctatgacaaacccacagccagtatcatattgaatgggcaaaaactggaagcattccctttgaaaactggcacaagacagggatgccctctctcaccactcctattcaacatagtgttggaagttctggccagggcaatcaggcaggagaaagaaagaaagggtattcaattaggaaaagaggaagtcaaattgaccctgtttgcagatgacatgattgtatatctagaaaaccccatcgtctcagcccaaaatctccttaagctgatagacaacttcagcaaagtcttaggatacaaaatgaatgtgcaaaaatcacaagcattcttatacaccaataacagacaaacagccacatcatgagtgaactcccattcacaattgcttcaaagagaatgaaatacctaggaatccaacgtacaagggatgtgaaggacctcttcaaggagaactacaaaccactgctcaatgaaataaaagaggatacaaacaaatggaagaacattccatgctcatgggtaggaagactcaatattgtgaaaatggccatactgcccaaggtaatttatagattcaatgccatccccatcaagctaccaatgactttcttcacagaattggaaaaaactactttaaagttcatatggaaccaaaaaaagcccgcattgccaagtcaatcctaagccaaaagaacaaagctggaggcaccacgctacctgacttcaaactatactacaaggctacagtaaccaaaacagcatggtactgataccaaaacagagatatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacaccttaattcaagattgatcaaaaattaattcaagattgattaaagacttaaatattagacctaaaaccataaaaaccctagaagaaaacctaggcattaccattcaggacatatgcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggaaaaaatttttgcaatctactcatctcccaaagggctaatatccagaacctacaatgaactccaacaaatttacaagaaaaaatcaaacaaccccatcaacaagtgggcgaaggatatgaacaaacacttctcaaaagaagacacttttgcagccaacagacacatgaaaaaatgctcatcatcactggccatcagagaaatgcaaatcaaaaccacaatgagataccatctcacagcagttagaatggcagtcattaaaaagtcaggaaacaacaggtgctggagaggatgtggagaaataggaacacttttacactgttggtggtactgtaagctagttcaaccattgtggaagtcagtgtggcaattcctcagggatctagaactagaaataccatttgacccagcaatcccattactgggtatatacccaaaggattataaatcatgctgctataaagataacatgcacatgtatgtttattgtggcactattcacaatagcaaagacttggaaccaacccaaatgtccatcaatgatagactgaattaagaaaatgtggcacatatacaccatggaatactatgcagccataaaaaaggatgagttcatctccttggtagggcatggatgaagcgggaaaccatcattctcagcaaactatcgcaaggacagaaaaccaaacaccgcatgttctcactcataggtgggaattgaacaatgagaacacgtggacacaggaaggggaatatcacacactggggcctgttgtggggtggggggaggggggagggatagcattaggacatatacctaatgttaaataatgagttaatgggtgcagcacaccaacatggcacatgtatacatatgtaactaacctgcacgttgtgtacatgtaccctaaaactttaataataaaaaaaattttttaaagcaatacaaggaagctttttaaaaagaaaaataatcgtcagtaatctcaccatcctaacaaccattttcatttttctgccttgaattagagtttatgtagttgctggtatagtatttactgctttgtattcagtattttaatctattaaatgttttctgtatttctaagcagttttcagaattctgtggttgaataatagtacatttggttgaaaaaaattttttatagttatgaactacctaataacgaatgtgattacatggcttttttttcttcgtgactgtattctgaggaagaaatttgaggaatctgagtactgaagaatgatggtagttgcaaaagcagcagccaatttgtattatctcttactttgtgtgggacattgtctttggtgatttatgcctgtgcggtcatctcagcttctcagcaacaactcatgacatacagatgcccattgggatctgtactttacagagaaaaaaaaaagctgtaaacactttaaatttggagccctgatttctttttggaattccaagtagacctagacactagttttccaattagggttgttgtaaggtctagacttttgtatgttgtggagatgtatcatagctgagtttaggatgacaaaccaccctcccgaataggttacattgtttctttctttttttcttaattatactttaacttctagggtacatgtgaacaacctgcaggtttgttacatatgtatacatgtgtcatgttggtgtgctgcacccattaactcatcacatgtgtcatattggtgtgctgcacccattaactcatcatttacattaggtgtatctcctaatgctatccctccctgctccccccaccccacgacaggacccagtgtgtgatgttccccaccctgtgtccaagtgttctcattgttcaattcccacctaagagtgagaacatgcggtgtttggttttctgtccttgcgatagtttgctgagaatgatggtttcccgcttcatccatgccctaccaaggacatgaactcatccttttttatggctgcatagtattccatggtgtatatgtgccacattttcttaattcagtctatcattgatggacatttgggttggttccaagtctttgctattgtgaatagtgccacaataaacatacatgtgcatgtatctttatagcagcatgatttataatcctttgggtatatacccagtaatgggattgctgggtcaaatggtatttctagttctagatccttgaggaatcaccacactgtcttccacaatggttgaactagtttacagtaccaccaacggtttaaaagtgttcctatttctccacatcctccccagcacctgttgtttcctgactttttaatgattgccattctaactggtgtgagatggtatctcattgtggttttgatttgcatttctctgatggccagtgatgatgaacattttttcatgtgttttttggctgcataaatgtcttttgagaagtgtctgttcatatgcttggcccactttttgatggggttgattttttcctgtaaatttgtttaagttctttgtagattctggatattagccctttgtcagatgggtagattgtaaaaattttctcctattctgtacgttgcctgttcactctgatggtagtttcttttgctgtgcagaagctctttagtttaattagatcccatttgtcaaatttggcttttgttgccattgctttttgtgtttttagtcgtgaagtccttgcccatgcctgtgtcctgaatagtattgtctaggttttcttctaggctttttatggttttaggtctaacatttaagtctttaatccatcttgagttagtttttgtataaggtgtaaggaagggatccggtttcagctttctacatacggctagccagttttcccagcaccatttattaaatagggaatcctttccccatttcttgtttttgccaggtttgtcatagaccagatggttgtagatatagaccaatggaacagaacagagccttcagaaataataccacacatctacattgcttcttgagtgccctgctgaaatgcagaggagcttggtgtcaggctcgggtgggttagaattctcagtgagaatgcaggtgttgcaaagctctgccttctactagctttggttatgctttctcagtttctccctttacaaaacagaataataatatgtctcatgtagggttatgataacatttgtaaggctggcacacaattggtgccctgtaaatagttggtatttttcaaattcatattctgttcctctgtggcatctggcccagagctgtgaaaatatctggactgtgtttatagaataaatgacccatgatggatctggattaaaaagtttgttcattttgggctagcggacctggcattgacctcatggaatggagctttaaagcaaagtcacgtgcttggccttaggaagtgccaaacagttctgccttacccaagtaaggcagagcagttctccatatgcaagatgatctgtcttcaccctcaatctaggccgtatgtagaatgttttactgttagtgatagaacattagtgtggagttttgaatgaggatatgcaaaacttaattcaagcgaggttaatgttaattatatttgtatctaatctggattagttttataaatcgaaatttgtcaaggttaatataatttcagtttatttcattgccgacactgaattatcttgttcttagaataatatatctctagatacttgtttaaatgtgatttcaaatcttctcagataagagataatccattctcaaaattaagaataaccttttatgttagcttgctcactgcactaaaattatcattgagttattttgagttagagggaaataaaccacttctccccacaaaatgttgattaggaattaggtgccctgagttcatgacccagtcttgccactgacttcgccaccttggacagcctctcagggttttggattagatgccccttaaaatctctttcagttccagtattccgggtcttctgcacagtaaacaatacaaacccaatggtactttgaacgtggtgttagaagctgagttggttctccatacatgagtagctttggtagggatttgccttgatctttaccacacctgagcattcacagcaaatgggaaatgtggtagaaagagaggatagttaaagtgtctcggctttggagaagcaagtacttgtcagagagctaaccacaagctttgttttctaacatcttggcagtcaaatttgcaacaccctgaattctgtgggctagagcttagctaatttaagattttctatggtaattgagcagagattacagtgtaaatcatagttgagacttgttggtgttaacatacttgtctaggtgaacaacagattttatgcgtcttcaagtaggatctttttgtcacattttccttttcctctgctaacatgtccagctatcaagcttcatgtgccagtattgatatctagcatctaaaccactagagttgcagggcaggaaaatgtaatgttgtgccttagggtaaaatttcaataaaaaatacatctgtatctgtccagatttcaagtattttcagaattgttttaattgcttgttgattattgagaactaacacagtatttctcttattctgcgcagaagaccactaaatcttgtattatctatgttctgagttgatccctttatcatgagctttttcttttgtttgttaaaagcatcacttaaagcaaaggcaatgttttggtaagattttatcttttttagttatttcatataatgatttaacttcaagccagagaaatgtgtgtttggcttgagtcttgcaggaggaatcatgtaaagacatgtttattttaatctggggggaattttttttaattagaactttttatatgggaaaagaaaacctgagattgttatagatctatagcgtttttcttcagggatctataatttactaaaacattgttggcacttattacgtacacagaaagatcaccttcaaaaatatatttactatcagtaaatggatatctgagatgcattatctaaatagagcatatttgaccaagtctaaaaactgggctttagcaacaaaacattataaaaatggatctggattttaaaagttttgcataaatgattagctttcaagcttgtgaaagtttttttttttcattttaaatcatttgggactagtgaggccatctacaatgggaaattgttgcatgtattggacaaaaatcatgagtgcatattatgggactgcagaattaaatgaggccctttacctttaaaaggaatataatctagtggaagagaggaaacgtatctgtattttttaacagaaaacaaaaggagatcacgtagagtaaggccctgattaatgtacatcatagcctgggtcacgtacctccaccccacaagaccaagaagtgaaatgagggaattgaagaatcaaatagaaaaaggcaaagccaatacaatgatgcactatctagtttgttacttctgaggatgactactacttctggtgaggcccagaagctatatccctaaattgtccacctaaggaattaaaaagagaggcattggtctgtcagcttctgttccctccttgaggagagtcaagggttgccttctggggcctgcctttcctgcgattctgtgttaatacacttaagacttagacgtatagatatctaacaagctcctagggaagtaataaagaagtatgtttagtgtaagattgagatgagacattgttaccccaaagtgggttgatacctatgccgaactgtttactgtagcctcgctggaatcagagatgaaggtgagatggtatataagattgtgtgtccagtacaatgtctttatatactttaaatgcaaaaaaaaaaaaaaaaagaaaatcagaaagggagaggcggaaatggacgtttaagatatttcatacctttgttctaaatcaaagaaacttccttactgtaaattcttcatgtagagaatgctttatgagattacaaaaataagcctgtctgcagtcagcaagatggaggaatagggagcaccagacttctacccctacagaaatactgacttaacaatatgtggtccaataaagcctttatgagaaggccagaaatcacttatgaagtcacagaactccagtttaaaaccaagaaccatggttttgaaacaggtaagaaaagctgtttcatttcatctgagtcggccccttccccaagccaccacagctaatgatgaggaaaaaaagtccagtgactggtttctcccttgggagaaaaagagtaaaatggaattatgtccaatgtgctggctttttgagactactcaagtgactggtttctgccttgcttgacttggagtgctgatgaggaataggcatactttgattgcctggggactgctgagaacaagagagctcagcggttggtggcagtaccaaaatacccgtagtactgcaaacagacaccagagggtgcaagagactgtagactcctgaaaaagaaaccagaaaactttgtctggttgtgaaattacacacataggctcagaaaaaattcatctctgtaaaaggtttgagagaccgccagaatctctagctgggctgattggtgaagatctttttccatccaaaaccagtctgtaaagactggaagaggtgaccgtttattcaaatacaaaaattacaacaaaatataaggcacacaaacagggaaaatatggtccaatcagaagaacaaaataactgtccgtaaactgacccaaaagaaatggagatctgtgaattacctgacaaatagtttaaaaggaacattttaaattagtgcactacaagaaaacatatacaatgaaactgtgaataaaatgagaatatcaattaagagatggaaactgtaaagatccaaacaggaattctaaataactaaacaggaattctgaagctgaagaatacagtaactgatttgaaaaaaaaaattataggggatcaacagcagactttattaagcaagagaaagaatcagcaaactcaaagacaggtcatttgaaattattgagtcagaggaacaaaaagaaaaaggaaaaatgaagaaagcctaagggacttatggggcgccatcaagtgaatcaatatatgcattacatgaatttcagaagaggaatatagaggaaatgagggacagaatatttttcaaactacaatagccaaaaccttccaaatgtgaaaaaggaaatagatatccaaatataagaagctcaaaggactacagtcatgatgaaactaaagaaattcacactaagacacattctagtcaactttccaaaaacaaaaatcttaagggcaacaggagaaaggcaatgtggtatatacagagactttccataagaatatcacacatttctcagtggaagcatcgcaggacagagtggaatgagattatatgagggatcttcaaaaagtttgtggacggtatgtattatgaaaaaaaaaactatgcatggatttcaaacttttttttggcactaaaataaattcctgctgatttgggtaagacatcaatttgaaaagagtccctatccagagcaacatgtattctgctattactgaggcaagaacaaataccaaatttatggtgaagcatggtggaagaatggtgaaattattgatactttacaaaaaatttatgggaatagtacaccaaagaaatcagctgcttccaaatggataattcattttaagaagggacgagatgatgatgaagatgaggcccatggcagcagaccatccacatcaatttatgagaaaaaaattcatcttattcatgcctaactgaagagggccaacaattcacagaagaagcaatggccaaacaccataggcatctcagttggtttagcttacacaattctgactaaaaaatcaaagttgaacaaattttccactcaatgggtgccaaaactgttgtgctaagattagctgcacacaagagctttcagtgaaaaattcaaacaattggcattgagatcctaaagcatttctcgaaagaattgtaacagcagatgaaacatggttttgccagtacaatcctgaagacaaagcacaatcaaagcaatggctaccaagaggggcacatggtgaagagcaaaagtcatggcaatagttttatgagatattcaaggcattttgcttgttaactttctggagggtcaaaagaaaataacatctgcctccgtcccaaaaagaaaaataaaaaagaaaataacatctggttattatgagagtgttttgagaaacccaaagctttagaagaaaaacgtctgggaaagcttcatcagcgagttgttctctgccatggcagtgcttctgctcgttcctctcatcaaacaaggacaaattttaaataatttccatggggaatcattaggcatccaccttacaattgtgatttattccttttgacttctttttgtcttctaatttaaaaacatctttaaagggtatccatttttcttcacttaataatgtaaaaaagactgcattgacatggctaagttcctaggacccccacttttttagtgatgtactaaatggttgatacaatcacttacaagagtactggaactttttggagcttatgacaagaaataaagttcatatttttaatttttatcttttaattcaattttccatgaaagttttgatgtcccctcatccatacagagtgctgaaggaaaaaaaaacctgacaatcaagaatagtatatatggcaagacttttaaaagtgaagaataaataaagacctttctggataaacaaaaggcgaggaattaattaccattatgcctgccttataagaattgttaaagggagtttttcaggttgaaacaaagggatactaaacagtaacatgaaaggatatggaaatataaagctctctggtgaaatacccatggtagatgcaccagaaaaaatgagaaagaaagaaaagcatgtcactacagaagaatcaatgaaatagaaaggcagcaagagccgcaaagggggacaaaattactactagccatacagaacacaattaaatgataatagtaagttcttacctatcagtaattactttaaatgtaaattgattaaattccccagtcaaaagacatacagtggctgaatggattaaaaaagaacaagatccaactatatgctgtctacaagacactttagatataaggacatactcgggctgaaagtaaaaggagggaaaaaagatattccatgcaaatggtaacccaaagagatcagaggtgttcatgtttatatcagacaaaaatagactttatagaaaataggtaaaggagggcattaagtctccccttacccaagatagcagattggaggtattgctagcatgcctctcccacttagacaaagtagtgtgtagaaattaatgctctgaacttttttttcaagaagcaacataggaactaaacagaaaaactgaaaggaactacagaccctttgaaagaagcagtgggcggcagcctatactgtgaaccagactgaaaacccccacaggaaacactgaacctgctcaacaccaagcatatcactactacaacgagcatctgagaaaaacatcacacaaagattctctataaccaagaaacttatacagagtcttcaccactgaaagcacctagagccaaagctaggtgacaataaattataaacattaaagtcataccctcaaggggaataaaagaaataaaaaccccagttaaatgaaaaataaattcaaaaataatgagaagaaatagtctacccaaatgagaaggaaccagaaaaataattctggcaatatgaaaaaacagggttctgtaacacctcccaaaaaacacactaactctccagcagtggattcaaaccaagattaaatctttgaaacaccagataaaaattcaaaaggttgattattaatttactcaaggagatacaagataaaggtaaaaaccaacacaaattaaaaaaaaattaggatatcaatgaaaaatttttttttaaagagatagatttttaaaagaaaaccaatcagaacttccagaaatgaaagacacacttagggtactacaaaatgcagtggaaagtgttaataatacactagattaagtagaagaaacaatttcagagcttgaagacaaggctttcaaattaacccaatcagacaaaaataaagaaaaaagatttagaagaaacaaagtctccaagaaatatgggattatgcaaaacagacaaagaattataggttttcctgagggagaggaaaaaacaaaaaatttggaaaacctatttgagggaataattgaggaaaacttccctgtccttgctaaaaatttagacatccaaataaaagaagctcaaagaagtcctggaagactcattacaaaaaggacgtcaccaaagaacatagtcatcagattatctaaagtcaatgtgaaggaaataattctaagaacagcgagacaaaagcatcaggtaacctattaaggaaaacctagcagactaacagcagacttctcagcagaacaaaccagaagagattggggtcattttttagtcttcttaaacagaataactgtcaggcaagaattttgtatccagcaaaactaagtttcataaatgaaggagaaataacgtctttctcagacaagcaaatgctgagggaatttgtcaatactagaccaatgttacaagaaatgctaaaaggagttctaaatcttgaaagaaaagattgatacacaccaggatagaaacctctgaaaacataaaattcacacggcttataaaacaataacacagtgaagaaaagaaagtatctaggtaacaatcaacattatgactggaatagtatctcacaatactaacattgaatggagatggtctaagtgctccattaaaagatacagattggcaaaatgaataaaatcgtcacaaaccaaatatctgctgtcttcaggagacacatctaacacaaggattcttatagacccaagggaaaagggtggaaaaagatatttcatgcaatcagaaaccaaaagcaagcaggaggaactattcttatatcagataaaacagacattaaggcaacaatagtaaaaaaaaaaaagacaaggtcattatacaatgataaaaggatccaattcatgaagaagataaaataattctaaatatatatgcacctaactccagagctcccagattcgtaaagcaactaccactagacctaagaacagagatagacagaaacacaataatagtagagggctttcactccactggcagcactagacagagcactgaggcagaaagtcaacaaagaaatactggactctagaacaaactgacctaagagatatttacagaacattctactcaagaactacccaagaactgcagaatatacattcttcttatcagcacatggaacattctccaaaatagatcatatgtaagctgcaaaacaaatctcaataaattttttaaaaattgaaatcacatcaaccatattctcagaccacagcagaataaaatcaattccaagagtaatcctcaaaactgtataaatacatggaagttaatctgttcctgagtgatttttgggttaacaatgaaatcaagatgaaaattgaaaaatttctgaaatgattgataacaatgacacaagttctcagaacctctaggacacagcaaaagcagtgttaagaggcgtttatagcactaaatacctacatcaaaaaatctgcaaggttacaaattgacaagctaatgtcatgcctcagggaactagaaaaagaacaaaccaaactcaaagctagcagaagaaaaataacaaagatcagggcagaatgaaatgaaattgaaaagacagtacaaaaatcaatgaaacaaaagctagttatttggaaagataaacaaaactgatacactactagctagattaaccaagaaaagaagagaaaagattcagataagctcaattagaagtgaaaatggagacattacaactgacacctcagaaatataaaagactatttgagattactatgagcacctctatgcacacaagctagaaaatctagcggaaatggataaattcccggaaacatacgacaccctagcttgagtcaggaagaaatagaaatcctaaacagaccaataacaggctgtcagattgaatcaggtaaacaaacaaacaaaccaaaaaaacaaacctgtcaacaaaaaaagcccagggcatatggattcaagccgaattctactagacattaaaagcagaactggaatcaattctactgaactattccacaagattgagaaggagggaaacctccctacctcattcgacccagtcagtatcatcctgataccaaagccaagaaagaacctagcaaaataagaaaactacagaccaatatccctgttgtatatagatgcaaaaatcctcaacaaaatactagaaatggaatgaactagaacaaaaaaaaaaatcatgatgaagtgggttttattccgactttttctttctcaataggtgcagaaaaagcatttgataaaatctggtatccctttatgataaaaattctcaacaaactagttatagatgaaacatacctcaaaataataaaagccatctatgacagattcacagctaacataatactgaaaggggagaacttgaaagaattccccctaagaatgggaacaagacaaggatgcccactttcaccacttctattcagtataataccggaagtcctagccagagcaatcaggcaagagaaataaagggcatccaaactggaaaagaggaagtcaaacttatgtctatttgctgatgatgtgatcatatacctagaaaaccctgactcctccaaagaatcctagatctgataaatgaatccagtaaagtctcaggttacaaaattaatatacataaatcagtagcaatgctatatgcactgagaaccaagctgagtatgaaattgagaactcaattccttttacaatagttatacaaaaatatttaggaatatatataaccaaggaagtgaaacatctgtacaaggagaactacaaaatactgctaaataaatcacaggtgacacaaacaaatggaaatacaccttatgctcatggattggaagaatcaatatcgtgaaaatgaccatactgcccaaagcaatttacagattcaatgtaattcctatcaaaataaccaacatcgttttttcagataattagaaaaaaaatcataaaattcacatggaaccaaaatagagcccaaatagccaaagcaatcctaagcaaaaagaacaaatctgaaggtgacatcacattacctaacttcaaaatacactacagggctatagttaccaaaacagtatggtactggtaaaaaagtagttacatagaccgtggaacaaaatagagaaccaagaaataaagccgaatacttacaaccaactgatctttggcaaagcgtacaaaaacataaattggggaaaggacatcccattaaataaatggtgatgggaaaattgaatagccacatgtagaagaatgaaactggattcctacctgtcaccatatacaaaaattaagatagattaaagacttaaatctaagacctgaaaccatgaaaattctagaagaaaaacttttctggacattggcctaagcaaagaatttatgaataagacatcaaaagcaaatgcagcaaaagcaaaaataaataaatgggacctaattaaacaaaagcttctgcacagcaaaagaaataaccattaaatagacaacctacagaatgagagaaaaaatctgcgaattttgcatctgacaacatacacggaactcaaatcactaagaaaaaacaaataatcccattaaagagtgggcaaaggacatgaatagacagttttcaaaggatgatttgcaaatggccaacaaacatgcagaaatgctcaacatcactaatcatcagggaaatgcaagttaaaacgcaacaagatactactgtaccccagccagaatgaccattattaaaaattcaaataacaatagatgttggcatggacagggtgaaaaaggaacacttatacactgctggttggaaagtaaattagtataacttctatagaatacagtatggagatttgatccatgaattccactactgagtatctacccaatggaaaggaaatcaatatataaaaaagacatatttatcacagcacagttcacaattgtaatgatacggaatcaacctaaatacccatcaaccaaagagtagataaagaaaatgtggcatatgtatattgtagaatactactcagccataaaaaagaatgaaataatgtcttttgcagcaactgggatggaactggaggctattattctaagtgaagtaattctggaatcaaaatctaaatccaacatgttctcatttacaggtggtttctaagcttatggatatgcaagggcatacagagtggtataatgtacattggagactcagaaggctggcaagcaggagagaggtgagagatgaaaaagtacctattggatatagtgttcaggtggtgggtgcactaaaattctagacttctccatggtaccgttcatccatgtaaccaaaaaatcactcatacccctaaagctactgaaataaaaaaaaatttttgaagtacattatgtaatgatgaaagggccaattcaccaggaaggtatgacaatgataaatgtacatgtactttacagcagaacacaaaaaatatataaggcaaacatggacaaaattgaagggagaaatagtaacataataataatagaatatttcagtgccccacttttaataaccagacagaatattagtagagaaacagagcacttgaataatgctatagaccaattggacctaacagatacatacagaacactgcacaccaaaacagcagaatagatagtcttttcaagtgcactaggagcattcttcaggatatatcacatggtaggccacaaaactagtattaagagaagattgaagtcatatcaagtatctttttagaccatattgtaataaaactagaaatcagtagcacaagaaaaactagaaaattcacaaatatgtggaaattaaacaacacactcttgaataatcagtggatcaaagatgaaatcatgggaaattagaaaatatattgaaaaatgaatatgaaaacacaacatagcacaacacataagatgcagcaaaagcagtagtaagagggaagtttatagcagtaaacatccatattaagaaaatctccaatcaacaacctaactttatacttaaggggactagaaaaggaagaacaagctaaacccaaagttagcagaaggaagggaggaataaaaattagagtccaaataaatgaaatagataatagaaaaagagtaaaaaaaaaaggctatgaaactaagagttggtttcttaaaaagatcaacaaaatcaacagttccatatttagctagaataagaagaaaacaaagactcaaataacaaaaatcagaaaagaaagaagagacattacaactgatgccacagaaatgtaaagtatcataatagagtactatgaacaattatacaccaacaaattatataaccttgaagaaatgcatacatttccagaaatgtacaatcaagaccaaattatgaagaaataaaatatctgagtggacatatactggtaaggagattgaatcagcaatcagaagcctcctgacaaaagcccaggaccagatggcttcactggagaatgcttctaaacaattaaataagaattaacaccagtccttctcaaactcttccagaaaactgtagaggaggaaacgcttgcaaactcattctacaaggtcaacattactctgataccaaaaccaggatatgcaaaaatcctcaacaaaattttagcaaactgaattcaacaccacattgaaagagtggtgcattatgaccaagtgggatttattactgaaatgcaagtatggtccagcatataaaaatcaaggtaatactgatatgttaacagaatgaaggaaatgtaacacatgatcatctcaattgatgcagaagaagcatttgagaaagtcatacaccctttcatgacaaaacactaaccaaacaaggaatagaaggaaattacctcaatgaaataaagggccatgtgtgaaaagcccacaactgacatcatactcagtggtgaaaactgaatcctttctctttaagatgatgcacaagggaaggattccttttctcaccacttctattcaacattgtattaaaaattttacccagaccaagcaggcaagaaaaacaaaaagcatccaaataggaaaggaataaatataatgatcttttcataggtgacatgatcttgtacgtagaaaaccctaatgattccacacacacacataaaactgctagaactaataaacaaatttagcaaagttgcaggacacaaaatcaacacacaaaagtcagttacatttctatactcagcaatgaccaatctgaaaaggcagttgaggaaacaatcacatttacagtagcatcaaaaagaataaaatacttaggaataaactttaccaatgaggcgaaacacttctacactgaaaactacaaaacattgcagaaaaaattgcagaaaacacaactaaatggaaagaccttctgtgttcatggtttggaatccttaatattttgttaaagtatctctattacccaaaccaatctacagattcaatataagccctattgaaatagcagtgttattttttgcagaaatagaaaaaaaaattctaaaattcatatggaatctcagaggacccagaaaagccaaaaaagtcttgagaaaagaaaaacaaagctcgaaacctcgtatgtcctgacttaaaaacatattacaaatccatagcaatcaaaatattatggtagtggaataaagacagacagacatataagcccagtgtggtggctcacacctgtaatcgcagcactttggaaggcagaggtgggcagatcgtttgagatcaggagtttgagaccagcctgggcaacatggcaaaaccctgtttctacaaaaaataacaaaagttatccaggtgtagtgatgtgtgcctttggtcctagctaatctggaggctaaggtgggagaattgcttgagtccgggaagttgaggcagcagagagctgtgatcacgccactgcactccagcccaggtgacagagcaagaccctgtctcaaaaaaaaaaaaaaaacaaaaaaaaaaacccagacatacagactagtggaacagaatagagaatcgagaaataaatcctcgcctatatagtcaaatgatttttgacaaagatgccaaggctactagtagggaaaggacaatctcttcaacagatgatgttggaaaaactggatattggcatgcagaagaatggtataaccttataccagattaaaaaaaattaaatggattaagacctaaatgtaatacctgaaattattaagctcctagaagaaaacaggggaaaagcttcatgacattgggtttggcaatgattttgtggatttaacacaaaaagcacaggcaccagaagcaaaaatagacaaataggacatcagacctaaaaacttttgtgcagcaaaggaaaatcaacagagtgaaaaggcagtctacgtaatgggagaaaataattgcaaaccatatatctcataacgggtacataaccaatatatgtaaagaacttctgtaactcaataacaaacatcaaaatttaaaaatgggcaaaggactcgaatatatcaaagaagatatacagttagccaacaaacatgaaaatataaacatcggcatgaaaagatcaacatcaagtaattgttaaggaaatgtaactcaaaaccacaagaggtatcaccttgcactcattaggatggccattattaaaaaaaaacaaactgaaaaaaacaagtgttggttaggatctggagaaattgcaatccttttgcactgttggtgggaatgtaaagtgatgccactagggaaaatgatatagaggctcctcaaaaaattaaaaccaaaattaccgtataattcagcaatctcacttctgggtttatatacaaggaattgaaaacaggaccccatggagatatgtgcacacccatttgcattgcagcattatttccagtagctaagaggtggaaacaacctaaatgttaatcagcagagacagggataaaaaaatgtgatatagacatacaatggaatattgctcaggattaaaaaaaggaaatcctgtcatatgctacaacatagataaacctggaggtcatcatgctaacttaaataaaccagtcacagacacataccacatgattccacttacatgaggtatctaaaatagccatactcttagaaacagaaagtagaatgggtagttaccaagggatagggatgaagaaagggagagttgtttagtggttatagagttttggttttgcaagataaggaagttctgtgtttcttttttacaacaatgtgcatgtagtcaacactattgtaatgtacactgaaaaatggttaaaatggtaaattttgttactcctcccatcccacttttttagacagggtctggctcctgtcacctaggctagagtgcagtggtgtgatcatagctcactgcaaccttgaactcctgggctcaagcagtactcctgcctaagcctccccaatagctaggactatggttatgtgccactaggctcagctaatttttttaggttttgtagagacagtcttgccatgttgcccaggctagtgttgaacttctggcctcaagcgatcctcctgtctcggcctctcaaagcactgggattacagggtgtgaaccactatgcctggcctatgtttttttttttaaccataattaaaaaaaaaaaaaaaagaaaccacctgtctgcattctgatattttacctgataggacaaatttgccttaggtaaacctttataaacaggcatgatcttttagaaactactcaaacgttttaaaaggaagagcaagagcaagtgtcagttatgacacttgaagagtcataactggttacctttgttacagtttaaaaaaggtagcactttctgtgtttcacagggtgaatgccttcatccattggaacctgaaccatgagtatttccttctgagactttcatcaaactaagtctgcatgaagcctgagtcctgtggtaactggaacctcataatagcatttacatttggtgttaaaatgcacccaacaggaaaaaggattcagttattttcaagcttccaaattccaaatgtgctgaatagacatttcctttaaaaaataaatatacaaaatggatttgtgtgacttgaagtttaaaagaaatgttcttgcatgccatagttaagaattgtaacaatatcacattctcaagtttacttattttaaaagtagactgtcatggtttggctcagctactaaattaaattattgctggcttgaacattcctgttggttacactgtaatctttacctcccttggaaaatatgtccgattttgagtgtttatttcagacttggcttgaaacacctctgtttagcagtgaagtatggatatatatgtgtgatctgtgttacgtatgtagaaaggaaagaaatagaaaaaagttttacattgtgtgttacaaatacacactaacaggaatacatatatacatacatatatgcaactagaaccatgcttatcaaggatcaagataatataactatactgaattaatagacatgcatacatacatacatgtgtatccattaacatgttattacaggttgaattgtgtctccctttcccccaaaatcagatgttgacattttcacctctgggagctcatttggagatagggcttttgcggcggtaatcaagttaaagcaagatcattaggttgggttctaatctaatatgactggtattcttattaacaaggggaactttggatacagagatatgcatagaaggaagacagtgtgaagagacacagagaaaagacagctatctacaagccaatgagagagacatggaactcatctttctctcatacccctcaaaaggaaccaaccctgtcaacaccttgcttttgtatttactgcttccagaaattgtgagacaataaatttatattgtttaagccacctagttggtggtacttcattacagcagcactagcaactaatacaaggtatttctctattatgctaagaattcaggatatactcatttagataggatacacgattagtctttacatgttttaacttttcatagtatctcctaagcactctaagaaactagtttccctaaaaataaagaaaaaaggaaaaaaagaaattagtttctcaagtttgcaaaattaagaaattagtttctcagttttgcaaattgagaaattaacgttgactgtgatgatgaagcagttagatttggaaagtggatcctactttacataaataataatcagactttttcttttattcaggagtctgtgagtttgtgtaatttgtagtgatagtatcagagtttaccagaggcctaatggattggaaagtcagaatcagaacaagcaaatctaccctcatccagcaccagaattaaaagttctcaaaattgcgcacatgggaattaaatttctccacattagaaacagatgccttcaaataactgatttttccattgccccaacgtgtaagtgcctttttattgtgctcattttgtcatcagtagaaggacgcttgagttcagtacttggaagagtggaagggtgcagtattccttgggccctgtccctttacgtttcatggtatgccagggatgtctgtgtttactacctccaaccaatgcaagaacatacctgaacaacccaaactcctgactggggctaattggagttagtgacagagaagaacactattttacagtgttgggtatttttgttgttgctctggaggttgggagggattagtctttgtcaggagataggatttagcagaatatatctatttatatcttgttttatctattacatctccatcctattgacttctttcctgaaccggaattaagcaatgaatgctgtttgggcatttttagtgtggctgttcattattacctggataattcagagtacttctaggtcatgacataaaaatgctgttatttgtattagcttacagatactgttggtctgtctccaatgttgttgtttttcaaattccaggagtaacaggatggaaggttgcagagctctaagtaataagtaaagtggcctgggatactgaacatagggagtggtggagattgaggcaaactagacagatagctatgccttgtttaaaggggctgcctgtgttgtattacatctggttgttgtcctgtgaaaatgcaggccagatgtggccaaatcttcctgtttttcaaaccaagtggtagaaatttgaatttttacaagcagtctcccaatttttattgtgacaactagttcagattacgaaaaatatttatgggccaagtaaaataccacctgttttcagcctctagtgtaggatatatgaagccagcttgttcttcaggtagcaggtggtgcttacaggtcatctctactgaggcatcgttggtgaagtcctctaagactcagctctgggatcctctgtagtgaatggctctcatagttgcaggaaaaacccaggtccaaatgacacccacagttgaccacagttttacctaattaagtaaaaaactttttttaaaaaaataatttattttgttatcctgttaccagtactttcaaatacttaagaaaaaaatcaatattaaagtatcagttttgcaatccagaggatatttgtactttttcaaaaaaatttaaaaattagaaaaaagataacatattggcctcctgccttttaaatatttaagggatgaatcagactttcagatgtgcttaaattggtacctagagacctaatggaggtttcttattttcttcactggtaagattttgtcattcattccagtagatacttttaagcaacctttttattttagagcagctttagagataaagttatgaatatagtacagcgagtccccctatacgccaaacccagtttccccttattattaccatcttatattaattaatgagccagtaatgatgcattgttatgaactacagtccatactttattcagatttccttagtgtttacctgctgttctttttctattctgggactctatccagaatatcacattgcattcattgtcatgtctcccttggctcctcttggctgtgacagtttctcagactcctcttgcttttgatgattttgacagttttgagaagtattccataaaacatcccttagttgggatctgtctgatgtttttttctcatgattatgtatttttggggaggaagtctaaagaggtaaagtaccattctcctcatattaagggtgtacactattgtgtcagcatcatgttttactgttgatgtgaatcttgatcacctggctgaggtggtagtcatcaggttcctccattgtaatggtattgaaggcactgcgtgcagcccatgtgtgagtaggagtcatgctgcacttctgtgagaggagagtatctacatcaactattcggaattcttctgcataagagattggtctcttctctgtgtatacatgcatgcatgtatgtatgtcagtatggatatttatttattttatactttggattataatctaatacttgtttatttcattgatcagactgttgtagctttggccatggaagctctttcagttggctactgtgtccctttgatatacccccactgttgcattgttgttgtttttgagtactttcttaatttctggcactacaagatgctcatgcacatcttgtatattccctgctccagtgctagaatcaatgattttttccaaggagccctggtttcttttattggagactgttactagaaaccaagatctgctatgctcattgctactgggatgtgttgcttctaggctctttcagctgacagagcaaggaaatatgttgtgtataataatctgtgtatgttcacatatttataaatatttgtatttgtgtctgtctatattaagccaaatatgtgtttatactgatgacttcaactcttaatctgttaccacatggctcattggagttttctctcattgcttctctgtaaactgtcattcaaacactgagagatctggctcccaagagccacgatccatttgcattgttcaactccagtatacagtataatagtgattttagaattcctaactaaataccctgtgagaaacagttttatccacagagcttatgcacagtgccttttgcctttagtcttacctactccacttatttgtaaggatgctcaggtcagcatctttcccattccatcactgagtgtattttatacatttgctagattctttcaccacagcctgcattccatcttggattctccaacctcccaaatgattttttacaatttgcatacattaaggttagctctgtattttgtgggttttgaaatttacaatgtcatgtatcccccattagaatatcaaagagaatactttcatatcctaaaaatccaatgtgctatatttattcaaccctcaccccttccgaaacccctggcaatgattgacctatttactgtcactgtagttttgcctttttcagaatgtcacacaaatgtcatatagtacataatcttttccttggctcaacatcatatttatgtatatgcatataagagttatctatgttgttgtgtttttggggaggggaggggacagggtcgtgctctgtcacataggcccttgtttttgttttagtttactttggggtgtgtgtgtgtcagggtttccctctgtcacccaggctggagtgcagtggtgcgatcatggctcactgcagcctcaacttcctgggctcaggtgatttttccacctcagcctcctgagtagctgggaccacacacctggccaacgtttatattttttgtggagacagggttttgccatgttgctcaggctggtctcaaactcctagactcaagcaatctgcccatcttggcctcccaaagtgctgggactacaggcatgagccacctccctcagccagtttttttttttctcctatgaatagtattctattatatggatgacaacagttcgtttatacactcacctgttgagattgtttccagctcttgaccagtataaataagacttctataaacattctcatgcaggtgtttatgttgacataaaatttcaaaggagcacaattgctatattatatgatagagactgtgtttagctttttaagacactgccaaactgtattccaaaatttggaatggtatacagcttttgcattcactccaacaatgaattgagagctcctgtttctctgcatcctagtcaacgtttggtattgtcagtttttaaaattttcgccattttaatagatgtctagtagtatctcatcattttaatttgtatttccctaatgagataatgatgttgagcatcttttcgtatgcttatttgtcatctatgtatcttctttggtgaggagtctgttcagattttttttttttggcccttttttttgttgttgttattgttgagtttcaagaattgtttgtttgtttgtttttttcttttttttttttgagatgaagtctcactctgttgtccaggctggagtgcaatggtgtgatctcggctcactgcaacctccgcttcctgagttcaagcgattctcctgtctcagcctcctgagtagctgggattacagatgtgcaccattgtgcccggctaatttttttgtatttttagtagagacgggtttttaccatgttgcccagactggtcttgaacacctttacctcaggtgatccacctgcctcggcctcccaaagtgctgggattacaagtgtgagccactgtgcccagcttagtttcaagaattctttgtatattttaattatttatttagtttggagacagggtcttgctctatcaccttgactggggtgcagtagcatgatcatggctcaaagcagcctcaaaatcctgggctcaagtaatcctccacctcagccttctgagtagctgggactacaggcagtgccaccatactctactaatattttattttcaaatatttttgtagagacggggttttgctatgttgaccaggctggtctcaaacttctgacctcaagcagtcctcccacctcagtctcctaaagtgctagggctacaggcatgagtctccctgccccgctgtatattttatatacaacttctttatcagacatgttttctaaatattttctccgaatctttggtttgtcatttcattctcttaatagtgtctttcacagagtagagtttgaattttattaagtccaatttatctatcttctttcataaataatgtttttttgtattgtatctaaaaactcatcactaaacccaaggtcatgtagattttctcctatgtgttcatctagaaattttactgttttgcattttatgtctaggtttatgattcattttgcattgtttgtaaaatataaggtccaagtccaggttcatttaatttttttcttggtgtatgaatatacaattattctagcatcatttgttgaaaagactatgcttttttcattgaatcgcctttctgtgtttttcataaatcagttgactacattgtatgggttgatttctggggtctgtgtcttgttccattgaccaatgcatctattctttctgccaattctacagtttggatggagtttgattttaattggtattaatttttatttggggtttgagaaagaggttctcattcaattttatgacagtgcttgtgtgtttgggtgtttttaagatattagacattttatctccttcatcttgtcatcagcttttaacattccacatcctgtttgtttttaagtgacattgagaatgcacgtctctgatcttccttcacatctcagtactagtaaatacaacctctttctgacatatgatatacttgtttcctttttatctgttcccctgatccttcactatttcataaaagttcataaaagcagggcttttaaaatttgttgttcactgctgtatcccctttacctaggacttgcctggcatctggtaagatctcaatgaagtaatgtgaactagattaatgaaatatgaggtctcacatttataacatctttgaacaagaggttattatacaaaggtgaatttgctaaatggctgaactttatacctttaagctgcaaaacttttattatttatttacttttaaattgacataaaaatttaatatgttcatggtatatacaacatgatgttttgatatatgtacatattgtggaatagctcaaatgagctaattaacatatccattaccttacatacttaatttttgtgtgtgtggtgaacacatttaaaatctgttttcttctcagtagttttcaagtatacagtacattgttattaactgtagtcacaatgtgtacagatctcttgaacttacttttcttgtctgtgtgaaattttgtatcctttgaccaacatcttcctaattccacacctctccttcccacccagcccctggtaaccatcattctactatttgtttctgtgagtttgacttttttagatttcgcatataagtgagatcatacataatttctctttctctgaccttaggacttttatgacttctgacctctaaaactgtaagacaataaatttgtgctgttttaagttgctaagtttgtattattttgttacagcagcattaggaaagtaatacagatgtttagtgcaaggaacaccatgcaagttaattttagaaattagtcttctgaaatgtttataaaatatataaagacaagttttttttggggggggatagactctcccttctttttttagctttttctttaatgaacatcaagcagattttaatgctcattttgtgtgctaacacttctttgtcattttcaagggtagctttttggaactttgtcaatagagtacaaaaatgtaaaaaaaaccagtctactgggtctggatgggaaagagttcactcttcatgtgttaagagtcttaacttcttggttacctacagtgtttgaggggaatggtgacttatagaactaaaaacattgaataacttatgttttactatacagatttatagttgcacaaatctgtagttgatattttcaaactgtaattacattttattcttatttctttttttattattttatttatttatttatttttgagatggagtcttgcactgtcacgcaggctggagtgcagtggtgtgatcttggctcactgcaagctccgcctcccgggttcatgccattctcctgcctcagcctcctgagtagctgggactacaggtgcccgccaccacacccagctaattttttgtatttttagaagagatggggtttcaccgtgttagccaggatggtctccatctcctgaccttgtgatccacccgcctcggcgtcccaaagttctgggattacaggttattcttatttcttaaacacaccgtagtgaacttttttgtttgtgctatgtcatatagtattttgaccagaaataaggaaattgagttaaagtcctgtttctgaaactatctagccaagtgatcttaggaaagttataatttctctaggtctcagttgaacactagattggtggtgagatatcttcagatctcaacagtctctaaaattctgattgatattgactgtattccttgtgacgttttttaaacagggctttcctcacaatgatattaaagtatgtagaacattccacgtaggcatgggctttcagacagatatataatattttagttattattttaaagaaatttttattcatctgcctttgttgctaagtgttcctgtgtttatatattttttcctactgaattgtagttttgttcttttgtctttccctttaaattgacccccatagggcttgttcatccctataatctgttaatagactctctcaataaatgtatgacagatgtagtggtggagagaagacagacctcccaaagatgtccatattcaaatccctggaacttgtgactgtgttaccatggcaaggggaattaggttgcagatggctttaaggttaccaatcagctgtccttaaagaggttagcctgggttatccaggtgggcctaatgcaatcacattggcagtaagtgaaagagggaggcaaaggagttagagtcagaggaattcaatgtgagagcaacttgattggaattgttggacttcaagatggaaggaagctgcaaggaatgtcggcagcctctagaagctccaaaagtcaaggagacagattatcctctagagtttccagtaggattgcagtccatcaacacctggattttaacccagtgaaatccattttggacttctgacctctgaaactgtaagacaataaatttgtgctgttttaagttgctaagtttgtattattttgttacagcagcattaggaaagtaatacagatgtttagtgcaaggaacaccatgcaagttaattttagaaattagtcttctgaaatgtttataaaatatataaagacaagtttttttttcgggggggctagactcccccttctttttttagctttttctttaatgaacatcaagcagattttaatgctcattttgtgtgctaacacttctttgtcattttcaagggtagctttttggaactttgtcaatagagtacaaaaatgtaaaaaaaaccagtctactgggtctggatgggaaagagttcactcttcatgtgttaagagtcttaacttcttggttacctacagtgtttgaggggaatggtgacttatagaactaaaaacattgaataacttatgtttcaatttatactatttggattctgtagaagaagaattttatttaaaataatgtttttgttatgtttattttaaatgatattgaaaatgaattacattttctcaaggtcatttaaaatgaactgattctttattgggtgataggtggaaggcaggaattgattgaattcatacctgttaatcccatattaaattcttaaggagttaggaagatctgtggtggttgtactaattctacagttaaggaaagctgagagtcagagaggacaatttaagtgatgagctctattagcttatctgttttattgtcgaaccctgagcagaacttagtctctgaactttaaatccggtcttcttttcctgtcttgtaagacaaaaatgggagaatttcaggcttttaaaattgaactttagtcaatgctgtagttatgtaatttttataaagagcctacaatatatagattctcttattaaacatgttagccattataaacgccttaggcaaacaggcattcttattttatggttcagtttctgaagttcctactcttttttgttgttcttcctgtgatgtaagtcaggagcagtggttttggaagaaagtataaagaaggtgcaaacatcagaaaaaaaatgcttgtgtgtttactagaacagcatttgtataataagaattactttgtgtttttgatccatgaaatatacacattcattatggctaaaaggaaggacctaatttaaacaatgtgatatcaatgttggtttaatatcctgatttttaaagtcttatatgacttacatttgatttttttttttttgcctctctagccttgttagaattacatttaattttggtataataaattctgttatatatacctccttttctattttatatattaatattttactattttattttcttgtaagcttaattctgtttgtttctcttttggctctgtgactgatcaagaacatattaaatgtataaagtctgagcttgttattttaaatttgtaatgtccaggttttgttataaataccttagtgtctttctttaaaaagaaaaagaacaagtaataagtaactcacatagtggggagagtaaaaccattttagctgaaatggtttagatctaggataattatttgggggaaaatacattttcgagattttttcatatttttgcttgaattacctttactttcagtgcaaacttctgaaatttgatgtaatgtactctttattcctgttgtaacaacctcatagatgtcaggtttttattttacagctgaagagaatagaggctgttggacattttttttttttttttttttttttttttaggtggctgaccctaggacgtaagcagcaatactaaatgttgcaacttgtggtcctatgtattgtaacctgttggaagtagagtaattagtagtactggtggaaatcttaaaaacatcaatataaataggcaaaatttcttttctgattatcaagatcaaaaaagggaagctaaggtctaggtgatgaggttctctatgtgaagtcagttaattttcaatgagcagatcagcgttcttatctcttctcacaataatgattagcagttctttgcaaaggaagtttcagtgagtgcttgaaaaatatgggtcactgaggtctgtcatgcgaaactaagtgttggcctggcatctctggaactcaaatgatggccaagcaggcttgacttcagtgaaacagggttttaatgattaaatggaaatggatgaagttggtgaacaaatatagtgacttcaaagcctttaacttggattactggagaatcaagtgaaatatttcaccactgtgttatcactaaagagaatcagttctgtgtgtggtattggttctttaaacattatgttctacactaaggacccgaactgtcattcccagttagatagtgtttgaatgggaagtaatgttgaattgtttattcttaaaatttttttttatttccttaattatggttatttagataatccatcaattatagaatgagaagcctatttgtaagattgtggaatttctagttttcgagtgttgggggatagttaatattatgacaaattattaacttagggtgattgcgaaagttatacctcctaggttgagtttaaaatgctagtctcttactgttgaatgtgaaaccttgaatatgtctaatttttattggcatggatgtatgcatacaaatagagaaaggtaaattctactcatttgcagcttctcagatattctgaaattgcattactagctctaaaataaacataataggtcaatttggtcttgcatcgaagcattttatgtaaggaaaatgtatattaaaagttattgaatttcttgatgggccataaatccccttagcatcaaagtttgcagcttggttaagagtatgaaggagaaaagaaacttgaccaagaaatgttacttagaaaatatttgtatggagttaaattaccataatttcaattcctcttatgccagattttgcccttaaaagtgaaaagcaatttgattgatagagcagttgatgcaggcaggcagaaacctttttttttaaaaatcactcttcagattgctcatgagtttgtttttttcttaacatcacttacaatattatcattatgtaaatatttgctgtggaatcaagtagtatacttggagtgattaagaagaaaacaatcttaaattactaagtatgcagttcaaaaggtaatggcctaggcatcaaagtccgaaagagtgtcagttttgtccttttgtctgtttcttctcagtcatatgaggcttccatttaaaaagaattctcatatgtttttcttgcattactattttttattctagtgtaacatctttttaagtggtttcttcatatgaggtgtgtggttagtagaattatggcccctaaaggatgtctacattctcattccaggaattcatgaatgttacctcgcgttgtaaaagggactttgcagatgtgattaaggatcttgagatgcaggattgtccttgatagttattttttctctgtctgaaggatttcctttaacatttcttatcctttaatattctcattttgcctttatttttgaaagatgttttcgttgagtaaataattctaggttgacggtgttttaaaattgcttttaagatgttctactcttttctggcttgcattgtttctgatgagaaattggccatcaacattgtctttgttgccttgtagataatgtgtattttttttctctagctgttttaaagattgtctttaacattggttttaagcaatttagtgatatatgacagcgtctttttttttttcatgtgttcagtggagttcattgagcttcttggatttatagctttattgttttcattagatttggaataattttaaccattatttattcaaatatcctttctgtttctccttcattgggaactccaattacacatatattcgactgcttgatgttgttccacagcttattgatgttctattcaattttttccagtattttaaaaatcaccatttaactttagataatttctgttgctatgactgtaaatccaatctcacatttttttctcacatagactaatgtgctattaatactttcagtgcttttttaccccaaagatgtagttttcatcttgagaagtttagttgggatcttttgaatatcttaacacttttcaaatttttctctagctttttaaatacacagtaacctttttttaatgttcttttctgttattctaacatgtaacaattctatgttggtttcagttaattgatttttcttctcatggcctgtattttcctgtttctttacatgtctagtaatttttgattagaggccagacattgtaatattaccctttttggtccagatattttcgtactcttgagcttgttaagggatacagttaaatcacttggaaagagtttgacccttttatgtctgtctttctgctttctcaggtaggaccagagcagcatttagttcagggctagttttacctcctactgaggcaaaagccttctaagttttctacctgatatcctgttaattataaggctttctactctgaccattgtgaacaggaggagctgttctaaaactatgtgagagttaggattatttcctataatcctttcagttggttctctagtagtttactcatatgcatgggttgatcggtactcagctgcacactcaaggagtaagcctgaacatctccagaattctttgtccttgcagctttcacctctttgctattctgccctgcaaactctaggcgtcttggtctctttggtttccaggcccagttcctctacttagagagacttctaggttccaccttgcttcatgcttttcgcgtcacaatctgtaagttctcctggcaataagctggttcaattgtatgattattttatttgtttccccccaggaatcggcatgctttgttgcttgttcggtgtaaaaccactcttaaatttatgttttccatttttgagttgttttcaaatgtgagggtaaatcaggtcccattttctctatcttggctggcagagtatgtctcttgcctatgagatcttaatcttaactctaagcaacattcttagtttcttagttcacaggtgctgctgtaacaaaaattccctagattgggcagtttataaacaacagaaaattatttctcacggttctggagcctgggaagtccaagatcaaggtgctaacagtataggtgtctaatgaggacctgttcctcatagatgatgccttctagctgcatcctcacataatggaaagggcaaggcatttacctgggttctcttttataaggtcactgatcacatttatgagggctctttccttacactttaatcacctcccaaagttccacctcctaatacaatcaccttgagagtatgtttcaaaaatgaattttgagatgatacaaatattcaaaccatacaaatattcaaaccatagcacttaggattgccttttgtggtacttgttgctgttgctaacttcatgatgtgttttaattaataaccacccccccaggacttttactttcataattgagccccgaaaaataatgtatttatatatatttaggagatttataatgacttatctgagagtctgtaaaatatagcagaaatctcagtgttcagtcacaatgctgagaaatactaaaattaaagttgtaaaggatttacagaactgaaaaatggtagcatgcttactcactttttgcatgctaaatttatttctaggcatttgtgttttttttttggtaagtagatattgtaaatgagattgctttcttgaattgtttttcagctctttcattattgctttatagaaatgctaccaaattttgtattttgattttgtgtcctacacctttattaaattcatttatcagttctaagaattggtggagactttaggtttttctgtatataagattatattgtctgcaaacagaaacagtttgattaccttgtttccagtttggatgctctttctgttccttaattgttctggctaagccttccagtactatgttgaatgtgagtggtaaaagtggatatccttttcttgttccaattcttagaggaaagcctttcacatttcccttgttcagtatggcgtcagctatggggttgtcatgtatggcctttattgtgttgaggtacattccttctatgtgtaatttgttgagaatttttatcatgaagggatgtcgaattttatcaaatgctttttctgtgtttatagaaataatcatttaggttttgttcattttgtgatatatcatgtttattgatttgcatgtattcctgggataaagcccacctgatcatgttgtgtaattttttgatgtgttgttggatttggtttgctagtgttttgttgaggatttttgcatctaggtttatcaggggttttggcttgcagtattctttttttttttgcagtgtctttgtctcgctttggtattagggtaatgctggcctcatagaatgagttaggaagaattacctcctcttcaattttttggagtgatttgagaagaataaatgtgagtttttttataagtttggtagaatttagcaggaaagtcatccattcttgagcttttctttgttaggagactttattactgactcaatctccttactcattattagtttgtttaagttttctatttcttcctggttcaatcttgataggttgtatgtgtcaagggatttattcatttcctctaggttttctagtttgttaacataaagttgttcataacaagcgctgatcttttgtatttctgtgttatcaattgtaatgtcttcctcttttatttctgattttgtttattcgggtattctctctttctcctggttagtctatctagtggtttattgattctgtttatctcttcaaacaactgtatttcgatttcattgatcttttgtatttttttagtctctattttgtttatttatgctgtgatctttaaatttgtttttcttttaccgactttggtagaaggaaagatttgcttttgctttttaaattccttgaggttgttcatttcaggtcttgccactgttttgatgtaggtgtttattgctgtaaactgttttcttagttcagcttttgctgtatcccatagattttggtatgttgtgtttgtattttagtttaataattttttttgttttcttcttaatttttcttcatcactctactggactctactggtgttcaggaacatattttcatttccatttatttgtacagtttccaaagttcttatttattcctagttttattctattgtgatatgatttcaatttttaaaaataggttgaggcttgtttttgggttattatctggtctatcctggagaattctccatgtgctcataagaatgtgtatacagtagctgttggatgaaatgttctgtaaatgtctgtcaggtccatttggtctgtgatgcaatttgagactgatttttgttgctgttgatttttctatctagatgacctgttcaatattgacagtagagtgttgaagtcctcaactattattgtattggggcctgtctctcccttttaatataataatatttagatctattaattcatgcttatgtatctgggttttccagtgctgggtgcatatatttacaataattatattttctggctgaattgatctctttatcattatataatgactttttttctctttttatagtttttgacttaaaaattcattttatctaatataaatatagctactcccatttagttttggtttctctttgtgtagaatattcttgttcatcccttcatgttcagtctgtgtgttctttataggtgaaatgagtttcttatatgcatataactgggtcttgtttctttttttaaaaaaatctattcagcaactctatatcttttattggagaattgaaaccaaccatttatattcaggattactattgataggtgagagcacactcctgttattttgttgttttctggttgttttgtgtatcatttgttcttttcttcctctcttattgtttatctttggtggttttctgtagtgatagggtttgattcctttctcatccttgtgtatctgctctgtcagttaattttatactttcatatgctttcatgatgttaaattttgtccttttacttccagatataagactcccataagcctttcttataaggttgctctagtggtaatggatttcttcagtttttacttgtctagaaaagactttatttcttcatttctgaagaatatttttgctgggtacagtattctttgctggcagttttctttcagcattttgaatatataataccattttctttttgctggtagcatttctgctgataaatttgctgttagtatgatggggagtccctttttacttcatgcttttctcttgctgttttgaaaattctctctttgtttttgacttttgacagttttcagtaatgtgccttggagagaacttttttgaattaaatttacttaaggatttttgagctatcgtatcttttccatgacttgggatattttcagctagtatttcattaaatatattttcaatacctttttccatctctttgttgaattcctataatgcgaaaatatgttcacttatttgtgttccattgtcttattggctttctccattcatttttattgttttttctttttattttgtttgacttgactatttcaaaagacccatttttatctttagaaattcttcctagaaaaatcagtctcttctgcttgatctagtctattgttgaagctcttaattttgttttcttatttcattcattgaattctttacctcaatatttctgttttgttcttttttatatctatttgtgttgaatttctcatttagatcatgaattgtttttgttttcattgaattctcagtctgtattctcttgtatcttgctgagttttcttaggatcatcattttgaattccttttcaggcactttataaatttccttttttggtgtcagttactggagaatagttttcctttggaggtgtcatattccttgcttttcacttctcttgtggtcttacattgatatctgtgctcactgcttctgattttatgtagtttttgtaaggataattttttttttctgtttatgtgtcttgtagtgctggtttggtagagtgttttcattttagttctggattggaacagtattgtcttcttgtgctttctttggcgtattcagtgtcagctgtgtctgcaagtgcctcagtggcctgggctgtgggtgtttctgtaggcagtggcacagcttttttggtgtggggcctgccaggcaggctgactctcaggtccttgggagcgtataggggctcccttggtcttgagggtagtctcctctctatgctgggccactgcttcttggtatacaggttgctgtatgggcttgcatgcctgagtcattgccgtaccactgggttcagggtggcatcattgtgctgcagccttctctgtaggcatggtgagatagtggaggggtcacagggatatggaattgcagggatattaggccccagggaaagatgcactctggtagtagctcatctctcaatatggctctgtgccgcagcagcctgggtcctgggggttgcgggggagacccagcatgagttttctctggggagcagtgcagccatgttaactttaggcagctccctgtaccctgactaaagtgtactccgcttagtcctctgtgaggactgtggggctttcctatagcaagcattgcaggcatccatggtggcaacggaggctacctcttaccttttctccacaatggagagttcctcttggttcaagccaatccttgctggatgctttacttccttctctgtgatactatcctgagtttttgtgtccagaggctttttgccacttccttgctaacttgcagtgttctctcttagacattctactcaaagtgcagttatctctttgttgttttggttctttgtggaagaggctagcactggacacctccactcagccattgatgatgacatgttctttgcttttgactacatgtactttgaaaatcagagacaaaggggtgttttaaagttttcctttcatgtctcttagcaacagcaaataaattttctttggattgcaattttataagtgataaaaatgtttagcaatatgatggggtgattgaaatttcttgataaaagttgccagtttttctaatgtttgccgtgaaaagtagattgcatatttgagtactcaaacacatatatttaattgctgatagtatcctatgccacattttattttgtacggctctttcttttgtctttcaagtagaaaaataaaagtcttgtgatattttgtgataaatatgtgaccaaagttgaaggagagtgaaagctgaacactatattttaagctaatcttaatttaaaatattttttgttttaactttatatttttgttataaatttacatacaacatagtaattttgagtattgttttggtcactcttctttttccttttctttttcttgactgtttaaaaaattaaatggttttgaaggaaagtcacagaatgctttgctctcatttattgtttattttccatggctataaatcaagtccataaatgagaaaatggttttggctttttcagtgaggcttgaagtgcttgctgatcatggtgtctgaaccagtggggctgtccttggctttacaggtggcaggcagttaatattgatcatctcaaatatcagcagtatatctggcattttatggatgaagaacctattttatggatgaagaacctaatattcagtgagatcactgtaagctgctccttgtcactcagtgagcaagaggttgattttttgaacttcatgacaactatgacattatgctgttttctaccttttccccttggacatgggtagagacaactattacctgttcaattgccccttgttcattgttatggaggtcagtgtaccatcatccagaggaatcactggcctttcaattacagtcccaaactagtctgttgggatgtcccacagctttataaaaagaggctatgaaacccatttgatatgaatttggtaaatatggttataaatggttctggctatttatttgagaaaaatctacaaaatgggacacttttaggaataatcccttttttatttattttggcaataagttaaaaatatgaaataatatacttttaggcataattttgtccttttcattttatataatattggtattaaagaggaataggaaagaaggaattactcaagaatatgacgtccctttttttaaaattatttgatttacctatttacattttttgcttcaacttacctagccatcagagaaacttttattgtaagccaaatcttccaacacttcacactcactgattcatctcctgggtatcgtgaatattctgaccatttatatcagtgaaaaaatttgtatgtttgcaaattgatagagatgcatttcatatttaggattttattagcttttatgcttcatctatgctatttaagcaggtaggcacatgtgaaaaactgatatcaattagccattacataattattttgcatctgttatgtccatgtgcctaggaacacagtgtgaataagccaggcctagaccctcatctctaaagacttgcagtcaaggaattgcaggagcttttggaatgttgaacagatgctgagcagagcctcttttcatcctgtcctcagaggagctggtcagtcaaatctgccaaaattctctgcctctgtgtagcctattccttgggggtttaggaaagagggcaataatcctctgagtcagagagcagaccatctctcatccttcacagcagctggatgctactgtctccccttgcccccccgatgtatgccctgggcggacagtactaaatataatggaaaaccaaaatacttaactggaaacctttatcatattaattagatctctctttgcttcaggctgtaaaactgattagtgttctcaaagtccctgagaagactttgctatcttctttgactgatctatgaaggaaggggtagaagactggttgcagggtaaggctggcccagtctagggaaaatcttttttgttttttttgaaaggtcaatatattttttaaaaatcctttatttccataggtttttggggaacaggtggtgtttggttacatgcataagttctttagtggtgatttctgaaatgttggtacaccttacccaagcactgcacactgtacccaatttctagtcttttatccctcagccccatcccaccttttcccctgagtccctatagtccattgtatcattcttatgcctttgcatcctcatacgatgtttggttttccattcctgagttacttcacttagaataatgatttccaattttatccaggttgctgcaaatgccattttttcattcctttttatggctgaatactaattcaatgatgtgtgtgtgtgtgtatatatacatatacacacgtgtgtatatgtgtgtatacacatgtacacacttgcatatgtgtatatctatacatgtacacacgtgcatatacatacgtgcatatgtatatatgtatagatacaaacatgtacacacacaccacatggtgtgtatatatatattcaattatatatatacatacacatatatatatacacacacatatatgtacaccacgatttctttatccagtcattgattgatgggcatttaggctagtttcatatttttgcaattgtgaattttgctactataaacatgcatgtgcaagtatcctttttgtataatgacttctttttcctctgggtacatacccaatagtaggatcgctggatcaaatggtagttctacttttaggtctttaaggaaaccacactgttttccacagtggttgtgctagtttaaattcccatcagcagtgtaaaagtgttctcttttcaccgtatccccatcatcatctattattttttgatttttttgactatggccatttttgcaggagtaaggttgtatcgcatcatggttttgatttgcatttccctgatcatcagcaatgttgagcattttttcatatgtttgtaccccttatcttctgatgtgtttgtgagaaaggcccttacttggaatgtgtgtgcattcttctgttattcacgatttcagcaagcttgcttacctggtgtttaagtccacagctaaccagaagtgacacagtagaggcttggagaagggatatttaggccacttactctctgacattataagtatacagcacagttgaaacctgatgggagaataataaaaaggtgtaaaaacctgaaaactgattgtactctggtaataggaggtagagaggcagcggcagctgtgcaactctttggaggcctgcagaatcataattcacgtgcatagtggtgggttaggccatgtctcttgtgccttaggaaaggtggggaaaaagtgttttaaaatgtcacagaaagctttctatgcttaatggtttacttacattttgttgttgttttgcttaagggtataaactttagttttttatggtggactattcccagacctgaggttttagtgtacatgtcattaatcagcctctcccataagctctcaaaaattatttggatgattttttctccctttaggaaagttatgaagagaaagaaaagacagtgatttgtcatcttttaggggagatatatatatatgtgtgtgtcttttaggggatatatatatgtcttttaggggatatgtatatgtgttctaggagataaatacatgtatgtcttttggggtgtatgtatatgtatcttttagggtatatatatatatctcttttaggggatatatatatcccctaaaattatatataaaatatataatttcccatcccccaattggcttatttgactttaatgtttcagcatacttttttgagcctctgctgaatgctgtgcctgtaattgcatagctaagaccttagacagccactgtcagtttaaagtcaatacttaaatacttatagttaatagattacttataatatagcatttataaagttcctgctatctagagactccctgatcaattgtgcttggaagtgtgaatacccagggaaggcagtgacgtcatctgattctcaagtaagtgtcttaagggacttacttacctagggacctgtaagtgcagaggcttcaatgttggaaagggcatggtatatttggagaagactgggaggtttatgtgatcaaaatgctcaggggacaatggggagggaatcagaaagaaaaaacagttaaaatcttctctcctggagtgatcattttgcagtcagtggcattctactcccaacaactttctggctatctgagtttaggtagtttaccttgatttcctcatctgtacagtcagtggtgctaacagtgagactccagtctctaggagagcttttctaaggactagatgaggagatacagaggtcttgagcacactgcctgaaattaagtgctctctacaggttattctctcctttttctcgttctgctcaggacccctggtgacatccttgttactttcatcctgactgacagatgccaagtagagccctaggatttgatacgaaagggctggcttgggaatgcctttaagtaagcaacatttggtttgctccttcagagagttctccttgagatcaccacactctaaacctgggtcacatttgttccaaggccttctaaagctaattctgtattatatagcacttattttaatgttccagtgggttatctgttcacctcaaagattaaactgagaactccttctggcaagaatgaaaggaaaggaagaggggttgttggccagcaaaaacagaatagaagagaaactagtgcccagaacgcccacatcagcacaccacatccactccaaggaggcttttcaaccccaaacatccagccagggtttttaggtaaggattggtctttgtgttcagtgtttgtcttggacatcttcacattttttcctactcctgtgctccactcccttctcccccttgccttccctcaactcagtgggttattggaagaaagaaggcaagaatcacatctgaacaccttttgtaagaacgacatgatattaccaaggcctctttaaggaaggggaatttggcctcaaagccaactggcctcttggcttgccatggagtgggtttggaagcagctactgctcaggctttccctcctttaccttttgtgttcctaaggaaagatttttgtaaaaagacaaatgaagacattctacttcttggggttattcctaagaattttcagcttgggcccttttaatttttcccttctctaaataacaaaggtagggaaatgaacctggacaggtttgataaaagtacactagaaatgctgttcatgtatgtttaaaagttacattgaaagggagaaaacagcacttcaagttaagtaagttacatgtagaatgcagtctttacatctaataatattcatttggagatggtatgactcaatgttcgtctacagtttcctggaagttcttcaatctcaaacctctttaaattatacagtgttgcatttttcttcttgttgcagttcacctcatcacaaggaatatatgtacatgccacaatacttaaacatgcaattaaaatggaatgtctttttaaaaagtatactttaagttctgagatacatgtgcagaatgtgcaggtttgttacttaggtatacacatgacatggtggttcgctgcacccatcagcccatcatctacattaggtatttctcctaatgctatccctcccctaggctcccaccccctggcaggtcccagtgtgtgatgttcccctccctgtatccatgtgttcttgttgttcacctcccacttacgagtgagaacacgtggtgttcggttttctgttcctgtgttaggttgctgagaatgatcgtttccagcttcttctatgtccctgcaaaggacatgaacttatccttttatatggctgcatagtattccacggtgtatatgtgtcacattttcttcatccagtctgtcattggtggacatttgggttggttccaagtctttgctattgtgaatagtgttacagtaaacatatgtgtgcatgtgtctttatagtagaatgatttacaatcctttgaatatatacccagtaatggaattgctgggtcaaatggtatttctggttctagatccttgaggaattgccacactgtcttccacaatggttgaactaatttacactcccaacaacagtgtaaaaacatttctatttttccacattctctccatcatctgttgtttcctgacatcaggaatgttttgggggaaaatatttctgagagtatccctcagataaaacttcgggaactataagttgtcagttgcagtaagcagtacataagcaaacattactgcctagtgagagagcatgaaagtcaatgaatttatttgttctgatgaagagccttcgttgggaaatttatttaaagacaatagatgtagtatccagttctgatgtcagggttagagaaattatctttggctaaggttatctcctattttgccctgtaacattgaaatgcatgctgttatgtgatgccagcatgtgcttttcctggcttgctgccctcttaggtttggccctggcagattgaaaggttctccaagttggccaacccttgtgatgaactctttgagcatgataggctggaggcggtggcaggagcagccaagatgactggattctggtgttgaaagagggtgaagtgaaactattcataacagatgcagagttacttacttcaattgatcccatctttgtaggcttcttttcagctttagaactgcttcttactttggctttgtatgtttatctttcccttaactttctagtcataatatatttgagtcagcagagcttgcaatttgtgcctaatttgcacaaatacagtttggaaacttaaaggtcagggaagttatgtgcaaataggaaatttaacttaaaccagaactgtgtatttccgagacctgaacccgtataacctggaatcactaagccaactgctaatttagcattgacacagcctaaacagaaacaaatgggtagcaagtgtagtttagggtgaatgttttgaaatcatttctgtttggggtttgtaaaaataaaatgctgctgatcttgttttgctctttttgggtagaaatgtttgcttgattctggtcatttttagtacccagcaaaggtatccacttcaccagttgctcatttctttaccattgctgtgtatccagtgcattctagacttggttgcagctctagatcaaacaatttgatttgagaatctggcttcccagttttcttatttttgtttcatagaccgcaagattttagaaaggcatgctgaccagttctgaatggtgtcctaagaattcagggacttgcataattttattggaagaaaactttgttttccctgggcctatccaaataccaagctcatggaagaggcttaaatactttttcgttgcagttagataatcaggttttatatttttatttatataatttttatttccaacttttattgtaagttcagggatacatgtgcaggatgcacaggtttgttacataggtaaacatgtgccatggtggtttgctgcccacattgtcccatcacccaggtattaatcccagcatccactacttattcttcttgattttctccctcctcccacccccgccctccgacaggccctgatgtgtgttgttccacccatatgtccatgtgttctcatcatttagcttccacttgtaagtgagaacatgtggtagttggttttctgttcctgtgttagtttgctaaggataatggccttgagttccatccatgtccttgcaaaagacatgatctcattcctttttatggctgcatagtatttcatcatgtatatgtgccaccttttctttattcagtttatcattgacgggcatttaggttgattccatgtctttgctattgtgaaaaatggcgcagtgaacatatgtgtgcatgtgtttttataacagaacgatttatattcctttgggtataaagaaatgggattattgtgtcgaatggtatttctgcctctaggtctttgaggaatcaccacattatcttccacaatggttgaactaatttgtactaccaccaacagtgtaaaagtgttcctttttctccacaatctcgcaagcatcttgttgctttttgactttttaataatagctgttttgactagtgtgagatgatatctcatcgtagttttgatttgcatttctctaatgatcagtgatgttgagctgtttttcatgtttgttggccgcatgtatgtcttaagaagtgtctgttcatgtcctttgcccacttttaagtgggatttttttttctcgtaaatttgtctaagttccttatagatgctggatattagatctttgtcagatgaatggattgcaaaaattttctcccactttgtaggttgtatgtttactctgttgatagtttcttttgctgtgcagaagctctttagtttaattagatcccatttgtcaatttttgcttttgttgtgacacgtcttcatcattaaatatttgcccctttctatgtcctgaatggtattgccttaattaaagacttgtttaatcgaactgatatggacaagcagtacactatttttatagatgatcttgttggaagccagatttaaggagattgcctggagactaaaaatacattattttcatggggatttcatttttaatctagtgtgaaaatagtgttgatatgagcaaactttattcagtgttgtaattcctcaaataaaatatgcatgaaattgaaaagcacaaaagtcttcaatgtttatctctgtcatctatatctatgtctacctgtagatatatagcacatatctatatgtgaatatatagagaacaatgctagaatgataaaatagcaacagggattatatctgggagatgggaaatgtgagaacaccagatagccagaggtaaacaatactacgcctttgatccctcaacatggaatgaaatgtggtgagcattttccattgtcattaggtagtcttcgatggcatggttttctgttattatttattctgttatgttgttatgttattatgttgttatgtgatattctgtcatataggtattttgtttatcttggtgcttaagaaagccaaagtagataattcatatttgactttggatcctgtgttttctaagtttttacctcaaacaaaatgatgacacaacaccttgatgtggcctgaattttggaagctgcatgttcttcctgcttggctctctcccattctgcctctactttctcttccctctctgctttctccagttgtaaataggactatcttagtggttatgcactgccaacttttgtagcattgggttcagtttatagcatgtgtaagtggtcaatgaatgtttcttcctctaaatacttttcttacaagaagaggtagttagattttcatccaacacaaactccaatctggcttttgtcattactgaagatactgattttgcaaggcagaattcctgaagcttttgagccctttctaggcagttctttgcggttagatgacagtgctggataagaaggaataggtatttctcaggcccagatggtctgaaagaggttttgctaatgctcctaaaccaatttgatggattataattctttgtttcttttgggtaagcatgaagagtgtaatagatggcaaggtaagggctgtagggtttctcttcaaagactttattaggcggtgtgtaataaccaaagcaaatctcgcaatgaattctgcctcacatgcaaacccttattaatgagcagggcccagttgtatgactgttctctaatgtcagtgaggtgcctgctgtctgtccttagggtactctaacagatctgtgcatgagatgtttatttgaagcagaaagggaagttgttcaagcagcgtgattgacttctgattattcttcagcatcaaagtcctaagcttaagggtactaatcctaaggggttgaggcattggacatttttggtttgtagaccctgtttagttaaaggcaggagtaccctatagtatttctgaccactctacatctggcaaaattcacatttacccatgagaaataatttttagcatccattttgctaactaacaaagcctccgttgtttatgacaaataaaatttggagtccgctgactctggagtgtgagcctccctaggaaggctttcacatactcatgaagtacctctggggtatgttctcagctggaataacccaccactcctgggaggagggtcagaaccatcctacaggcatttgttacatgcactgtgctgaagtgttttaaagataattacagacagcacaacagaaggatgttttgtgattcttctgtgtgagaatcagattgggagatggatttggacacaaaaatgttgaaatataaggaacatttttgtggttgatgggaaaaattggaaacacatttgatgttaagactgtcctggaaaacccaggacacgtggctaccagagaacaggctctttcagtttgcttttttctgggaagtgagataaaaataccaaatgcagtgtgataaacttttccttcccataaaatatacatgtattgatatgttaaagtactatgtgttcacaaatacaagcttaattttatacatatgcataagtattaaagtgtatacagctctttcaccttcaggaacagttttcaagcattttgatttcaagccccttttacattttaaaaattgttgaggatcccaaaagagattttatatgtttggtttatagctattgatgttgactatattttcagttaaattgagacaattttaatagatttattaatatttttaaaaataacataaaacttactgcatgttaataaaaaattgtttcacgaaaaattccctattttctaagacaaaaaattcagtgagatgaatgatattgttttacgtttctgcaaacttcttgtgtgtctggtgtacaagaagacagctgcattctcatttcttcttctgcattcaatctgtccctctcactcttcaggtagcctctgaaaaactctgtgtacatttgtgtgaaaacgagtgagcaaaaaatgactcagtataattttagaaattattttgacccctcaaaccttttttttttttaattttactttaaattctgggatacatgtgcagaacgtgcaggtttgttacttaggtatacatgtgccatggtggtttgctgcacctatcaactcatcatctaggttttaagccccacgtgcattaggtatttgtcctaatgctcttccctcctgttgtcccccactccccaacaggccccggtgtatgatgtccccctctctgtgtccatgggttctcattgttcaactcccacttatgagtgagaacatgaccttgcaaaccttttaaagagtatcaaagatccccgggtccctggatgacactccgcacactgctccgtggtttcagtgttctaccacccattgtgttatttggtcctaattgccagccctgagaagtcattactatctccattttatagtcgaggcaaactgggattccagaaggcttgcctttgagtattatgaaagttccactagtactgatgcagccagtttttatttttattttatttagtgtttaaaggttacagtcttattgccttggagatttatgaagtagtttttttttggttgttgttgttggtttttttttgttaagaaatagggtctcgctatgttgggtaggctctccttggactcctggacttaacgcgattttcctgcttcagcctcctaggcagctgagtctgtaagtgtgtgccactgctccaggctgcaaccagtttttaaatgagagtcttctgatggctttgtttctgtgattgttccttttcaatgtattaccataaattgtatttaccttctacttagaattcagggagagggaagcttttatcttttatttatgcaagttcacaatagaagtttgcagagcgttatagctttggatgatttttcagacattttcatatcaggttttaatctgtaatattttaatatttgagcatttatgctaagaataagtgataatattttacaattttttggtgtgtgctttaaataggttatttgaggacagttgttttattttctcactttatgtggattaaatgtcacatctttgaagagccgagtggatttggcagagtgtcacctagcccctaattaactgtgtttacacagtccacaaacttgtgccctccatggaggtcaaagcaaatttgccttccaaacctttcaggaacaactctgttatatagaatctgagttttaaaatttcaaaattccagtggaatgatactttttgtatggcgtactgatcctgtaatagttaatacaagtgaatagtgagaaaaatgataattactagaaaagcagcagacatacaaaataaaagcctggatttttatttcattccacatgcatacaactaccttttcaagttactacaagaatttctaaatactctttaatttctgtatcattctgtattatctgcttgctctctgggaacacacggttcatgtacaagcaaggatcgcactttgaatagcactgatgcccattattgccactgtgcattcctgcataattcaaatctggaattttagctgtcttacttcgtgcctcccatcctcaacttcagtttaaactagagaattatttgttcttctctgcctcccctcccaaaatacttaaatggtgttatacattgttacaaaagtgagggagatatgtatatacaaaatatactgtttaaaaggatcaatactgttacaaaaaaaccgcactcaaatgtaagttcagatgacattgttctgaatcttattttcctcacttaataaggtatcacttctggctcacttgcttgagggggacaaaataatgagagagaaagaaagttatcccagatgtcttgagttaagggaaaggatgagtgattgcttatttttttctttatgggattcttacatagttgttttaacgaagacttgtggatgaggggaggaacagagcaatagctggtcagaagtgggagcagctgagaaaatgagggaaaacagaaacaaactgtcgggccagaggcagagggggctctcagagacagagaaagcaactttgatcagatgaggttggtttccacaatgtccagctatctgctggacctgtgatcctcacagtcagtgctgggtttccctgagcacttaccattcagtgggtgcctaccatgtgctagacaggggaggttccttttcacacacctgcacttaaccctcacaacagacccaagaagtggaatgagagaacaatgaggctcacaggggtaaagtatttgtttaagggcaccaactagtaagtaatgagactgggatgggaaccaacatcattctgatgccaaagcctcttgctttttccagatttgctacaaatttaaaagatagggagtcgagactgaggagggcccatgaaggagcagtaatatgcctggtacattagcccctgtagcttcctaacaattcctacagtacttctccagataaagaatatggaagacagtgaagtatctgtttccagaaacatttttgaggaagtcagagagaggccaaaagggacttaagtttcttcagagaggaagttgagaaactcaagtatagcaaaccactaatgccagatgttatttatccaaaggtttttggctatattgcaatactttctggatctctgctagttctctgcaatctttctgaagctgctttgagttttgaaaatatacatacctgaatttgaaaccatggtcatttaatctaaaatatgtccttaaaatcctaaactctttgtaataacaatggtggaagcacaagaggaatcattctcaatgactatttgaaatattattttattctaagtcaaagaagtatttctgatttggtaactgtttcagctagagcaagctgtgtttttgctttaaaaattgcatttagccctctctatgtgcaaatagagtttctttcttaaatttttaattattattcctcaatggaaggctgaaaggagatttcattgtattatagccctcattgacttttctctctaaatgatgacaaaagcttttaaatttagttataaggcaaaaaatacttatggacctgtaaagtgtgtgaagaggtgggtgggggtaaagacaattaacattttcccttatgaaaagggctgatttgtgatataatttctctatttatccttcatttcctgtgtgtcattttcagcaacatttcaactttaatatcttgacttttgatcattttttcctcttcacttgagagtatttccgagttgttattttttgttcctgagactttagtcaaagaatctcttctacttgttctttttatttttctaccagtatactgtgtgatctacctttgtcttttccaacgtcgggcccacattgtatttcaatacatcaccctaattgatagaaaacttgcggggatgtattgttccggctaatccatttttcctcttaataaagaatcatgaagaaactttattttcttttttgactctgactgttgaaaatgttcctaaaacaataacccacattcctgccttagtaagcacagtggatatgattgactcctgatggccgaaaaccttgtagtgtttgagagcaactcctgcagatatcacttcttcccaaatgtatggtaaattgaaatttgaaagaggtggaggtaaacagcttctggcataattgcgagagaggcacaggatctcgttaccctatcccctcgcccctcatcagagagaaacaccataacccctataagagccatgccccctctcccacctgtgtgtgcaggagttcaacctcccttcacttggaagtgtgcagaattctcttcctttgctgctactccttgaaagctagccctctgtgccctcacctctcgtacacataaagggggaaggcataccttggcagtgccttttaagatagtgaatggccaggaagtggctatatgaaacaaatcctcatgatatctagatttcttatgagttgatttctcatgaaagttctggttcataatgtttcagacttgtgccctgttgagaattgatgaggaatctaaaggcccccttcatatataataccactggtggtcagccccactgaagccccactgggacctaaggccatgtccctgttgagctcacagctgcaacgctgtcaccttgggtcagttgtgcctctggcttccttgcgacattccttagaactggcttgaaactgaagctcagtgggtgtccacaagggcaatagtccgctccttgctggagagaagacactttaactttatttttgggttatgctgcttacgtaagtaaaattaaatataagtaattattttttcctgctggtgctgacgtgtcacacccacagtaaaactagaattgtcttcaccaaaggaatggcttgtgtgcgtgcaggcattattcatggtgaacaccacagcgttaacaatccacgtgtcaccatgatcagatcccggagccacgcctactggggcatcggtttttcctagcctcactagctctgattttacaatccatcccctggcagagaaatttggggctctccctggatgtcagcaaatcactgctggcttgtaactaccaggtgggaagtgttcatccctaattgttcctaatttttgaagtaatgggagttttcttttttctctcctactgctgagcctgtgaagtacttcccctactcagttggctgagttaatctgctctcagagaggatgcaggctaatttagcataaagggagtatgattagaaaggtaagtttacagggcaaagaaagcactggaagtcttccaaagtagaaaagaacagcttttttggattattcattttttccataatagaatatatactctagcttactctcagtcactccagtttagtttcatggctatgtgagaaataattatattacattttgccctaaattttttttttttattgtgtttaagaacacttaacaagaaagctgtcctcttagcaatttttttttttttttccagacagaatcttgcctgtcatccaggctggaatgcagtggtgtgatctcagctcactgcaaccttcacctcctggcttcaagtgattctcctgcctcagcttcccagtagctgggattacaggcacccaccatcacacccggctaatttttgtatttttagtagagacagggtttcaccatgttggctaggttggtctcgaactcctgtcctcaagtgatctgcccgcctctgcctcccacattgctgggattacaggtgtgagccactttgcctggcctctcttagcaaattttaagtacaggttgagcatcccaaatcccaaaatcccaaatttgaagttctctaaaattcaaaactttctgattgctgacatgatgctcaaaggaaatgttcattggagcatttcagatttcaaatttttggacttgggatgcttaactggtaagtaaataatgcagatattccaaaaatctgaaaaaatccaaaatctgaaacacttctggtctcaagcattttggataagggatattcaacctgtatataatacattattgttgactattggcacagtgttctacagatctctagagcttattagaagctcttaacttaaacttcatgcttgttgattaataacttccatttccctggatattatgctatggagtttttggctctacctgctaccagctttcccttcccaatatcaagcaatatttttattaaatttgaaaacctcagttaccaatggactgcaaacaaactcagtgtatgaaggagctagtggtttttaaagctcaaaccatatcagaggaatttcatgtttagtaaattttaaagtctccttaggatgtcttaatgatgggagtaaaaacagaaaaaattatgtgacaacctttgtattttatttagaaaaggttttaatcagggaagaggggttggtattcaggttttgaagttatttgtgtgtgaaaacttactagatatgtctaagaattttattttccttttaaaaattaaatgatgactttatttcttggtgtttcagttttccatacttataaagcaaaggaaataataagaatctctttgtagctctgcttttataaggataacataaagtctcagataattgtgcctactactcctgaaggaattatatgttgaggcctctttttaaaagtgttaactattttgaatagtagtgctttgctaaattttggtacttaaaacagagccacaaaaattaagtggtaatagtaatatttatatttaaaatatgtcagtttatgatgatattaagttattcagtggtcagtttattcatctatatacatgcttaatattatttttaaatgttgtagtgtttttgatccataggattttgacttttcacatgcctctgttttatgatccttgaaaagaaaagaaaaaatcaaggcacaacaaacttaaaaagcaggaattttgttctatattggtggagaggagcaaatagactgatgtgagatgttagaaatatttaggtgttgacatcaattgatagatgttggttatttatcatactgtagtcttagttaacaacattaacgatccacgtgtctgtggtcagatcctggagcctcgcctgctggggatcggtttttcctagacgcaatcatactgtattataaataagagggagaaaagtgctaaggggaccccctccctccaatttgggaagattgagaaaagcacatctgtttgttttcaatggatgaaatatgcacatggcaaatttcagaagattaaaaaaaatacttaaaagtatattagtatttttttctccattcctttaatcatcaaattcctctctatctctcctcccccatgttacgataacggattttttcaggttattttgtcctctctcccaccaccccaaggtcatctgtgcatatacatgcatatgtatgtgtaacctgttttgtttttaaagcaaaattgtagcattctctgcactctttccctagctccttagctttcaatttttgaagattgctccttcttagtactcatcctttccaatatccagctggatgtactaatattatttggctagtattctcttagtggacatttctgttggttttagtggatgttaggttatgtgtatattgaatttcaaatgatattacagaattgctctctgtaaactctccactttatatttacagcaataatgagtcatattgcctagttttctacattcttactaacatgatgtggtctttttgacctttgttaatctaataaatgaaaaattgtattttaatgtagtttaagtatttcctttgagggaggctgagcataaatgaatacctttaactatcagggtattagacttgatcaccaaccactcaggtccttttctttccagtttatattctctgtattgatggtgttataaattcttattagcttcagttactatccacttagatgtctcaaggccacttgtatttcctattgttgctgtaataaattaccacaaccttagtggcttaaaccaatacaaggtgattatcttagaattatagaggtcagaagtccaaaacagatctcactgggctaaaattagaaagttgacagagctgcgttccttctagaagccctgggggaggttcatttccttgtctttctccagcttttggaggccacctgcatcccttggcttgtggctccttcctccatttttaaagccagcagcaaagcacctgattcttctgcctttctcttccatctttttaagaactcttgtgattgcattgagcctactcagagaacgcaggataatcttatttttaggccagctgcttagcaatcttacttccatctgcaacctttattctccctcaacatgtaacctaacatattcatagactccagggattatgatggaggggccgttattctgcctaccacatggcttaaactccacatatccaacacagaattccatcaccccaccctaaacttagtcttcctctagtgttctgtgtcttaataaatggttcctctatcagttgaagaaatagatgtctccgagttgttattgttgattctatctttgtcttcctcgctttctagatataatctatcatgaacttttatggattctgctgccaaggtagatttcttaaaatttttttttatttcaataggtttttggggaaccttggtgacatttggttatatggataaattcttcagtggtgatttctgagatcttggtgtacccatcacccaagcagtgtgcagtcttttatccctcatccccctcccacccttcccctcgagtccccaaagtccattataacattcttgtgcctttgcgtcctcatagcttagctcccacttataagtgagaacataacgatgtttgtttttttccattcttgagttactttacttagaactgtggtctctaattccatctaggttgctgctaatgccattctttcttccttttttatggctgagtagtattctctctctctgtgtgtgtgtgtgtgtgtgtgtgtgtgtgtgtgtgtgtgtgtacatacacacacataccacattttctttatccactcattgattgatgggcatttgagctgattccatatttttgtagttgcaaattgtgctgttataaacatgtgtgtgaaaggtctttttcgtattatataatgacttcttttcctctgggtagatgcccagtagtgggattgctggatcaaattgtagatctacttttagatcttaaggaatctccacactgttttctacagtggtagtactagtttatactcccaccaacaggatggccttaagtcatcctcctgccttggcctcccaaagctctggaattataggcatgagccactgcacctggccactttttcttcatagctattgttatggtttgtaattgtaactgttttgttgagtagttaagtatctctactctgaatgtaaacatgaaacacacacacacacacacacacacacacacacacacacacacacagtttttcagtattttttctcacctgcgctatgttgacattcccatttctgtgaggtagaatgtagcatatttcttaatgatatctcaaccagattttatagctttcctttatcgtttcagcatttaagactcaatcctctttattttacaccttctgtcttcaaattggggaagggaagaaatgacctctcccatgaattctgttgtcctccaaaggtaaccataccctgtgttctgagccccctttttggactgactgaggtttgggtgaaatgatggttggtggaattagggccggttctggtgcctcctactaaactctgggaggaggtgacttcggcaatatctggtgcgctcctctgactgctctgtgaatgtatattgtgatgtgcttaggtctgggcctttgctataatttcaggatatgaggatcatggctgggatgctattacataatttgtttttgtgattgtcagagaattttccttttcctcattacacagaaaggttcgtgagtacaataatgtatatctatcttttcccttcatttgtttctcagtggagtgtgactagctgttccagtttgtccaacactgaaggggtttccaaagacatgggacttttaatgctgaaactaggaaacacctgggtaaattgggatgagttcattagtgtattgcagtgccttttttttttttcttagcacaatgacagtgactgacaaaatggttatacaacattttttgaaaaaacatgagtgcggaagagttttacaaagactaaccagtcaagttataaatgattataaccaatattaatgattgtgtatttttgttttacttcattaataaaaatttagcataaataaaattagtcattgtgcagcctcagctgtttagtgattaatttccttcactttaggtttctaatttacaattatacctggcaagtggtagggagttgtacaggtagagtatgaaaagcagaattcagttgacttaatgctttgtgaaccggatcaataatttatttgtagtgttgaataagactaacatatttaggtagcatttcagtattgctatttttttcccttttattttgaaaagttgtttactttggcaagcaaggcttaggtagtctgtgtggtctgttcctgtccaactgtgacacaaatctttgtgtggccattgtcaagtcacttttaaaaatcaggtatgattcagttggttggtgctggtcacttttgaacagttcctaaggacgggtgctatcattagaagatccaatgatgaatgggcctcaactcacagtaagtttatacttaaggaagtgatttatactattttctgaatatggtgatacaaattagggtaaaaaagatcaatgcttatattttgataaattgagaactattttctttctagtttcccctcctatttttctttttccgtgattgcagtcttcggcatatgtgtgtcatacacctcacaggggaccagtggatctcattgtgcattctccctcctcccccagaaaaaccttatacttccccttttctttaataagaaagcactgtggtgaagtgtgctttatgttttttagtggagtaatcagaaaatggattatctcagatatggacttgtgaatttggtataatttcttaataattattaagttcatttaattgtaacaacttcatatattgtagtgtaggtattattctcccaatgtgtgacagatgatgacgtaccttcagagaggtggccaaggtagattgtggttgtatgttagcagaagtagcacttttattctgaaaggtaggggctggtattctacacataaaatacacagtatgttagtagccacatgagtagctaatactcattttaagtgttttcctccagctaaactttatcaattaagagacactctcaccttattatttacaattttctacactggaaagtgatagtttatacatgccagtagtagaaaaaaatgtaagcatttgtagtttccttcgtgaggactaaatccattctaagcagaatcctaaaaatgtgacttccttctttgattcttttgtttcttaacccatttattcatccatccatccatccatccagtattattattatatgtctgctacatttcagatattgtcaaagattgagggattggtgggtcaaagaaatgaggtgattaagacccaatccctgttttatatgaagtcaagctctacaagttgcatgttcttggtaatctcttactgactaccaattgactttctaaatatttgctgagtactttctccgtgtcaggcactgctgttaacagtggaatacaaagtgaataagattcatgcagagtacttcctgtaataccagctactcgggtggctgaggcacgagaatcacttgaaccggggttgggggcgggggggcgcggaggttgcagtgagcggagattgtgccactaccctccagcctgggcaacagagagagactcactctctctcaaaaaaaaaaaaaacaaaaaaaaacctcatacagagttcctatgttcacatatacatacccacacacactatatccacagacatgcatactacagactacatacatatacatgcaaatgaatatatgtatacataggcagaaagcatgcagttacattcccataaacatatggatatcatctggaaatatgtatgtttatgtgtctgcaagtgcgtgtaaatcaatgagctcattgaactgagggtgatttcaggaatcaggcatcaaccaatattatgaacttgtagccaggttcttctctggcctcgtttgcccatttgttctctatgggagagacacagggattagttagcctgctgacagctatgggttttgtgtgtcctgtgctgaggataagaatgttctttactgtgggtggcctaattaaagcctcatgaatattgagtgccacgtatgtctcatatataatttgtgcagcatgaatatttagtgcctcaggtgcctcatgcatatttagtgcctcatgaattttagaagcttcttggtccttccgtcttcttctgtgttcatgcatacgtgttctgcttgctttacctaataggtttcattacttatctatgcttaacacattttatgagcttcatctatcccatgtattttcctgtcttattgatcatagtttcttgtcctattaagcagaattgaattttctccagcactatagcaaatttacattacatctgtccatttggaaagcctatggcccagatgctttatggaaaagaaagctatttttaatattcagaatttcaagtcagtacatacacttacagatattttccagtgtaggacttttcgtaaaatctttagcataataaagctcaaaattgatttaacaatctagaaaaagtattcttgaggaattcattcatgctagtttatggttttgcttaaagcttgtggttggagatggtaaggaaggagaaggtaatattccttactggcttgggggttttgaactttaactggccagctttagccctctatgttgtaaacatttttgatgtagttacaattcaaagttatggcatatggaaatgttctattgtaggataaagtggcggagtagtataaatagggtttggctggctaaaaagctccatttattctgactttgagtcagttacccattaagcttatgggtttcgagtaacctaggggtgtgtttaaggttagtagtaattgacagggttgtttgtattttctgtgtattgtgggaggaagttcattccatttcatgattaatggtcaggaagggacttctaggatttggtgtttcatcttccaccattgaagaggatctcatttagattgttgaagaagatatctttgaacagacacatcagccatcctgcatatatttagggaagtggtacacaaagtggttcatgtacagaaatgcttttccattgtgattgacaccaaaataaacttgctgaaattgaagaatcataaaaaatatatgctctatgtatcttattcccttcaaatattagtatgtatttattcatgacccctgccccttttatttacagggacaaggccttttctgaatatgagaggctgactagaaatatgtattttgtgattatttatttgacaaacacatttggggacaaacacagttgaaccttggtaagtagatgatacatctggtggtgggagcagaggtgctggcgggtgcatgggtgtatcttgttaaaccgagtatttggggtcctcatatgcatcagtcactttgttttacaggaagggagagtggcagtgatgtgaaggttgaaactgtgttagagctgcttctgcatttcatactttcattcttttttgtctaccttgaattccagcttagatctctactgcatgccagtgatggagagggaagaaaggcatttcttgtattggaggctcttgtttgtggcattctggagccatttaaacaggcaggggctggcagcctgaggactgttctctagtggatccagctccagagggtgctgtgcacacgatgtcacaggtaccatgtggctttaaggtagtaaaaacgcatccctatgttgctttgagtatacaaaaatagttaacatccaatatcgagtgccaggccccaggctaagcacactgcgtgaaggagcacatttgattttcatggcattggatggcatagcagacttggccacacctcttgcgactcaccatcctgtgtcaggatggctactgcaagcaccaggtagagtgaccagctgtctccctttgccctgatctcagggttgtccagagagtctgagtttttagtgctaaaaggagggtgagttggtcaccctagtccctgtgactgctgtccaaggacaccggcagccaaggaacctctctcacagtggatgctgccctctaccggtgacaccggtgacggtgattggtgggtgaataccatctctgcagtctccgagagttcccctgcagaattcgtcctgtggcccacagagagaacccactcacacgctcatccatgtaggattccctctttgctcttttgcatttcactttctcacctccctaccagcgcctccggggatcaccttctgcataaatgactttcactcaggtacttgtcacagggtcagcttctgggggaatccagtctaaaacacatgggtagaactgctttactaccatttcacataagaggaaactgaggtgtggggaggttaaataattttgctcaaaattgtacagctggcacacagagctaataattcttagttattaagttatacagctttactttttttttttttagtttttaattttttgagacaagatctcactttgtcactcaagctggagtgcagtggtgcagtcatggctcactgcaaccttgaatgcctggggtcaagctattctcttgccccagcctcccaagtagcagggactagacgtgcatgccaccatgcctgctgattttgttctttaatttttggtagagacaaggtctcgctatgttgtccaggccagtcttgaactcctggtctcaagtgatcttcatgcctcggctcccaaaacaataggattacaggcatgagccactgtgcccagccattacaaattttttaaattattattattattttttttagtgatggggtctcattatgtagcccaggttggagtgcagtggctattcataggcatggtcatagtgcactgcagccttgaactcgtggcctcaagcgatcgtcctgcctcagcctcccgagtagctaggaccatatatgcacacccctttgcctggcttaagttatacagcttttgttcctatcctcacccatgtgtatttatttccaggaaatctacaatttcatttattcatatgggattaacaataagctatcatcagtccagtggggttatgaatggtatgttattattctatctctactaaattcattgagcatggagcagaagtcttgattttaatggacttaggggagtttgatgggactgtttttatgaaggagaaatttgtcttttatacataagttgccaaaaccagtgctgttgctgactaaggactaagtgcctatcccttgcctagctatgcgcagtctggccttgactggaagcaggaatcgtgacatctctgaccagattggatgtaaactgcctgcttgtgctaaggagttgtgtctgctggttcttggctcccatcctagagttctctatgaaatgactcattataaggaagtctattaaaaacaaatctctccccattttagagtatctcttaaaatttcttcttaataagagaattttggtgctttcagttccagttagtgccaagaaatttgaagtgtgtattgaagaaggctatgataattacagtacttgaatttcttgtaaagatagatgctttgggaagtgagtgtatttcccttttatttgaaagacagaagcttggaaattctaccagacttaaaaaaaaatttttctctcactgcaaatccacagcctaatggaaagtgctccaagtttctctagtgaaagtggcttcacttacctcagcatttaagatccttccccattgttgtagttttataggtattttagattatctatttaaaaaggcagctgcctgtcaaatgatccacataaataaaataagattgtgcagaagtgtagaatataaccacatgccaatccttaggaaacagtgggaaatgttttactttaaaaatgtagggttttgcttttacaaaactgatctttgaccaccggttctctcaggctttgccttttctagttcaatgatcttttctactagttcccccctcccttccctcaaaggcctgaatagacacttcccagtttgggaaatagaccttcattagttacacctggctcagcatttttttttcttttctgcacatctgcttagcatcatgtatttgaaggtgccacatacatgtttgctaacgttgctttagatgctgttgagtcataagaagataagcagtgctagggaggattcagtccagcttgatattcttctccacaagtgtgacttgggtagggaaagggggacactttctttggtcaagacggaaaaacagattcatgttacctgtcattagcatagtaaaaactatgggaaatgtcttagtccattccggctgctataacaaaataccatcaactgggtggtctataatgaacaaaaattcccacttctggaggctgggaagtcaaagatcaagcgtctggccttcaaagatgtgccttctctgtaacctcacatgatggaaggggcaaaggacctctctaggttctcttttataagggcactaatcccactcttgaatgcttcctcacatgacctaaccacctcctgaagaccccacctattgataagtatcattaccttgggagttaggttttcaacatatgaattttgggagatacaggcattcagaccacagtggaaaattaagcttaactgatggggagatttaggagatgcagtgagagagctttgttgtgctgtgtgctctgttctctcaatattatgattttaggaaggccattgccttctcaagagtttaggtatgtgctgcaagcactcagctttttataatttacatccttcctctacggatggttgaatgaatgaattgctctgaattcttgtacctatttctatttctggcctgtgcaattgagtttaatgttcgctaaccacatataaagttgtgcttagcaatgtttctcaagtggtgttgtttattgtttttctagattatatagagtaatacagaatatactttccagaatatgacacatctttgtattctctccataccttttataattttataaatgtgattttataatgtttttaacttatccttgctgcaatgaaaatttccacaacaaagtttattagaggaaaaacatacattttacttactgtattaattacccttatttgaagacggttttttgttatgtgttgtgatgagaaataacaagcagtattccctgtatagccgagtattacttttggctaaagttaggataatgttctttgccctattttgtcattgcccattttttcttcttgttagggaggcagaggtggtggtggagacaactgggaacagctagaactgagttaatatctttagagaatagtctgctatgacattgtttttgtttccctctataaacccttcaaataatttttaagaaattcctctgggccagtcgcaatggctcagacctgtattcccagcactttgggaggccgaggcaggcggatcacgaggtcaggagatcgagaccatcctggctaacacggtgaaaccccgtctctactaaaaatacaaaaattagatgggcgtggttggtggcgggtgcctgtagtcccagctacttgggaggctgaggcaggagaatggcgtaaacccaggaggcggaggtagcagtgagccaagatcatgctactgcacgccagcctgggtgacagagtgagactccgtgtgaaaaaaaaaaaaaatagctgggcctgttggcgtgcacctgtagtcccagctactcaggaggctgaagcagaagaattgcttgaacccgggaggtggaggttgcagtgagccgagatcgcaccactgcactcaagcctggccacagagcaagactccgtctcaaaaaaaaaaaaaaaaaaaaaaaaaaaatcctctgcattgagagccaagtgttcgggctcggtgggtcttaccctgacagagcccagcacactaagatccactggcttgaaattctcgctgccagcacaacagcagtctgagattgactgggacgttcgagcttggtgtggggaggggtgtcctcagcaatggtccaccattgcctatgcttgagtagactgttttacactcacagtgtaaaaaaagccactgggaagttcgaactgggtggagcccactgcagctcagcaaggctgctgtggccacactgccagatttcctttctctgggcagggcatctctgaaaaaaaggaagcagcccaggtcaggaacttacagataaaacccccatctccctggaacagagcacctagggaagtgggtggctgtgggcacagcttcagcagaattaatgtccctgcctgacagttctgaagagagcagtggacctcccagcacagtgttcaagctctgctaagggtcagactgtttcctcaagtgggcccctgacccccttgtatcctgactgggagacacctcccagtaggggccgacagacaccttatataggagagctctggttggcatctggcaggtgcccctctgggacgaagcttccagaggaaagatcaagcagcaatctttgctgttctgcagcctcccctggtaatacccaggcaaacagggtcgggagtggacctccagaaaactccagcagactggcagcagaggggtctgactgtcagaaggaaaactaacaaacggaaagaaatagcacatccactcaaagaccccatccgaaggtcaccaacaccaaacaccaaaggtagataaatccacaaagatgggtagaaaccagcgcaaaaatgctaaaaattccaaaaaccagaacgcctcttctcctccaaaggatcacaactccttgccagcaagggaacaaaactggacggagaatgagtttgacaaattgacagacgtaggcttcagaaggtgggtagtaacagactcctccaagctaaaggagcatgttctaacccaatgcagggaagctaagaacctttaaaaaaggtgagacgaattgctaactagaataaccagggtagagaagaacataaatgacctgctggagctgaaaaacacagcacaagaacttcatgaagcatacacaagtatcagtagccgaatccatcaagcagaagaaaggatatcagtgattgaagatcaacttaatgaaataaaaagaggagacaagattagagaaaaaaggataaaaaggaatgaacaaatcctccaggaagtacaggactgtgtgaaaagactaaatctacatttgattggtgtacctgaaagtgacgaggagaatggaaccaagttggaaagcacttttcaggatattatccaggagaacttccccaacctagtaagacaggtcgacattcaaattcaggaaatacagagaacaccataaagatactccttgagaagagcaaccctaagacacataattttgagattctccaagttgaaatgagggaaaaaatattaagggcagccagagagaaaggtcaggctaccaacaaagggaagcccatcagactaacagcggatctctccgtagaaaccctacaagccagaagagggtaggggccaatattcaacattcttaaagaaaagaattttcaacccaaaatttcatatccagccaaactaagcctcataagtgaaggagaaataaaatcctttataaacaagcaaatgctgagagattttgtcaccactaggcctgccttacaagaactcctgaaggaagcactaaaaatggaaaggaacaactggtaccagccactgcaaaaacatatgaaattgtaaagaccatcgacaacataaagaaactgcatcaactaatgagcaaaacaaccagctagcatcataatgacaggatcaaattcacacataacaatattaacctaaatgtaggctaaatgccccaataaaaagatgcagactggcaaattggataaagagtcagacccatcagtgtgctgtattcaggagacccacctcaggtacaaagacacatataggctcaaaataaagggatgggggaatatttaccaagcaaatggaaagcagaaaaagcaggagttgcaatcgtaggctctgataaaacagactttaaaccaacaaagatcaaaacaaagaaggccattacataatggtatagggatcaatgcagcaagaagagctaactatcctaaatatatgtgcatccaacacaggaatacccagattcataaagcaagttcttagagacctgcaaagagacttagactcccacacaataatagtgggagattttaacaccctactgtcaatattagacagatcaacgagacagaaaattaacaaggatattcaggacttgaacttagctctggaccaagtggacctaatagacatctacagaactctccactgcagatcaacagaatatacattcttctcagcaccacatcacacttattctaaaattgaccatgtaattggaagtaaaacactcctcagcaaatgcaaaagaatggaaatcataacgaacagtctctcagaccacagtgcaatcaaattagaactcaggattaaaaaactcactcaaaaccacacaactacatggaaactgaacaacttgctcctaaatgactgctgggtaaataacgaaattaggcagaaataaagatgttctttgaaaccaatgagaatgaagacgcaacataccagaatctctgggacacatttaaagcagtgtgtagagggaaattttatagcactatggccacaggagaaagcaggaaagagctaaaattgacaccctaatgtcaaaattaaaagaactagagaagcaacagcaaacaaattcaaaatttagcagaagacaagaaataactaagatcagagcaaaactgaaggatatagagacatgaaaaactctttaaaaaatcagtgaatccaggagctgattttttgaaaagatcaacaaaatagatagactgctagccagactaataagaaaggagagaagactcaattagacacaataaaaaatgatataggggatatcacccctgatcccacagaaatacaaactactatcagagaatagtataaacacctctgtggaaataaactagaaaatctagaagaaatggacaaattcttggacacatacaccctcccaaggctaaaccaggaagaagttgaatccctgaataaaccaataataagttccgctcaacttgtttgagggatcaagttggctttgcccctgggatgcaaggctggttcaacatacacgaatcaataaatgtaatccatcacataagcaaaaccaatcacaaaaaccatgtgattacctcaatagatgcagaaaaggccttcaacaaattcagcaccccttcatgctaaaaactctgaataaactgagtacccatggaatgtatctcaaaataataagagctatttatgacaaacccacagccaatatcatagtaaatgggcaaaactggaagcattccctttgaaaaccagcacaagacaaggatgccctctctcaccactcctattcaacatagtattggaagttctggccagggcaatcaggcaagagaaataaagcgtattcaaataggaagagaggaagtcaaattgtctctgtttgcagatgacatgattgtgtatttagaaaaccccatcatctcagccccaaatctccttaagccgataagcaacttcagcaaagtctcaggatacaaaatcaatgtgcaaaaatcacaagcattcctatacaccagtaacagacagagagccaaatcatgattgaactcccattcacaattgctactaagagagtaaaatacctaggaatacaacttacagagaatgtgaaggacctcttcaaggagaactataaaccactgctcaaggaaataggagaggacacaaacaaatggaaaaacattccatgctcatggataggaagaatcaatattgtgaaaatggccgtactgcccaaagtaatttatacattcaatgctatccccatcaagctaccactgactttccatacaaaattggaaaaatctacataaaactattgggggaacccacccccaatatttcaatgtaagttctttctattttctataagtgtcagctggctgagaaataaagacagtacaaagagagcaattttacagctgggccgccaggggtgacatcacatatcagtaggacatcacatgtcaggtaggaatcaccatgattcctgcctgagtctcagaccagcaagtttttattaagggtttcaaaaggggagggggtgtaagaacagggagtaggtacaaagatcacatgcttcaaaaggcaaaaagcacaactactagtaagggtctaacacagatcacatgcttctgagggaacaggacaaagggcaaaagcagaactactgataagggtccaacaaagatcacaaggcaaagagcaaaagcagaactactgataagggtctgtgttcagtggtgcacatattgtcttgataaacatcttaaacagcagaaaacagagtttgagagcagagaaccagtgtgaccacaaatttaccagggcagagtttcccaaccctagtaagcctgagggtactgcaggagaccagggggtatctcagtccttatctcaaccacataagacagacattcccaaagcagccgattattgacctccccccaggaatgcattcctttcccagggtattaatattaatattccttgctaggaaaagaatttagcgatacctctcctacttgcacatccgtttataggctctctgcaagaagaaaaatatggctctttttgcccaaccccgcaggcagtcagaccttatggttgtcttcccttgttccctaacaatcgctgttattctgttctttttcaaggtgcactgatttcatattgttcaaacacacatgttttacaatcaatttgtacaggtaacacagttatcacagtggtcctgaagtgacatacatcctcagcatatgaagataacaggattaagagattaaagacagccataagaattacaaaagtcttatttgggaactgataaatgtccatgaaatcttcacaatttatgttcctctgctgcagctccagctggtccctctattcagggtccctgacttctcacaacataaaacttcatatggaaccaaaaaagagcctgcatagccaagacagtcctgggcaagaagaacaaatctggaggcatcacgctacctgatttcaaactataccacaaaacgacagtaactgaaacagcatgttactggtaccaaaacagagatatggaccaatggaacagaacagaggcctcagaaataatactgcacatctacaaccatctgatctttgacaaacctaacacaaacaagcaatggggaaaagattccctatttaataaatgttgttgggaaaactggctagccatatgcagaaaactgaaactggaccccttctttacacctatacaaaaatcaactcaagctgggtcagagacttaactgtaagacctaggaccataaaaatcctagaagaaaacctgggcaataccattcaggacataggcatgggcaaagacttcatgactaaaacaccaaaagcgatggcaacaaaagccagaatttacaaatgggatctaattaaattaaagagcttctgcacagcaaaagaaactatcatcagagtgaacaggcaacctacagaatgggagaaaatttttacactctatgcattgacaaagggctaatactcagaatctacaaagagcttaaacaaatttacaagaaaaaaacaaccccataaaaaaatgggcaaaagatatgaacagacacttctcaaaataagacatttatgcggccaacagacatatgaaaaaatgctcatcattactggtcattagagaaatgcaaatcaaaaccataatgagataccatctcacaccagttagaatggcgatcgttaaaaagtcaggcaacaacagatgctggagaggatgtggagaaataacccttttacactgttggtggacgtgtaaattagttcaaccattgtggaagacagtgtagcaattcctcaaggatatagaaccagaaataccatctggcccaacaatcccattactgggtatatacccagaggattataaatcattctactataaagacacatgcacacatatgtttattgtggcactgttcacaatagcaaaaacttggaaccaacccaaatgtacctcaataatagactggataaagaaaatgtggcacatatacaccatggaatactaggcagccctaaatagggacgagttcatttcctttgccaggacgtggatgaagctggaaaccatcattctcaacaaactatcacaagaacagaaaactaaacactgcatgttctcactcataagtgggagttggacagtgagaacacatggacatagggaggggaacatcacacactgcggcttgtcagtgggtgaagggctagaggagggataacattaggagaaatacctaatgtaggtgatgggttgttgggtgcagcaaaccaccatggcatgtgtatacctatgtaacaaaactgcacgttctgcacatgtaccccagaacttaaagcatattaataaaaaaaattcctctgaattttcttttacttgtcctctttctctctccttaatcctacccagaaaggggttggggacagtaccagatcagtgtggattacctgttcaaggcacatctctatgaaaaaattctgagaccagtttttgtcctttttaagagtgggagggtgatgtaagagagagacttttttcttatgggatctgattgtcccccaaacatcactcctgctctgactaacatgattttaattgtctttcacaaaatctaactaaagagggtgtgtgtgtgtgtgtgtgtgtgtgtcagtgggaacatcttgtgtttgtattctgtgattcattactttttggaagttatttggacaaagattgtcaagaattgcttcaaaatgcatcccactgatgctcacgttctcgtttcctaattgctgatggggaagcttttgctcctcctgttgtagtcactgcttctgcccatgtgtgttgggggctcctcacagttcatacagcagcactgttttgagacatcagctcccagcccttactgttacaacatgcatgtcacatagcaccccgtttttcaaaatcatttttgttggcttgtgattatcctcataaaaggtgcttaattggaagcctcacagctgtagctttctgtttatagccactgagtaggtacagttaagctgactgcattttacgtgttgtgagccacggcccgggaatggagagattcaggctgtctctaagacagagctatggggagaagctgtacacgacttactggaaggtaagcattcaggcttagacagttgaagaacttggtcaagatgtgctgttttgtacattcattttgactttgttaaacttaaaatatcctttggaaatgaaacttttctttactagatttagttagatatatgagtgaatacaaattcatataatatagttgactcttgaatactatgagtttgaactgtatgggtccacttatgtgtggattttcttgcacctatgccacccctgagacctcaagaccaactctcttcttctgcctccttctcagcctgctcagtgtgcaggtaatgaggatgaagaactttatgatgatccacttccacttaatgaatagtaaatgtgattttctaataatattttctctagcttactgtattttaataatacattatataatacatgtaacatagaaaatatgttttaatcagctgtttatgctatctgtaaggcttccagtcagtagtagggtactagtagctaagttttaggggagtgaaaagttgtacgtggattttctacttccaaaggtagttgctgacccaacccctgtgttgtttaagggtcaactagaatcctttttttctcacaaatggataatttaaaatagaattagacttgataagaacacttcactagtttttacttgggtatttatgtgtgtacatactttttaggcagtcattttaaaacttatatatatatatatatatatatatatatatctcccaataaaatttggaaaataaaaaaaatttaatataatcatactcttccctggcatacacattttgatcttgtgatgaatgttcctagtttttatgtgtttatttaaagaataatagttacaatcatgtttcacatgtaattttataatccacttaaaaatcatgccttattttcttttttatgcagtttatcataatcatttttccttattgcttcaaagagttttgcaaatccaaatcatcttttcaaatgaccttaaaatgtttgaaaaagtgtctatatctaaattttcttaattcccatattggtttttccttgtttttgcttattatgtgtattactaagatgacatgtttgtggcagtagtttttcttctttctcttcttacttggattatatttttaagacctagactcttagaaatagaattactggatcaagtacatggaaactatagttattctttatataaaccaaattattcttcaaaatggttgtgtgaatttacacttccgccattgtacaaacactacatcattactagtgcttatgatattactgaatctcagggttataattatataaattatacaatcttcaactgaggtaaaatcttttaagttacctgggaaaatacaccatttaaaaaaggatggattcaagggttgtatcttgaattgaagatcaaaaatttattttcaaatctttctcgaattaatctaagcagatttagcaaaattagaaagatattctagagaatgtttacattatatatttcaggataggtgtctcagccatgaagatccagaacttgatagagcattgccaactattaaagagaataaacttttattacctttttagaaggacttgaatattttgaggctggtgaataaatgaggcctgaaacatttaagtttcttgaatttaagaagaaaaatgagtttaagctttccaaagtaaacaaagtaggaaaagcagctgagaagatagaactgttcaagataataatacttataggaccactatgcaactgtagcagattcattttaattgagatagaatttgactccttaaccaaagttacaattctgggaataagaataaagttatggcttagagtatgaccaatgtgtttgcatcataaatgtacgcacatattttttgaaaggaaatcgaggtaacattatgttataacttttatgctaggccaaagactattacctaaaaattactcttcaagcattgtttgaaatgaaaaccatatttaaaggtggtttgctgcctactgatgaaaaatgaattcatgttaagaaaccaaggactttaaacggaataaattataatcagatgttagatttagaccagctttaacaaaaacaaatgattcttttcagagatgaaaactgatggcttagccctcaaagcatctatcttttttcaaactaaatgtcttgagagaaggggatctgcttaatttcataaaagtaggtgtgtgatttatcagcagcaaattgctgagtttaagaaataagaacttccctaactcccctaaatgtttccctaggccttctaaatgagaatactttgatttgtagtaacttgattatgcaaagctatattttgcagaaggttaaaacaggacccattgggatcatagaccagatcccttctgaatgatgacccttgctgcctttgtttgcatgtccacacttactccgtaaacctctggattatagacttggtcttcttgagtaaagaaaatcctccagttccactggacacctgctgatttactttagcacttcaggcctcttttaatgagatgcagtatgagacagtcttagggctcaaaaggcatttaatagatcaagtttagaatattttaatgttaaaatgtctatcagtgactgcttctaccatccttcatttcaccttgaaaaacagctcttttaggtcataatgagttgtgctaaacactgagagcaaatttgaatctcttacttgcctcagagtaattaaaagagagaattgtttcctcacatttctctgtaatcatggggttaagttaaatatgggatagatggtaatgagtacaactagttaggattataggaggccaacttgactgatggtttggaaataagtagtgttgatttcaccatgtgattccagtggtgtcacaatgcttgagacttacctgtgtgtaaaatttacctggcatgcttgcaaaaatgcagattcctgggatcccagaaagattaaaattcagtgggatctgtgggtggggcataagaacttgatttttctcgtgagcaccccgctacctctatgtatcttcaagtaagttggtatgccgtcagtccactgtagagcgtaatagttgatacactgagttagtcagtgtgtccaatgaaaaaatatacattttgtggtatagttaaatgtattagcaagttaaaagatggaaggatcatgcagattaattatccatttggtagttcacaggtcaattttgtggggagggtgaaattatatagaatgtacattgatggaggtggaattctacttgcagtgaaaatgccaatcttccataatagttattatcaggagtgggaggccaataacattctgttcgttcaatttctaaaatcatgaagtcaatagaaaagtgggcaactagttactcatttggtacttaagtaattaatgagtaatttaatacttaataggtaattaagtacgtaataagtattgccaatattagttaggcctgtggagtttttcataacggtcttcaaataagttcagatctatatttctgttatgtgcaagggggtccctcttcttttttgaatgcttcatctactcactgcctttccatttgtttggcctttctttgcttctgctttctgactaattctgcacttccaagaagacttcaaagcaatagagccctccagatttttgccacatggatggttcacttaattatcctctgatagtcctagtattgtgtgcccagtcccactggggagaggtggggcagtagaactcctgagacttgctactgctgtattgagggccacagtgataaacacattgttgtcttatagtctgtttgatatttagactactcaaatttaaccataatctttaaaaataaaatgtaaatataaatactattaggtcatgaacaaaaaaaattaagcggctgggcgtggtggctcatgcctgtaatcccagcactttgggaggccgaggcgagtggatcacgaggtcaggagatcaagaccatcctgatccaaccccatctctactaaaaatacaaaaaaattagccaggagtggtggcgggcgcctgtagtcccagctactcgggaggctgaggcaggagaatggcgtgaacccgggaggcagagcttgcagtgagctgagatcacgccgctgcactccagcctgggtaacagagcgggggaaaaaataaaataaaattaagcaaagcataatttccatctttacaaatcctgaatgaatattagttcatgcttttatgtctttagaaaacatagttggaatggtgtcttagtctgtttgggctgctatagcagaataccatatactggatagcttataaacagaaatttatttctcacagttctggagactgggaagttcatgatcaaggtgctggcagatttggtgtcctttgaggcccgactttctggatcagagacagtgccttctatttgtttcctcatgtggtggaaggcaagaggcacctatctatgttctctcttatgagggtgctaatcccattttgagggtaccaccctcatgacctaatgacttcccaagggccccacctcctaatagcattaccttgggggttagcatttcagcatatgactatgaaggcaaaacatttagaccagagcaaatggtctaggccagattatcacacttgtcctttgtattctctttgtggtgtgagtactaagctaaaatagcctagaatattaaaaatcgtcacgtaatatatacgcatagtttaaaaatgaaatagtataaaaagacttatgatgaaaacacaatatccttccccacaaaacatactctgttccctagatgtagctgctttttattccttgagctgtttcttgctgattcttcattttcgaaatctgtttattgcattctccccattcattacctttagccattgtctgttgtattcttttgtggtagaaaggatttaccttttatcctcctctgttttcccaataaagtttaatgacaagttttagcttaatcaatattcagtgtgtatattttatttgtcctttggtgtctatgggggatttgttccaggacctcctatggataccaaaacctgatgctcaaggccctgacataaaatgggataatatttggatataacctgtgcatatcctctgtacactttaatctctagattacttacaatacctgatacaatgtaaatgatatgcaaatagttgttatactgtattgtttagagaataatgtcaaaaaaggctgtatttgtttagtatagacacaattttctgttgaatatttttgatccacatttggttgaattcacagacatggaacccagggaatgtggagcgctgactctctatcatctatgttgttgtttcctgacaagcaactaatatacaaacatttcttttcctttttttgtcagaattttgtttttcctggagttggtaattgccttgttcttttcttcccccttgggtttaatattttttatacctatcacaaattctttctacactgtctaatgctctcagaacaattttccacatggttaagatttcagataattaatcagcttttttttttccctgacaactttcctctttgaggcctgttggcctgcttcatcctttactatttgccttctggcctggcttcacagctgtcatcatggaatttgctcccatcctgggaatttctcctcactcttttctatattcaatccccagttaattatataagggaaagtctcagtttcttggctaatttattcaatttgatacatacaacccctactaatatatggaatccaagtagtagggaggtaatttttttccccttgcaacttagcgtgcctgaaaatttcaccatatccttctacttaattgtgggtttagccaggtaaagaattttgggttgaaaataatttttccctggggtgggggaggggggagggatagcattgggagatatacctagggctagatgacgagttagtgggtgcagcgcaccagcatggcacatgtatacatgtgtaactaacctgcacattgtgcacatctaccctaaaacttaaagtataataataaataaataaataaaataaattttccctagaatttaaagctttactctcttgtcatataccatctcatggcttgaatgagaattctgacactattctaatcgcctgtgacttgtttttttctctctggaaggttttaagatatttttatttcaaatgtgaaatttcagaagcatatgctttgagtattttttctttcagttacaaattgaattagctctactaatatggaaccttatgttttttggttctggacattttctagtatatttctttgattaaaaatacattttatagtctgttttctttttctggaaattcggttagttggtcttggattttttaaaaagctatttcctcctatattttatgtatgtcttgttctttctgggagaatttttaaaaatgtttcaaatcttggataagattgtgatatttttgttctctaaatgtttctcttttaaaactgtcggcctggcgcggtgtctcacgcctgtaattccagcactttgggaggccgaggtgggtggatcagctgcggttgggagtttgcgaccagcctgcccaacatggagaaaccctgtctctactaaaaatacaaaattagccgagtgtggtggtgcatgcctgtaatcccagctactcgggaggctgaggcaggacaatcccttgaacccgggaggcggaggttgcagtgagccgagattgtgccatggcactccagcctgggcaacaagagcgaaactctgtctcaaaataaataaataaataaataaataaaactgtcatgctactgttttttcttttgggatgggtgcattactttttcttatctttctaatatcaattgtaagttaaaaaattatcccatcctccattctctttccccatttcccagcctatccttcctcatcttctccacctcctttatcctccttctcctctcttctctttcccttgctttctccctcctgtccttttcgtcccccttcgccttctcctcctccccattctctttcccactcctccctcactcttccccatcggcctccctcactttcttctctttgtcatttcctcatctccttctcaatctcttccttctgttattttgttttgcttttgcttatattttggattgaggcagtaaaactgtttctgctttggtgtgatttgttgactggtcctcaccagcaagggaatgacctcgtatgctgatacatttcatagtgaataactgctacatggctgtcttatgatagtacagtccgtaacaggtagagcattgcatcagctgtgcacctgaattggaatatgatgccctagaactggacatgtggagaacccaggagcaatcttgaactcggaggaaatagctgtccttcctggttttcatggtaatgtatgggacttgagcaagtctaagtcactgacactgaagcagtagtgtagatatgtactattttagaagatcatttactgaagaaaggacatttcctaaaagaaacaatatatgggtatcactggtattatactcctagtattatacaacccctttgtgggtgttctgggccctgaacactaaatgtctgtatcactacccccttttcctcccgcattctataacaaccataaaactactccccacctctcctgcttccactgccccaaaaccacctatttcggaacacctgtgtgaagagtgggacctcccctggtgaagaaagtgttcgccagcttacgggattccctttccctttcaccatcactggagagctccccttcctcccctggcctgtaccatctggctccttctaggcacaggtgctatttcaagtgctctgaggcattgaaaaaagaaaacgcgttttggaatcagacattcatgagtattcacagcattgtctctgcccagaattccctttccccatgtcctcatgtctacattctacattaaataatcagttcaaaagtctctacagtagttattctttgaattcctgtgcttaatcatctgtgactcttctgtaatgttttagtcttgtcgtttttattacacaactatacgtccttagaggtcaaagtagaaggcttccatttattaaatgcttacagggtgctgctttgcatatttcaggggtaaaacagagcttgaaggagattgaagaatttgcccagagttatgccactggtaaatggcaaacctagatttgaacctagacttttctggttccataacttttatctcctctctctgtgccttgttgctaaataaatttgtataaataaataaagaaatacataagtattttagcataaagatgaataagcagccctgatgaaagcaggcatgtctcttctttgccctctgtcaacttccagttttggtggagaaaatagcaaaacagactgcctggtcatggatttctgcatataacctgaactttaaacatgcctggaacacatttggttctgatttaaaacaagttggcttgcaccattgccatgttattacaaatacaaaagaaatataaacttcattccattaaataaccatccacataaactcttaaatactttcatggctttgggctgggccaaagctggatattaaggaaatgattattaatgttacatattttattcaaactgctctaattcttttaaccttccctccatccctaaaagtaccagtcaaccttttccttcctcctgcaaaatgttcccaggaggttaaaacagatagaactttgatttcaagctactgactcttactatttggaaatactctttgttttcagttcctcatagcctgtagctgtgtgctctacttgaaacttttcaatcctccttggatgacagcaaagttagttattattccctatagcggtgctgtacaatggaaatatgtgaaccacaaatgtaattttatgttttattgccacattaagaagagtgaaacaaaacaggtaagattagtcttatatttctttgtttaacccaatatataaaagtaacatcatttcaacatgtaatcaaaacattattaagattttttacattctttttttactacgttttcaaaatcctgtttgcattttataccacagcatatgtgaattcagactagtcacactttcagtgttcacgaggcacatgtggccagtggctgtcatattggatggcgtagctctataggaagatcagcataagctcactgtggtgtattaggtattcctaattccattaaactatgaacattgtttaaattttggtaaagggttagggttgtttttctaaaaaaacattgaaattatgtaaatacccaaagtcttcaaatagtgttatgacctcaggccagactaaacgatgcttcagggattgcttatataagaagaaatagtgtctgaaagcaaggcattggacatgaccaacgtttctgttaatcagttggactgaaattccattgacatatgttagggtcatcagtccaccaggaagtcttcattgttaggccaataaatttgaagttcgaataaacccttagcaagagttactgaaagagttcaagttaaaagttgcttaaagcagtgagtaatgtagatgttctcaaatttttgggaatatatatttccctacatttgatagcaacagatgctttctgaaactaaaatcccctagatgagagaatgctggcctttgcttgctttctgttgtgccctgagtgtgacagggtcagcactgtcttagattgttcctggcattggaatattggcaggaaaaagattttacatgtgaaaaaatgccttgcaatccacattttgagaagtgtgtgtaatctgcagagtcttatggagcagcagtggtccccactgttagacagattaggaatcctccccctaacctccatcataatctttctaattcttattctgttaaaatattttgtgggaaatgaaattttaaaacacagtctcaaaggatgtcttggatggttcaattattggcccatcctcttgtcccaaattgccatggataatctatctagctcttttttttttttattctgagccatagagcccttttataatggggtaaatttctgttttatttcgtgtttcatttgatgtgacctttcattgaaagtgggttttgtttttaaacagcctagaattggaaatgtatgcatatacatttttctttttgcggttcacacattttggagggtgtctatttctgtcttctttggctagctattgagtttggatataactcacagaggttttccaaatactagattgtttactgttttcagctgtgaagattctactataggcctaaatgattaaagcttctccactgagagctgcacaaaatcagtgtttcattctagaaagtactaggttggttaaagcctaagatctatacctggcatgatgttattgattgtccattatctatctctgatattgcgttagtcattgtgtctccttaggcagcttatatctacatttgattttcgtacttttgccaatgattgccttatacactgtgggctgaaaataatgctgtgacagaccagtaatggtgaaaccttggttcattctcaaataggaaggaagatttaaaaataatttttacctgaatgttttctaattaaaaagcaattcaagctatttaaaggtatgctgaaaaatacaaagaaaaaatgataaacagacccaagaattctaccactcaaataacaagtgttattaatattttggtatttatcctttcagtcttttttctaacacattcactatgtatccatatatctaaatacatgtttgtttatatttgtgtctgtatatgtacacgtacagacttttatacagaatttaagtcattctgtacattctgtttttttgtttcttctttttttttttttgagacagaatctcgcactgttgcccgggctggagtacagtgtcatgattttggctcactgcaacctccgcctcccaggttcaagagattctcctgtctcagcctcccaagtagctgggattacaggcatgctctaccactcccagattattattattattattattttgtatttttagtggagacagggtttcaccatgctgcgtaggctggtctcaaactcctgacctcaggtgatcctcccacctcggcctcccaaagtgctgggattgcaggtgtgagccactgtgcccagcctgtacattctgttttatactttaaaaaaccaagttaagattgcatttttgaccatgggaatttaactgcaaaaataaaacaatatttaagaaaaaatattaaagtgaagaagaaagccatccttaatccagccactgttaagagaaaaattatatttatttttgtctattcttaatttttctcaacaggcctatttatttaattttttacaggcaggtgaatttgaattgttcacagtgaagactggtaattagagagggaaaagatagggtctgaaaattctcacacttatgagatacagcattcagatgatacttttcaccgttgaaatttaaagttagaagtgttcttcagttggttagagtattttaatgatgactatgattttaattcagaagtggaagaaactttaagaatgaacctaatgactactcttttctcagttggctctcagagctttgcatgccattccaaagtgcaaggtataattcatgaacataaaaagtttctctgggaatgtatagaaactgcatcttctacatcttttgtgctgattcctctttcacttgaattggctgggttgtcagggaaacagttaacatacagttttctggaaacagttaatatacagaataaaatatatggcatagctcttttagcatatggattaaattgatacaataagggaatgttttaaattttgtgtaaaatatttttgcacaagaatcaggctacctgaataattgtttatctttcaggtgaccgaaaagcacagcagccctcttagttgcaaatgtgttgagttgtgttaaaaaaaaaaaaaaaagatggagaggaatgccctgattctttacagatttgaagaattatatctcaattaattttataatttgaacttggtattttcttgctcaaattccaaaggggaagaaaccccattgtttatcaaggtaatgtttaaagatgtttcatactatgttataaatatgaagaacatagtccttgtgtttttagagttggctccataaagcatcagatgttataatagaaaagcatttcaaaatgaaaaggatatttaaacagaagtttccatgtgccccaggaagaatttaaagtcaagctacccccctcccatttaattcagtcattaactggacttgctctgtagtttggggggattgtaatagtttacacctgtttcaacttttgctgtttttattggcagtggcttttgccatcccatatttcttgtgaagcaaaaatatgaaataaaatatggcaaagcattggagaaattataataaacataaaaaatgaatcgttcagcttaaaatatgaaatgctttacctgcacattcagccagccacgtttcagtagtattgaagtaatttattcccggagttgtgtgtcatgaaaataaagacaattgctttcattggcaggaataatccagggtttttacatccaagcgaataaactttggaacatcaggcagacgttatattgtaaagacagtttaaggaaaacctgctaaatcattatatctgtgctcatgtcactgtggaataaaaaagatgaaggagtatcagtgtctaagattgcaaagactcaatagaagtattttaccacagagtgtaatcaaactttaaaggtcaagcaatatcatgacataaagtatggtttggctcatttcacaggctccattttgccctccaaatataatgaaaaggaaatgatttgagtcaatatattatcatatctcatatatatttttttcttccgatccagctctctaatggtctccatataagtgccctttgttcttcagatctaacggtagctgtccagctccagtgttgggttcggagtgaaataattaagtttttagtgcattgtctagaatgagaattgctaaattaaatttataagtttaatttggttagaattgtgactgtgaaaaactctctgggaaagttgctaggagaactgaattttaactttggcttaatctcaccagttaggttgctttgaatattttacaggttggggttgtaatttgaatgaaggtagggccttgcctattttgattcattagcatcgaacctaagtcctaagtatttgcagaatgaaagtgtcagcttttctgggtctgtaaaatgagcattttattttatttatcttattttttttaaatgagcattttaaatgcctaattttatattgagaaaaatgttcttcagtgatacccttttccccaatctctcacttcttggaaagactttatattttgatactaatgaatgcagactaagtgggagaagtagactctcaaatttgggctcagaagaatccgtgtttgggggaagagaagaagacttttagtgaaatgtcactctcttaataggctctcatggcctttgttagctttgtctgcttggggtcagtgaaagtccttcaggtgacctggcatcctgggagtgaattgagtatgcttctccctaggaagggctaatgattgggactcaacaccgtttgcacctgagaccatgatctaaccaacaactcatcagcatcttttaccaaggtatttatgggcttgggaaatggatacatcagaattgaggtaaaatcaggctcagatttagaatttcttgcacacaaacacttggaataaaaaagtccaaagatttttgctgccagtgaatgtaatttgccatttctggcttcttgcctgctgttttccctcaaataataaacttgctaaaggtgcaggtttctggttaaattttagtgattttttttcaccttggaacagaggtaataacagtttaggtctaacttaggaaatctttccctttttattcatctggaggttgaagggccattctgtgaagggtgtttagtgttttgatggacttggaatgaaggggcatgacaaagtgtgatgtaatgagtttgtcttgagcaaaataagtctcctcaaggaagtttgtgtaataaatatagttgtataatgaaatttcaacagatgaattctaagttgtgaaggaatttcctgtggtaaaaagggcaattatctactttgcttgatagacctttgaaaatatatttgattctaaaaatttcttctcacagaagagtttcctcaatgtgactagatatttttttgaatctccatgtccttatctgctactttcattgccatgtgaaagtgggtatcattgagggtggctcttttaaaactatttttagccttagacaaagacagccaagaattggctaagtgcccccccgagacacttttcattaggtttgagcactgaccttttatcttgcctgggtgttcgctttagctagggccacccacacttgccagtttgcttagaagtttgttcaactttactttttatgttttcattgagctttaatattggcatattttaaagttacagaatgaaaatcattgtttgcagagcaaactacagataatttatttgtagaaatgtgtgattcaaatggcctccatcagtgtgtaaggaaaatggatgtgccgcagtcaagaatacgtcgaggcagacatccagttcagcatgacccagcgagtttggagtgcaggctcccaactccactcattatgtaaccacgccacatgaggcgcattaggtgtccacccacatgagctcgtgctttgctcagagccactattgtctgtaaaaggtataattaccctgctgacactacatgcagcttgtgccccagtcggcttgttcgtgccaagagacagaataaagccacgttgaaaccccctacgattccttgagtgttctttcagctgtccaccactcatccacccactcctcagtcctcagcttgggctggaacctaacacttggcatgacacttggcatagtcagcaggatactgaggagagagagccttcggtccccactgattccaggttgggcatgtgactgcaacatgagttatggtgcccagtggcagctgtactgcttaatgggctctggtggaaacctaggtggtggcagtaaatcggtcccccacgagcatggaagaggtgctgaagcagctgcaagtgcaaagccctgagaaggagtgagcttttgctggcagagttggataggcatttttgaatgcactatgaaaagtacacacccagtccctgagggatgcagcagaagtaagggccctccaggtgcaggctgggtgcctggaggcctggctacacagctcagcaaaagatttagaagctgccgtaagtggggaccttcaggtgcaggcagggtgcctggaggccaggctacagagctcggaaaaggaattagaggctgctgtgaatgcaggcctggggctgtcgtctcagctggagacccccactctgataccgaggaggctgttagtgagaccgaggggtctgctccataaagaaggggaagatgccctgcctgcaggggtccccccactggagaacagggggccccaacaagtgacatgctcagagatgtggattgatttggttttggccaggattgactgagagaaaattgataaacagccaaatgaagtactcttaactttgtgcaattccagaaaatgccccaatgggagaaggacattgctgcacaacctggtcccacctgggcgcttcagctcaaagactccgtatgtgctacagccaggtgggggtgtaaagccttttctgtatgatgagggaactggctgaggttcgacttaggggaacaccagatgactggaggccacatgtggagttgacagtccattgttaccccaccaacatatagcaagtgctggtgctggtagacaccagcacagataacgttttgggcatggatatttcacatggcttggcagccatgctgtctatcagtgggcttgacaaaactgagacagtaccactttgtggtggacttggccaatgcattcttttccagagagccaggagcagtttgccttcatgggagggcaacagtggactttcacagtgttgctgcagggctatgtgcatagccccaccatatgtcatggtcttgttaatgatattatgctaacttctgattctcttgcagatttagaagtgacaatgctccccttgcctagatttaagatggtgcggctgagaccaccttcctggcagccaggtgggctattcagcaggcacaagccctacgggtagttgaccaggggtacctgtttgagctggatgtgcatgtgaccacagatagttttggctggggcctttagcagcgcatggagcgcttgagaatgccagtaggcttttggtcccaactgtggaaaggagctgcgctccagtattcactgttagagaagcagttagtaactgcatatgctgcccttcaggctcgtgagagtacggcaggatgggctacagtcgtcgtgcggatgacttagctgatagcgggatggatgcattcatggataatgactccctgaaatgggctagcacagacatccactttagcaaagtgtggtgcctacttggagcagcagagtacactgaatacaagtcccttagcagcagagtacactgaatacaagtcccttagcagcagagtacactgaatacaagtcccttagcagcagagttgcaagaggtcttgggacttgtagtcctaatggaagataaggccatggggcctgaggcacccctccattcctgatagagcatggtatacgaatgggtctagctggggtgctgctattgcctggactgctgtcacagttcactctagtactgacgccatatggtttgataccaagtgtggacaaagtagctaatgggctgaaatcaggacagcatgaatggtgatcaccaaggtggtgacacctacggtaatctgcaccgacagcttggcagtttattgaggcttagccttgtggttaactatctaaaagtaacagaagtggccagttggtcactggcccatatagggccaagccatgtggcaaaacctatgggaggaaggatgacctcctctgaccaggtacagagatgaatggtaacctgttgttgcctgccccagtgctcctaaaggcagggaaataaaagcttggctaaatgtacaaagcaacattggtgtaatgtcaccatggggtggttgcccaccataacctggagttgtttttccctgtattactgctgtggcctctgggtccagggtttcaccctttgggcatgtgtccccactagaaaaactccctctgcctagggggtggaatgtaagacctatgtgttgggcctgagtgtctggggcctgtgtacctagagcctatgtgtaaggtcttgtgtcggacctgtgtgtctggggcctggcttgcatgcccagaggctatgtatgaggcctgtgtgttggagctgtgtgtccaaggcctatgtctcccttggcctagggggtggagtgtaaggaaaatggatctgctgtggtcaagaataggccaaggcagacatccggtcttgcatgtgagtctggagtttggagcgcatgtacacaattccactccttacataaccacgtcacgtgaggtgcattaggtgatcacccatgtgaggtcgtgcttggcttggagccactattgtctgtaaaaggtataattatcctgctgacgctgtacatatggcttgcgcctgggttggctcgcgcccaggtttgcacccacagttcacgcccaggctcactcacaccaagagagagaataaagccatgtcacaactccccatgattcctcgagtgttctttcagctgctcgtcattcatccaccccctccccttggtctcccgcttggtctggaacctgacacttggcgtgacacagtgtctgggtgcagttcatcctattgatgatgtggaatttgtgcaaaaataaaagttaaaaagacattagcattataggttagtttgcttttgctgctgtaacaagttgccacagtgtagtagcttaaaacaacagaaatcttactttttgggtctgaaatttgaagtggttttcactgggctgaaagcaaggtgttagcagagctgtattctctacagaggccatagggaaagataatttctttgacttttccagctcttagaggccacctacattccttggctcatggcctgttcccctgtcttcaaatctttgtcatctctgatctgtcctttgttgtcatgtatccatctctccttgtgcttccattgttacatcactttcttgtactctgagccccctccttctttcattaaggacacgattacattgggcccatctggctaattcaatataatcttcctatctttttatttaatcacatctacaaaatctcttttgccgtgtaagattccagggattagtacatgaacacctttgctaggagtcattattcagccctaccacatattagaatacaatttttaaattcctttttagcctttgtttttatgttttctcagattgcccttggaatttccagaaacatgtactctgcaatctgttgtttggataaaaatgtgttggtaaaaaatacacatttctataaaaatagagaagatgtcttatatttaactgtaaaatttaagttggtgaaaaaagaatgtaaatacttgttatttctttgagggcagagagaatttctcaagttttgaatctttttttttttttttttgagagagtcttactctgtcgccaggctggagtgcagtggtgcaatctcggctcactgcaacctctgcctcccgggttcaagcaattctcctgcctcagcctctcaaatagctggaactacaggcgcacaccaccacacccagctaatttttgtatttttagtagagacagggtttcactatgtttgccaggatggtcttgatctcttgaccttgtgatccgtctgcctcggcctcccaagttttgaatctttcacttaacaatgtcaaaattatggtagatgcttgtcaaaacttgctaagtgacaaatgtgattcttaagtgattgctctgccacatttcttgggtctttagtcattttaacaagtgttctggacacacacacatatgcacttctgcacacaaacatggctgtgctgaggtattacctagcaggtgtttggtttaccgtggtcttccagactttaatttccagtagttctcacttcagtacctttctttgtcctggccaggcttctctcattaatcactattccacctacacctgagtcagagtcctgtttggccttagaaagatgcagtctgagtctgttgcaagcaagatgctattggctctttatcacttctctccttttagtcaaattccccacccctcaaaacaaatgaatacaaaatgttcatagtcacaagacttatgaacacagactgagaaatgggtttgtcttgtatttatgggctaccatttatctataaaaatgatatgaaaatacagtgatattttaattaatgttacatgcaattttattgttggctgtgaccgtcaccattactgtttaattctcatgtttttttttctctctttgtatatacaaatgaaggagtgaattaaaagtatatgatgccagctgaaattcaagtagattatatagactttataaagcataaaatggaaacagctcagaagtaggccatatacatgagccatctttgtgcctgggattgatcacagataggaagtgcttggaatgctacagttgattactttgagagttgcatttattcatatagttctttaactatgaaaggacgagatcactttcatcatctaagtgtgcaggggtttgtgagtctttcagacaaagcaaaagagtgttaaataatccagagacatgtaattgatggattggattgctagtctttaccagttttgcatcccagtgaggcatattagcaggcactgagctgtgggagagcaaggctggcatcttgtttgcttttgcattctcatatctgatgctcgaaagttttttgaatgcatacattgaaaaagtattttaaatgtgcacatttttatttacagctgctgctgaagggaaaggcagaagtggggaagacttttttcaaaaggtaagttgtcttttactcttgtcatggtgataagtaagaggaaatatacttatctcaacagctaccctagaagccaccgaacgctccccttcatgtggaggagaacaggtttctatacgggagctggaaacactcagagctagccaggaaaagaggggatgctgtatgaaacttaaccattccaagaaggctccttccagggaaaatctaatgaaatttttgcttaaaggcaaataagcaaaatgtaagagggctcagaggtggatcaattcatgtggcattcacacttcatttggctggcatgtgacataggaaggggttattgtgcaaggtaaggtacactatcctatatggtgaatatggtgggggagcttttctaaagatatttaaattaaaacaaattttaaaatgttctactggccaaatagaatgtgccagactgctagttttccatcctttgctaaatttataggctcaggctgatgcagtttaggtactgtaccccctgacttggtgttatctgacattggttaatctccaacttatactgaatacccgagcatttctaagtgccctggccttagctggggcaggcttagcaacaagggtaagacaagagaagacgaataggctggatgcagtggctcatgcctgtaatcccaccactttgagaggccgaggctatcagattacttgagtccaggaatcaaagaccagcctggggcagggcatggtggtgtgtgcctataatcctagtgctttgggaagctgaggcaggtggatcacttgaggtcaggagtttgagaccagcctggccaaaagcctgtctctactaaaaatataaaagttagcccggtgtggtcgcagatgcctgtaatcccagttacttggaaggctgaggcacgagagtcacttgaacccggaagacagaggttgcagtgagctgagattgtgccactgcactccagcctgggcaacagagtgagactttgtctctaaaattagaatagaatagaatagaatagaatagaatagaatagaatagaatagaatagaatagaatagaataatccagcctgggcaacatggagaaatctctcctctaccacaaaaacaaacaaaaaacccaaattagccaggtgtgatgatgtgcacctgtagttccagctcctctgaaggctgaggtgagaggatcacctgagcccaggaagttgagactgcagtgagccatgatcgtgccactgcactccagcctgggtgacagagtaagtccctgtctcaaagaaaaaaaaaatgaaaagaaaacaaatagcagaaatcatagatttcccttgggttggctctgatggtaaaaatagatgctgtcagtggaaggattcttcttcattgttcttctttaactcacagatagatgtaaaaaacagatgctccacctttgtgatttcagacaatttaaaagctgagtcaaaatatggtgtatatgatcataaaggactttcattcttagatttcctaatatttctcactgtttgcagagacatatatacattccagcagtttaaatggaaacacatgtttgaatccaggaacatgtgtgcgtcccacagactatgagttagagtcatagattctattcttggtcacagattaatgaggtctctgaataactagatgggagtacattttatcttctcatttgtttctttagttcaatgggaactgtcttttccatagataggtgtccgtataggatttgcatactcatccagcaaaaaatctctaacttagaaacagcccaaattccagagagtcatttttctgctattttgactggacagaagtagacattatggttcatctacagtagaatgaagtaatggagaaatactgaattgtcctccaggaacttgcatgcagtcacatgtattctagttttacatgacattttgggaagcatttaagaaataggctacatagctgttcactagcatcttcgtatttttctctctctaaaataatgcaaatatgaaggatctaggcttgtgattggaatgtttcttagtttttactttgaggtgtgcatgacaaaagttaaaacctctctttagctgagtttaaacttcagctactcaacttttctaagcctggaaggatatctacctagcttcatagtgcctctccctatgtagagatttgagaaggagtgtgagacttttcatatgtaactttatgtttttttgtaccataaaaatatatgtaaaatcataatgactatactaaattttgctcaatttaattaattgctctcattaaagttttcgaattagaaaataataaaattaattttaaaaatcttccaaaataagaattggtatatttccataaagagcttgcatttcagtttaacagataataagattgtgaaacatattatctcaaatttgaggctgtaatagtagttgttaagcttattatacacttcttccattgagtcaacgttactgttttttccagagatctacccagttttctatacactgttttgctgcatgggtttgaaatgatatatttcccaaacacaataaaggataaaatgtaaaagcctaagatgttatagcaaaaaatccccaaaaccccaacaatatagtgtcttaaagagcagagtcattcgttgtcctcttatgtaacgttctaaggagagtcttccagctgggttggtagctgtgtcccatgctgtcattcagtgacccaggctccttctaagacatatctggattgtccctaagcatgaccttcatctccgttgttgaagcttggtcacaaccatgtccaattgtgtgttggtgagggagatagaatattgaagagaggcacgccatggttgtaacgcccaggcctgaatgtggcacctgtcacttcctctcacactctatgggagaaaacttagttatgtagtcttacctaatagcaacaatagaggggagggaggggctgggacatttggagaaaacaattgattttgcaggcactattcaccacaaatgagattgttagggaaaaaaaaaagtctgtgatcaaagtgtaatttctttgtgtggtgtactttgaaactttttgtatttgttagggctcccataccacaaactgggtggcttaactgtgggagggagaatctgttccatgcctttctttagcttcccatggtttgctggtgatctttggtgttccttggcttgtggaagcaacacgtggatctctgccttgatcttcatatggcattttctctgtgtgcctgtctctatgtccaaataaagacaccaattatattggattagcagcccaccctactctggtgtgtgttcatcttattatacatctgcagtgaccctatttccaaatatcacattctgaggtcccaggcattagtacttcaacatacgactttttggaggacagttcaaactataataccttttaatggagaaaataattctgtagaaaaatttactaagactgtagatgttatttgtcacattttgatactcagtctgatctatagatatttaactgcctagtcatttatactaaatctatttttttaatcacaagtcatttctaaattgtctacaatgagtatataattgacatgcaaaaagagaaaaaagtaatctgtaatcttgcctttttgtttttgttttttgtgtttttttgagacagagtcttgctgtgttgcccaggctggagtacactggcgtgatctcagctcactgtaacccctgcctcccgggttcaagtgattctcctgcctcagcctccctggtagctgggattacaggcatgcgccaccacgcccagttaatttttgtgtttttagtagagatgggctttcaccatgttgaccaggctggtcttgaacttctgacctccagtgatacacccacctcagcctcccaaagtgctgggattacagacatgagccacagtgcctgaactgtaatcttgcctttgaaagagaactatttgtacacccttggtcttttttctgtgtatattaaaaatatatataaagtgatttttaatattccctgtttgatgggattacagattaaactatgtatttgcattggatccattctgtgttaaaactttgcaaagttatcctgtaatagtactttttattcttcggctctgactacacttataaaaggcgggaatggatataactttatcagtactctccgtccactcctgatggcagctctatctaatggaaacacatggaaacaatcttccagttttttacagttctttgggcagttgttcatggcttactcactgtctgtcctatttccttttaatcagttctttttttctttctcttgtgaaatgactatggtcagatcttggaggggaaaatgggttacagtattttaggtggggatagggtcagtgattgtattacacatgtgactcatcaaagcaaactgcattaggaatctgtaatcccaatggttggagaagacaaaatacagtcagcattgtaattgatgaaagccaggtttttttttgttgcattgggttatgtacagtatttttcctcaaagtatacatcatttattttaatgtaggactatgttatattctttgaatatattggatgtttatttggaaaactgacctataaaccatggcttgtcacaaaggctaacagtaagactaaaacaatgagatattgatggcttatgtggtttatttttaaaactttcaaactcattgtttttagacaaacattacttttggtgttttcagactggaaaatagcaagtgttgtcttctgggggaaattcctgggataaataatttggttccctctgtacctaaaaatgggtgcattagatggtcttagatggggactaggtgagtccttttattgaggggcagcagagttaataaagttactctggctttctccactagcgattatttttatatttcgagtgggttatttcctctagtaatggatataagttttggtttaattatttaaaagtgaattcagttaactctggctcatgaatgtgctttttctaatactgagtctgtgcttaaacacaaatcaaatttaatttaaataagatccagatattttaaagctttaattttagtatttatttcaataggtaatacacgtacatggctcacaattcaaatttataaaagggtatgcagtgaagagtatttgatatcttgatggtttctgaaggttcactgagaaagctgtgcagcattacattgttggtcccaagcttgggtaaagatgatcatcaatgtgcgtcattactaatgaaaacttagggcctaaagctaacattctgtgagttcttattaccgatcactatactattgccctgagaatgttccagtgacagaatccgtgatcatgttttctttatactactgtctagataggaataactggctgcttgtaagacttagaaaagaagagtaactttccaccccgtaaaggttgtttagtcatcatctagaaagttactaaagatgagaatggagcttatttttataccttatgatttactcaccttctatcaagaatctagtaaatcagggttagtgagaagagattaagaaaaagatcaagtaatttgctcatcattctcctagtctttcaagttttgttcttgtgttcatttgaacacaggaagactgggttttgagtctatattctcttagcatgttgtagagtcacctgcttcgagttgcattgtaatggtatattcttttatttcatcagtcatttcacacaacctctttatgaaaaccacatttcctgtattattcctttttctaaaaccatggaagcaaggaatgtcattgagattgtttaaaaatgtatgtttaatggccaggcacagcagctcatgcctgtaatcccagcactttgggaggccgaggtgggcagatcacctgaggtcaggagttcgagaccagcctgaccaacatggagaaaccccgtctctgataaaaatacaaagttagctgggcgatggtgcatgcctataatccgatctactcgggaggctgaggcaggagaatcgcttgaacctgggaggcagaggttacagtgagccaagattgtgccattgcactccagcctgggcaacaagagcaaaactccatctcaaaaaaaaaaaagtatgttcaatgatagtgaacgtaacttaattactactgcagtttgttcaattgaataatctttaatcaacatctgatgaaagtttagtcattattgattaaaatggttccttgaaaccaaactcaatgcattggatcatgtagaaaatgaaattgaattcatgaaaataggtcttttaagaagggtcacaagacaggaccctggattacacacttgtagtgcaagtaaccatggaaaggtctagttaagagacttattggcattagtttaaaaaggtttgtatattattttgtaaagtgttctccctttatgacttaaatgcctacattaattcctgtacttgtcggcatttcccttaatcgaaagatcttgagatacagacttcctcatttatggttgatattaagattttggaactatttcgacattatgtagataaaaattaccctaactgataatatgcaaacgtaaacatttttgtgtgggtcagaagcaacttttgaagagggtggcattagctgtttgtgaggaaggagtgcatttgattagttccaattttagccttgcctttgcattgtgtgtctatttaattgtcttttcaatgtcatgtgattcaaattgtttttatatcttagcgggggcataggacaaacttggtcttaatatattacgtagaacattatcagagatgtgtctgaaaatccatatataaagatattcattgtcacaatattgtaataattaaaataaaattaaaaataacctaagtactcagccatgtaatatttgaaatgtggtatatcagacattggattattatgtaggcattaaaaatcatactttttggaaatatttaatgacatgttgaaattggttactagataggtacaaaaattaggacaaaaggcatataaatagcttgactcaaattttgttatatatgtttatgcctaataaatgactgggcaagaattatgccaaaatgttaaccgtgactctcagtggtgagattgtgattggtttttattttctttctgtactttcctacaatggacctccattacttttataatcaggattaaaaacaactaccatcttatgaagaaaaacagataacaataactaagatagattgaagttgttaatggattaattattgcagtttaagagcatgcagtttttttgctgaaaaacatttaagaagtcagacttcccatcatactgaggttacttctgtgtcttttatataacagttataaagacagaacaagtttcagatcatcaaggtggatcatttctaggtagtgttaatttttagaaaaatgtcccccctttcatccatttgcccttgttttgacattcagaggtgtaaaatttttttaagatttttttacatctctgtgccttcttttcttcagaccaaagatacttagtttcttatttatcatatgacttagttttcagacccttatcattcttttcgctttcagtagcaagatcagtgtcccattttaaaagtggcaacaatatctgggtatagtgttttggatagagcctggccagtgcaattataatgaggccataatattcataatattaaggtgatccagaagtacctaaatattatataacctttaggcactgttacattggtcactgacatgaagaatcgacattacttgtcattcttcacccaactgaagagaaaaggttggctccaatgtcattgctaggtacataacataaaatgaggatacttctagactgttgactggctggtaaaggcctccatagatgtcactcatatgttgtgcctgtcactctaagctcttgacctgacatgtagcttggagacaatgtggcagatgtggtggctagactgtgaaagtgtggaaagcctcactctgggagatttcacatggtttggacattgaattgatagtgagaactcctgcatgcttttttcttctctctggactccttgagttagctgggggaaaggactcagccacagggtgacagtctaagatgatgggctgggtgtagtgccttttaatctggctaaagtaacatgtagtaaagaactttaagctttactgatttaaaatgacttcacagaagaatcaatgcagtttaaagctggatgtggtattgtctttttcttctagtcggggatatcgtggtctaaatagtcgtagattgatttttttttttcaagtttatacaggttgttggtggcagccagaacttagcgatattctgactttatgcttggctactattaatacaagataaatgtttttatttaaatcggcaattatcatgcccacattaatgggctatgcatctatagtgagagaggttctgcctaaaactgtaagttttgctaagtagggctctgaattagggtcattgtggcatattagagggacaaccaaaaggctgggggcaaattaatatactaaataaatgtatggattttgtagtactttgtattttgtttaaatagattcagaatcacactaaggtttatcattttgaagtttgtacctttggtaccttactttttaaatttcatctaggagatttacagtaatgatttgttgtcatctcatgaatcgtttctaaatttgagtttgggaatctttctggtttcttaacaatgatctttggcttgatgtatttgatgtttttgcattttatcttggcaaagtatgttgcgttaaaatttgttttttggccaattcaattctttaacctttaggcactgttattcaattcaacttgctttcctttctaaatagcccttttaaatttctaggctttgtagtttacatgattatagctcctaccttgctgcatgaaaaaggagaggagaaggccttattttgcaccactcgactctgcttccctgctcttccagccacagctgcttgggccaggatgtgggtgccacatgcagcaacaaaccttctctatacagtgtacgtgacctatgtggcatgctctgtgaactcagctgagccagactcatctctattgagttaggaagctaagatcaagagtgggaatgagaagagaatggggagggtcatgaggtagcatggagtgagggagaggccaggagtggtgctgttgatcatgggaaagctggggttaggagagggagaagctgtgaataagtggtgaagacccatccacggagggaagcatgaagcagaagacagagggggaaaaagatgttccagagtgagcgatgctcctacttggagttggcacagtttgggatgcatctcaggttcttttcctgtttttgttttgttttgtttaaagagatgggttttgctctgttgcccaggctggagtgtggtggcctgatcatagctcactacagcctagaactcctgggctccagccatcctcccaccttagcctcctgagtagctgagactattgacatgcgccaccacgcctagctttcaggttctgatctataggtgtccctagagtcttccccttctcctgatgtagttgggaaactctacaaggcctaaatcatgaattcaactgtgatgcataaaagacattcagttaactgggataattgcataatccccttttcttcaaagggtttatgcattcacatgttaacaaaatttggtgtttgtagagtagtttagctcctcagtgagtgccccaaattaagttatatctttaaaggagcagtgctctttatataaaaggtatttctgtcaaatctgtcatttaaaatatgtatactgcagcaatactacggtaaaatattagaccatactataccagtgtatggtgaactctctccatatattacatatatactataaagtatatatgtttctttttgctagtcagttaccagcattattcaagaaataatggggttattgacgttaatatgttaggtgaaaaaagtgagtgctgtccttttatgttactgagcttttatcctgcatatcagaatttcctttctctttgtcattggcattaatattgttttcatccctcttacacttctgtgggaagtttgtagacagccaacatgcagaaaggttagcatggcagataaatattttctatttttcttattgatagttacggagaatgctttgttactctatgcctctctaagtaacatgatccttgaatagatgtattaaatatcctagtgttactctctcattttatatgtttaacagttgcggcttgtcccaaactggctctttggcaggtttttttctttctttttttttaaattcattggatgtaaatttcttcctaaaaggagttgtcttttggcattttaagtagtggaaaaataaatttcattatctttcttctttctttttttttgtgaaatcaaaattatcaagaaatgtgtacatatggcttttcttcttagcatttgctacttttgttacttttgtcaccctggattatccagttattcaaattttctgcttctcaatgggcaaagtaccgataagtagggaaggagggaatttagccaaagttgtaactgacaataagcaaaatatagaggcctctgtgtttcctgcttggttctctttcttgagttcatcactaattttatgaaagaagaaaacaaaacagaaaaataaccagcttcaatttccacgtgcctgtttattctggagttaccaggaaaccttaatctccagtgaataagaacactttaaacccaaagttgtttgggtttgttttcttaaatagaacttcttcctgttatgttttcctattggcatttgtaaaacaatgattcatgtgtaaatcagtaggaggtgctctttgagaagcttcctaggttggtaggttccagagcctaagcttttcttggcttcagtcagtatgttgagaggggaaggtattaacaagatcaaggaagtgatagttttcggtatgtagttggaaagtgggtatgtgtgtcttctcatttgaatatcactttgttgtccttttcatatattaatatgatgggctacctcataatctgggaatccaaaaattatcctgccttcttctaaattccatgagaatactaaagaagaagtaattttaactttcaaagagcttttattctgaagggaaaagatgcttgtaagatggtgttagcatgcatgtgtgcaggcttcacagagctgctaaggacgccattcatgagacattattgccctccctctgagccagacactataccatgtacagttctacagagggggaagggtggccctatggcttctctcctcaagaggggcatactccagaggagaagtggcacagaagtgccatccagtgtggcgagagctttacaatggaggaaacggagggagtgatttttttttttttcccctattctgaggactcagggaagatggatttcttgggagaaagtgtttgaggtgcgttttgaggactaggtaaaaggaatttaactagtatgttgggtgaagtgaggaaaggctttgtggcacagtttctgagcagggggcagtttagattagattaagatgccttccagacctgtgactccatgacctgaatgtcctaatggagacaaaataggcatttccagcagaaagaaccaactgattgcctttgcaaaggcagaataaaggacagaggagactgtttttttctcatatagcccagaaaacagattaaaggttttacatagatagatagatagatggatagatagatagatagatagatatcacttcatctgagctagttatttaaaaattctttaagtgaaaggtttagaggatatgtagaaggatttgaaatctaaaagttaggagatcatattgtttctattcattattgatatggtttggctgtgttcccacccaaatctcaccttggattgtaataatccccacgtgtcaagggtggggccaggtggagataactgaatcatgggggatgtttcccctatacttttcttgtgatagtgaataagtctgggagatctgatggttttttaaatgggagttcccctgcacaagccctgtaagacatgactttgctccccatttgccttccaccacgattgtgaggcctctgcagccatgtgcaactgtgagccaattaaacctctttctttgataaattacccggtcttgggtatgtgtttattagcagcatgagaacaaactaatacaattgtctactcaaagaggatgagaattaaaaatgatagccagggtgaccaaacattttgcagtatagttgctttgcagcatctgacttcattagtgccaggtaagggacaaattattacttttttccactaccttcctaaatgataaatgcattcctagcaagattaacttttaactatgctttgaaacatgagttttcagctattgtgatgccatcattacattctgaatgataaaattgccaagttcagaatgacagctgtaaaataaatggcatcatttaattaagttctgaacttttgatgatatgcagtttaaaaaaaatgtattttccaggaaaacagttggaagtttcgactttgtggtttacttttggctgtgttttatggaaatcacatgaaaacttctgagaaaaagagacaaatgattcaaattttgcaagtaatagaaaattgggttccatttgtataaaagattccctgaaatcattcactatcagtttagcacactctggtattagcatttaaccaccagtatattgatgaacaagtacagaggagaaagccaaggatatttgagatccagtatcatatgcagaataaatgtaataacttttaggggcggaatttcttttctttttcttttttttttttcttttctttttttttttttttttagatggagttttgctctcgttgcccaagctggagtgcaatggcgcaatgtcagctcactgcaacctccacctcccaggttcaagcaattctgcctcagcctcctgagtagctgggattacaggtgcacgccaccacgactggctaattttttgtatttttagtagaaacagcatttcactatgttagccagactgttctcaaactcctgacctcaggtgatccaccgcctcggcctgccaaagtgctgggattacaggtgtgagccaccacgcctggcctaggggcagattttcagttgaattattaactggaattcatgttcctgttcccatttctccagttctaccgtcagccattttagtgatagtaaactcttaatctagagcaccattcttaaccccaggtacaggtttgtctgaggaacttttaaaaattattgatgctttaactagagattctgatttatttgttctgaaagtaaggccttagcattagtattttttggaaaagctcctcaggtgacattactctgtagctaaggttgggaactactgatgtgcagtatgggtaggtacaaagaaaagttgtaaattcttgttggtctctacctctgataaaaggaaaggaattacattttactcttgaacaacacagtggcgagggttgccagcccccaccccactgtgcagtcaaaaatttgtgtataattttctctccccaaaagctgaactattgatagcctagtgttgaccagaagccttactgataaaatcatcaaataacatgcattttgtatgttatatatatggtataacgtattcttacaataatctagagaaaataaaatatttttaagaaaatcgtaaggaagagaaaatacattaattattcattaagtggaagtggatcatcataaaggtctttatcctcatcatattcatgttgagtaggctgagaaggtggaaaaagaggagaggttggtcttgtctcaggggtggcagaggcaaaagaaaatctgtggtagacccgtcacagtttaaactcctgttgttcaagagtcaactgtatatgtattttgtgtatgtgtgtcaattactgatggatttaactttctgttcagtttcattctcttagagggtatactgtgagatactagttctgcactatcttaataaatatatgaaaaaagttccatggtaagataagtttgagaaatacaggcatttacagttaaaaaatagttctttcctataaaactggttgcaaacttaaatgtgctggttatttgcattttatgcatttgttacagaaatatgtaatttgtggcacttcccagtattgtttgatgaaatgatttctttttcttgctagaaactccattctacaaaattaaacaatcagtgaatcagttggaaattcatttttttcatttactgagatctgtgttaggaatggatgtgatgtagctatacaacagaggctctcttgaaaagttcctcagtgagccttatcagaagggtgagagtgtaaattattccaaggtacacaattcttttctaaaagacaactgttacctttttatatccatgctcagaatttctctgacaactcaccattgccttccaggtaaaattaaataaatatccacctttgacatcaaatgtttattatagtctgatcccttcctactgatataactttgtttcccattgcccctcaactcaagcctttctcttgtcaaccagtggtatccccaagccctgatcgttcttgactctaacagcgatacataaaaatatatccccaactagaacgtctttttttcctctttgtctctggccctctccattagttatatatttaaaagtccgtcatttggcattttctggactagcccagcctgtgatgacagttcccacttctttatatgttaaacttacatatctgtggtcactttgtttggattttcttagaaagtcaattttcttgttttgttctcttgttatgagttgatacactaatagtccaactagtttctgaatcttgaattgagacactcaaatgttttgggacctaacacattgttctgtgtatttggtggggtgaagtaactctgtagaattgtgatgttgtgggactgtatgggaccttaaagatttcctagtttagcaagtgtacaaaggaggataagacctagcatttttaagtgatttatctgagtcatatgactagccatttgttgaatctggggagaaaacccaattcaacactgtttattacactgacaattcataactttaaaaaatctgtgctctttcaagagaaattaaatttcgtatttgtctttcttaatgggaaaacacagtaaattaaatattattaaagcaataagaggtagtgctatcttgtcccatcctcctgcctccccacctcctccccaacacacaaaaagatcctatgggtgttcttaaggagctgttgtctgagatagggcctaggaagtaggtttttaaaacttgggtgatccagagcggatgatgatatgcattcttccatacacatcattgtctcctcctcctcctcctccttctcccttttttccttccccaattcatgccaggctgtcattttgaatcaataagtgaatgtaacaaataagagatgttaatactatgaagaatactgaactaggagccatgagttctggctttgaattccagtacagtcaccagctgtgaaatcttgggcaagtcatttgacaactgagcttcagttctcctgcttagaaaatggggataattcctcatagaattgatgttaaaattggttgaaatatgcactcaaaagtgctttataaacagtaaagcattgagcaaatgcgagagatgatttgattctttagagaagaccctttcattctagtgtttgcatcctctggctggggggaaggctgtgtggctgatgtaggatgaggcaccttccatatctttagttgcttgaaaaaaaccacacacagttctataatatttttggcaatttgtctcagtttaaagctgtgatcgtaacttttatttggggatactactttcttgattcttatatggggaaaaattccatttgttggtttccttttatttaaatatgtttatgtattttgcattttagaataaaaacatttccttctcgagtgaagattttttttcttttcttttgaggtggtggttaagttctcatgtaataggatagttggttgctattagaaatatgttttttcctttgttatgaaatggaaaattgtcagaaactgataggctgtggttagatgaggtttgctaccaataaagaattatcagggtaaactgaactttcatttaggatgcaaaaatatttgttttgcttggcagcatggcataaaaagaaaatccaagaaacttcttgtttcaggagctgccagttctctctgtggctcaaagaacgtttcgtgtctcagccacaagaatttgccgctggttctgatgttcattgtcttccctcctcacgcacgctttgctttcagcttttggctttacagccctttgctataagatgatgaaagtccttccagggctactcattaactttcccttctacatcttactggtatgaatagtgggagcctttcatctttattgttatgaaagcttttatagaatattgaatgcagggcactgtgttagagctctgtaaaacatgataacatagtagattctgtcagttattggctgtgagtagaggtagtttgttgaggatcagtataggtaccagtggcataacttataaattgggacaggcatggtggaccagaggggatctagtaactaagcactgtgatagccaggggaatcacttaaacaggaccagtaaggtacagaaggcctgggaatttgggggaggtatgcgaacaggaagataaagggactgatattaggaaattagaaggaagaatcttggatgtaggatgtagtggaatgaagtggattttaaagtttctaatactaaatgacagacatagtaacatctagcaggagggctgttttggaggaaaaaaagaatgtaattttaactaatacgatgacttttaagtctaggtggtaaggtttagagtaacagagcagggctggaaatagtgacttattaggaattaacttgcattccagaaattgagggttcatgtagaattgcctgtaagccaggagttttcttattcatctctttaatgttatagaaaataacatctgtactttatggtaagtaattacagagttaaaaaaaaaggccatttgaaaaaaacagcttaaaaatgtcaaataggaaatgtggggataagtgtattcttttcaaaatgtggttctgaattggactaactcaagctgcagttaaaggaaaaaaggctcgtttatttgactcttgccttctttgctttctccctgtctcaggctcctttccccaacgcctctcccctttttggtctcagtgcttctgaaatgtagacactggtctacacatgggtcacccagagttcacagacttgaaagtcctcttattcccaagagctgtgtgtgcctcatcagccttctctgggttttgtggcagggggtgatgagaaaggatgcccagaggctacttgtaccaataagagccaccgcttgttgtgaaaagagcaccaatgaggagaaagcaggcagagatagtcccggcactgggtatctcttcaaggcctctggttccgttattcgtcaaaggaggggtagaactaagcatatggtctctaaagctttgaaattcttttttcttttcttttcttttcttttttctcttctcttttttctcttctcttttttcttttcttttcctttttcttccctccctccctccctcgtttgctttcatctttttctttcttgcagttgacaaataaaaattgtatatatttatggtgtacatatttcattgtatatatgtacattgtggaatagctaaatcaagctaattaacgtatgcattacttcatataattatcttttttgtggtaagaacacctaaaatctactcagcaattttcaagtataaaatacattgttattaactagtcaccatgttgtataatagatctctgaattattcctcctaactgaaaatttttttagtgtgcagaagatccatatctataccctaagtgttcccaataaatcaaaatagtgtccaagaagcagctcacagagcatatttgttttcaatgtgagatttatgtagcacttttatatttgccaaagcttttattttcctaaattccccagtgaagtagggcaacaagaagatcatcagtggtgagtctgccatttaaatttttttttttttttttgagacagagtctcacactcacccaggctggagtgcagtggtgcaatctcggctcactgcaacctctgcctcctgggttcaagcaattctcctgcctcagcctcccaagtagtagctgggattacaggcgcctgccaccacacccagctaattgtttttttttttttttttttttgtatttttagtagcgatggggtttcaccatgttggccagcctggtctcgaactcctgacctcaggtgatccacctgccttgacctcccaaagttctggaattacaggtatgagccactgtgcccggccaaatttttttttttttttttttttttgagacagggtccttcgtctcccaggctggggtacatcttggctcaatgaagcctcaacctcccaggctcaagtgatcctcctacctcagcctcccgagtagctgggactaaaggcatgtgccaccatgcctggctaatttttgtattttttgtagagacagggtttcgccatgttgcccagactggctgccattgaaattaatccagtgtaatcttctcaaatgcagtgtagtattgagaaacggggtccagtgcaacaaagagtttatgattttccctgagcctcatccctaagatcttgttaaccaaattttggacagaaatggtaatttttcagtaagcataagataacattactttttattcttttttttctgatgggagtactgatcagtaaattaagcaatataagcttcttagaaaagattgggttggaaaaagaattgaatccacactgtagttttgttctggatttacattatatgccctgcctgtgtttactgacaacattcctcgagcattttatttgctatttggatataaaaaggtgtcagttgtataggaagaaaccaaagttataatagagtgtttgtaccaaaatgtttacctataaacaggtagggctgtcatgaaatgcaataactaatccttatccatactgaagaaagctgcattgtggcttttttacatgcaaagtcttaaggtgttataacttaagttagattttaaataaattatggactgcccttcttccctttgtgacctcttaaatctctgagaccaaaaatatttacatatgcagcttatagacatttgttaaaccctaagatggttattgcagccatgggatactcaattaactgtgcatttactcaccaaaaattgtttttgagcccactagtgtgtggcaggtactgagttgggcctttggaatacagtggtgagcagttatgacatggattctgccattatggagcaaacataaatttcactgaagaatgcagacaaagtatagagaaatgagtagatagaataattactgattataatgtgtctacgaaagaaacaacttggaagggacctattacatggtgaacacatcaagtaaaaagctcttcaatttttaaacaaaataattttgagggacagctaaattttcatcacttgctttggatagataaaaagctttcttaagtgtctatttcaactttcaaaagcagttctttgcttttccacttagaaaaacacatttaaaaattcttgcccattgaggatataattgtattttctttcaattgtctttattggaattcttttacaattcttccaaaacaataatacattccttagagctgagcctcagcaggaaaaatgaagcatctcatttgatgtattattccattacctatgatgtcaaggcagttggtaaataatttctttttatagagcaaccacaggggttgctaacagtgcaatccccaggaaatgattttgggaagctctatcatgcgatggctgctattcattatctactctgtgttggacaggctcggggttttgtttgccttttaaatcagggcaacacttgcattgtggttttgccgtcgtgcccttgcttcatgttggaatttttctaggacttattgcagattcagaggcagatgtttgtcttcctgaggttaggagatgatttggcgccatctaggttgacttcttttttttctttcctttttttttttgctttcctggaacaaacactattaccaaatacatttcaagcaatgaaaatagctcagtagaaatggtatggtggtgccttcatacccttggctattcgagtattgactagtcttagagagattaatcatttgtaattttaagttctaataatacagcgaaggttatcatttgtattttaggaaactttatagcctctgtactttgtaatggagaatgagttggctgtggggttaacaatgtggttatatagataaaacctcttttgagagattcttttttcaagaaattgtggtaaaacacacataaaagttaccattttaaccatttttaagtatacagtctagtggtgttagcattgttgggattcacattgtgttaggaattcacattgtgattcacattgtgttggaatgtgaatcacagcagtatgaatgtacctaacgttgctattttgacgtctaaatggccacatgttttcagagaaaataatttaacattgaaacatagttacaaaatatcttgcagggaagacacaatttgaaattgtaatagcagtgctgcaagtttatagtaaaactggaatagccaggtctcttcaaggccagctttgcacatttaagtgaatagtaaatagttactctaaagctggcatttagaattattaattaattggtaagtgctgaatacctggaaaatagcccagggaagtatctgcattttgtgaggtgtgagttaggctctgcactttcggggtgaatgaaaatgaacagcagctactcatggtggcttcttattcctgagttccgaaagaggctgggggtgttttcatgtactgagtactgtcattatgtagatcttagcttgtcttccctgaaatgtttattaaatctctatgtgttgtgttccagggtgtggaagagtgactttggttggttagaggaagaggtcagaatgatgagttctaggttggcattattcctggaatgtcatggaacttttcctgtaatgagttcctggtgacttgagaacatttgcaaaaccgtgccctcaacgtctagctgtgcagtcatcctttctgttccactcagccagtggtctcccaggaaagtgtggttgactgtacaacccatcattctattgcaccagtcaccaaaaacacatatgctcctgacaatatgaaccatttattattattattattattattattattattattattattattattattattattgaggcaggatcttgctctgccacccaggttggagtgcagtgatgtgatcacggcttactgcagtcttgacctcctgggcttaggcaattctccccactcagcctcctgagtagctgggactacatgtgtgtgcaaccatgctcggctaattttttttactatttttgtagagatggggtctttgttgcccaggccagtcgcaaactccttggctcaagcaatcctcctgcctcggcctcccaaagtgctaggattacaggcatgagccactgcgtctggccctgtctttattattcttgtaaacttaatgtctgcaaggtgttatttaccaaagaggtttgtaaaccagatgtctcttctcttgaacactaatgaataaaatcttgtattttttggctttctcagctaatcattacttaaaccttcagcttaaaaactggggaattgaaatccctgtggctggctagtcctctgaaggctttgtgatgatgtcactctcagatcgggacagaagcattcaagagagggataatactcttgcttatgtgacagctgtatgtgtccaagagcatttggctacattcagtgatttgatggccttgttctgattacagagctctttgctatcttcttcctttgcattgaattttgtcaaatttcccaggtattctctgaagaaagttcctctttagttgtcaatcaccacctgtccatcagagaaatcttttagctacctctaaatgtgagcttggctgggctaggttgaatgatagaattcttgtatttttagagtgaattctgaatagcagaatggtcaggacttacagtacattattttatcctttgttccaaaaaggggtttgaagtggcttaacaatttacatttagtaatacagactgaaaaataaatagaagaggaaattgttgtgaagggaaaataagtgttggaaaataatttgagaggaggaacaataagatttgtacacaacacacaccaacaggatctgagcttcctccatggccacagcagaaaaggaagcctgaccatttaggagaaccacaaggtccatgagattaaaaataaattagtggctctggaagatcacaggctttattgctacaggaaccttggaggagcttctgttaattacctaatgagacactgcagtgtgtgtctggcagaatatgtcctcaacagcacctaccctgctgaaatatggttgtttcctgttatgtgtcagtataggaaataatatagtttgctttctattgtgtgctaatatgacttaaatcagttctaaaaaagttagaaatttttttggaatatctacgatgagatatatacctgtcagtcctccatgaatttctcccagctgagttagataaggtggttatctggcctttagaatattattattgctaataattattacagtagcaccagttacaacacatagctactctttcccaagtacctataatgttttaagcatcatactagggcacttgctacagaagagatctctcaattctcagggaaaccgcgtggctttattcttattttagagaaagaaaattggctcaaagactttgactgacttggccaggtttgcctggctaccactccctgtgtgcctggccccgattcttctacctgagacccagaagttgtgtaaggaagacagtttagctcttttgagtcaactccctaaaacaatcgatccttttctcctgttagtctgtgcagcacagaaacagaactccacccgtccccgtgcctgggaagtctctggtttttgtttaaggcatgtgtatcctatacgtgccttgtggcaattccacagctggctccctttaggctccatggaattgtacatctagggccacgttagagtgatcgaaaaaactagataaggataagtattttcttgttttaactttttaaatgttcttaagcttcgaaaattgaattgaatttaatttggccaacgttgtcaggaagggcaagcttataaaaagaaaaaaataacctttcatgtaaagttatttgaaatctcataatatttctactgtgcctttttgattaaaaatttaagttaaaagcagtgatagattttgcctatcattttgattttttaagtttatgttcaaaagtatgcctatatatattttaagtcagagctggggttacttttaaataccggttcttaataacaataaaaggtcatcaaatagtattatgttcacattctaaaaggtttagtctgtgtctaaacaaaaaaaattttctttatatggacagaaagaactccccgccccaccaatacacaccctctttcttacactttgtagtaccctaggtcaaagtagggaagctcatgatatgttttaaagagggaaaaggtggccaggcgcggtggctcacgcctgtaatcccagcactttgggagaccgaggtgggtggatcacgaggtcaggagatcgagaccatcctgactaactcggtgaaactttgtctctattaaaaatacaaaaaattagctgggtgtggtggtgggcgcctgtagtcccagctactcgggaggctgaggcaggagaatggtgaacccgggaggcggagcttgcagtgagccgagatcgcgccactgcgctccagcctgggcgacagagcgagactccatctcaaaaaaaaaaaaaaaaaaaaaaaaaaaaagagggaaaaggtatgcaattagaaccagattggcattttggcaggtatttatttttccaggatgaacgtgctttcaaaaattgccagtagttgctaggcagacttcaacaaacacaaaagacatttcccaagcatctaacctggctggtttctccatttatattttgtgatcctggctcgcagtgtagtaaaccctattactatttgaactcgaaatacagaatacttctgccagcagtcccattggcattttgcggcagtcatgaagttaaattttcttcgccaggaggccagttgactaactttaaacgaaggcacattgtccaagattgtgggcagatcatttgaactgccttgaagttgaatagaaactatataaagaaaacaactccatcttgccagaagcagttgcctttttatttggtgttctcctttctgatcactgaattttcctgctgagtttatgcttattgtatctttctctttcctctggcaaatgaacagaaccctcacatacgcagttatggtcagtcctttacttaaataactttgctggatgaatttggaacaatgccagagaaactgaagaaacccttgtttttctggaatagcaattagatttgcaatgcttttttttttttttcctgaagaactgtttaaccatagatctgtccatttccttattttttgtttgttcattcgtttttgttttccactacttgtccaggccagcttttcctaagaatagtattatgccatttactaatagatgggaaatgcagactaattttgaaggctaacagtttaaaagtcagcatcttttaaatgcgttgatcatattggggcaaagtgctaataaatataattttccttccacatagagtaagcatgcacagctgggataagattgcaaaatatttatcctgacttgtagtggtagtaaatgacctatttgtttgggctaaaagtctccataatatagtaacagttttaccatattttctagtaagttatgactatcatatattctttaaaaaaggttttagggtcttgcaggctgtctgcattgtatttggatattcattacctaaaaatgagggtatggatttccttctgcatgtataacctcttattactattaaccctttatatttagtctcatgtgtctggaacattttgattgagactagcatgatatctctgtgcctcctgtatagaacttcttaggaaactcatagccgaaatgacgggagaaacaattttattttaggccatggagattcttgtgaaaaatgttaacaagtaggtagtgctgtagttgggagatatatgttctttctttcttgcctgttcctgattttttttaaattaaatactacagtcaattttagggggttgacatgctagttttaaatacaacagaaggtatttcttttcgtaggttaatattctatttggaaacatagcctttttccttctttctctctttctttcctttctgtttttaagtaaaaatggtatatacttatagaaagaaaaaaattacagaaaaatccacagcaggaagtaaagaacagccaaattctctccccaaagatactgttatacattttggaagcatctttctaatcatcttcctatggtagatatacctgcatataccactttaatttaattgtcatttactctgtaaactagtctgtattctgtttttttctaaccatcaacttttcttgttcgtaaatacagatttacaaaatcctttttagttatagtctcacatcaaaaaatatcattgttttatttagtaagaaaagtagcattaaacattcactatttgcctatagtaactattgaaaacagaatattccaaatttctactgtaagaaatttagttcataaaacattgaaagtgtattattttaggaaagagcatgaatgtcaaaataacttcgctgctttggagaaccaaaaatctttggcctttagcttatttcagaagtttggaagaacttaaagataattcatgagtttcagaagcattttaataccataaaatgctacttatctggaatccagagaaatgaatcatagtggttacagtatcaaagagtgagtgatttttttccccaaggtgatttttccacactcctaaaaaccatcatcttcacgataacctgtgtcttttcacttgtcagcacattgaaatataagacttttccaaatcccagaaccctctttggctgctcatagctacttttcaatctttttgatggggtttaaagagctaccctgcaccattgcaagaatgtgtgcttaagggatttgaagagggctttctcagaaaaaaaaaaaaatgtgtataatcacgtaaaggaagcatggctctgcaaacatgaaactagctgaatttttctccagcttccttcagtgtttagctgtgaccagaattacagagaaagttgataagcatggtccatcatctactgattttgtaagtgttgtaaactgttggagaatacactgcattagtaatgcattttccagaaaccacatatttttttctacctttatgacatgctaagttattgtcttaacttgatctggtggtttcttgccttactttaattagaaaagattttcggaaatacacatgacacaatcaactgcatttaaaaaaaaatgctttgcttttctagcaggccattaggcataagtaagggcagtgtctgctcttttgaccaagactgtctcctccggtagagcatggctgaagccgtctgctttaggagggtgtagtgttttgcagctgtagatgctgttatatataaaaatattttcacaactgccctctttgaactgtgttctcatatgtaacagattgtacacaactcagtgcttcacccttgtactgatccttcagtgttttttgtgttcacctatgttaaatgtcatttctctctgtcctttgccagagaggcttttgaatctaagccaaaaaaggcatttattatacacagagttatgttctctggcatgtagaatactcttgtatgctggccactccactcggacttagtgtattcctataaatatgtctgttgctttcaaaggctatgatatggagggaacaatggtatgtttagtgcctctctctctctctttctctctctctttctctcttacagagacacacacagaggatctcatatctttaggcatcagaacgctaaggtacagaatgcctctacactgttggaaatcctctctgttgtttgaccataatgctacttgctactcctgtcttttatcttaatcatgatgactcctgatcactctgcttttctctttcctttctgctttttcattttctcttgatagttgcactatgcatgttagtatcacatgatttgagtaggaccttgcttgttatcccataattggcaactaagattcagaatggagagccatgtggccctggcattctgaagagtgctttgaaagatctgccaacacttgaaggcatacacttctccttcacacttaatgagaggtggcagaaacttctctaataacaacagccactattacaaaccaccctactaccctgaacaccttctccccaataagaagattaaagagagaagaaagaagtacaaagtcattggtgataaaagtggtgggaaatgggtaggccccataaaggcgagtagatgatctcttgggagaaagaactttccaaggaaatctctcttaaatattgggcatgtctacaagaggaggaggccagagtttctttccctggttgcacaactgcttaagtgacagacttgttgatgtgccccaatgcctatgaaaagagacttgaagagagaattggggagaaactctcccgcagtgtagcataagtcaagtaggtatcactgaatgaagctgggcttgtgctctctctctgataacccacccacgaagcctgcctgctaggttagtaaagcccagcaactagagaccatcagatattctgctggtatcagagggtaaggagacatgggagataccgattttctcatgttagtgaagtatgcaatgggaaccctcatgggtgtcttttaaaaaaaactcttcaactcccacgagagagctgcacctgtggaggctgtcagcagccagttaatattagagaagcactgggaagcagtggaaagagaattgtgactgcatccaggtaagtaaggagatatttgctttttctttgatccctttttcctctgaatagctaatctctattggtactattccatgggctttccagatattggctcatctaatccttctagcaacatgggattacataggttctactgttgttcttttgcatgtataggaactaaggcacagaaaggtttgttacctaggatttggattcagggggtctggcttccaagaccatgctatcactaccacattgtacttgtactgccctaccacccaatattgagataaatcactttcaaatatttttttgaatataaccgtaagaaatatattgacccactacttgactcactacgtagctacataaaaataatgaaacaacatttcatgaaacaatacttatatgtaatataaccttatcattttgtcttgttttctcttacattaacgatgctagtcactatctactgaagagatgatctgcagccctgaagaagtttgaaaggagaaaagaacagtgccattcctaatgtatatttcctctctctgtctctttctccctgtcttcttcctttactccactgcctcccttgcaaacctgagtttcctgagctgttaactctagctggtcatgtggagtaggttaactttgaattaactggttatgagagtggagtgttacatttcactggactgagtttctgatactacaagtgaccagaactttatggaatcttaccttaatgttaatacatgagaaagagggattccagagagcacagttaaaaacagtgatggtgtcctatccccaccaaatgatgattattttagtgagctggttgtatcagccttcaactgtttggactatgtgaggggcttgcagtccagtcaggatgaccctgtcttcaaggggttgtgcctatcatccatggaacattggctacactattcttattcatggctcaaatggggctgtcaggattctaattccagacctcaagctactttgtgttactagcctagagtaggctttactgaaatagcttattttgctaagtcagacttgtttattactgcatttattatgtgcagcacactcatattcattcattcctccttggcttataatttcttttcaataaaactcaggctcctcgtatcctttttataagcttttcaagttaacctggagctccccttgttaaaaataaataaataagtcaaaatgaaaagatgtcttggtaggagaaggtgaaaccaactgcagtcagtctttgaaaatttacaagacatacaaatgttaatggtaacacttctgttagagtttgtggaatcatgctttttaaagaccaaaaaactactgggctccctcctcaccccactcccagcttacaaattacttttgtagacgatgaggaatgcctgccctgagcactttccaggctaaaatgattgctaccacgctctaagctttgtgaccttaattgcccatttgtctggaagttggagtaaagccagactcttctctaagggagattttggccttgttcacaaatacttcctctgcacagtgagatgggttgtctgtcttggttttatttggcatgaggccatctgcctgtgttgcgagacagtgagcagaaaagacccagcacacaccactattgtggaggacatcacccaccacatcacagactggactctatgaaaaaccgccggggaaactgcctgcagatcttcataccagcagcatctgtgcttccatcctgaaagagtggtttgctttttagctatggacaatgtgaatcctgttcagatgttgtttctctctttgcttgagggacatgggagtaaaatttgcagcccaaaatagcggccattcaagccctgtgtagtgaaattcagtgttccaatcctaacctttgttttattatttccctatcctgattttccttatgagattctctcagttctttattttatgtttttgtttcttttgtgcttttttagacacctccagtcctcttggtgaaatacatacatctagagtgctgttgccaagtaaatacagtgtgtttttaaagctttagtcttttttaacctgctacataaaatagtgattctatttgaaaataagttatttccccaaatttatagtggatgactgaaatcataacttttctagaaatcttgagatcttgttgtaagcttggcaaaggtagacatgattaagtaaaagtgcatccttttcttgagataacaggattaagatggttgaaaagtcatgttaattgctcaatagaccttgttggtattaaaatttatggaaccacccagagggccattccaaattcggtaatgaactgagatagaaagcatatttaaagttcatatttaatagttcagaagacaaaaatggagttggaggcattgatactgagaagcaagagacctattagctgggttacttaggtcattttacctttttttaaattggtcatttcatctataacatgaagaaactagatgaacataaccaatctatcatctctagagttttgtgatttatttttcaaatgcagctgaaatagaccctcaaaaagaaaatttactattattgcttggataagtaaaaatttgggaatcctgagttttgaggtccttagcggtagccaaattaatatgttaattcacagaccctcattgctgtctcttggcacagtgtctggggctctagacacagtcttttgctcgtaaatctgaacatataatagtaatttataataaagcaaattgaagaagttctgtatacacacacttgcatgcatgtgtgattacagtagttaccagaaagattacctgctcatagttctcttcttggtaagttttaaaatacccatcattagcattcaataaatatttattgttttgatttgaaattatacatcattatccacgtaacacggtcaattatataatgtcttgttgccttaccttggaattaattttcttttaattttttaaggatgataaaattttaatattgtttacctcgttaaacatttttgtttcatgattttgggggaggagattgtttaatattattactgtctagtggaatgtggcttctttttacttattttagaactcttaaacttatcttacacgtgtaatagaggaaggtaagcactgcacctagcacagaattggagttcagtaaatgttcttttcctcctttctttgaatcagtgtttgctgttagtagaagtcttcacagctagaaatctgtacacatggaggctgagcagaggtttccttgataccatgttatatacactggaacattttgggcatgcaggtgaggggtttaatcaccaacgtaagagacatacagaaaacaaattagtacaaagttattaccttagagctaatcattgatttttttatgaagtaaataagagtgtagtatttaaaagttaagttactctaaaatatgaagtatatttagctaggttgaattgattttgatggtttatgctgctgatggtagctgccatatttcacaaaagagaatgctttttcactgagatgggcagaagcaaacactgccctgattttggccaagtaaccagaaatagttttgggattcatggagctgtctccaaaattccagagatattgcatcatcttggtgggtctggtttgttttcagttcttttagaaactgagccctgctgatgggacaaatgcttgataaatcacattcacaccaagactgtggacaccaaagacagtcacagaaatttaaagcccatttcataagcatcaaactgtgcaccccacttctgaagagtggctttatttcagtgaaaatgtggttcagcatttcttcaaaatatgtgaagtttggactcaaaatagttcaacatggaaaactgctgaagtgttgtcttcatctgccatctgttcaatccacacgtcttgtttgaaccagggcagtgcacatccttttacaagtattgttctttctttttttttttattattatgctttaagttttagggtacatgtgcacattgtgcagtttagttacatatgtatacatgtgccatgctggtgtgctgcacccactaactcgtcatctagcattaggtatatctcccaatgctatccctcccccctccccccaccccaccacagtcctcagagtgtgatattccccttcctgtgtccatgtgatctcattgttcaattcccacctatgagtgagactatgcggtgtttggttttttgttcttgtgatagtttattgagaatgatgatttccaatttcatccatgtccctacaaaggacatgaactcatcattttttatggctgcatagtattccatgatgtatatgtgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaggaattgccacactgacttccacaatggttgaactagtttacagtaccaccaacagtgtgaaagtgttcctgtttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcgcccactttttgatggggtcgtttgtttttttcttgtaaatttgtttgagttcattgtagattctggatattagccctttgtcagatgagtaggttgcgacaattttctcccattttgtaggttgcctgttcactctgatagtagtttcttttgctgtgcagaagctctttagtttaattagatcccatttgtcaatgttgtcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctccatatggctagccagttttcccagcaccatttattaaatagggaatcctttccccattgcttgtttttctcaggtttgtcaaagatcggatagttgtagatatgcggcattatttctgagggctctgttctgttccattgatctatatctctgttttggtaccagtaccatgctgttttggttactgtagccttgtagtatagtttgaagtcaggtagtgtgatgcctccagctttattcttttggcttaagattgccttggcgatgcgggctcttttttggttccatatgaactttaaagtagttttttccaattctgtgaagaaagtcattcgtagctttgtggggatggcattgaatctgtaaattaccttgggcagtttggccattttcacgatattgattcttcctacccatgagcatggaatgttcttcaatttgtttgtatcctcttttatttcattgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgaaatatgtcccatcaatgcctaatttattgagagtttttagcatgaagggttgttgaaaggagctggttttttgaaaggatcaacaaaattgatagaccgctagcaagactaataaagaaaaaaagagagaagaatcaaatagacgcaataaaaaatgataaaggggatatcaccaccgatcccacagaaatacagactacccatcagagaatactacagacacctctacgcaaataaactggaaaatctagaagaaatggataaattccttgacacatacactctcccaagactaaaccaggaagaagttgaatctctgaatagaccaataacaggagctgaaattgtggcaataatcaattgtttaccaaccaaaaagagtccaggaccagatggattcacagccgaattctatcagaggtacaaggaggaactggtaccattccttctgaaactattccaatcaatagaaaaagagggaatcctccctaactcattttatgaggccagcatcattctgataccaaagccaggcagagacacaaccaaaaaagagatttttagaccaatatccttgatgaacattgatgcaaaattcctcaataaaatactggcaaaatgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcagcaacccttcatgtattgttctttctttgtcccagcttgacctcagtaaaaaatatcatcctttaatcatagaggctctaataagttcagttctaaaattttattccctaagttccttgatctgagaatacaactcaattacttcatgtttttacagccagctgaaagaatttaaatgacacctccatactctaccagcggaacttccgaccttcagtaaatcacagatggttaattttatctcggcataacagtttataatcttgacaatgtctccatgacttagaaggtcacacactggttggacatctattaggagattgacagtgacccagtctgggatttgcttgattattgaggcacttctaccttctgcgctagcctccctccagccccatctttctccattcctctatcttaagtaggtgctgttgtcaaaatgagctgctagcttctcctcacgtgcgccattccatctacctgaatgctctcctactatccctactcttgcctgggcgagatgcattattcttgaaaggccaactcaaatgccatttttttccatgaagtctttcttcatcacagggagctggaaatgatcactgtctattgaaatgttctgtgttgtagtgcaccatcttctcactcattggcgtttttgtctgcatgcatcactgctctgcattataataggtgtgctatagtcaggtaaaggtaaggattgctgtttttgcttttttgtatgttcctgaggaacgtgcactagtagtttttgtgtatctcagtaggagctcagtatcattgagtgactgaacattcccttgattgaactggcaccacctgcaggtacactgtgattgagagtagtaggagtggtctggagccactcaagttaccttagggtaggaagatttttctgaaagtgaaattgttttgtttacatgttaatttaaattcttgcttagttaatgtattttcaagattcaggattcaaaatgtacaaaggggtatatataatgttaaaagagcttcagtctcctttctttgcctggcatgtacttaacatttccacttttgaatttgcttttaactttttgaatttttgttaactttaaccataaatctagaaacttattccaattgatatataaagatcactcatatttttttttcttcttgctgcatattacatattattacaatgtgtggatatagcgtaaagaattcaaccagtccccagttgatatgtcttcagttgtacaactatttattgttagaggagtgaattttcaaccatttgcaaaactggaggaggattctgtactcttctcagtgtgtcaccttaggaaaaattgtgtcaatctgtccttccactagtggtaactgtgattacctaaccaagttggtgaatgatgagttttttcactacgacaccaccattatcccctttgtaattaattagcaccttgtgcagagatgttctcatattatgccaatttctgttcatcaagtcttcacctacaagccggagctttcattaacagctctctgcttttttttgagacagagtctcagtctgtcacccaggctggagtgcattggtgtgatctctgttcactgcagcctctgccatctgagtttaagcgattctcctgccttagcctcctgagtaggtgggattgtaggtgcacgccaccaagtccagctaactttttgtatttttagtagagacggggtttcaccatgttggccaggctgttctcgaactcctgatctcagtgatccacctgcttggcttcccaaagtgctgggattaagggtatgagccactgcacccagcctctctactttttaaatgtagattaccactatgatagttgccaaatggtgattaattttattatgccatctgtgtttgttacttagcattgtataataaagagcgctcttttattccctgtttatcaaattgtttattcgtttaatgggtttatggacttccattttattcagtggataaatactggataatggataaataatatcagtatttgatgcccaaattgttccaaatttggccagtaggagacctttcaggttggcttctgtgtccttttgacatgctcccatcattcctggagcattttcctggtttctggcacaagcagatgttccaggttttttcttgtactttctgtgccccagctctgatcctttttgtgtagtggaggatggcaacaagaagtcatgatctgggcctcagtgggttaattggcactagagtgtaattggttctgcaccctcccagcagatagaactaggacatgtatctgcatgtgtatgaatgtgtgtatgtatacacgtacgtatatctatgactaattctatatgtgtctatataacttttttaaaagagttcattctgggctattaaaaagtcaaaaaataacagatctggtaaggttgttgaaaaaagggaacgcttatacactgctggtgagaatgtaaattagttcagccattatggaaagcagtttggtgatttttcaaagagctcaataccattcaacccagcaatcccataattgggtatgtacccgaaggaatagaaatctttctaccataaagatgcatatgtatgttcattgtagcactattcacaataacaaagacatggaatcaacctaaatgtccatcaatggtagactggataaagaaaatgtggtacatatacaccatggaatactacacacccataaaaaaagaacaagattatattctttgcagcaacatggatggagctggaggtcattatcctaagtgaactaacacaggagcagaaaaccaaacaccatgtattctcacttataagtgggagctaaactttgagtacacatggatgcggcctaactgagggtggagggagggaggagggtgaggatccaaaaactacctaattggattctatgcttattacctgggtggtgaacttactggtacacggaacgcgcatgacacacagtttacctgtataacaaacctgcacatgtacccctgaaaccaagttaaaaaaaagactgtctttcagaatttctgggaaaattttatgtcaagtgactgataaaagtagaagcccagaaaatagtagttattggtgaaaatttcagagagtaaaataaaaatctgagaaacagaagcacttgagaagaaggtaaaaatatattattatagcaacaaagtaacagtactaatactgttattattattatactgtgctgacatgtagtattatattgtgctggcatggaggtagttttgtgtggttcttataaggaggattgtctaaaaaggactctgagagttctctctgaattgcctaaacaatgagctagttagcactggggcttaccccttctcctagcaagaagagctcctcattgtcagctgcctgtgggtctaggggccctttgctccagcagaaggtgctgcagtgagccacaggactccaaatcaccaggtgctgagcagctaatattcccagacagcccttataaacagcagcacccaaacctggagtacttggtgctcaagtagtgtatttgtcttctccccgacaacacaggcaattaacaaggccaccttcccttgtttgtcaaataaggagagtatagtaataggggacacatttcctgccctaaaatcatttctccagcagcataccctggccctggatcacctctcctcaggaataatgagagatttcaggattgtgtatcttcttttcttgctgtgactcttgttttataaatttcctgaaaaaagttcattccttaacccattaaaaaaaaaaaagagttcattctgatagttcacattctaaccaaatactttagtgtacttctagcccgtctcttctcagaaggtgagaaagctggtttccaggatcctcagtgtattaactttatgcctaattaattagttaattgtgctgaacataaccagtattccaactactcaagactccttctgacatctttgtaccctcccattacctcccttccttggctaccagtctcataggactgatgcctctgcctggcaactccaccccatcccattgcacctcctcaggaggagaggagagaaaagggaaagagaaagtcaccccaggcgacttcatgtgctgccaaggttgaaagccactgtatttaacatttacacacattatgtctctttaaatatttcaaagcctagatgctttccacatggagtagtagagatttaagaaaagtatatttttatcagcttctctttttataatttgtccatttctcccacaagtggaatagagaggtaagttctcattaattgtgaggctgtagtggggtgttgatggctggattttattcgaatgttttcatttcctctgtggttttagggcagtggttttccaaatggtctgatctagtgcattggtagcaacctgatgctgtcaggttttttaagggggaagattcttattttcaaattcgtaattttttaaagggctcgcatatcgagcttgaatttttttttttttttttgtccctgaagttctctcatgccaatccttgtttctgcttctttgctcaattcagaatactggtattcagttagttccatgtcatttctctctggagtttagaaatggcattttaaaggcatcaggcatcccctagcctaaccccacctcctttaggaaaactggaaggagaaaaggtagagggtcactggcctagattataaaaatcaaagcaccaaacctgattatagtcaaaagaatcctaagagtgatctgaagctaaattccatggctgtgtgattcatgatgatctaagacctttcatctgtttttcattttctgaagattgttaagttggttgctattattgacaatgtttaggtttaaacaattagaattaaggtatagagttacctacatatgctgtgttcgggttgtgctcatttgttggcacaagttgattctgcaaaggttatgtggcaaaagtttaatttaggtcatctcttgcatagtggaaatagctgaagtcattggaggataacagtgctttaagtaaatttttacttaaaaatttgattaagtattattgaatttatacttcaaatctgatataatttggcttttaacatatgaggcattgaaatttggtatagttttaaaagatgaaatcaagaaagtaaaatcagaaaaattcgagtgtaggttgagaaaaaattggaaaaatatagaaaactatactttttaaccttagaactgtcacattttggaatttaaaaattgttatgaagaataaaatgttccatctcttatgttctaaatttccatgtattgtgttttctctgcagtgaggtcctttgagaggcacatatgggcgtgcagttccattctcttagtgtgtgcctgtgtattgagtagcacctgcctctggtgtacttgaagaaaacttaagtggctatagaattagtagtccctccaggccaaaatacaaatgacacatatcttggacatcttctactagaagaatataaaaatcccaatggcctttaaaaaattagaataatgttaaaaaacacaatttataatttcgtttctaaaattatctgaaggaattggaaggatattccatttttaaatgcccaaatgaaataatccttttaaacaagggttttccacccatgatgaaggaggttaaattaaaaacttaactaaaatgagaacaattgtgttgttctttagttcttgcattaggaatgtgaaaccagaagtcagctaagtctccatagcaagcatctgtatttacaagatgagtaacacaagtctgaatgttgcgaaagctctcgaaaggtgaaaaaagttcagaatatcagacgttttgactagaaactctgtcactgattatctcgtattacaatgagaagggcatgacatgacccctgattacttttacacctttcttgcttctgaatccttgtttttgaaacataggaaagaactattttgttgacaacattgcagtttcatatagttcatcctaataaatgtataacaaaactatcatgagataatataggagattttgtaacaatctggtaagaaaggaaaagtattgcgagttctgaacattcagttacatgtggaaaacttgtataaagtgaatttattgcatttgttgtcatcacttttctgaaaaagagaactcttgcaactaaaataaaattcttttttatccagtgtctagaatagtacctgccacactgtaggcactcaataatgttttgttgaataaataaatgaaagatgtcatttttatttgtagttggctttgaacatccaatttttttctttttctttttctttttcttttttttttttttttttgagacggagtcttactctgttgcccaggctgcagtgcagtggcactatctcggctcactgcaacctttgcttcctgggttgacgccattctcctgcctcagcctcctgagtagctgggacttcatgttcatgccaccatacctggctaatttttttatttttagtagagacagggtttcaccatgttgaccaggctggtctcgaactcctgtcctcaggtgatccacccacctcggcctcccaaagtgctggggttacaggtgtgaatcaccacatccggcccaatttttaggttttatttaacagacattttcttcctcccaacttctagcactggacaacctctggtgtgttttctctttcttttccaacatgtcatttaaatcaggggtccccagcccccaggctgtgcactggtatcggcctgttaggaattgggtcacacagcaggaggtgagcggtagccaagtgagcattactgcctgagctccccttcctgtcagatcagcggcagcattagattctcataggagcatgaaccctattgtgaactgtgcattcaagggatctaggttatgcactccttatgagaatctaatgcctgatgatctgcggtgggacagtttcatcccgaaaccatctccctgcccctgcattcggtgaaaaaattgtcttccatgaaactggtccctgatgccaaaaaggttggagatggttggtttaaatagaatcatatgctatagtcttttgtcttcttttatttattaaatcctttgagattcatctcatttgaggttgttgggtgtgtcagtagttcattgctttggttctgagtagtggtctattgtatgggtatatcacattaaaaacattcattcactagttgatggaatttgagtcatttttaatttaaggcttttatgaatgaaggtgctgtaaaatgcacatagaggtctttgtgtaaacatatattttcacttcttttgtatgagtgccttggagtgtaattgttggctcatgtaagtgtgtgtttcactttctaagaaagtgccagattattttctaaagtagctatgccatttcaaattcccaccagcaatataggagagttttagttgtttcacatccttgtcagcacctgttattatctatcttttgaaatgttagtcattctggtggatacttagtagtttctgattgtggacttatttgcatttctctgagaaccaatatcgagcattttttaatgtgcttaatcattgtttcctttggtgaagtatatgtttgagattttgctaattttttattggattaaaaagcattaagagttctggatataggttcttcataagatataggttttgtaaatagctttttcctcagtctgtggctttgttctgcatttcagacatttttcattggattattttatagtttttatgtctctggtaaaatttccctttctatacagacacattgataatatttttcattagatccttatattaattgtagttattttaaaagttctatctgatatttacaagtctgggccatcttgaggtctatttcatttgactatgctatctgttgatgataggcttgtgggttttttttttccctccacttttgtgtcttgtaattttttattgaatattggtattgtgtgttaaagagcaatagtctgtggtaaataaaattaatacccacaatggttactttttttgtttcttcagttcgttaatataggggagtgtgtcagtagtcagtattgtcagcagttgagctgggtttgaattttgctgttgctgtagttaccttgagtgcaaacagacttcagatttctccagtggtggatggattgctgctgctacattgagcttaatatgagtcccggagtgtggtacagttttctgtgttcctgatctacctttggctttctgccagctctgtacagctgtgccacaggggtctgtgttattgccacttccccagtagtagactactgcttgttattacttggtaaaaagttcatggaagggtaagtgggtggtttggtagtctgtcacttcccagcctcagttttagtcaggtcttgtgtgccgaagcctcaggaaaggggcattctcagtgttcccacctctctcaaaaacaaccatttttgaaatctgcaagatcaattttaatagtatcttgttcccttaacatacttttgataacttctcttgtgtttttaagcataagtattctgtataatattattatagtgcctgcattattttagtggtctttttctgttgactctcactaatcatggcttttcctctcatatctttggtggtttgattgtacttgttgaagcccgtatttaaactccttggcctcagagagtatttttgtctttatctgcctgggaatacagccataactaaatgaatctgttttgctttgttcatgaattctatcgccaatagtgcataaatacaatcttgtgtttaggaattcagaggagagaggtttttcattccccttgcttcaccaaggcaaaaccaggcactcatctacactgtgaatcactaagggaaagttttattttatttcatcttctgagactttatgtgttttgatctgaaatttattttctattctttaaacattttttaaaacccacgctgtagaccaccaggtattagtggacattttgctggcaaatgctggctctagccctaatttacccgtctatttctttgttatcatttctgatctctaatgaattttataaccttgcaaaagtatggttttatattttactcagcattttgagatattttctgtttaaacatgtatagtcggtttcatctgaacatccagtttaccctcttgctagacgtacaagttccttatgttctcatacttctggccaagcagttgatatattatattggtaaaataaaaacttcagccaaattaaatttaaaggagcttaattgagcaatgaatgatttgcaaatcgggcagtccccagaatcacagcagattcagagactccaggggtgccttgtggtcagaacaaatttatagacaaaaaaacgtaaaatgacctactttcactttcagaagtgaggtgcagaaagagtgagattggttacagctcggcatttgccttgtttgaacacaggttgaacattcagcagactgtgagtggttgaagtaggccactgagattggccaacactcagctattgtttcaggtgcatattactaagttaggttttcaattttgtctcactgttaagctaggttatagttcatctataaggactcaaatatagaagtactgagtccttctcaggccatatttagtttgctttaacaatatcctaattatgttcttttccttcagccagcattttaattctaataggttgctgaatgtgacttttaatttttgaatccttatccaagcacacagaaggtgggaagaagtgtgatgtagtataaaagtgcttggatttttcattcaagtgtatatatgctggaaatacaaaatcagcatttattagctgtatgctcttgggcaagttacttagtgtttgaatctctttcttcacctgttaaatggaatagtgaggccttccttttatgggactaaagacagaaaaccaatctacctaaaacctcctaccttgcatgacccctcccaccatgcatagtagccattcaattgctgatatggcactctttttctctttcttaattgaattatttaggatatacttgttttttccttgagttcctccctggaaacaactttaaataagatactaaaaaatttcagctatttgctcctatttaacttgtctacttaatatttaaattcctttgataaatatattagacataatgggttattctcacttttcaataatgatctagatgaaagaggcttacaatttggtcagctagaaggaaaaaatttcaatttagtgccactgacagttttaaggaaggcaaattacttaccaaactaggatttcattttattttcaaactaattactgtgtgtttgtacctctgtagattatataagtaggctccagaagaaactacttgcttattcttcttggccttttagtccttttaaaagctaatttgtaaagaatgacatgtaagtttagatatacaatttctcatagctattaatgatatttctttaccaaactatgagaacacagtaatgattttttaaagtgaaggtatgaggtatttgagggaattttatgaagtctggtcccatttgttcactggaattatgaaaaaaatatagcaaaagtagaagtctttggatactcttataattcttagggaaggtagttttaaccttaattctcagggttcaaggaattcttatatttccctttcaaaggtctggatggtgttaccaataccaaaacacacttttaagtactctttttttttggcagctccttttttcttaaaccattctgtggaattagtaaagaacagtgaaattggataaaggcaaaggcaatagggtagaggggaggaagtaagcctgaacatctattaccagtctctgaaagatcaaatttaccttttaaagtaactacagggttcacttgagtctatttattttgtctatgaggaaatagagtgtcagagagatgacatatctatatgaactaatagctactccttggagaagccaggactggaggatgctcctaactcatagctaggtgatcttaaatctctctaaacttccttttcaaatgttaaatggggagcatgcctgcttaatcaggttaagtagattaagcagaggtaaagcacatatttatgaagtgttcatggataccagatgttcaataaaagtttttttcctttgtctcatcttggcttactgtaaattttttaaaaaacataataaattaaaaattggtagtaaacagtttacacagaatgaaatatttcacggtcatccggcttttaagaaaatgcatagcatgcaaactggaagcaaaagttctttgggaagagtccttgagtcatttgaatttggaaaggaaaggaagttttacgtcatctgtagatgctctgatttcagttggtgcattattgccttgggccaggtgcaccaatttatacaaaaagtagttttaaaaacttttcctctccatttcttttatgaattcatcttgtgtgagcttttgatcctcactgaatgaccttataaaataaagggaaaaatcaataaagcttaaaacttatacttttcactcaatttttttttccagatgaattcacagtgctctgaatctcacctttaggtttgaccctgactgaaaaacatctcaaaattttacttttgcacaacaacctgtatcccagtaatcatatttgagctgcacttttacttcatttgcccttttaaagaacacacattgcaaggattgcatcaatttaaatggacatagcatgtgactagaaattatcttatttgggaaaagtgttttattgataacagagagttctggtgttggtttactcatttgttgatgatcgttacttcattttgggccagttacagtaaaccagaacctaggaacttgcaaagccagattatttttccttctcttctactaatggtgcatctagttcagtatttttcctgatcagattaaagaaaaacttagaaactcaggagttgggaccagccttgagctcacttagctttttctccctaccatccagccccactctgtctttaacagtgggaatctaacaagaaatagtgcctatttgagggatgtttatttgaaggattaataaacatttattttgaaatctaaaaggattgtaaaaagtttttgagcagttaaagcccatgtttttactgtagtttgtatagtaagagaaactaatatctaagaatatttcccagattatttgttaagaataaaaccttatctactgaaaataagcaataaaatatagtttcttaggtagtgtatatgaataggcaattaaaatacttgtgctactaaatgacagttcttttttttttaaatatacccagttgagcatctcaaacctcaatccaaaatgctccaatgagcatttcctttgagcctcatgtaagcgcacaaaaagttttgggttccaaaggattttggattttggattttggacacttaacctgatacgtatacaggaatgcttgccatttaataaactctatgtattggttgagaatgatgagagtctatttggagcatctgaatttgtagttggttttgaaaattcaaattatgagttttaattaaaaggacaatttgacccttatattttgaagatgaatttttagtaaaatttaactaagcttttaataaattgtagttgctaatttttgcaaagaaagacctggggtgtttttatgtacaaactattgtatttgatagtggaaattaaggctagaaacaatattcctagggaaacatgcaaaaatacgttgagtaacataatgtgacatttgagatgccagtgatagttatctactataaaataggtcccacatagctgccagagtataaaaataacaaaacagaatcccttaaaacgttacataattcagaataactgttattttccctaatgagctagaactttacccatatatttttttctgaattaacatggtgttaaaatatttctgtttcactcttttgctgcaaagtaaatgttttgggcttttgataatgatttcaaacggcattaaaattctttgtcattgcattgctcacaaatccattagtagtaaacattcatgaattcttaataaaagtgaagatgtgaaggaaaggaagaagaatgtgctctgtttatgttattgtaaagttttagatcgtgcttttaaagaaatgcagcttggttaaagtttttttaacattctaatgggaaaatgcacaaaagttgagataattttgcatggaataccagatatccactacctaaattctaaaattatttttaaaaatatttgctttatcacatatccaatcttctatctgttcatcaatccatcttattttttgatgcatttcaaactaatgcgcagaaatatccctacacttcacctcatcagcgtgcataccaattactagtgtcaatatttcttacatagcttttttgggggtggttgttgttaaacattcataaagtaaatgtagcattcaatgtgtttctacaaatgtatatatctatttcacccaaactcctatgacgatatagaccattattatcacattatcatcctacgccttccaaaaaactccactgaatatcctgtccccatctgccatggcaacaaaaatacccctatggcactagggcaaagtgagtaaatgtgaagaagagaatactggcaggactttgggtctgatcacatgggaggagtcagggacaggcagtggtcaaggatgacactgaagactgtgacttgaacagtagagggaatggcagtgccatttactgaaataaagacttgtggaaaagatatacatttagatgagctcaattttgaacattctgatttttaagttcctgtgagatcatcaaatggaaatacctagcaagtaaaagacttgtttttggcatctttattcatgaaagccaaaaactgaaagcatccaggtgtccatagagtggataaacaaactggtgggtttcatacaatgtaaccatactcattaataaaaaggaaggacctactgacacatgcaacaatatggatgaaacctgaaaaagcgttatgctgggtgaaagaagcctcaccccatagagcaggcactgtatgtttccatttatatgatattctagaacaagcaaaacatggctctacgtggtttgccttctctctcgtcttccctttttcttgtctttctaaccacatggttttgcatgaccctcgtccttcccatgtaaggcggtttccctctgccttgtctctttaatgagatcattcccatttctacagagtcatattctagtgtctccaagaaaaccttcttatattagttgggattagaattgtctgcagacatagaaaaccaaagcaaaacaaaataaccattgtttaaataagttggaagggtatttgttatgaaaaaactctgtagcaaggtagtccaggtctggtgtggtggctgttttccagagacctcagtaacccaagattcttccacctttactgttcccatctggagggtatggcccttatcttcataatccaagttggaactgtggatatcacagtccagttggcaggctggagggagacacaaaagacattgacaagctgaatgatgagatttcttagaatctgctaaaatttccctggacagaacttagttatgtgccttgggtgttacctgtcttcaaggaaggcagggtacttaagtgtccatgtgtccagctaaaaatggggttccaattgggacaaattggaaattagggtgggctgcttaactacttccatgcttcccttgatttcacattatcctccagccattgtcctgtttctctgctgcttgttagaattgatacttcttgaaagagttatctactcataacattctattatacttcccaaattgccttgttttttcaactcactccagcttctgcactcactcttccatgtaaatggctatcaagggtacccatgatctgtttcaaaatgtaagagatactttaaagttctcatcttatttggtttctcatcagcattcaattcttttccttttcttgagattccctgtaaaaggaacagcctcgagtttttcatttgtcgtctatgactttgttgttgtctaccaccattctggaagctcgttccctgtcatttttctagcatttcctgttctgtgcagtgtctaaatgttggaattttttaaggtttagtttttattgtggtagcatatacataacatgaaatttaccattttaaccattttaaagtgtacatttcagtggcattgagtatattcacattgttgtgcaaccatcatcaccatccatctccagaactttttcattatccacaactgaaattccatacccatttaacaataatcacccatttctccctcctcccagtccctagcaaccaccattctactttcttctctctcattcagacttactggagtaagtctctcagtagatttactttttaaattctattcactattatatacctaatgcttaacataaggacgggcacttatttagtatgcagtagatgtttgtgaattgagtgaatgctaatctccctggcatgttttgtgttaccccatttgatggaaccatgcttcatattgcagcttagaaaaggtagccttttctgattattagactagttggggtctgtatgtcagatgatatcattgcactttgtaaatttttcatgacacttaactttgtaattatatatcggcaagtggtgtttgacagtttgtttccctgtatgtactataagcctcacaagagcagggaccaaggctgtcttggccaccatcctttccccggtgggaaatatagtctcacactcaccttgttttataaatgaatgctcagtgataaaaataaacctctttaactggttacatttcctaatacctgaaaactgtatgccattttattctttgtgactaggtgttggaaattgaggttatattgagggaatttgaatttcttgaaaccagagtttggaaagtttagtggtttttaattggatcctctttaaatgttgagaagctaaagattcaccaggggaaagccattttgaaacttttactataagaatcacatgaagaggtctgatatattgccaaatctaattctgcactgttgcagatgaatgcaatcttaggacatctgtgtgtttgtctttctagctctcccttgtgacatcattagtgcacttaagcctccagagtagcttctttggaaattttcattaccaattaaactcatttttgaaatgtataaattctttgaatattactaataactttttataggctccacatttttttcctatatcaggaagatttaaaattacttttgcagaaacatacatgtagagtgcagtaggtattttctaccatgctgtaccaaattcaatagggtaacaatttttctggcatcctctgggaaggaatcagttccaatatttattcaggaagtattattgaattcctaccatgtgcaaggggatttacatataacccttgccttaggcttaattggactcagttttctagcagcctttagccctgtgcctccccaccaaatgctttagcctgtaagacaggtgctggactataaagctgtctgttccttcttcctaagatcaaaatccagctagttataaaatgccgtggagcacaagcttttatgattctggtagtagcaccatctactcactttgagtattaccacattcttgttatttttttcatttttattttttgtgattgagtctccctgtgtcacacaggctggagtgcagtggcacgatcttagctcactgcaacctccaccccctgggttcaagcgattctcctgcctcagcttccccgagtagctgggactacaggtgtgtgctaccacgcccagctttttttttttttttgtatttttagtagagacgaggtttcaccatgttgagctaggctggtctcgaactcttgacctcaggtgatccgtctgccttggcctcccaaagtgctgggattacaggtatgagccaccatgcccagcctatttttcttttaatctatctcaggtaaacactcaagctaatagcttgctggttgtatttgtcatacaagttatgttcactgtaggccatattgtgtttgtctgaataatggttttgaaataaatcatttagctaccaacattttagaattaaggagatttacataccaatttggttttgtagcttctcttggaaaatctgaatgtctggctattttgtgccagcatttgcacgtgatagctggagctggtgtttgcaagcttaggcagggacagtccctatcctatttgctgcacctctgaccactctttattatttccctgaaactcagatcaagtgtcagttaccatttatccttgtcattgtactattggtttttttttttcgtggtagagtgaaataatttttgtaccatgtctgcaggtcaaggggaaatattagtgaaggggtgttagtgaatgccaagaaaatgagacaatatatttctttgggcaaatgagtaattttcctgtgtctgtgtttttcttttgtggaacatatatttatgttaaaaccatgcacttctgcccattcattcctcactgttctttctctggcttttctagacatctgagtcaggcactcttgattagatgcatgattgtacaaaaggaaagtgattctacctgagggccgcttgaaggaccaattcaaatagagtagtaatacatcataactatcataagaggtgatatagcagctcagaggaaggagagattacgggaatcttgatgttgcttttatagttgctgttgaacaacatgtagaaattcagcagcaggagacagtgggacaaaaggacagtttgaataaagcaaaaaaagaaaaaaggaggattgggtgaggataggacagtggctagttataagtagggagctctgagagaagtaaaacttaagaggctggttgtggcctggttatggatagtcttaaatgttaggctgagagacagataacagttaacctctgagagatgttgtaattaggggagggaaatatcaaattaacgacttgtatgagaaaaggctggatgtgccaccatcaagcatgaaatcctctgtgtaagtactcacggatggtaattatctggatagaagattgtcttggattatggacatggttttggagagggaattgctaggtctgtgcaacttattagatatggttgtggtgggggttgaggacagttggaggagaagctgggagagaggagagaacaaggatttgaacacagatatctgaggagagcatggaaatcaaaaggaagacctggtttggaaggagtatccaataggatgcatttagcctcaactaacaggctggcatcaacaatatgcatgtgtattggctcatattactgaaaagtgcagaagtacagtgggttttggaatagttaatcaagaagttctggaagatgaatggataaagaaattgtggtatatatatataataaaataatatttagccataaaagagaaggaaatcctgcaatttgcaacaacaagggtgaacctctaggacattatgctaagtgaaataaaccagacatggaaaggcagataccatctgttatgaattatatgtggaaaataaaaaaaaatcaaacttacagaagagggtagaaccatggctgccagtggggtggaggaaacggtgaaatttgggtcaaagggtacaaactttgaattataagaggaacccagttctggtgtacagcatgagtggcgatggatgtgttaattaattagattgtgataatcattacagaatgtaaacatataccaaatcattattttgtacaccttgaatatatcccatctttacttgataattaaacattttaaaatttaaaaagacatgagggattcctgggcaagatggctgaattagaatagttctggtctgcagctcccagagagactaacgcagaaggcgggtgatttctgcatttccaactgaggtacccggttcatctcagtgggactggttagacagtgggtgcagcccacggagagtgagcagaagcagggtggggagtcgcctcacctgggaagtgcaaggggttggggaactccctcccctagccaagggaagctatgagtgagggatggtgctatctggcccagatactacatttttcccactgtcttcacaacccgcagaccaggagattccctagggtgcctacaccaccagggccctgggtttcaagcacaaaactgggtggctgtttgggcagacaccgaactagctgcaggagtgttttttcataccctagtggcacctggaactccagtgagacagaactgttcactaccctggaaggggggctgaagccaggatgccaagtggtcttgctcagcagatcccaccccgatggagcccaacaagctaagatctactggcttgaaattcttgctggcagcacagcattctcaagtcaatctgggatgctcgagcttggtagggggaagggcatccgccattactgaggcttacgcaaagcttctgtagccagattcctctctagattcctcctctctgggcagggaatctctgaaaggcaacagccccagtcaggggcttatagctaaaactctcatctccctgggacagagcacctggggaaaggggtggctgtgggtacagcatcagcaggcttaaatgttcctgcctgctggctctgaagagagcagcggatctcccagcacagcgttcaagctctgctaaggggcagactgcctcctcaagtgggtctctgacccccccgtgcctcctgactgggagacacctccctacaggggtcgacagaaaactcatacaggagagctctggctggcatctggcgggtgtccctctgggaaaaagcttccagaggaaggagcaggcagtaatttttgctgttctgcagcctccgctggtgatatcgaggcaaacagggtctgcagtggacctccagcaaacaccagcaggcctgcagaagaggggcctgactattagaaggaaaactaacaaatagaaagcagtagcctcaacgtcaacaaaaaggacaaccacacaaaaaccccatctgaaggtcaccagcatcaaagaccaaaggtagataaatccctgaagatgaggaaaaagcagcgcaaaaaggctgaaaattccaaaaaccagaatgcctcttctcctccaaaggagcacaactcctcgccagcaaaggaacaaaactgaacagagaatgagtttgatgaattgacagaagtaggcttcagaaggtaggtaataacagactcctccaagctaaaggagcatgttctaacccaatgcaaaggaagctgagaaccttgttaaaggttacaggaactgctaactaaaataatcagtttagagaacaacataaatgacctgatgcagctgaagaacacagcacaagaacttcgcgaagcatatacaagtatcaagaaccaaattgatcagttggaagaaaggatatcggagatggaagatcagcttaataaagtgtgaagataagattagagaaaaaagaataaaaaggaatgaagaaagcctccaagatatatgggactatgtgaaaagaccaaacctacgtttgattggtgtacctgaaattgatggggagaatggaaccaagttggaaaacacacttcaggctgttctccaggagaactttcccaacctagcaagataggccaacattcaaattcaggaaatacagagaacaccacaaagttactcctagagaagagcaaccccaagacacataattgtcatattcaccaaggttgaaatgaaggaaaaaaatcttaagggcagccagaaaaaggttgggttacccacaaagagaagcccatcaggctaacagcaaatctctctgctgaaatcctacaaaccagaaagagtggaggccaatattcaacattcttaaaagaattttcaacccagaatttcgtatccagccaaactaagcttcataagtgagggagaaataaaatcctttacagacaagcaactgctgagggatattgtcaccaccaggcctgtcttacaagagctcctgaaggaagcactaaatatggaaaggaaaaaacgggaccagctgctgcaaaaacataccaaattataaacaccatcgatgctaggaagaaactgcatcaactaacaggcaaaataacgggcaaaatagcgtcataatgacagggtcaaattcacacataacaatattaaccttaaatgtaaatgggctaaatgccccaattaaaaggcacagactggcaaattggataaagactcaagacccatcagtgtgctgtactcaggagacctgtctcacgtgcaaagacacacatagtctcaaaataaagggatggaggaagttttatcaagcaaatggaaagcaaaaaaaagcaggggttgcaattctagtctctgataaaacagactttaaaccaacaaagatcaaaaaagacaaggacattacaaaatgacaaagggtgcaaaaagaggagctaactgtcctaaatatatatgcacccaatacaggagcacccagattcataaagcaagttcttcaagacctacaaagaacttagatccccacacaataatagtggggattttaacaccccactgtcagtattagacagatcaacgagatagaaaattaacaaggatattcaggacttgaactcagctctggaccaaggagacctaatagacatctacagaactctccactgcaaatcaacagaatatgcattcttctcagcagcacatcacacttattctaaaactgaccacataattggaagtaaaacactcctcagcaaatgtaaaagaatggaaatcataacaatcagtctctcagaccacagtgcaatcaaactagaacttaggattaagaaactcactcaaaactgcacaaatacatggaaactgaacaacctgttcctgaatgactactgggtaaataacaaaattaggcagaaataaataagttctttgaaaccaatgtgaacgaagacacaatgtaccagaatctctgggacacagctagagcagtgtttagagtgaaatatatggcactaaattctcacaggaggaagcaggaaagatctaaaattgacaccctaacatcacaattaaaagaactagagaagcaagaataaacaaattcaaaatctagcaaaagagaagaaatagctaagatcagagcagaactgaaggagatagagacactaaaaacccttaaaaaaatcagtgaatccaggagctggttttttgaaaagatcaacaaaatagatagactgctagccagactaataaataagacaagagagaagaatcaaatagacaaaattaaaaaagataaaggggatctcactactgattgcacagaaatacaaactaccatcagaaaatactataagcacctgtatgcaaataaactaggttatctagaagaaatggataaattcctggacacatacaccctccaaagactaaaccaggaagaaatcgaatccctaaatagaccaataacgagttctgaaattgaggcagtaattaatagcttaccaaccaaaaaaagcccaggaccagatggattcacagccgaattgtaccagaggtacaaagaggagctggtaccattccttctgaaactattccaaacaatggaaaaagagagactcctctctaactcattttatgagatcagcatcatcctgatgccaaaacctggcagagagacaataaataaagaaaatttcaggccggtacccctgatgaacatcaatgcaaaaatcctcaataaaatactggcaaaccggatccagcagcacattaaaaagcttatccaccatgatcatgttggctttatccctgggatgcgcaaggcaggttcaacatatgcaaatcaataaacataattcatcatataaacagaaccaatgacaaaaaccacatgattacctcaatagatgtagaaaaggccttcgataaaattcaacaccccttcatgctaaaaacactcaataaactaggtatagatggaacgtatctcaaaataatgagctatttatgacaaacccacagccaatatcatactgaatgggcatttcaaagtattccctttgaaaaccagcacaagacaaggatgcccttcgtcaccattcctgtgtattggaagttctggccagggcaatcaggcaagagaaagaaataacaggcattcaaataggaagagaggaagtcacgttatttctgtttgcagatgacatgcctgtatatgtttgtatatttggaaaaccccgtcatctcagcccaaaaactccttaagctgataagcagcttcagcaaggtctcaggatacaaaatgtgcaaaaatcacaagcattcctatacgccaataacagacagccaaatcataagtgaactcccattcacagttgctacaaaaagaataaaatacctaggaatacaacttacaaggaatgtgaaggacctcttcaaggataactacaaaccactgcacaaggaaataagagaggacacaaacaaacggaaaaacattccatgctcatggataggaagaatcaatatcatgaaaatggccatactgtccaaagtaatttatagattcaatgatattcccatcaagctaccattgactttcttcacagaattagaaaaatctactttaaatttcatgtggaaccaaaaagagcctgtatagccaagacaattctaagcaaaaagaacaaagctggagcgtcatgctacctgacttcaaactatactacaaggctacagtaaccaaaacagcatagtactcataccaaaacagatatatagaccaatggaacagaacagaggcctctgaaataggtccacatgtctacaaccatctgatctttgacaaacctgacaaaaacaagcaatggtgaaaggattccctatttaataaatggtgttgggaaaactggctagccatatgcagaaaattgaaactggaccccttccttacaccttatgcaaaaattaactcaagatggattaaggttttaaatgtaagacctaaagccatagaaagcctagaagaaaacctaggcaataccattcaggacagtggtatgggcaaagacttcatgactaaaacaccaaaagcaatggcaacaaaagccaaaattgacaagtgggatctaattaaagagcttctgcctagcaaaagcaactgtcgtcagagtgaacaggcaacctacagaatgggagaaaatttttgcaatctatccatctgacaaaggcctaatatacagaatctacaaggaacttagactaataagaaaataactccatcaaaaagtgggtgaaggatatgaacagacactttcaaaagaagacatttatatggccaacagacatatgaaaaaagctcatcatcactggtcattaaagaaatgcaaataaaaaccacaatgagataccatctccagttagaatggtgatcattaaaatgtcaggaaacagcagatgctggagaggatgtggagaaataggaatggttctatactgttggtgggagtgtaaattagttcagccattgtggaagacactgtggggattcctcaaggatctagaactagaaataccatttgactcagtgtgcctggaattggttccttccggtgggttcttggtctcactgacttcaagaacgaagccgtggaccctcgcggtgagtgtttcagttcttaaagatggtgtatccagagtttgttccttcagatgttcagaggtgtccagagtttcttccttccggtggtttcgtggtcttgctgacttcaggagtgaagctgcagaccttcacagtgagtgttacagctctctctttcttttttttttaaattatactttaagttctagggtacatgtgcacaacgtgcaggtttgtcacatatgtatacatgtggcatattggtgtgctgcacccgttaactcatcatttacattaggtatttctcctaatgctatccctccctccctccccccaccccatgacaggccctggtgtgtgatgttcctcaccctgtgtccaagtgttctcattgttcagttcccacctgtgagtgagaacatgcaatggttggttttctgtcctggcgatagtttgctcagaatgatggtttccagcttcatccatgtccctacaaaggacatgaactcattcttttctatggctgcatagtattccatggtgtatatgtgccacattttcttaatccagtctatcattgatgaacatttgggttggttccaagtctttgctattgtgaatagtgccacaatagacatacatgtgcatttatcttgatagcagcatgatttatattcctttgggtatatacctagtaataggatggctgggtcagatggtatttctagttctagatccttgaggaattgccacactgtcttccacagtggttgaactagtttacattcccaccagcagtgtaaaagtgttcctgtttctccacatcctctccagcacctgttgtttcctgactttttaatgattgccattctaactggtgtgagatggtatctcgttgtggttttgatttgcatttctctgatggccagtgatgatgagcattttttcatgtgtcatgtgtctgtttcatgtgtctgcataaatgtcttcttttgagaagtgtctgttcatatccttcgcccactttttgatggggttgtttgattttttcttgtaaatttgttgaagttctttgtagattctggatattagccctttgtcagataggtagattgtgaaaattttctcccattctgtaggttgcctgttcactctgatggtagtttcttttgctgtgtgcagaagatatttagtttaattagatcccatttgtcaattttggcttttgttgccattgctttggtgttttagtcatgaagtccttgcccatgcctatgtcctgaatggtattgcctaggttttcttctagggtttttatggttttaggtctaacaattaagtctttaatccatcttgaattaatttttgtgtaaggtgtaaggaagggatccagtttcagctttctacatatggctagccagttttcccagcaccatttattaaatagggaatcctttccccatttcttgtatttgtcagctttgtcaaagatcagatggttgtagatgtgtggtattatttctgagggttctgttctgttccattggtctatatctctgttttggtaccagtaccatgctgttttggttaccatagccttgtaatatagtttgaagtcaggtagtgtgatgtgtccagttttgttctttttgcttaggattgtcttggcaatgcgggctcttttttggatccatatgaactttaaagtagttttgcaattctgtgaagaaagtcattggtagcttgatggggatggcattgaatctataaattatcttgggcagtatggccattttcacgatattgattcttcctatccatgagcatggaatgttcttccatttgtttgtgtcctcttttatttcgttgagcagtggtttgtaattctccttgaagaggtccttcacaaacttttaagttggattcctaggtattttattctctttgaagcaattgtgaataggagttcactcatgatttggctgtctgtctgttattggtgtataggagtgcttgtgattttgcacacagattttgtatcctgagatttgctgaagttgcttatcagcttaaggagcttttgggatgagacgatatggttttctaaatatacaatcatgtcatctgcaaacagggacaatttgatttcctcttttcctaattgaataccctttatttctttctcctgcctgattgccctggccagaacttccaacactttgttgaataggagtggtgagagagggcatccctgtcttgtgccagttttcaaagggaatacttccagtttttgcccattcagtataaaattggctgtggatttgtcataaatagcttttattattttgagatacgttccaccaatacctagtttattgagagtttttagcatgaagcgctgttgaatttcgtcgaaggccttttctgcatctgttgagataatcgtatggtttttctctttggttttgtttatatgatggattatgtttattggtttgcgtatgttgaaccagccttgtatcccagggatgaagccaacttgatcatggtggataatctttttgatgtgctgctggattcagtttgccagtattttattgaggatttttgcatcgatgtcatcagggatattggtctaaaattctcttttttttgttgtgtctctgccaggctttggtatcaggatgatgctggcctcataaaatgagttagggaggattccctctttttcttttgattggaatagttttagaaggaatggtaccagctcctctttgtacctctggtagaaatcggctgtgaatccatctagtcttggactttttttggttggtaggctattaattattgcctcaatttcagagcctgttattagtctattcagagattcaacttcttcctggtttagtcttgggagggtgtatgtgtcaaggaatttatccatttcttctagattttctaatttatttgcatagaggtgtttatagtattctctgatggtagtttgtatttctgtgggatcggtggtgatatcccctttatcattttttattgcatctatttgattcttctctcttctttattagtcttgcctagtggtctatccgttttgttgatgttttcaaaaaaccagctcctgaattcattgactttttgaagggtttttttgtgtctcttatctccttcagttctgctctgatcttagttattgccttctgctagcttttgaatgtgtttgttcttgcttctctagttcttttaattgtgatgttagggtgtccatttcagatctttcctgctttctcttgtgggcatttagtgctataaatttccctctacacactgctttaaatgtgtcccagagactctggtatgttgtgtctttgttctcattggtttcaaagaacatctttatttctgccttcattttgttatgtacccagttttcattcaggagcaggttgttcagtttctatgtagttgaggggttttgagtgagtttcttaatcctgagttctagtttgattgcactgtggtctgagagacagtttgttataatttctgttcttttacatttgctgaggagtgctttacttccaactgtgtggtcagttttggaataagtgtgatgtgctgagaagaatgtatattctgttgattgggggtggagagctctgtagatgtctattaggtccgcttggtgcagagttgagttcaattcctgaatatccttgttaactttttgtctcattgttgtgtctaatgttgacagtagggtgttaaaatcttccgttattattttgtgggagtctaagtctctttgtaggtctctaagggcttgctttatgaatctgggtgctcctgtattgggtgcatgtatatttaggagagttagctcttcttgtggaattgatcccttttccattatgtaatggccttctttgtctcttttgatctctgttgacttgaagtctgttttatcatagactaagattgcaacccctgctttttttgttttccatttgcttggtagatctccctccatccctttattttgagcctatgtgtgtctctgcacatgagatgggtctcctgaatacagcacactaatggctcttgactgtatccaatttgccagtctgtgtcttttaattggagcatttagcacatttacatttaaggttagtattgttatgtgtgattttgatcctgttattatgatgttagctggtacttttgttcattagttgatgcagtttcttcctagcatcaatggtctttacaatttggcacgtttctgcagtggctggtaccagttgttcctttccttggttagtgcttccttcaggagctcttgtaaggcaggcctggtggtgacaaaatctctcagcatttgtttgtctgtaaaggattttatttctccttcacttatgaagcttagtttggctggatatgaaattctgggttgaaaattcttttctttaagaatgttgaatattggaccccactctattctggcttgtagagtttctgccgagagatctgctgttagtctgatgggattccctttgtgggtaacccgacctttctctctggctgcccttaacattttttccttcatttcaactttggtgaatctgacaattatgtgtcttggagttgctcttctcgaggagtatctttgtggcattctctgtatttcctgaatttgaatgttggcctgccttgctagtttggggaaatttccctggataatatcctgaagaatgttttccaatttggttccattctccccatcactttcaggtacaccagtcaaatgtagatttggtcttttcacatagtcctgtatttcttggaggctttgttcatcatgtctttttactctttttttctaaacttctcttcttacttcatttcattcatttgatcttcaatcacttataccctttcttacccttgatcaaatcggctactgaagcttgtgcatgcgtcatgtagttcttgtgccatggttttcagtttcataaggttatttaaggtcttctctacactgtttattctagttagccattcgtctaatcttttttcaaggttttcagcttctttgcgatgggttcgaacatccttctttagctcagagaagtttgttattaccaatcgtctgaagccttcttctttcaactcgtcaaagtcattgtccatctagctttgttccattgctggcgaggaggcgcgttctttttggagaagaggcgctctgatttttagaattttcagcttttctgctcgggtttctccccatctttgtggttttatctacctctggtctttgatgatggtgatgtacagatggggttttggtatggatgtcctttctgtttgttagttttctttcttacagtcaggaccctcagctgcaggtctgttggattttgccggagatccactccagaccctgtttgcctgggtatcaccagcggagctgcagaacagcaaatattgctgaacagcaaatgttgctgcctgatccttcttctggaagttttgtctcagaggggcacccggctgtatgacatgtgagtcggcctccactgggaggtgtctcccagttaggctactcagggatcagggacccacttgaggcagtctgtctgttctcagatctgaaactccatgctgggagaaccactactgtcttcaaagctgtcagacagggacgtttaagtctgcagaagtttctgctgccttttgttcagctatgccctgcccccagaggtggagtctacagagggaggcaggcctccttgagctgaggtgggctccacccagtttgagcttcctggccactttgtttatgtactcaagcctcagcaatggtagacaccccttccccagcctcgctgccaccttgcagttcgagctcagactgctgtgctggcagtgagtgaggctccgtgggcatgggatcttccaagcctggcacgggatataatctcttggtgtgccatttgctaagaccattggaaaagcgcagtattagggtgggagtgtcctgattttccaggtactattctgtcacggcttccctttgctaggaaagggaattccctgatcctttgtgcttcctgggtgaggcaatgccccactctggtccgtgggctgcacccactgtccgacaagccccagtgagatgaacccagtacctcagttggaaatgcagaaattacccatcttctgtcgctcacgctgggagctgtggactggagttgttcctatttggccatcttggaacctcccccgagtgttacagctcttaaaggtggcgcatacgtagttgtttgttcctcccggtgggttcgtggtcttgccgacttcacgagtgaagctgcagacctttacaatgagtgttacagctcttaaagttagcgtggacccaaagagtgagcagcagcaagatttattatgaagagtgaaggaacaaagcttccacagtgtggaaggggacccaagtgggttgccgctgctggctcgggtggccagctttaattcccttatttggtgccgccacgtcctgctgattggtccatttcactgaccactcattgggctgttttacagagtgctgattggtgcatttacaaacctttagctagacacagagcactgattggtgcgtttttacagagtgctgattggtgtgtttacaaacctttagctagacaaacagcactgattggtgcgtttacaatcttccagctagacagaaaatttctccaagtccccccctgacccagaagcccagccggcttcacctctcaccggcaatctcattactgggtatatacccaaaggattataaatcattttgctataaagacacatgcacacgtatgtttattgcagcactatttacaatagcaaagacttgtaaccacccgaaatgcccatcaatgattgactggataaagaaaatatggcatatatacaccatgtaatactatgcagccataaaaaataatgagttcatgtcctttgcagggacgtggatgaagctggaaaccatcattcccaggaaactacacaggaacataaaaccaaccaccacacattctcactcataagtgggagctgaacaatgagaacatatgggcacagggaggagaacatcacacactggggcctgttggggagtggggggctaggggagggatagcattaggagaaatacctaatgtagatgtcgggttgatgggtgcagcaaactaccatggcacatgtatacctgtgtaacaaacctgcacattctgcacatgtatcccagaacttaaagtataataacaacaacaacaacaaaaaacaagaaaacatgtattaagaaagaaagaaaggtttttggtgctaatgatcaagaacctttctgcgatatcatctaggatctaggatccaggatccaggtgttttctgactctgtctttcacactgatggttggtactccttatggctcatgggtggagcctgtggcatcagggctacctgtgcctttgttcacatgtggtaagagaaagagagaacttagtaattctcttacaaagccagaaagcttcattctcaaaagcttccatgagacctcttctcccttgtctgtggcccagattggatcacgtgcctattggtaaaccaacctatgggaatgggagtggcatcccttttagataatcaggttgattccaggattctgggtagacagcttaaatgttcacttgtgcacagaagattgagtgcagtttaaacatgtcaaggagctggtggcataacaaggttgcaacttgcttcagaggttacatttatgagtctggattctgaaaggagcaatatgtgttttaaaggaaaaaagcaagagacagtgttcttgaattcttcagtgttttcagactctttctgtgaatgtgttactctgaaagtttgtagtagtacagacctggccagttttgtacaagcaaagcggagcaaacattcagtccactgattcccaaggtgctgaggacagaagttagtggaacagtccacggtggtgtaagctgagtactgacactttcctcatttaccagctaattctcccttttaccatttgatttgactttgccgaaattggtcagatgggtaaggtttgggtggctgaagcatatgacacttttcagttttagagctcattaggtgttttttaccagtatttcaacttgatgcattacaaatttgatataattcagggaaaggacctgtatgggataagaagtaatcaaaattattctgacctttttatgtagtgtttcaccataaacatattgtttacttttgtctcttctttaaggaatatatacagcattaaaagatgagagttaagtaaactctgggctatcatacagtggaatatgaataaaatacatacatacacacacccccttccttaatccctccccacacccctaaacttttctggcagaggcagtcgtgcccaccaaatattctaattgctttccgcatttcccagccacctttcagttgcgtgggcatgtgtctcatgatggacaatgggctgtgaaagagatacatttttcttacaggccatggcagtaaaagatccatgcagaattcttcctgtttttctcccatgaggagactgaagggaccatggattccagatgggcagctataaaatggaaggatctctgttagtttgagtcgctgagtgactgtgtgaagcctgtgtggagctgagcctcttgttgacccttgtaggccatttaacatgggggagaaatgaacttttgttctgttcatccactggcatttggaattgttacaggagcacaatgaatacatacctcctttcaatatttactctttgtctggaagcacctttctcaaacctaatccttacctccttgcctgctcacccagtagagcctacataaaagtttctctctttttgatatctcagtgttgccattatagatctcagttattgtgctgatctgttattactcatcagcatagatgccatcaggacctactaagctaagtagggtcatttgctttaagagatgaactgagttgagtagtaaaatgtattccctaaaaaagcatgtgtgaatctacagtaactggagtaactagtcttatgaaaaattggagactagaaaattgcattcaaggtttggtagcttgatattttgttaaatcagtactatttccgttcctcccccaagtttgtttagtttcattttttaaaaagactttattgaggataatcgacataagaaggtgtacatatttaatgtatacaacttgatgagtttggaaataagtatatatccaagagaccatcaccacaagctatccaccctctctgaaagtttcctcctgtcctctttattattgtttttttcctgagaaaaacacttcatataatatctaccctcttagcaaattaagtatacagtacagtgttgttatctccaggcagtgtgctttacagtagatctctaggaattatttgtgttgtccaaattatacactgttgtattcaagttatatacaagttgtaccttgatagttcaagtttaataaatctctttgtagttacccatgagatctgatagaagatctggctaatatttctgaagaaattattccttggagaatgaagtagcttttagaaacatatttttatgtcccagaggaaccccaagacctgttcttcactaacattataggccgtcataaataacctacccacacaccacgaaaattgtctttggtttggagcagaggtcaaaaagtgggacccatgcttgctttggcccacaaagtggtttttgcataaggaaaataggtgccaacatttagaaatcaggaaatttaacacaaaactctagatttctggctgctcttttaaaatgggtggatgtggccactctgagcctgtgttagcagaaggttggaatggaaacaacagaactgaggcatcccattttccacagccctcgcttggctcggtttgcctctcactcactgcactcaccccactactgcaggcattttggttggagggtttttttctccattatcatgcacatatttcctgggagaatcctgccagtgatttaggacttactttcatctaataaatattcacttagtattcacttagtttcacttactctggtaagcagtccacgtgacatataattggaaagccttacataattgttgcctcttctgttctcttcatgttatctcctttatcactatagcattaaatttactctaatgatacttattgagatcctatgtgctagattctaagggtttaaaaatgaatgagatacagttgttggccaccaggagcccagcttgttggtgatattgttaaagaaatgagcactataatgttgccacaatatactgagtatgagagagagaaagagagagagagagagacaggtgacctctgatggggagagttttggaggagttttcttagtggaaggcacatttgaactaggttttcattgataagtaggagttctctaaacttttgagataaattagctaagcctgcctatagtgtggaccagtttgaaacttttactaattcttagtgaagcatgaaaggtagtcttcactttgcatggcctatggggacatcaaaatgactacgcaagttgaaactgtgcaaaacactttcatcaatcaatgggaacattaattgatctacagcctttaaaattttttgtcaaaatatttagtctgttttattgtcagtcataaatgtataggaaaatgaaaaaagtaaaactaatatttattcagtacactctatttaaatgttggaaacactgaaaattaacacgtattatttctttgtaaaaacttgttaagttcgaatagtgctttctttttgttgtataatttacaataaggcgagagcatcttttgtaagccttagggaattgtcatactcaggagtctggatcagcttccagtgtttcatcctgtgtgctttcaaagttgtgaaaaatcttctagaatttctttaatgtgaagttttttgtggcatcacttcctcagggatatctccatcttttttttttttgattttttttttaaattttattattattatactttaagttttagggtacatgtgcacaacgtgcaggtttgttacatatgtatacatgtggcatattggtgtgctgcacccattagctcgtcatttagcattaggtgtatctcctaatgctatccctccccactctgcccaccccacaacattcccgaagtgtgatgttccccttcctctatctatgtgttctcattgttcaattcccacctatgagtgagaacatgcggtgtttggttttttgtccttgcgatagtttgctgagaatgatggtttccagtttcatccatgtccctacaaaggacgtgaactcatcattttttatggctgcatagtattccatggtgtatatgtgccacattttcttaatccagtctatcgttgttggacatttagtttggttccaagtctttgctattgtgaatagtgccgctataaacatacatgtgcatgtgtctttatagcagcatgatttataatcctttgggtatatacccagtaatgggatggctgggtcaaatggtatttctagttctagatccttgaggaatcgccacactgacttccacaatggttgaactagtttacagtcccaccaacagagtaaaagtgttcctatttctccacatcctctccagcacctgttgtttcctgacttcttaatgatcgccattctaactgatgtgagatggtatctcattgtggttttgatttgcatttctctgatggccagtgatgatgagcattttttcatgtgtcttttggctgcataaatgtcttcttttgagaagtgtctgttcatatcctttgcccgctttttgatggggttgtttgtttttttcttgtaaatttgtttgagttcactgtagattctagatatcagccatttgtcagatgagtaggttgcaaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgaccatgcctatgtcctgaatggtactggctaggttttcttctagggtttttatggttttaggtcatatctccatcttttttgtcacagccccttccttgctcatatcaataaatgtatcttcactaagttcctatggctgagcatctggagtcactcaaataatcagcaatgtcagcattcccacaatcatctccttctcctgttctcattgacttctgattcagatttcatttccagcattgtcattttttgtttccttgctgcactttcacctttgttggtcagtttccccttttgatttacccatttttgtaaaatgccacgtggttttatgactgggagacaaggagtcatcatgactacttgcgttgccatctgtgcagaactgataacagccatgtcgtgagcagtcaccaacaaacttcagaagagaaatgtgattggtcactgatccagatgagacctgttatttatggactgaagagctggcagtgaaatttgtatttgatgcaacaactcacagtttgtgtatcatggtaatggaaatgtaaacttgtgttgttgagggattggtgggttttcaaccaagctgtggtaactgaaattcatgcgtagtggaactttgtaaagcgtggactatctgtattgacattttgagtggatttgtcctgtcctctgttcagagtttagcaagtataaccctggccacttgacggcattccattaaaacctcctaatcgctgttaacaaccacaatgcttcccatatttcccatatgtgtttgggggtggtggtggggacactaatctagtttgggaaccatttgggggctatctctgggtcatttcatcattaataaggcagggagtgtttggaaatagccactctgctgctgctcagttacttcagcatttatggctgaattctgagaggtggagctttcagagtgacctccccttaagtatgtggtgccttctgcttccttcataggccaagggaggcagaaagagcctcctccacaaggagtcacatgacctggattctagctggactttgccacatatctgtctgccatataacctttttgaatcctaattttcacagctatacagtaagtttatctgatttacaaattattgtgaggaataaatggaaaatgtatgtaaatactgggtgcacatgaggaattgttctgatgatgatgaataactgaatcattggtaggcctttcttggactacaatgaaatatagcagaaccctctaatgtctcagcaaaataaacatcctcagcttttagacgccgcctcgagtgagaagttcacaactttcccatctccgcttagttggctcttttctcacttagctcccttcatggtgaaatgcagcgaatagactaccagtccattattagtccatgaaataactttaaacagcctcctccatgagggacagaccttatttctctattaatataaggaaaatagagcacaaattagttggtcttttagagaaacaggctgcagatggctcccagctggtagccattttgaatgatgaattttgaagagagtataaatgttgagttagagagttcagtgttcttttcctggtccaagaataaatatttttagtaaagttagtataaatagacctgtcttggggtgatctgagatgctgattacttacctgtggatttttaacttaacgtcgggagcgaagaatttggtgaaataagcatgttagtagaatattgctggcttggcaaaggtttccttcatctgtaagatattatccggtaattgctgcaaacctgcgacatatatggtttagtgaacattggtagatatgttctctttccacatggtatactaatctggaatttgttggagatgagataaatctattatgacttgaggattgaagaatatgaatggaaattatttttatcatggatgaaactacttgtagaatttgattagattttacttgtttattttattctaactttaacagtttatttcaagaaagtgaaattacttaaatgattcagtgtaaatctctgaaattttttcaatagcttacagactttcttctaattacaaaaaatttgtaattctagcttttgtaaacattaccttcccttcctatctctacctgccaaagccccacagaaactgaaaagaaaacaggtacatgcaattttatatttatttggtacctttttaatgtggaaaagaagtacttaagtcttggatcagggaacattacttcctatttataaaatttaaatataaagtggaaagttaagataactatttaacttccaaagctgttacatatctatagcatgctatcttcatcagatttttcatgatgaaaaaaaaacttttgcagatgaaatataaaaaaaaattttcttacatcaacaatcttaattttaattgtttcatatattttaaaattgatattctttgggcaagccctttttttactatgaatatttgctattcatcaaatctgatattaccgtaagaatgaagttacacttcaattattagttccctataggaaatgagcacagtaaatctaacaacagaaatttaaaacaattatatattcaaataattacatttttagatggactcctccaaaacctcttcttttcttatgacatataagattgctagtataagagagcagctaaggaaccctaacagagattggtaaaattgagaagagatttcttttgtcaatgaggatgtccggaagttgaaactgacttacctgaaatagcaaaatcatacagcatccagaattatgagttagaacaagagttttaaaatacttaatgtgtgttttaatgttcatagacaatgattcaacatcagatgtttgttctttgagctttcttttggttttgtggtggtgaaaacagggacaatagtaagattttaagaaactggctggaattcactctagggcttcccccacccccctgctgagacgacatcattttcttcgtggagattttgtggctttgcataacttggcattctctaatttaactgacagcatgatatttatagttttgttaccataaggaagtactaattattttaaacgtgtttcccaactttcaggtaacatttcacacaactgggaggcatcagcgtcatattttgggtggggaatgaccagaatgatccgcttaattgaattattccttgaaagcaaactaaacattttggacaacatattgactcacttaaacatatcacatgtttcttggaagtgattttcttgtcagattttttgggaattaattggattgtgagaaatgtacaatatcctcttgaaaaagtgtcagtgtctctgtccatagtagcattcataaaattatctctttatttccatgatgtttttgaaaatgttactttaatgtttatagaaaataattcaaaatcagtagtttattctttcagttttggttttgtgaaggtgcaaatagggacaataatgaaatttttttagagatcaaaaaccaactagttgaaactcactgtggagttttttatttcccctgaaacaaatagtcattttcttctcagcggttttgtagcttctttgatttcagccacatcttcctagccttaccttttccagttccctaatttacctgccttgatgaacatttaggacatatttttgcatagcttgtggatacagaacctctgacttgcttactgccctatctcctgcctttgtgccctttcttccaccccatgccacttgcaggagatgtgcttgtcggcccccagatccagtaacctagctccagtactggggttcctggaccaacctccacccacaccccctgcaggagatgtgcttgtcagcccccggatgcaataatctagctccagtactgaagttcctagaccaaactccacccacaccccctgtagagaccttgtgcttcctcccccacctcccacccccatgacagaatgcgtcacactccactactcccatcactggctgaggctgtcacaaattaatagtgtgccatatcaaagctgtaagaatagacctggagtcattgtagatgatggttttaaaagcttcattgatcacatcctaaggaaaattttgacttcccgaaagtgagtaagtgtggccccttcctatgtgtaatcactgcactggccagaatttatttgtagggagtgtcagttaagcacaggtacttggtggcttctctttctgtcatgaattcaagtcagtttgaagggtattagtgtgcacagccgtaggacagtggggatgacaagagacacgttacctgtcctggatgtgtggggtgagccttgaagcccttcggctgcactgaatcaccctcagggccttgcaggtaccagccctctcttctttttccagacctttccacatgccctcctcctctgcctgggacacattcttcaccttttctccagtgagccaactttttctcctcctttaggtcacggcattagtaagcattttcttgaggtagctttccttgactacccacgaccgggttaggatcccctctgtacatgctcatattgcactgccccattctgaaacatggcacacagtaccatgatggcggttggcttatcttctcccttgttagattctgagctcctgcaaggtaggaattatcttgtttgctgttgtatccctagtatctaggacagtgcctgtctgaccaaaagttattaatatcatcataaatacaagggctaatatcaagcactcagtacgtgccatgctatgtgctttgggttttcttaagttctcacaacaactttagaaatagatacgataaaggattttacagaggaggaaattgagattgatagaagttaagtaattcgctcaacacagcacccctagaaagcagcagagctggtatttgtctccggagtccctgctcataatggctagattacacacaatgatgaacaaataaaggatgtctgcaaaggcatctggccagagctctgtgtggggccagcagcttcatgaatgatccaaagagttggcattagctggccacaaatggtgttccagagagtcactttttttctagtcatataggagaggtcagctccagatgtcaaattctaattactggcaatttgttttctctaagaggtttggcatttactgtggctcatagaactttagaggtcgtgtggtacagtatacagagctctagttttagaattaaggattggaggcttgggcttaccccactttcccttaaacacagtgttgatgtgagtaggttgagagtggtctttgtgaacccacttctctgcacggtatagacagggagttgtagtgtggcttagagggagtgtgtataaagctgtcttcccaacttgatggcagttacctgctgctcttaggatattttctctggcatattattttctgtcatgggcatctattggtgcttaataaaataagtgtacatgcagggttatttctgggcacttctactaatgatttaagatttcagaaagttaggtcttctacacatatgtcaaaaggcaaacttatctattacagtatcataatatggcccttgacttcatttactggattaagcaactgcattatttaattcagaaaaagaaaagcatgtagattgttttcttactgcctccccaccaatagcaacattatagtaagatcttatttttctatctttctttcttttttttttttaaacagtgtctcaatctgtagcccaggctggaatgtggtagcatgatcattgctcactacatccttgaactcctgggctcaagtggtcctcctgctccagcctcctgagatgggactacaggcatgtgccaccacattcagctaatttttgtattttttgtagagacggagtctcactatattgtccaggctggtcacaaactcctggcctcaagcaatcctcctgcctcagtctcccaaagtgctgggattataggcatgagctactgcatgcagccttatttttctatcttatctctttgagagtcttaagtaacttaggggaaaattctgaaactagttaaatccggggcctgctgtatacagggcagagaacttagtttctgttttgcagaaacaggttgtaaataagtaagttcagaaaataagaggatttccacttgcaataagggttaggagggaaataaacacagtgaggtgggaaaaataattgtggttgggttggtgtgagagtagaaaaggatggggagttggacaagatggcagctgaagtctgagcatgagaaggggctgggacaggaaattctgaggaagagataatagtgaatgcagggactcagaaggggagcctgctgggcatgtttttggggtggcatcatggctgatgcagagggagttgagaaagataacattttttcttttttactagtggtttagacttaactaaccaagttaatggtgcaaacagtaaacacattagcagagacaggcatgaatgagagaagcagcagccggggccaggtgctgtaggattaaggtaacgagctcacctgccttcagggccagaccagtaccttgacttagtgaagacagtgtgggcttaacttttgttcaatttttaatagagacataagtgtagagaaatattgctctgagaaaaacagcaaacaccatgataaatggcaagtgagcagtacaatgccatgatgatgatggcaagtggcctttgacctcgcagtcagagaagtagtagggactgggagcagctcagagcctgctggccctgactcaagggggcagctgtttctcagtgccagccaagcattgccatgtgggaatgtgagtggtctgtgctaaatttgccaagttttccagagaaccagaaatctgaattgttctatgaagttcccagatttaaaaatgttggctcaaactttaaaaaaccttacaatgaatagacaaaatgcatctgtgggcttacagtctgaaacatctgctgtaagcccttttatattatgataaagggggctcatgaagtttgatgtatgtgaaccatttccttgtgcccggtacgtagccagtactgaggagaaaaaggtacttattattgattgcacccttgatgtgtttaggttgttttcaccattaatatatttaatgaactctcaatccatattaaagataaatattatcccagtctaattcaagtgattaaattaatacatgatttttttttgctgtttgcatattggttagtagtttgctctattagtttggttaattctatgtttgtcttacatgagcaaacattaatctagtgtaattcacgtaaaattagtgaggaacagaggacgcacattttaaatcctgttcttttcttatttaccgtccatttccgttgctgggcagtcgttgcttccctcacttgtcctggtgcttccactcattcaggtcttgagacctcctagacagtgttagctgcatgtgcaagtgggaaggacctttggcaaaaatgccattctgaaccaggcaaaggatgatggggaatgcagtcttacgacgtgatgtcgcgtttagagggttttcatcagttttaatgaaatacaaatgcacccaaagcaagttattttttcccccagggaaaaaaatcttcatttagtatggtctaactcatgcagttttgtattacaggaatcatgtttggtgtgttgcaatcccttggcaattgtcttggggaattttattcagcacaagcatctctgatggttctggcatcaagttgggttaattacttgttcatgtactttttggtttgtgtctatgttaaaattctgaagcattgtggagaggaacactgggagtaacaaaatatatttgaatatttctaatagattaaaggcttataaaaacatctcttttccccccagggttttttttttctttgcattgttttcaaatgagatcattttgtatgaacatgaacttaggaacttgaaaataaacttttttgtgtgtgaaaaatcttatctgtaaatacaagtttttaattgagtcaatatttctctcaatttttgttacagatcatggaggaaacaaatacgcagattgcttggccatcaaaactgaagatcggagccaaatccaagaaaggtaaattgtgagagggcaagaaataggtggttttgataactgagattatggaattactgcaggtttgctggggagaaaactaacctttattcttaacacttttgtcccaaaatgtttgttaagtagcagtctttcaggaggattttcataattaaaaattatagtttttatccaacaacagaaaaatattaactattaacattatgatagaaatgtaattatgaaagatatagcaacctgtgatttcaaggatgcttattcgattgatatccatgagtcatggtaactcttcacatgtttttaacacataaatttctattgtttatatttcagggttcttttttatgtactacacagatttaatagctggttttttttttccctccagtatgatatgaaccttagatttcaggtctcgagtgctgcttgtcttcatctatcagacagcaaagaacccactagatttctcttttaggctgagtgtttcccttgcctggttttaccctatgggacactacccagtgcatagatgttcagaaatgaaactaaaggcctccctagttttctccctggattacatagtgttttcaaatgtgacctgccaatatatatttttatggatagtttttaaagtatgaccttagtctcaacaaactttgtggagtatatttcattagaagaatgcagatgcatgtagttgtcaggatgtaatgacaaataccatcaaacaattaaaaaataattgcagtctgagctgcaattatccatcatggtctggcattgttattgctgctgtttagtttcgtatttgctgccccttctccccatgacttactactaaatgataacactgtaagatttctcagtttcctttcttacttcagtccagtttgccttcttttaattgcatttcgttagagttactcatcacatggaataaaaattattttagttatttagtgagtgttgttagctggacttgaattgactggaattcctgtagaaactcctatcttgctactttttttttttttttttggagacagggtctcactctgtcacccaggctggagtgcagtggcacgatcatggctcactgcagccttaccctcccaggctcaagccatcctcccaccacagactcaagtagctgggactataggacaccaccatgcttgggtaatgtttgcattttttgtagagatggagtttcactatatgttgctcaggctggtcttgaactcctgagttcaagcaattctcctgccttgatcttccagagtgttgggattacaggtgtgagccaccgcacccagccttgttaccttcttaattgttatcatgggcggcaaggaattgggaacttatatgctaaataatcataagaagacatggtgaatttgcaagtgcaattctgtatctttgtataagcctgtatttctcaagtggtgtagaatatattcttaattaatcttcagtaatttttgtggtatgttggaatgttttgtactcattatgcagaagaagaaactgccgttcatggattatctagctgtttgcagcatttaaaaatttctgtcctactacttgaataaattggaacttgaacatagactaaatcttctttccctgttgtcaggcatttttacttaaagaataaaattagctttattactagcctaataaaaatgcaacttaatcagtctccaaagaaaatccccaaggaaacatgaacatttaaacaatgctagataactttttatgtcttattctcttgcagtatccatgctgttgttttcctctccccatgccattatcctgagaaactgagaactgattagtttttgttcaaaatgtggtggcaacattagacatttcagaaaatgtggagctgaatagattttattcattggtttcttgtcattgacacttaacccattcaaaatggccaactatattgcacattttgattatatattttgctttggaattaagaatatttcagcagtacattcgagggtgtttggcataatttccacctggttaaaattaacctttggaactatgcctaagaattgatcccttcaggcctggatctatagacatcatttattttgtattatttatgaagtgttatggatgtatatagtactatatgatgcgcagaatgcacttaaagagaacatggaagggagagaatcagaagtttgcctcagaggaatttactgttgagaatttacttgagttgctcttatcatttaagcacacagctgctgaatcagttcttggctaacatccctggtatgtgtatacctatattattttttaaatgattcacttcagagatgcaatttttggaccataatttgtatttaataaaagtgaaatgaaaatggcaggaagaatgttagaaggtaattatttgctctttgatctgatgtggcttttccttctcacccctgagtgttgcagaggaaggaattgttggtctttagagctttttcattccagactattattattcaagagacccaagaatataaatgtatttagggactcatgccgtgttttggatgattattacattctaaatcccatggtgatgtgaaactttggaatatacacataatccccaggctgagctagagagacagtacagccataggtttgtgttgcatttcactttggagtttctaaaatgcatgttggctaaatatttgagcctagacaaacatttttcgtggtcgctgttaccacagtttgcccccttctttaccttactggaatttagtcctgtgtttcctaaattagcttccatagctctgtctaaactttactttttaagccattaatcctttatcgagagcagctgtgtgagtggccgtatggctcacttgcttgaagagctggaaggaagctgcctggcaagaaggcaagcagccaacagcctgaatttgccatcagttagagagttcagattcttctcctctaaagatgttggcttagtagttctgaggctggtactgggagctgctatatttaacaagtttcactacttgttcttatggtcagactgagtttgggaaacacaaatctcaccatctgatatggaaatatcactaagaagaccatgtgttctgaaggcaaagggtgaccactactgagaaacagcagagtccttctacagtcgcttctggataatgcccatcttggcatctatagaactgcatttttatggatgcattaatttcatttttctatcatctttgtagtcagttaatgtggattagtttagagtgatgacaacctcattgttctgtgcctgtgctaaatgttggataaaagaccatctaatttttgtccattccctttcctcctccctttcttatcatctcacttttctttcttacctttcactccactttcattcttctgtgaccgtattctagatggaatatagtaggggcaaaagtaatagaaatattttcatgtgcacagggcattttagggaagtgcatgttttgtgatataaactaaggaactatagaattatttaaactttttttaattttagattcaggggtacatgtgcatattttttacatgggtttattgcatactggtggagattgggcttttagtgttactgttacacagatagtgaacatggtacccaattggtaatttttcaaggccttgccctagaattttttaaaacatctctagagtatttgaaattattggaaggttgagtcatcattagagctggagagaactgagaatttaaggttcagtataatggacatttaaatgggtgactgtagaattgtcttaaagagggtcacgattaagaacaacaaagcaatatttgatatttcttctgtatcacgtaaatttattttgagtggataaaaatttaactccttctgactcttagattgagaatactagaacagtctcctttacattgaaaaatttgaggtttgtgcctgtgaaaccagtatttagggattaaggtgtttaataccatacacccttaccaacagaataacttcaaggactcattaaaattttgaacatgctattctgaatcatagccttaatattttaaaataaatgcagcttcattaaagtacaaattgcattcttaacaaatttgattgttttgccaaatagaagtcctgccagacctgctttaagaaatacataaaaatgatttgcaatgagcatttatcacactggtatattgtgctgtgagcttcatgatgctagataagtttgttttcttaaacaaggtaaacatttttctcacagtcttcttttgctcttaatctgctcatcagtctcttcttagactggcgaaggtgaacggtaaatgatatggtttggctgtgtccccacccaaatctcatcttgaattgtaatcccctttatccccagatgtcaaaggagagatctggtgggaggtgattggatcatgggggtggtttccttccacgctgttctcatgatagtgaatgagttctcacaagatctgatgagtttaaaactgtttgaaagttcttccttcccacgccctctctcccctgctgccatgtaagatgtgcctgctttcccttctgccatgattgtaagtttcctgaggcctccccaggcatgcagaactgtgggtcaattaaagctctttcctttataaattacccaatctcaggtatttctttattgcactatgaaaacagactaatacagtgagtaaaaaaatgtttaaagtttttaagccaaatttcaaataactgaggtcagcatgagtgaagctttattgcagagttaaaccaagtgataggaactaatccctgcaagtggtccttgcatgatgacttaggaaaccccaggactagcaggaatgagaggcattgactgggttacttgatgtttcctggtttggagacaatttggcaccaagtttagccattctcttcctcccagaatcaacaaaagaatcttcgtaattccatgaggttttattgtttttggttacattttatcagaacaagtaggtatctaatagaaaatgttagcatgagaaaaatagtagacagttcgttttgttttttccagaagaaaatgttttgttgagtatgcttacacttttattgggtgttcatagtgaactagttagttgagggctttaacatagttgtacttaaagggctgagggcacggaagaggcatggcagggcatggcatgctggaccaaagtgttgctaatggtgggttgcaacctattcgtgtgtcaggtgttaggttagtgcgtcgcagccaatagtaaaataacccaactaggttaaaaaaaaatagagtgtaagggcattgtttgttattaaatttttattttatattttttgagacagagtctcactctgtcacccaagctggagtgaagtagtgcaatttcacctcactgtgacctccgcctcccgggttcaagcgattctcctgcctcagcctcctgagtagctgggactacaggcacacaccaccacgcccagcttattattattattattatttgagatggagttttgctcttattgcccaggctggagtgcaatggcgcaatctcggctcaccgcaacctccacctcctgggttaagcgattgtcctggctcagcctcccgagtagctgggattacaaggcacctgccaccacgcccggctaattttgtatttttagtagagacagtgtttctccatgttggtcaggctggtctcgagctcccgacctcaggtatttcagccacttcggcctcccaaagtgctgggattacaggtgtgagccaccgcgcctagccagctaatttttttttttttgtatttttagtagagacagggttttaccatgttggccaggctggtcgtgaactcctgacctcaagtgatctgcctgccatggcctcccaaagtgctgggattacaggtgtgagccaccgcgcctagccagccaattttttttttttttgtatttttagtagagacagggttttaccatgttggccaggctggtcttgaactcctgacctcaagtgatctgcctgccatggcctcccaaagtgctgggattacacgtgtgagccaccatgcctggccaatatttaattgatagaatactttacatatttatagagtacagtatgatatttcaatacaagtataccagatgtaatgctccaagtgaagcggcatcattgtctggggtaaattcctgaggttcgttgtctcatgccaaggaaatcaaggacacggacacacatggagtgaggttaagagcagaggtttaataggcaaaagaaagagaaaggagaacagctccctctcctacaagagagacttccagcctgcagtagagtgcacagggttttatagacaggcttgaagaaatggtgtctgatatacatagggcccgaagattggttggaccaggtgtgatgtttacatagcacgtgaagaagctggccactccaccctaatcttttactatgcaaatggggtctctacttggcctgtgccatgttgcctgcttacttactgtgcacgtggttgacaaggaaaggggaagatggagctgccgtgttggacctacctagcccccaggtggtcttttcctagtggcacagttgctggcattcacccatgcaagcttccagcttgcttgtctatgtttgcagctcgattttactggctgctctttgttagacaagaaaatgatttgggggctacttttccttaaaaggaaaaccttactgaggacttcttacccttactatctgcctaaatagtattctcttaactcctatatcacaagcagggtaattagcatatccatcacctccagcatttattattctttgtgttgggaatattaaaaatcctctcttgtagctatttgaaaatatataataaattatatttaactgtagtcaccctacagtgctacagaacactaggatttattcttccaatctagatcttacctttgtaactgttaaccaacctttctctataccaccgtcccacaccacacctttcccagcctctagtactcattgttctgttctctacttctgtgagatcaacttttttctcttccacatatgagtgagaacatgcagtatttatctttctgaacctggcttatttcagtaagggtattgtttagtaaaactttcatatgcgtctgtttatgtgcaaacatacacctgtgcacaaatatattagtaggtcatgatataaaatggatgacaaaggttgtagaacactgtgctaggtggtcagctctccaaagggtaaggagcacgtggattttgtgaatccgtctatccctaacactgtaaccagttcatagttggcactcagtaagtgtttgtagattgagccctcaactcaatcatggaaacagtggaaccactaatacagatgggaatgtatatccctaaggtgtgtcatgtaggaaaaagatttagaattattgccttcccagatgagtgataatcactgttatgaaaattatccactactgatatcttccctatagaccccttaagtaaaaaaatgtgggacatgattgtgactaaaccttctttagtggttctgaatagtcctaatgatgactgcctgcactaatgagggaagtggaaggaaacttagggacaatgacctgatcattgtcattcacaggacacctgaatgagtgaaactccggtgccattctcagtaagcttttaaatgagacttaacaagacacagcctcctggtagacctccagactatagttgttttggttgtggttattttaattagtatttatttacataattagcgattatgtaagtgggtcctaccatttgttgaaacctcctggggtcaggcactgtgctaaatattttatgtacataatcttttcaaattatcagtgagtgataccaccaaactctatgagtgaggtggtagtattttcattttcggatgaagaaactaaagccagtaaaggtaggttagtttgcccatggttttccagttggtaagtagcagacctcaaacccaaattcaggtctgtttgtttccagaactccaaatcactgtactcaaatgccctttcacacccataccttccatggtgcttttccctattccaggaagttccataatgtataataatatctcttcagcaaccattgccaagattagctgatgatgctcagtccagtttcataatgtctcagtccttgcagattacagagattacagagatttgaaggtaggctaaggttagcatttcttgtagacaacacctcttttttcaggggaaattagattttaccgtttaaaaagatgaaaccactcaaaggtgtgtacatttttgaaaagtgcttgcctctgaattttaccttgctatttcatgccatgtgttatttccttaggcagagactttttgatatgtcattaaacaactttgaaaaaatgaatttggaaggaaaataaacccagaatatgttataaattgcttgttgtgttggttttcttttacatgtatatgtgtgtgtgtggtttttttctgtatgtgtggttgaaatcttcgaaagtactgtttgtcacatacctgaggacctgtgtatttcttctgggtagaaaaatgtgtggttttgttgttgttgttcttgtttttgagatagggacttgctcctttgcccaggctggagtgcagtggcatgatcatagctcggtgcagccttggcctccatgacttaagtgatcatctcacctcagcctcccaagtagctgggactacaggtgcaagccaccatacctggctaatgtttaaatttttgtggagttggggtctcgctgcattacccaggctggtctcaaactcctgggctcaagctatcctcccacctcagcctcccaaagtattaggattacaggcatgagcctctgtgcctacagaatattttgtacttaaaacttttgtatatattattaagatcatcacttggtgaatgctaatcgagggccaagagtagaaattcacccaaagagttgaataagttgtatgcaatgtaccaatagtcactgtggctagagagagcatggtctaaataggaccactcagaggagaacagagacctgggccattccagttcttgaagatcccagtatacttcaacaataaaaattttataaaacgactacttttagatattcagtttttcagtgcatctctttctacatgaataactgtatttgtagatagtgccaaacatgcacatttgagatccttttcgaatatgtattttctcacactcacagacatacagcgcacacatcattttacaggtgagacagctcatgttcggtgacctattagcaagactgaggacctgagcttgggttcatttcttgatctccagctagttccgccttcttctcttctgaaggtcccaggtattggcttgtttgcttatcttataactgctgcaaactagctgttctttccaatcttttttctctctctcctgtaccagggtcagagaggaaaatggtctcagcttttcagttatcttctcaagcctaaataagcaaatatatctggtagtttttttttttgttttttttttttaaagatattttcccttaacttagaaatgaaacaaattttcagtggaatagagaggtgagaaagtaagtaaaaaagtgaaaacatcaacagaaagacaagccagagacggggagaaaatatttgcaaaagacacatctgatgaagaactgttactcaaaatatacaaagaactttttaaaacctaacaataagaaaacaacctgattttaaaagtgggtcaaagatcttaacagacacctcaccaaagaagatatacagatggcaaataagcatgtgaaaagatcctcaacatcatgtaccattagagttgcaaattagaaccgttaagatatcactacctacctgttagaatggttgaaatcccaaacactgacaacaccaaatgctggtgagaatgtggagccataggaactctcattcattcttggtgggaatgcaaaatggtacagctactttggaagatggttttgcagtttcttgtagaattaaacatgctgttaccatatgatgcagctgtctctctccttggcatttatccaggggagttgaaaacttatgtctgcacaaaaacctgcacatggaacagaagcttatagcagctttatttgtaattatcaaaactcggaaacaaccaagatgtccttcagtaggtgaatggataaatgtggtacgttgacacaatgaaatattattcagtgctaaaaagatatgagctatcaaactatgaaagggcatggaggattcaatcttaaatgcattatactaagtgaaagaagccagtctggaaaggctacatactttatgatttcaactctatgtcattgtagaaaaagcaaaactttggagacagtaaaaagatcagtggttatcagggacttcgtgggagggaaaaataggcagagcacagagcattcttagggcagtgaaattattctgtatgatttacaatggtgactatatgtcattgtacatttgtcaaggcccatagaacaggttttgaagttgatgtgatgttgacagtccccggggaggctgtgcctgcgtatagaaagcagcgtatgggaattctctgtactttccacttgattttgctctgagccggaaactgccctgaaaaataaagtctatatttaaaagaatagtcgtagatactagacacagcatttttatcagcattttaaaatatactatatgcaaagataatattatatggtcaagaataactccttaatgtataaatttaaaagcaccatgaaatctcttaagaaacaatcagaagttttataaaattttaaaaaaggaaagtgaggaaaatgcctaaattaaacagtaaaacacacccagttattcaacaccaggtggcgactggactgggtctggatttttcttagcttgcctgactctgtgactgctgctctctgctttcttgggctccttctccctcaatcttcctgtttccagaacagatgctttttatgtcctcttgcctgtggtgacatcccaggatcccttccatctgcagttttttcttacctgttaaactttatgaggaggaaaggagaaaatattgattatttacctgttttgtaataggcattataatagatgcctgttgtaatctcttttaatcctcacaataacccacatgaaggagtgttattctccccattatatatattaataactaatgtgaaagatgatataatttgttgaaggccagtgaattgtaagtgatgtagtttggatataaaccttggtttcaaaattcaagacacggtaatctgtccattctgtaagaagcaagcacataagtgctaatgatgagtgtttggtcacacacaaaaaataaagatttactaacacatttatttaagaaaactcagacttaagctacatttggttcttaagtgtcttcttcaaaaagaaaggcaatcttgggtaattcctcacctgacttttagaagtgtgctagacctctgtcttttaaaaatgttcagcctacgtttatttttattattcttgttcttcatggtatctttctttccttttctccttttttgagatccattaaggattttactgtgatttataaactttcttctggaatggtggttctccacctgaggtgattttattccacagggatcatttggcaatatctggagacatttttcattgttacagctgggagagggtgctactggcatctagagggtagagccgagggccgctgctaaacatcctaccctgcagaagacagccgcctcaacacaaaattatctagcacaaaacgccagtagctcaaggttgagaaatgctgaactagaggtgtgggcttattatcaggatagcatagcactggattcccattagaatccatagtgtcttcatagcactggattcccgttagaacatttcatgcagcctggtgcttcaattacctggcttccctttttgtagcattggcattagaatatagtttagtctgactacagaagggagaaaatacctatgtaacaaaataggtgaactgacagaattttggtaaaagagataaaacatagtagggtgataggtctacacattttaaaagccagtttgcagtcagtgttgaattttatagtttaattgtgcaatttaaactgtttgtttattctccatgagtgtttcacgttatgcctttgtgcctgcttcagtgctgggggacagaccttctaccctcctggttcatgttgcctctgtcttccattcctctttgctggaatgtgtagttgtggtaactgtgacaattcctaaggtttctgacagtttttgaacaccacaatggtgctgtaaattcctgtcttggccaggagatggacaccacattttgatggtttctcaaaccgtgtgtgaccttttcctggtttctctgttctgtcagtcatggcatggctggacagaattcagggacatctatcaggcctctcaggagcaattaaattattttcatgaaggcaatttgcagttgtaaacaatattgaagacactgtgtggcatttctcattagctaaaaaaaaaaaaaaaaagatagtggcaacaatacaggattatctgactcgataattagccaggcatggtggcacacgcctgtaatcccagctactcaggaggctgaggcaggagaattgcttgaacccgggaggtggagtgagccaagatctaaccactgcactgcagcctgggcaacagagcaagactctgtctcaaaaaaaaaaaaagattaaaaataataattaggagggagaataaacgacatcttggttttttaaaagtcctttttatgccattaaagtgtggcttgtggtttattattacatttgtatgcaaccttggtactgacatttttatcaaaagatattggagagatttcaggaatgaggagttacattccctttatatcttgttgccagaaattactcttaagcaaaataaattctgcctgaaataaaaataaaatgagaacacagcatatgcgtgtttttggctctgtgatctatgcaaatagttatgtattaactcattaattaaaatgggcttattctacacacacatttctaccattggatttttcttcttaaaaaataagcagagcagagtggggaggcggcaagaggacctgtggcaggccctcttcggccatctctctggcctggtttccctcggcgtgccactgtgtgctcagtccagcaccatggggaagcgggacaatcgggtggcctatatgcacccaatagcaatggcgagatcaaggggtccaatccagtcttcagggccaacaatacaggattatctgaattgaccaaggcctacctgggaagaagtaaaagagcaactagaaaagaaaaagaaaggttccaaggctttggctgaatttgaagaaaaaatgaatgagaactggaagaaagaactggaaaaacacagggagaaattgttaactgcaagtgagagctcatccaaaaaaaagacagagaaagaaaaaagaaaagaagaaatctgataggtattcatcttcttcatcaagctctgattcttccagcaattcttctgattctgaagatgaggataagaaacaaggaaaatgaagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtaagaatcagagtatattgaggaggtgcgagcaaaaaagaagaaaagcagtgaagaacgagaaaaagcaacagaaaaaacaaaaaagaataagaagcataagaaacacagtaagaagaaaaggctgttagttcaagtcctgactcaccataacattaagaaaaatcaggattcccttataaagaaagtgcaatgtctgaggaaatttcaactgtgaaaactacaacatatttactaacatgcatgaattttcttgtttttagaattattcctggactattcagtagccactcagatgctactgtgtgaaagggccataaatgttgcctgctgcttgaacatctatttttttctcttccagtgcttgataactctgggagataatacactgcagtcatactagtggttaagatatttgggaataaaattaatacttttgactagaaatgtctaaggataaaccaacagaaattgaatctggatacatctttaagatgtaatcagaaatgaccagatgactctagttaaaatttttgaaggagggattacattaatatttcaaaacccttactctgtaagataagtgtagtttaatttttttcccctcgtatacttttatttacctggggaaggagcttttagggttgggggggtggtttgctatctctttagctagcagaatagtgtgcctttgatcctcacacatcctgtattatgaacacagtagccatacttcacggggaggtcagagctggctaccagcagtcttgccctttactgagcttagtgtcatccttggatgctgtcatatgctgctttgagtgaaccagagaaacagccatttgcagcatgagaaagccccaaaagctctgggatttacctccacttcagtaataatgaatattttttagcattagaatgtgttaggtcatttgaattaatttttactacactttggcttgggagaggaattattttaaatagacactggtacttttcgaacttgatagctaaagattctaaaatgcatgttttatactaagttttaaccagtcaggaaaattttatgtaaccagtgatagtttatttttttgtatgaattttgtttaggctacaatgtttagcttttgttaactcctcactcttgctgtcttaagttcattactatgtttaatggcgtacttgccaagatatttagcatgtaaaaagcagggttttgattaaaaaaaaaaaaaaacagcttcatattgaagctgagacttacaataacaagttgagtggcaagcctggtatgctgtgtcttattgccagaatcttagtaaatgtaatgttttaaaagtttattgtctttgtatattaataacaaagtatgacaagttaagtttaaataagagttaaaaaaataagcagagaacttcttctatataagcacgtaaacagtaataccattatttttgtagctgcatgaaataccattgcatgtatatgtaggatatggctataatatacatttcaacagatttgatgacattgggttgttttctcttttgtctacaatgaatttcaaatttagttgcctacttttacacattttttatgttgcgtaaattcttaaaagtagaatttttaggtcacaggatatgagtaactttaatattttttaggattgtcaccttgtccttccaaatgactcttgaactcctactaggcaggggctggattctggaaagagaaacaattgttcttgctcctctttgccaatactgtgctttcctgtcctaggccaatctaaatggtggaaaaaaaaaacaacaacaaaaaaacaaaaaaaacctcatgttgtcatatgcactttcttaatagaaaagttgagcattgtttaatctgtttgtggaacacttatttatatcactctgtgaattgtttgcccttcccttttgttggtttattcatattctttccctatgttagtgagttgttgtcttagttcattttggctactataccaaaataccttagcctgagtaatttgtaaacaacagaaatttattgcttccagttctggagactgggaagtgcaagatcaaggtgctggcagatttggtgtcagggcctgttcctcataggtggcaccttctatgtcttcacatggtagaaggggcaaaaaacctccctcacatcacttttataagggcactaatgctatttaggaggatgcagcccttatgacttaatcaccttccaaagtctccacctcttaatactgtcagcattgggggtaggtttcaacataggaattttgtgggcatataaacattcagactgtagcacttgttcatcttttttttcctggtaaaattagacttttaaattgttttttctattgtttgtcttgcccaaactgttccctcctcgccaccaatgcttatttacaagtaattgatggataatttctatatcaaactagaatgaaatgaattgaccttaaatactaataatgtgttaatttttgaaggactataggaaagtatgtattaacattaaggccattggatttccaaaataaattatctaaagactaggtcctcaatattaatagcatggaaatgtgtgtgtgtgtgtgtgtgtgtgcgcgcgcgcgtgcgcgcgtgcgcacgcccgcgtgcttatgggtatgtgtgtgtgcgtgcatgtttgccctgatatgagaattacttactgtattatacaatagtcattgaatttctgagttttcttggtgtaacagaaagatgatacaataagttgtttggttttatttctatgtgttgggatttgaattctaattttagggtaaaatttctgaattttttctaatccattatattcaagggaaggaggacatataaacttcagtatgttattttgaattggctcatattccatttctactttgtctccatttctagaatggtatccatatgtaaaagtatttaatttttggtatggtttactttctctttaacactcagtttaattaactgagaacaaaattcaccttctgtgctgtgcaacttcagaggtgccaaaatagcaccttatattaaaaaatatcttggaaatatttttgagtgctttgaataaagtttttccagcaacattgatttatattttgttcctcaactcattatgctactttacacctgggttgtgtctgctatggaagggcatcctccatcctcccttttccaactggccaactcctactcatcctcacacatccatcccaggtggcatgtcttcctggaaagcttcacacacacctccagatggagcctaacactctctttcttgcaccagctcagcaccttattcatgcttacatttgggcacttttcttttttttttttgagacggagtctcgctctgtcgcccaggctggagtgcagtggcgggatctcggctcactgcaagctccgcctcatttgggcacttttcatgcttgtattgcatcagcctagacatttgccttttctttggactttgagctcatggacctatgtcaaagaccagtatgtcttattcctttccatgtgcgcagtgcctgccagaaagttggagtgataaattatgagttaaagtttacattatcattagatttaggataaatttgaagttaattcaacagttatttaagttattctgttatcttttgaataacttttgagaaagtaaaaaatggccctggcagctgacaggccacataatgttcccaactgaacataaatacctcttgcagaatataaataatcagacaagcctacttcttgagtatgtctgaaacaagactgagaaaggaccctttccaactacaaaagtaattaaacatccctctcttatgactgacatgaatgattgctgcttctttaccgatgatgactccaactcagctttaatcctctgctttctagattaaatttgccaagataatcagtgaattgtccctacctcctgacagctcccagtccaaacctggcctttagtttcttaaacctttcttggaatcacccaaaacaaactgaaatagtatcctaagtatccaccagtttcttaaaattctccagttactttggtgtactctttcttgctgtcgtaagtgaatgaaagctcaatttatttactacaagagtgttcctggtggtctttgattagtgggcactagagtgagtgttggagtaatttaagaaagaaacatttatctcagtctctgccctttggatacttagagtttgcctggggattctggccctacttgctttaaataaacctttaaagtggcattgtttgctgtcaagactagagtagaggagaagagtgcaagtcacagctaaggaaaatattccttaagtattgataatttctagtgtggatctcaaagggctggggcattctgtgtgggaaaggctgagagctggggagaatcattatgtgttacaggaagagaggagactattttttgaaagggaaagtatttgaagacttggtggccaataaggttggacaggtagaggagatcggtgacagccggtgaccttgtgagaactcatctacagacagtgaaaatcccggggttcggggtggacacaggagataattagtaggaaggggttaaaatactgaaagatgagtatagtaggtcgtatttgatgacaggaggatcagagagtcttttttgaaagatgagtcagcaggacatggtaacttgataagagcaaggaattgggtggtgggctgctgtagcagatgcttttgatatggtcttggcccacctgtgagttcacccacagtggacatctcccatgcatgccaacagctttccatctcaagggcctgatctgtgcttctctaccggagcacattgtcagccctgtggaaatttactcttgctgcagagcagcctcgaagtataacctttactcagtgaagggctggagtcagaacacaaatgcccattttccccttctcttcgtgggacaattctgaagcacattatttatgtcttttcagaacatcctagggacattgacccccagcaggaatgtggcataccacccccttccatggtttttctctctccccagtcaggctttcctcacttcctaacttatgctccctgggatcacctccccagttcactatgccagactaaccaacccaagttcttatctcaaggtgacttttgggggaacccaaactaagatgggtatcttggataattgggttaattattatgccatggaaaaatggaattgggattctttcccaggttaattaatgactgctgtctagtgaaaaaatgactacagtcatctcaagtgtattttatatatcagtgcaggaatatggcaaaatgctttagaattcgtggcttgttttgaggaaaaaaaatatgctccaaaccatctgcaaaagtattacagtgatctcaagtggaacataggcacttgaagcagtttccaggcacattagattgttgtcaacaagaagaaaaatatatgccatggggaggagcaagaagaaagagagggtctagaaatccatgattttagcaagtcaggaaaaataattttcagcacgtaagcagggcaggatccctgagctccttcacctggaagtcatccaggtggtttaagattctcaggctattggcaactatgatgtggctcctgccaggttaaggagcattgatgattgatcacaagggaaaggacccagccatatgattgtttctgtcagcttgtactctcctgaaagtcatggttaatgacttgagccaagttaggaaaaatatttccgttactaacaatatagttgttaagtatgctccatggggattctgaaatatttacttgacagtaatgagctttagaatttcattcttttcctatgattcttcatgatcacatttgcatccagatctttgaacactcagcacttgatggagtttaatagactaatggcaagaaaattgctcataagtaaaggaagcagtgaatccatccggtttccatgagcagtcatacctgagttcttcagcaattggaacagatgcgtcactgaaaagatgcctgcactggggtggtcctatccattacattctcttaggaaatgaagccctggctttccttagccctgtgatctattttgaaccttattctagcggagaaggaatagtgtttattgattttttttctcctgttgtctattatttagagattcttaattctactaaaataagttgggagaacacatattgtttgtttagtatttaataaattttggagaatccatataatcactttacagtattctcatcaatcacatgaattaagtaataaaataataaaacatttgaattcttaggaacatgtattttttaatcagaaaatattcacctccgtggttagcaaacctcatatacaggaaaataaaattaggccatgatcacgttagttatctctgagagagcacttttagaaataataatctagaggacaatgatcagaaaaggaagaagtagcaactaatacttaaggatacctacctatgaaagaagatggtaatagatagggtagtttcttggtgcatcagtgggttgaggtgaaataagtttattttatagttttgtttttgtttcctttaagaataaaggaagcttatttgagtgagcttctagactgaggaagtgtagattgacaatagaggaaattagagggtggtgtttaacctggagcgaccccttgcaggggtagatttaaggtaacaggtgttaaggctgtggttaactagttttgggcttgttcacctcactttgtgaattcttccactgacactttgctcattttattgaaataactgatttcaatttctggtttctagtcttcagttctgctaggtatggtctcagacttaatgatgaaaactgttgattctgccagacacatgcccaataaaatgcttagcttttagcagatcctcaataaatatttattaaaactaatttgaacatattttcctgagtttgggaagaagggagtgagacaaataaaaattataatgtatttgatgtaaactggagaaaattcagtgtaaattccctctactttcctcagtctgtttggagataaagtcatctcctgggagaataaggggatggattagagactcgaagacactggggagtgttcagaacagctgcttatggaaaatgcatggaaaaaaattaaaaacttgccaagatgaactgaatatccagctgaggctgcatggtatgaacttgttgagtttcttaggatagttctatgcctttttctagttctttggtcactcaaaagtggagaaagcagagaggggttatctttggtgagacgggtatggcagaaagcctgaggactggggattttggagtgtttgataaaaagatgaaatgttcagctgaaggttgtgatggcacagagagaatttcaagccagcaggaaggctagagagggcaggggctggagtcataataagctagaaaacttattatgtgttctctagcttgttgcctgtggggttgaggacattcaagattgtgttggtaggaggctgtagccacagaaggaatgatagcttaaaaatcttaagaggttgagtggtctggattgtgataaagtgcaatttacagctgggcttatgggttgctaatgtgtaattactctcacaatttggcaattctcagcatctttaggagtgttgtctagcaaaattaaattagattctttaaacaagcaaaaagaaacttgttaatgaattacaaccaagtaagatggaaacagttagtgtcaacatgatgagtttgtgagattctatgtgactttaagactttgagcagccaagctaatgttcagttcaaagtaattgaatttcatgtatggaagaatgccttatgaaacagccgatcagtgcttttgctagccagttttgaaatgttacatgtccaaacacctcataacttatgcatgttctccagtgagaattacatcataggttgaaagaaaataaatgcatccatgattcttagatgttacataatctaagcacttaataacttcctagttacataatctgtagttattatataatctcatggctctttacaaagggggaaatcaaactattctcagagaaattcaattggatgattggatgaaagaactctgtgtctgtgtgtgtgtgtatatgtgtgtatgtgtgtgtgtgtgtaattttgcacatatacaaatacttaagtgctggttagaattgatctgaccctctccctgactgcttttcccagcccactccaatgaacaactgggtcatctttcagctccagaacattaaaagttgtgacctgtgccatcccaggactatgtacaggattccttggagtcataaggaatgttcttcattcttccagccatttcactctgttcctggcttttggctctgccccagtagttatgcttagccctacttgccctgtcagcagctcctgaaccagttgcaggttcagttggtgacttcaagatggggacactggcttacagactggcagtcaccagaacacatctgtccagagccccggttgccccggtcctgttgaaacaggcgctgcaccttcaggtctctattttccttgcacctccgattactcatcatggtggagtctgggtaagaaggaagttgaagagatgaaagcagatagagttcctgaggatctcattgccagtcgtggctgtctattccctcccttggcagcccagtgtctcatttgaggttagacacctgtctggtgcagatgtaaactgatatacctacctccccatttgcagcaggaatctggagtctcctatggcaattttgtgggggttgattttgggagacttttatctagacatttctgccttgtttaacgtgtggcttactttcctgttctgtgcatgttattatgtattactggcataataacatgcacagaatgcatgttatttccttttggagcacattgttgcaaatatcgatcatgcaagacatgtacatttgtggcagactcttaaatgtgtaaggatgcagtgaggttttacttagcctgatcgttccatctgtgacttccacttccttgccgtccctgccctactacaattcccaactgcagactctgcccagatgtaattcagcaaacattttaaaataccaaattttctctctacctctgtcttgactgtggtcctcattgtgcttctttcaagtatggatcatctagtctccatccttgtttgtgaagttgtcctgtccttcacatatttttaagaggggagaggagcaacgcggaactgtatttcaccgctagagtgaacataccatatcagaaggcagaaatgtgtatttttgtaattacacagcatgtgtttttgtctgtgggtttgcttattttgcaaacaaatccacatggtttacttgctagtcttcttgaatttttcagatggtgagcctgtggatcctcatctcatccaagatgacttcctggccacctcaggccatgttaaacaacctggaatgctagtattactaccagcagtgtctgagggagacatcccagaggctgatggttttctagaatcatgttttcagggaaaagggaataatttttttatgatgaagtaagttcttaaaaaattgccttattcttttggttaatgtttcttaacagctttgtggggaatggttgcacactttataaagtttcctttacaattggggaacttggagaccaactttaatgttgattgttaaggctatttcacttataaaatttagctagctgttaaaaaatttctctgctgtatttcttatatccacaagggattagaatctattgcttttgcaatgtaattttaattagactgcaaattcaatcatctgactaactcttcccttgtcatttaaaattgtttgcaagcttgaatgggaaaagttaaaaatgagaccagataagcatgtgcattttcattcagataagactacccacaatggatttaatcatttaaccagttttaataataataataatagtgaaaattacataatttattgaacactcacctagtcagctgttggattttacatgtcttataatttatctcattcttctgaatagctattcaatgagatgagcatcgcatctcaaagtcgagaacaggcttagagaagttaaaggaacttcatatgtttccattaacttgtaggttctttggctgggatttgcacctacagttcatccatctgggcaacccatcatcttcacagtgcttagagcttctagaataggaccctggcactgccgttgtatactcaagtatcacatgtatatttttaagcactttaattgttaagtctttctgatttcaacaggtaatgttgctattatatgtcatgcacaaataggagacagctgttaggcctccatccatcctgtgtctgttacttacatactgaaaagaaatcagctggttgtgttttatttgggagtgactggaattgatctgtgcccatttttgtgtgtgatcatcttaaaaatatatctgttactatggaatgttctgcagtcacttcttaaggttgaatacacagttgatgggaaatatcttttaatctacatacaaaggaggaagtttaccacagtgaaattcagacgtatagactgttgttgtacaaaatggaactttttcctcctagaatttggcagacttttgagtccaggaggaggaggggtatataggtggatggaagattgaggaaacatgaagttgctttagaaatgtaaggagttgattaaaaagtaagtatagatgcttattttacagagctttgtaactttgtctcactaatgttaacattggcctttaaaaaatgatagaatttagtgttgctcttttctttacaaagaaaactataccatagaaaatggaattttctaggggacagtaagaaaataatatatatatgatttaaattctttattttattcatttaattctctttgagaaaacttagtgcatatgtatccaaagtctgtaaccagattgttaagttaaaaaatggttttcaggctgcgcacaatggctcatgcctatagtcccagtactttgggaggctgaggtgggcagatcacttgagcccaggagttcgagaccagcctgtgtaccatggtgcaaccccatttctactaaaaatatagaaattagcagagtgtggtagtgtgtgcctgcagtcccagctacttgggaggctgaggcaggggaatcacttaagctcgggagactgaggctacagtgagccaagatcatgccactgttctccagcctgggtaacagagcaagatgctgtctcaacaacaaaaaaaaggtggggtggggtgggggcggttcatacttaagaattacaaaaggatttctggcaaagttgtactaaaaaatagatttctttttgtattgaaaatataatctttagaaactggatttatattcctttagcagcaaacctgattaatgtcagttaatagcttcttcttaatcaagtacagacataccttggagacactgcaggtttagttccagactacctcaataaagcaaatacctcattaaagtgagtcacacacatttttagtttaccaatgcatataaaagatatgtttacattacatggtagttgattaagtgtgcaatagcattgtgtctttaaaaaatgtacatactttaattaaaaaaccttttttgctaaaaaatgctagtgatcatctgagctttcagtgagtcttaatctttttgctggtggagggtcttacctcagtgttgatggctactgattgatcagaatgatggttgctgaaggttaggatggctgtggcaatttcttacgaaagtcaacaatgaagtttgccccatcaatggactcttccttccatgaaagatttctctgtagcatgtgatgctgtctaatagcattttattcagagtagaacttcttttacaattgtcatcaatcctctgaaactctgccactgctttatcaactaagtttatatagtattatacatttttggttttcatttcaacaatctttgtagcatcttcatcagaagacaaagaacccatgttctttgcttatccattagaagcaatgtctcatccactcaagttttatcctgagattgcagaaattcatttatatctttaggcttaacttctaattacagttctcttgctgttttcaccaccactgcagctactctctttactgaagtcttgaaccccctcaaagtcatccatgagagttgaaatcaacttcttccaaactcccgttataattgctattttgacctcctcctatgaatcatgaatgatacatagaataatacatcctttccagaggttttcaatttactttgccgcaatccatcagaggaataactgtgtcagctatagtcttacaaaatgtatttcttaaataataataataataatacttgaaagtcataattactcctctatccatggggtacagaaggaatattgtgttagcaggcgtaaaaacattaatctttttgtacatcttcatcagacctcttttgtgaccaggtgcattgtcaatgagcagtaatattttgttttttattttaatattaaaaaaaggaatcttttttttctgagcagtaagtctcaacagtgggcttaaaatattcagcaaatcatactgcaaacacatgtgctgtcatccagactttgttacatttatagagaacaggcagagtagatttagcataattcttgaggattctgggattttgggaatggtaaatgatcattggcttcgacttgtagtcaccagctgcattatcccctgtcaagagcatcagtctgtctttgaaagctttgaaggcagacactgacttctcctttctagctaggaaagttctagatgacacctttttttccaacagaaggctgttttgtctacgttgaaaatttgttgttcagtgtagtcaccttcatcaattttcatagctagatcttctggataacttgctacagcttctacatcagcacttgctgcttcaccttgcattttaaaattatggagatggcatcttttcttaaactttatgaacctgtcagtcttagcctccaacttttcttctttagcttccttacctctctcagcctttagaaaattgaagagagttagggctttgctctggattaggctttgttgtggcttcttacattttctattcagatcactaaaactttcttcatatcagcaataaggcttgtgtttgttcccacacagctttaaagaaatacctgagactgggtaatttataaagaaaagaggtttaattggctcatgattccacaggttttacagaaggtatggtggcatctccttctggggaggcctcagggagcttttactcatggtgaaggccaagtggtagcagccatcttacatgacagaagcaggatgaagagagtgaaagaggcagaggtgctacacacttttaaacaaccacatctcgcaagaattcactcactattgtgacgacagtaccaagggggacgctgttaaatcatccatgaagaatccacccaatggtccagttgcctcccaccaggccccacctccaacattggagattacaattcaacatgaggttttgtgaggacacagatttaaaccatatctttctcccctgaccccacagatctcatatccttctcacattgcaaaatacaatcatgccttcccaacagtcccccaagtcttaactcattcagcattaactaagatgtccaaagtctcaggtctcatttgagacaaggcaagtcccttctgcccatgagcctgtaaaatcaaaaacaagttagttacttccaagatacaatgaaggtataggcattaggtaaaatactccagttccaaaaggtagaaaacagcaaaaaagggggttacaggcactatgcaagtcagaaacccagcaggacagtcattaaatcttaaagctccaaacaaaataatctcctttgacttcatgtcccacatccagggcacactggcatgagaggtgagctcccaaggtcttggggagctctactcctgtggccttgtggggtttagcccctgtggctactgtcatgggctggcattgagtgcctgtggcttttccagtgcagggtgcaagttgccagtggtttacccttccaaggtttggaggacagtggccttctactcacagctccactaggcagtgccccagttgggactctgtgtgggagccccaaccccacatttctcctccacactaccctattagaggttctcagtgagggctctgcccctgtagcaggcttctgcttggacatctaggctttttcatatatcctctaaaatctaggcagaggctcccaagcctcagtctttctttctgtgtccctgtgatcttaacacagtgtagaaaccaccaatgcttctagcctgcaccttctgaagcagagtcctgagtggtacctttgctcttttgagtcagggctgcagctggggcaacagggatactgggagcagtgttctaaggctgtgcggggttgcagggcccttggcctggcccaggaaaccattcagcccccctaggcctccctgcctatgatgggagattatgcaaattcctgcagcctgcttgaattcctcctttgaaaatgggcttttcttttctaacacagaagcaggctgcaaatttttccaaacttttatgttgtgcttcccttttaaataagagtaccagtttcagataacatctttgctcatgcatatgagcatatgttattagaagcagtcaggctatatacttgaatgttttgctgcttagaaactttttttaccagatactctaaatcatctctcacaagtttaaagttccacagatccctagagcaggagaacaaccaggcaagctttttgctaaagcataacaaaagtgactgctggagttcccaaaaagttcctcatctccgtctgagacctcctcagcccggacttcactgtctatgtcactaccagcgttttagttacaaccactcaataagtctctaggaagttccaaacttcccttcatcttccccctcatcttcctgtcttcttctgagccccccatactctttgaacctcttcctattacccagttccaatgttgcttccacattttcaggtatctttgtattaataccccactcctggtagcagttttctgtattagtctgttcttgcactgttataataaaaaaatacatgaaactgagtaattattaaagaaaagaggcttaattgtcttgtggttgacaggctgtgtaggaagcttggcagcatctgcctctggggaggcctcaggaagcttgtactcatggcggaaggcaaagtgggagcaggtgtcttacatgggaggagcaggacaaggggagagagagagagagagagagagagggagggagtgggggagagatgctacacacttttaaacaatcagatctctcaaaaactcactcattgttgtcatgacagtaccaagagggatggtgttaaaccgttcatgaaggatccacctgaatgatccaatcacctcccaccaggccttacctccaacattggagattacaattcaaaatgagattttgtgggaacacagatccaaatcatatcaaggctatttctctttcttatcatttgtgcgttcactggagtggcacttttcatttccttcaagaacttttcatttgcattcataacttggccaactgtttggtttaagaggcttagcttttggcctgttttggctttcaacatgccttgtttactaagcttaatcatttctagcttttcatttaatgtgagaggtgtgtgaatcttccttctgcttgaacatttagaagccattgtagggttattaattgtcctaattttagtattgttctttcttagggaataaggaggcccaaggcggcgggtggggatggggagagagagagagagagagaaagaaggagaagagaggaaagagagaggagaagaggagagagagagagaaagaagaggaagaggagtgtatgtgtgtgtgtgtgtgtgtgtgtatgtatatatatatatatatatatatatatatatatatatatatatatatatatatatatatatactggtcagtggagcaatcagaacacatacatcatttgtcagttaagtttgccttctcagccaggcacattggctcacacctgtaatcccagaactctgggaggctgaggcaggaggattctttgagcccaggagtttgagaccagcctgggcaacatggtgaaaccctgtctctacaaaaaatatgaaaattagccgtgtgtagtgatgcacatctgtagtcccaactacttgggagcctgaggtgggaggattgcttgagcccaggaggtcgaggctgcagtgagctgtattttgcaccactgcattccagcctgtgcaacagagtgagaccttgcctcacacacacacacaaaattgctgtcttatgtggtttggtttgtgatgctccgaaacaatttacaatagtaacatcttctgatcacagatcaccataacaaatataataataatggaaaagtttgaaatattgcaggaattaccaaaacatgacacagaaacacaaagtgagcacattgcttttggaaaaatggcactgacagacttgcttgatgcacgatttccacaaaccttaaatttgtttaaaaaaaaagcccccaaacaaaaaatacagtatctataaagcataataaagcaaagcacaataaaatgaggtatgcttgtaatatttatcactgttactgtgtagggagattaaacatgattgtagctaataaaacatgattttgtaaacacctgtaactctaatttccatgaatctctaaaaatagaactttgtgaaacaatcactagcccttgaggcaatacctagtgcatagtaggtgttcaaaactttttgtgagtgagtgaatgaataatgaatggaagcgtttgtgattatgtgagctttaacatgtcctttcactgccaatgcaatttcttgtgattctaatctgtaaaaaaagtattcctctcttactattccctgttgccttacttgggtatacttagctttatgctcagagaacacacttgcttaaaactagagtaataatcacaggtacaatgtccccaatacatttctgtggaaatttttgtaatctgggttgcattggtagtaaccaagtttcatctagggtagctacagcacctcagatactctccttcaccagtgccatctgctcaagcctgtttctatggtttgctgttgatgcagctgttggagctactctcttggtcacttgcttacccggcttctgagattcctctaaaaatcaatcacatggctaattggctgctgctgttgatcagggccagttggcctagcatcataaatgcattgctggttggcattgatagtcttggaagtggttttctttctgatataagtctctttcactctagtataggatagtagttaggagcatggtgtcttgatgcagaactatgaatgttgtcctgggtcagccagttactagttgtaatttgaaattatgggcaagttattgtacctcactgtaaacatctcagatttctaatctgttaaatggaaagacaagtagtagccacctcttaagggatttgtattgatctctgccctaggtagtgtaacatacacttccatctgtgggaaaagtctgtgactgttgtcactaacctgcacagggatctgggcaaaaatgaggaagactttaacacaaagctgggactgtgtttaagatctgccaccctgcctctgattatcttcacctagtggagggtgagcaccccctctctgtgacttgccgacttggcaaggattttaggtcactgtttctacccagatgccagtatccaattaaactcttgagagtctgtgatcattatgataaaaatgttcattctggaaaagtttgaaaatgctttctggttagaatgagatttttggcatgttttaattgtggtctttggctataaattcctgaaatgctgacatggttgaatttatttttgctttaaacaaaatcgttaacatttccaagtgtccatatgagctcgataaatactttgcctctgcttactgcgtatgtgaaccgagtgaagaggagccatcatgatgtggggaatcttgaacatttttcttcatttagcttgatggggaagtgaattgaaaatacttctttgtcaacataattttggggttttgaaattgtgtttgggttttcaggaaattggtggtaatcttgtattagctgaaaaaaagtgaattttaaaattctcagtgaagaagcaaatgatttatttttcatagaagaagctgcttttttcaagggaatttgctgccaagctgtctgcagtggcttcagacattacttgaccttttggcatatcaagaaattgtggttttttggtctaaatattaaatacctattttaggaaggctgggtactctatggtatatagtgcaagagcagcagaaagagtcagccttgtgcatttccacatctgcaagcaaatttggtttctgtactgtccatcaagcagatcttacagaatgaattttcatcccctcactagttgccatgcaaattctattaatagttctccaagaaataaatcacagtgacccttctgacaaaggtagacagtgaaaaatagtacaaggatatagtacatccacccttaaccagaagcaaattgtgttttccctttttatactacaaaaagagaaaacaatttacaaaaacagtttcttccacacatgtgttatctatgatgtgatagactgttcttttcatagcccttttctgttttggtgactgcaacggggtattatttggaacatgtagtcttctgtttggacaccatactcgggctgtttttcttctcgcagcctgtgctgctggaaatattcccccgtctcatagccatcataagtaaaggacaccttccactgcgacatgctgcatgctgttaaagcccttcgatgccagccaaatgttacaccgtgccttccaggatatctttaattaaacccttatatatgcatttataaccatctgatgaggggattaatattacttgtgcttaacaaatgtgttaattgagaaaggaaaaagaatacaaaataaacatttttaagtaccttccctatcgtagtcactgggctaagttcacagccaccttgccaggcagaagttaccatccccatttatgattgggaactgaaacttgaggcacttttgggaaactcttcaactgattattcgatcgtgtgaaactgaagcccatgtgcaacatcagctgcctccctgagtttcacagtgaaatgtgaaatatttaagatcctcagtgaatattgttgaatgtgaaagatatttactaaattgtaatcagtttctcaaactatgttctttatactacaaggtaactggattaaaatggactttccataggtacctcattcttagctcgaccccaaataaacttgggatctcctcctaaaattgtccccacttcagtgttcccatctcacatgctccagccagaattgcaggagtttcccttgagccccatttccctttctctttccatgttttatcaggcaaaaaagtatcacgattacctacgaagcatcactgccaattgcaggggtgcctgagagagcagcaggacagagcccagtgcagccccacaattcagacctgacacctgtggaaggagatgtgtgtattggggcaggggatgaaatggagcaagatggggacaggagagcttcagactgtgatgcagatcagttctatgtggtcaataagtaaatctgcatattatcattatattacaatacactagccactggagatgcagtgggatataccaccttatgtaatgataataagggacacccaacaaatagctgatgactcactaaaatgagcagtacaaattttattttgtttatcaaatgtttcttctctcagaaaaaacaacatatgtagaattttgtgattaaatttgatgcttgttttaattactaccacatttaatatagtgtgctgtttttccttgcacttagtctttttgtgaaaaatcaagtaccaaatatctaaggtgagtcatcagaggtaaaaagattggtccttctggagtacttgtgaccgactcatttcatgagatttaagaaacactgtaatgccgtctttccattgggtatctccatgatttattgatatgtttttagaaaatgaaaacaagtaaacaaattttaaagttatccccactcttattgaagaaagtctgtgtataaaaatacatatgtatttaaaagtagttaaagtcattgtatgttatcaaattcttgtattaccagaagacttactaaagaacagtagtctttgtgattacctaatactggatggagaggtgagctgagtagtgctaggggaatctaaatctaaattatttgtcgtattcagccaggatgagaaacgttgatttgattgaacaaataaagaaaatagaactaattttattttattttattttatttttttgtctggggcatagaaattttattttcacaaaagtatgctttattacactagaatatttaaaaatgaaatactatatatgtcaacatttgaaaaaaaattttttttgagacagtcatttaatatcatctttattttgtactttctgtgattttttaaaattatactttaagttttagggtacatgtgtacaacgtgcaggtttgttacatatatatacacatgtgccatgttggtgtgctgcacccattaactcgtcatttaacattaggtatatctcccaatgctatccctctcccttccccccaccgcacaacagtccctggtgtgtgatattccccttcctgtgtccatgtgttctcattgttcaatccccacctatgagtgagaacatgcggtgtttggttttttgtccttgcgatagtttgctgagaatgatggtttccagcttcatccatgtccctgcaaagcacatgaactcatccttctttatggctgcatagtattccatggtgtatatgtgcaacattttcttaattcagtctatcattgatggacatttgggttggttccaagtcttcgctattgtgaatagtgccacaataaacataggtgtgcatgtgtctttatagcagcatgatttatattcctttgggtatatacccagcaatgggatggctgggtcaaatggtatttctagttctagatccctgaggaatcgccacactgtcttccacaatggtcgaactagtttacagtaccaccaatggtgctatttctccacatcctccccagcacctgttgtttcctgactttttaatgatcaccattctaactggtgtaaggtggtatctcattttggttttgatttgcatttctctgatggacagtgatgatgagcattttttcatgtgtcttttggctgcataaatgtcttcttttgagaagtgtctgttcatatccttcgcccacttgttggtggggttgtttgattttttcttgtaaattggtttgagttcattgtagattctggatattagccctttgtcagatgagtagattgcgaaaatgttctcccattctgtaggttgcctgttcactctgatggtagtttcttttgctgtgcagaagctctttagtttaattagatcccatttgtcaattttggcttttgttgccattgcttttggtgttttagacatgaagtccttgaccatgcctgtgtcctgaatggtattgcctaggttttcttctagggtttttatggttttaggtctaacaattaagtctttaatccatcttgaattgatttttgtataagatgtaaggaagggatccagtttcagctttctccataaggctagccagttttcccagcaccatttattaaatagggaacctttccccatttcttgtttttgtcagatttgtcaaagatcagatagttgtagatatgcggcattgtttctgagggctctgttctgttccattggtctatatctctgtgttggtgccagtaccatgctgttttggttactgtagccttgtagtgtagtttgaagccaggtagcatgatgcctccagctttgttcttttggcttaggattgacttggcaatgcaggctcttttttggttccatatgaactttaaagtagttttttccaattctgtgaagaaagtcattggtagcttgatggggatggcattgaatctataaattacctggggcagtatggccattttcacgatattgattcttcctacccatgagcatggaatgttcttccatttgtttgtatcctctttgatttcattgagcagtggtttgtagttctccttgaagaggtccttcacatctcttgtaagttggattcctaggtattttattctctttgaagcaattgtgaatgggagttcactcatgatttggctctctgtctgttattggtgtataagaatgcttgtgatttttgcacattgattttgtatcctgagactttgctgaatttgcttatcagcttaaggagatttggggctgagacagtggggttttctagatatataatcatgtcatctgcaaacagggacaatttgacttcctcttttcctaattgaataccctttatttccttctcttgcctaattgccctggccagaacttccaacactatgttgaatgggagtggtgagagagggcatccctgtcttgtgccagttttcaaagggaatgcttccagttttccattcaatatgatattggctgtgggtttgtcatagatagctcttattattttgagatgcgtcccatcaatacctaatttattgagagtttttatcatgaagggctgttgtattttgtcaaaggccttttctgcgtctattgagataatcatatggtttttgtctttggttctgtttatatgctggattacatttattgatttgtgtatgttgaaccagccttgcatcccagggatgaagccaacttgatcatggtggataagctttttgatgtgctgctgtattcggtttgccagtattttcttgaggatttttgcatcgatggagctgattttataaaactttagtttaattttttttttactttccttccagatctaatttctctccaacaattcttacatggaagtataatatttttctcctcatttgttcttgagctattatagataaattttaactgaacacttttgttgttagaaccgatctaacttgggtttactgttttgtcaaattaaaaatcaaaatctatatatagatatatgtacacatatcccttcctctagaaaattggtagtttttccctctgttaggaaataaaaaatattttaataatatcacttatcagtttgggaaattagtatataaatcttagatgaatggcttatatctccactggtcaaagaaggttgcccctttgaatttgacagttggaacaagtctttatttactctatagagaagtcatctaatctgtttagctttttggtaatagactttagcttatagaatatatacatgaccttgtgggtcagattgtctgtatttgagtccttgcttgatgatgtctagctgggtttacttaatctttttgatcagtttccttatatgtaaaacaagaataatggttcctacttcataggatggctgtgggatttaaatgcaggaacctgcaggaagtgcctggagtagtcctggcactaggctcccagggaatggtagctattactatgaccagtgcatggaaataacgtgtgtttttatttcccaaattcaaagttaatttttgaaatgaaggtttatttccctgttgaattctaaaagatttgcacatgtataaagaaaagacgattataatttagaaattatattttggaaacttatcagagtcttaaggttttgtgctgttccctgaaactcctttgacatttaaaagttgtcaagacaccatcaggtatttcaaaatgagatcagctctgattcatttggataaatcaaatgatttataaagtttatttgattgtgttggggcttttgtttccatatttccctggatcttatttgatgggtgtatatatgtgtgtgtgtttagtcaagagtcattatggagtggcttggatttgggtgaaaagaaaaaaaacctctttggaaattaataatttctacatcactgtttaaatcttttaactcttattcccaagttttaacagctccttaggacagagtttaaaacaaagtgtcatgggagtccacatgaggagtgactaactcattctggaagacctcctagaagaagtgacatttgagttggccttgaaggatgaattgttcgccagatggagaaagggatgggtgtggggtggctttggccgaccaaaggcgtgacacgtgaatggtgtggctttggcagaccaaaggggtgacacgtgaaaaggcagagctctgaaagcccacatatttcattaaccgtgggaaattaggtgcctggactgtgagagattacaatgtgaacgctgtccctggaaccgtgaaagagtggtttcaaatggtgaggagcatggtcaagagactggaaatggatttgggaccaaattgagacgggcctgtgtcctaaggaatttgttctttacatagaaggcagtgctcacatttgtattttagatttctgggtggagaatcacctgaagagggcagacgagttgttggaaggtgttgaccgtaatacagatgagagatgaactgttgtaatggaaatggcaacccaaggagattaggagcaagatatttaggcaatagaattgatttgcagaaggagaagggatttgaattaatttttatggattatatatgatcaatgtgagctttaaccttgtaacagccccatgaaagaagttagtattttgtgactgattttttcgggggaagaaatattaatacatttctcaaataaggatactgtagtccaagaagtttgggaaacagtagattaaacagagtgagatcatttttgctctatttatattatttctcataacctttaatttggcaatatgtttggcgaattcccaagagagcaatatagaatgacagaaatacatctcaaaaactatttgttagttgaagcttacttttttattttaaaaaatttcttataagactcatgttgagagaggtcttatatctttgcattacaaacgggaaactgagaataagattgagtatcttgtccaaggattgtgtacctagtaagaatccctttatatttaaacccatgccttttatttttcatgatattgtagttctgttgaaattgttggatttagggtttgagcctaggagacgagacgagtcaagactgacttagaggctttagtttgagtgaccatggctgctggcactttgaaccagcaataggaaacttgaataccgaagcagttttggttttgttttgtacatgtaggaatggaatggataatcatttaagccttggacttgttggatttaagatacttggtggagatgcctcgtaggcagttggaatatcaaaaaatgaaaggtatacttttggacttgacacaactataactttttctgttataaaattggccattaaagtttggatgttcaattttattatgacttcatttataagttgatgtctgaaactgccaaagtaggcagtttgaaaacttgtttttttcctaagtgcaagtattacttcacacccaagtgtcatgtttcattttacttgtgtatgttttgtcagaaagctgtctgaagaagtctttaaagggaaaatatttctactcattttcttttcagagaagtatactgtctagctcttacggcatattttaaggatttcttgacattaacaactgtccatgtgaatgaattattatatctcagtggtattctcaagagttagtcacttctgccatgaggtcatgtgtatgctttaattttttttttttttttttttttttgagatggaatctcactctgttgcccaggctggagtgcagtggcacaatctcagctcactgtaacctcttcctcttggggtcaagcagctctcctgccccagcctcccaagtagctgggattacaggtgcccatcaccatgcctgggtaatttttgtatttttagtagagatggcgtttcaccatattggccagtctggtcttgaactcctgacctcaagtgatctgcccacctcagcctcccaaagtgctgggattacaggagtgagccactgttcccagccaaaattctctggtctaactgtgtgtcaacagctttggcttgatgtgcttaaaggtttctactttaatattcttaaatattgattgattgaagctgatattccttaattttctaccattccattatcattattgtcattcaggttactagagaactagctattagattcagagccattgcccacaccttaaatgatcaatagtatcctggagaagtgatgcagacacctgaatactttggtaggcatgaagtaaatgtcaagcaatgtgaataaaatagttaatgtaaattcataagtcatttttgccaggtggcaattgaacctggttttatagattatttactccttgtaggatgatggctcaaaaggcattcgggtggtggtggttgttcgggaaagtcagatatttagcttatttacagaatgacaagcagacatatttggctggaatgcagaattcatggaattgtatatttggacgttggcttaaaattaagtggcttggggccaaattgtggaggactttgtgatatctgatttcttaagaaaatactatctccaggtctctcatcaataccagtctggctgtcacttttctgtggactagtttatcttgtaggccaatgaaacttgagctatagaatggcacacacatgcatccaacaaaatgggaccagggcctcttcccctctctctaaatttttatttctctaccaccatttgctgggatttttttttttttttggatattttgatagtgagctttaggtaagtttaaaggaaaagatgaagttagttgaatttcccttaaaataccagcagaaataaagcaaggagacagcagctgtgaaaacatacaccaaacatctcagttatggtcttatcatgctagcttcagtgcaggctcacagtgtgtgcttctgtttccatggttacctgctaggcagcagaatcccccaggttggtatgctatagagtcaggatttttcatggaaaggaaattcaagtcttttcagagtgaagttaatagttttcttttctttttttttttttttaaagcagatgggttatacatgttttaaaaataaaaatggttactgcaggtttgatttccaaactgtaagtgaagccagactttaaggcagtgttttaatggtttggaaattctagttttcaaatggtttctcctagatggttcccgtgacaacacaacttaagcaggtatcgagtatcatctttgctgtgaaatattcatgccacaaaaattcctttcatttttaattccacgctaatgaactaaggcagaagaagttagcttattcaaggacaaatggacaaatatttcaaaatcattgttgagcttaataaaattgcaattctaagtgagcttttaaaaaattgaatgatgatatcatactttattatattcttaaattgatgttttgttcccttgaaacaagtattatttcaattgctacctggaaaaaatagtattgttttatgatagaaaaatttgaatttcatagttgtagcagaagattgctgttttaataatgcctgttttgtagtgtagttaaaaagctctctcagtgttttggcatatatctttccccactcaatttttcttccaaagaaaaattttattgttaagctaatacttgataaagccattcatttgttaaaagatatgattttttttaaaaaaatagctttcatgcatgcattttaaaactttgttaaaaaattagaatgaggtgccatttaaagaataagcttctaattcattaataaaaattcattaatattttttaattttaaaaagaataattttttcaaaagtgacaattattctttatttgttgtttaatattttattttattagccattgaagaggaagcataaaatcttacattccatgatgaaacttttatgatttgacatctttatccttatcttgagatttgctgatgagaccccctttatcaaattcagatgtctctctctgatattcagtacaatatctgcctctggaccagggttcaaggaaaaggatggatacaggaggtcattgtgaagatactgggtaatagagaacatctggaggtgatcagagatagccttataggaactgaaccatagaaaggaagttcattacagcaaatggatgaagttgatggtccagaagaaatgagaaagattgacccatgttgagagttcttataagagtgtttttatttgggctacttctgcagattcagtcaggccttaaattagattttctatctcctgttatgaccctgttctgctacattcacattcttgattaaatgttatagtaaataactttatttcctttaaccacatgatgactctaatcttctaaagactttccatcacaaaacttcaacttttaaccacaggttatggctgtccataaagtatttttcagtaattttcagtctttcacatcataaagtcctggcttaggggattgggctctggaacttgactaactgggttgaatgctggttccgccacttattggctctgtgacattggacaagttaataacttgtcacagtatcttcaactgtgagatgggaatgataataataatccctcacaggattatgcaggaattaatatatcagaaatatctagtgttagttttctattgctctaacaactgaccacaaacttagctggcttaatacagacacaaatttattatcctatatttttgtaggtcagaattccagcagtcatatcactgggctaaagtcaacgtgaaagcagaaccatgttcccttctggagactgagaatttgtttccttgcctttccagctctaagagccccccaccgccccccccccacatttttttctgatggctccattcctctgttttcaaagccttttcttctgtagtcacatctctctctgcttcttctgcctccctcttccacctttaaggagccttatgattacattagggccacagataacaattagataactttttattttgagatcagctaactttttattttgagatcagctgattagcaaccttaattaccttttgccgtgtagcctaacacaggatttaagggttaggatgtggagatctttgggggatcattgttctgtctgatttgtgtttttacctcatgctatcctattatagggtagatatttgtatatttctgcaattctaatattctatctattttggagcatatatattaccacaggcagatgagagaggttgaaggaagggagaagtaggaagaattatgtcctggtattattttttgcagccacaaagaagtaatttatttgtcatatttttgtagcaatccaaattggccttcccatttggttagtgcctctgaagtttgctaaaagcagttataacgatgtggacagaatttaatctacttagctttgagacatctttttcctactgaaactttattttgcttacatctataaagtatggcctaactacatcaaatattacaatttagggtgagcaaagacttaaaacaatgtattaatatttgtgaagtgcctcagcatttacaaatgttttcataaaaattattttatgtagcctgtcagcatttggagaactaaagcagctcagctctttcagacaacaaggtgtctctgaatatttgctccctcattgcttctgccaaagaggacaggggtaagaaaaacacctaccttcttccttaattaaaatttggcagtggtatgattggtaagaagggggaaaatgattgaggaggtgagttctcagtttcatagctgagcaaactaaggtgagaaacactaaggctgctcattgctatggctgagtttctatcccagactggttacctttgtccttggtgtgaatcagtttgcaggagtaggctaggagaggcattctttccttttcctaaagcagagcatgaatacaggtattcattaagccattgtttcctagctgggtgttcatctactggcattgtcaatgattgcatataacaaaaagggaatggagagaaaaatctgttctgagttcacaaaactcactgaagaaaaaatgtaaagtcagctgatatgtcaacagcagggaaataattcattgtctcttagaaaagcgaatgccaataacaatagccatgattctggcaacagagtagtacttcagagggtcactttcagctcttggctttctcctttccctccatttccaaaggacattctccccagcaacagaaaccaagtgatttatcatggctcatgtcagctgctgaggttcacgggaccacacagagtggttggtcagccaggtctgtctttccatggctgttattacaaaggaagtattcttttataaaaagagaaatataaagtgatatatttgtttgttattaaagcctttttggatgccttagagaagattagcttcagctccagggtgccagagtaaacttgcatttgataaagccatggtcatttctactgctgtctttattgcacccaaatcttacaaggtaaaagatgtgaagaagacagcctttccttaattgtccattttgattatatctttgtatttaaaaaaatacagaaatgaactttaagaccaacttaaataaataagcaaataaatgatgtaagagataagtatgcagaaatagttattcatttcttaggggtttatacattttatttatacctattattatttttgattgaaaaattatcgtatacatttatggggtacaatgtgatgatgttttgatatatgtatatgatgtggaatgattaaatcaaactaacatgtctatcacttcatttacctatcattttttatggtgagacatttgaaatttactctttcagttattttaaaatatacattatggagtatataccttagataacataaacctttatatgctctttctaaaaatggctatttgaaaccctgtgtatagccttttgtctgtatctgtcaacttagtttttaaatataaaaccaataatagttgttagctctcttgctttcatcagggattggcaaaccacatttcacaggccaaatctggccagctgcctgtgtttgtaaataaaaagttttattggaatacagcctcatccatcatttacatatggtctttgtatgctttcgtgttacggaggcagagttgactagctaaagccaagtccaaatggcctacaaagcctaaaatatttactatctggcccttgcagaaaaaactttgacagctgccagacaggtaagttacattatatcatactaggtgatgtgggttcaaaaattatttaagacttagtctttaatagtttataacgtagctggataaaagacataccaaagtttaagtgataatacaagtcagttttaaatttatgttttcattgtctcaaatcgagtgacttttgagagtgtcctatatgccaggcagtgttctagggactgggatgtagatgtaaagaacacagaatttttgccttcatggagcttataacctggtggatcaggcagataataaagaaagaatatatagtataatgctatactatacattcttgatacattgagatttagcccaggtcacattaatagtcttgtctgcctttagcaataaattggttacttttcctaaatatctttttctccagtaagattcatatgaaaaagtggtggggggtggggagaatgaaaatacctcaaaccagtcattgtttctctaagtttgtacacgtggttcagaattcgatttttatcttgacgtagggtggaaaatattataaacctgttctggtatagtagaagaatatttgattgggaaacaggaaacctgtatcttagccctagtttagtctcttcgggctgagtgggcttgtaaagattcttaacttctctggagcatgtagggtattgtactcggtcagtatttctcaaactcgaatgttcgtcagaatcacttggagagtttcacatttttgagccctaccccctgagactctaactaagtggggcctgagaaatttcatttccagtgagttcccaggtgaggcagctgctgctgctgttttgggaacctgcttagagaaggattgcactccatcattgtggaggtccttccagtttctccattatttttaaactccctggagaagctttacagctctttgagcttgcctaggaagattccactaaataatggtttggttaagttgtctacttaatactcagggctatttgctgaggaagagatttcaaagacataagagtttttaaacacttgcttatggtcacatggattgatattcatttaattgatattatgtggtttctttgggaaaattaatgtttgctaattctaagggcagagactattgttcatgatttcttctttgtatcctgagtccatggtatgcgttagatgctcaatactgatctgtttaattgatctaaacttagagaagcacagaatacttctgaaggtcatcttcctgagttcctgttgggtttctgttatgctctatttagaattaagaatcatgaactctactggctgtcaaaactatacgcattattgtatttttgcaatgtgtattggtattatttctatagaaattccagtaagaacttcatattgatattcagtctgtctcctcctttgagtctgaatatacagcaaaataagcagaaacaagacaaacagtataataaataaaagttatccacattttctgttacatataatgtatccacttaatttcgtataattcagatgtttttgttcaaatgtgacttttacagagcatctcttaaaactgtaatgttattaaaataggtttaaaaagtagatactcatttcaacctgtttctcaaatgcccactgtggatctacaaagatgcataagataaaatttctgccattaagtgccctccagacccttagttgaataaatcaaggattgaagaaatgtccaaggagccaggcacccagtgcttcaaagttgggatttttatgactttttaaaatgttggctcaagttaaaaataatcaaaaatgaaaacagtgtggatcaacaaaacctagagttagttaccagctgaattctaacatcaagccttcagtttataagttttgaaacatggatgcacagacataatatttggggatgtttcatatgatctggagtgagaacaaatctaagtgcagagattagaaaaagttgcttagaggacctggtgtttgacatggactttgaaggataaataaagactctagagcaaaatctagagcagtgtgaggataatgagtcctagcagaaacagaccatgagaaacttctaaggcaagtagatggagtcaatgttcagggcattgtgaatagtttattgctcacagcaggagtagaaaaatggtagcgagtgagagagaagactgttaagtgtagttgggattctactgtgtggacccatgatggccagttgaaagttttatactcagtgtgttaggcaacttcaatcaccagccatagacaagcattattaatctggattatatttataccctatttcatcaaatctaaaatgccattgattgttagaaacatataaccactaaggaagaaaaaaaatgccactgttaaactatgacagaatgctgtgttgtcatttggaattattttaagttcataagaactctaagatttgttttgacacaagaaataacgaacctttgtgtcccagtttgtgcttgcatatagatctatgttatgaccgctaccagaccactagctattgcagctatcagtttgaagatgcatcaccacttcatagaagttgaaaggtgcatcctacagtcaataaaatatgataggtgaaaaagtctacatgttggatattatacataatggattgagtggaagattttttaaacaaaatgcctcccatctaggtcataattaccattataatccagctattaccattttcaagtgaaaagcttgttaattgtgacttaatgttccagaaatcggaaacctgctttttaattggaagcagtctttactctcttgaagccacgaatattttcttacctgaagggtgctcattgaaaacagctgattcctatttcgtgtttgtgttcttccttgggaaagtcttttgcatcccaagctttgtttttctttttctctttctctgttaaaaaatgttaagattttatgaaacggaagaacagccctagggaataaactcttaatcacagagctgattgagtgggtttgaaacagaagatgcacacacccaaatcaatagccatagaaggatagcagttctgcaagtctccagtaactattcttaattcagaaaagccaggaaaggtcacaggctccaaataaataaggttgtttttcttgctcctttagtgttttgtttttaaatcacccatgcctgtaacttaactgaaacgttcctttttatttctatactactaaagtgattctaatataaatggtacagttgttgaaacactgatcactgccatttcttaaggttttgatgtggtgtttctgactggtgtcagcctaccatgctatcctttttgagatgttactaataaatatttgtaataaaatataaatgttaaaaactatcagctgttaatttccttaaaacctaatgaagtcctttattaataatacctgggatatgttttgtatttaggaagtaacgtgcccagtgggaactatttcatttgttctctctgtgtgttagggatgtctaactttatctgttgagatgcaaaatatttcactgttaagcagataatattactggagaagaataatttaacatccaggaaatgttatagcccaaaatataactgtttcttactgctagtcaaaatacatattctgcttttatattttaattttttctttattgaaccattaaaaacttcaaattttgtttaggagagacaaactttaatttaacttctttgtatttttaaagtgcctgaagcatatatccattcacatgtaggtttggaaccaaaaaccacaggctcaatatttttagggaatctaatgcatttggaaattgagactgtacatataacatacctatagggtgcatttatttttttccagaaaaccaagtttaataatgtgttaagatgaaaacaagcctccctttctgttataaccttctctacattatacctcactatgatttcacatgagctattgaacttctacagtttttcttatttttagacataaaattggatgttgtatgcatttttaaaatatctcttcagctaaggagagaatgtggaaaaaacaaagagcaaacccactttgctataattatattgctgaatctaaaggatttttcactggcaccgcaaagtgtaaaagagcctcacagtgtgacatttgtgctgttgtggagttgacctaagtatataaatctaggtttttgtcatcagcgcgtattgatggcattttaaatatattggcatgcagttctctgatattaggcatgcccagggatagagtttgagtatctgcttgcaaaacgtctcagtagaaggatctaattctctggcacaattgcaagatttgggccttcctgaacaatcctactgtctgtctggggctgattcttcggaatgccatcagaacctgggttagcagcagttgaaccagggctcaataatgggtgaagagagaaagaacaattttcttttagcatctttatcctacttggctgctaggctgctgtctttcttctcatttctcttcttcctgaatcttcttctgatcccatctccttagttgagtatcttagaggcaccgttgattctagaaatagttttgattattttcaagagcacatctgccctgaatgctaaaggacatttcaaaaccatagtggtgggcaatgttttgttactttgggtatacagcatttactttaccatgcactttcattcgtggctgcaaagaacagaaaacccaaccagtagtagcttccaagagcaaaggtgaattttcccacttagcacaaaaggtctggaggtcagcagtgcaggctggttccattgactgatgatgcaggtgaccagggaccgaggtgcctgctctctagagagctgtgctggctttctttatgcttcccataaagaaaatgtggtcacaactttgtagctgcatctgagtaatcaggaaaaagtggggcgattgaagggctgcagggtgttccactcttccttcctctgcaaatgggtatttacactgcctctgctgggctccccaaagcctagtgtctcaaagtcaacttaatatttttctatttgattttacgttgttgttgtttttgttgttgttgttgttgagatagggcatccctttgtcacccaggctggagtgcagtggcatgatcatgatcatagttttctgcagacccaatttaccaggcttaagcggttcccccacctcagcctcctgagcaattgggaccccaggcacacaccatcaggcctggctgattttttatttttgttagagacagagtctcgctatgttgtccaggcttgtctcaaacctccagggctcaagtgatcctcctgccttggtctcccaaagtgctgggattacaggtataagccaccacgcctggtcagtttacctttcttatgtagacctttgatccatctggaatatgtttttgtatatgatgagagggatccaatttttttccacaagatgagtcagttttcccagcatcagtttctagataatctgtcctttctcacaggcttatgatgccacttctctgcatcggccacacctgctttctttatgatgccacttgttagctaagttggaaaacacacacacagacacacacacacacacagtctcttttctctctttctttttcttcatccctcctttatatttttctggaatttctattcttttccatttttctcttacactttgtaatataccttgatatatgctggacaaaggccctttttgccttgccttgccatttttccctattccgtactatatcatttgtcctgtttcatttttcttccccccctttacttttcttctctttttcttcttaaaattgacagtagatgatatctctgcatactcaccatatgataggacttaatttttgtgtttctctttcattgaccaccaactgtaaagcaaattttgaggtattaggtgtataaaaaggctacattcagcaataacagcctaaaaacagcatactgtgtgtttctaaaaactgtatgtttttggccactacagaaattttgggtttgttttgttttgctttggttttgactgccagatggagcaaagtgttcatgtacagctcaaacatagctctgtataatgttgcctttttttactcttgtctccttacagtcattatctgactaaaagtaattagtgtgttggaaatttagagtgaataactttgagaggaagcacttattttcttttattgcaagtaaaagatgttttttgattcagttgaatagtacttgaaagactgaacgaatgtagcaaattctgtcagcaaactggataatccaaaagttgaaaatgtgggggtctgcaaaaatcagttacagaagattaaagtacctttggtagcacattattaagaaaatccacagctgttttaaagtgggtgtttcctcatggagaaaagtctaaagtctcttgcagttacattctgatttcttcgtagcttgccaaaggttggcaacctttgctcagtacatgcctcacacggcagggagcaggagtgtctcatcatttctggggtgggtggtctccttgggggagcccagggatgccttatgcatggctgagaaattttctttctgtggccctctgtactgtatgggctttagggacaaacttgtgagggggggtgtgtatgtgtgtgtgtgtgtgtgtgtgtgtaaaacactcttcttgagctctgactgcaagaagaaatggtttgagaagacagaggaaggctgagaaaggactttgaatgtgaaaatgctattcttgtagcatccttaatgccattggtccttagctttatagatcaagattgcgagtgagccccttataggtctggggtttattgttgctaataccagatgagttacagtatgtattgcagtccttgtattttaagttacatctggtttctcttaaagttccttagtaaaccaaaactgttggtgagtggaagcctgatgctgaaaattttgaaaagcaactgtgtcagatcacaggatttttctttgttttttgttttcatagagttgttttgggcttggtgactgtttcatttaaatcaagtataaatgcacagaggtaaacagacactcctatttagtcttaagaacttggtttgatttggaattttaactgccagggcccactgtttagtgtctagcctgctttctatttcctgcgctattgttttgcttttggtcaccttaggggaaaggctacagcttccatggtcccaaagtcagtggcgctgtcagattataaactgagaagagctgattccttggtggacaaccagagttcttcatgtgattttagtttacatttagttggatttcacattacagtacatttggtgaattatttcctgaatgagactgagaaatcactgggctctggcaactctgtactgcttcctctgctttagggattttctgtctgaaatcttcagaaaaagttgcaatagagttcatgaaaaccctcagttctaaatggacacatgaagaaacaccttaggtttgaaagggtgttttaaaattacattcctgtcttgtatttttttttctcctttttattttttttttctttttggcctaagtttcaatgacattctggaagatgaatttcagttgggttttgggaaactatttccagcagcggttgagtctggatttgattccacagagttacagccgaggcttctctgcattggccacacctgctttcttgagcaacctgagagacactgcctgtggacattttccactacttagtgattagtcacctcacagttctgctgtttttgccgtgagataatttcactttctccttctgctcctgcgtgttctatgtctgttttcacccatctttgcttttcccattttcctctggatttatttattctgtcccttacatttctttatacatttgcctcttcttatcctgggaacctcacacctctgcttgttccattttcacttgtttctggatgtgttgtatctattcctttgaaaaacgttgctcttttgtaacatgacctgtcccagcatcatcaagatagagacttttaaaaaatactccctttcgtatcttagaaggcaatagatcttctttcccagccaaccagctggaaaggcttttttttgcttttccgttttttgcatttccacgtagactgcgttgctccttgctagagaaaccacaagcattcctgtgtgaaatgaaactcgctgttttgtgattttgtgtgtgggggtggagaggggcatggtaatatttagagtccctggcctttgcctcccaaaggtttgtcattaacattttgttgatttttaagcttgctcttatatttaggaccagtttactgagtttacctcccattccctttctagcaggacacccaagagtcctgtttgctcatttcctcttgtcctggtcccaccctaagggttttccatgggctcgcacttctcaaggagttcttgggatccaggaccctttagcaactactagccttttttttttttttttttttttttttttttttgccagagtcttctccttagcaactgtaatggcatattaagttaccagttaattcctttgtgaggaagcgtagcagtttaatatcgaacaaaggcatgtttgagcaaatattgacaattgaacactttagcaacattaagatgccttttataatggatctgtcttacaaagaaaagcgataactttctagtctcttatgctgtccaaaactcagggacttcgtagatttagataacatgatttccttggtagttggatttcagcaatatcatagactttgatagtgaagcatgcttgtatgctattttcaaataattttcattggtgctaacatttttaaaaattcaattattgtctcactgctttaatttcttagttactctaataacaaagcccttttattgtgcagagaagtaaccgtatgtaatttataatacgggatgctgaacaggacttatcgtgtaacccgctacaagactttagaatatacaaggactgtatataaaataatgagaccaagtctgtggctcaggcatgaaatcagccaccttgttgaatgttaaactacttttatataatgttctgtggatttgtatttgttcatgagtatgtgaacatttctcctctatgaaataaagctgtcaatgagttctatgaaatcgtaacacattttctataggacgagtatttgacgttatggttaaatatagtaccaatttatctacccaactattatcatgtttctatgtttctactggaaaatgcactcctaattgagatgtcagaggtgagaactaaagcctctgtgagactagcatttaagaatgcagaagtaaatatcagtgagtccatgccagagtggagcttatcagtaagtgatgttatggagagtatatattcagagtctctgactaaggtttcagttcctttaagagattgagtccgtaaaaagggacaggaagggcacaggtcttttaatgctgtacacctatgtaatttcacaagagccaggaccccccatccaggtcagccactctcaagatattcaagacataacttccttcagtgattatttgtatgtttaggttgttcttgggtaaactgtgttagaaccagagatgccataaatatcaatgcagtctgtccttaagcctgtggctgccaactcagatcagctgtgtacagctgacctttacatcaaaggcttctctttttgctgccacagcaaaaggtttgaagttcttggcagtcagcaacactgtgaagaacacaaggggaagatgcatttcctatctcagaaacaacccataggaagcaaccttagcagtggtgcttggtttcctaagccattctgcataagacataacatactgacacttaacacatttgcagtatttttccttctactatcttaaaaaaaaatatatgtagttttaaagtcatcctatgaatgattaggcttctgtgagccaaacctaggtcagtagccgtcattaaaaattttttttggttggaaaaatatgttgtatatttcacataaccagttcatataaacacttacagaatataatccattcataagtttgcggttcccaagtgtgtgtttagcatgtgccatatatacttatagatttgacattatataggagcccctcactataagtgcctaaaggttgctagatgattactaatgtattcttcccctaccaaattgacaattctctgctactgaataaaaaatggaacttgtgatgtatcctagaacaggctattaaatcactgccatgagtatgacattcactaagaaaggaattcctggcacatagttcatctagtttttctcctcttccctataaggtctgtgacaaaaaggcagttcactgttcttcttgtccctgcctggttacaaggttagttctaataaccaaactgtgggtctagatagtaattctatttcaaccctgtaaataattacccaaagctgccaagcttaagaaatgttttatcagacatttcttctcatcatcggtaagtctaagataatgaaacaaatggcactaactttttttattttttacttgtgaaacatttctgttttggggaataaaagagcaagagatttttaaagctctgttaagttctgtaaagtctgatcagaaaatggaattaaaattaataaaaactgagcttttgttctaataagattttttttaagctggccacttgcttaagtccaatttagcttcccaaggacagtatctttgatcattaaaatatttatttatttatttatttatttatttatttatttatttattttgagatggagtcttgctttgtcactcaggctggagtgcagtggcacaatctcggctcattgcaatgtctgtctcccgggttcaagtgattcttctgcctcagcctcctgagtagctgggattacaggtgtgtgccaccacacccagctaatttttgtatttttagtagggacggggttttgtcatgttggccaggctggtctcgaactcctgacctcagatgatctgaccacctcagcctcccaaagtgctgcaattacaggagtgagcaaccacacctggcctgatcattaaaatatttaagagagtggcaatataagcaaaaatgattcaatataaacaaatacaaatttcaatataaacaaaaagatttatgaaacctaaaatatttgaaacttttctagagagagaacactagtctaaatatctaggaagcaggcatttaagtccttgtgctggcatatgaaatgggttaattccttgatacaaacagctctgggtatttattgtatgtatttgtatagtggcataaaacattctttactaagttacaagtcaaaacagtaaaggaatgaaaatgactaaattgttcatttgttaatacaatatttcctgtttactctttttctatggtgtaaaagaaactgaacattgactttctgttttgtaaaacctaaaaatataattaagaagaagagagcaggcctggcgcggtggctcacacctgtaatcccagcactttgggaggccgaggcgggtggatcacgaggtcaggagatcgagaccatcctggctaacacggtgaaaccccgtctctactaaaaacacaaaaaattagccgggcttggtggtgggcgcctgtcgtcccagctactcaggaggctgaggcaggggaatggcgtggacctgggaggcggagcttgcagtgagccgagatcgcgctaccacactccagcctgggcagcagagtgagactcgtctcaaaagaaaaagaaaaaaaaaaaaaaaagaagacagcaaagaagtgagaaaggagttttggaaggggttgtgatcatttgcaatgtgacacgatgttagctgcttttcataagcgcgttttaagcaaatgtgttcttagctctgtttttggttttaatagtaattccactgtgaatttgtatgttgtggaatgagagaatagtgttaaaaggtgcctggttgttgccagatctaagaatgggaatgattttctcaggcaactcttattccatcaagtgtgttaaattactgtaaattacaatcatgcaggagattggtggtccccaaatgacgttttccactatttgcagctccttagtgtatctatacctaacagttttgcatcttgttaaaccgcagcattcatatattacgcctcttccacagagaagctcacatgtacattccaggtggaatcccaccgtaatatatacatcacaaccaaacaccatagagtaggttttctgaatcatttatttaattggtatttaatacagaggaatttctgtttgccaaaaaatgttttttgtaatctactgtaagcagacttaaattgtccttgttaatggctttgagaattattttttttaccattaaagaataattttctgggaaaataaaaaatgatgagactcatacagacataaattgaacacgtgttaaagattttatgaatcttattaatggagaactaggaagatgtcataaccattcaaaggagaatcatagatttatatggaataaagaaatgtgagatgaatttacaaatggatctgaagctggctttttctaatgggaggaggaatgtaaattgaacctccaagggacagaatttatttgtattgtctatagaaaagacttactttgctttggtctcatttatctaaaacagagctatgaaatatttcagaggcagtaaaatgccagaatcagaggaccccaaagggtgttctctagacaatgcattgttttccattggaaacacctagtaatcctttttgtttatcaccctgcctggcaaaatttttgtatatttttttttaatagagacagggtttcaccatgttggccaggctggtcttgaactcctggactcaagtgatctgcctgcctcagcctcccaaagtgctgggattacaggcgtgagccactgcacccagcctaagagaccaagaatttatgaacagaatgacaagtttgtgtgaaagtacatgatgctaagatacagatgaaggctaccccacctctgtgctagctgtctacaaaaggagccgagtgcggctggaaagaaagttgcttcctttccaattcgaagaggaggtatacaaatcctagagctgggggcagtgacaaggtttaaaatcgatgtgagagaaacactaaggaatgagtcagtgaaagattttaaactccatcacacccaactcagtttctctttaaaggaaatggcagagatgcccatcaatgtagatttttagagatggtttattgtgatttcccatttatgttaattagctttatctgtcccctttcatttcttttgataaaatcacttagaaaaatgtagacgtagttatgtgtgttaaataatataattcagtgtgacaaggagttgcgtccctgaagatgtgttgttgagaatggatgacaaacagttcaggtcaaccttgagtaagtgtgaggaaaaaataaaaataaataaatgaaggatgtaattgggctcctctcctggagactgaaaagtaaggactggcatggaaatctttgatttttggcagtatatcattatctttagaggtctagaaaaagtgcctacgtcatcctttctatgaacacatttcaggagctgagaagttcctatccatcatgaataaaagcaaccacttgcatgtggcttttctagaaaaaaattcttataaaacattttcatcaggaaagaaccaggagtctaaagtcagatgaaagaacgtcagactgtagaaatcagctttgtaggtatgagtccaggatcagtttgaggtcaaacccctttgcacatgtttttaactttgcaccgccctcgctctcagtgctggctcctccactcatctttgttgctaattcatgtttgagagagtctgcacaaactccccacccaggctggtatgggccttaatgcaagtttgtgtgtccaggagactcacaaatctgatcaatttcaagggcaagtaagtgaaagctggagaatgtacaaacagaaaatcgaaagctatggaaacttgaagagacaaaacgaaaatgtaagaaatgccactaaaatgagaaaatatggtcaaacattgagaactgatttgcagataagctttatgggaatgtctgtgaaatattggagagtgtaggtgtcagatttgctgagtacagcaacaaaaaatatctaaagcatatagtggtagtaccaaaatcaagattcataaggttttacatgatgtagtatctggccaaaaatgtggtcagcgttgttttttgtttgtttgtttgtttgtttccacactatgtggtaaaaggaagaagaacaggttattaagtggccagcattcatctttataatctgtggtgtctgtggtcagtcctgctgcagggaatatccagcctgtatgcttacacatgtggactggttttcatgatggaccatttcagtgccaggtggtgtacatgacattaagcttctgtacacactcttttcaaaattttctttacatgaaaattaacatcagtttttattatgagatggaagttaatagtcattgacaaaacttgaaaatgtactttaaaaactttaaaaaacaaagagttctctctctccagatcaaccttacaagtacatcacaggatttaagcaatttcatcgtaacacaaaggaggcccagtacattcttcagtgccagagccaatccacctgtgttggttagactcaatgaaacagaaagtttataggttctaaatgtaaaatggagccagccctattatgtttgttgttttaaggccctgtgatatattgtttttgtgaatgggggaaatataggaaaaaaaacactgagttttgaattattaacatactatgatttgcttcataattctcagatgtagttctgtcagatcctcaaaatgtgcacaagattgaccatcccttccaggaagaaaaataatatgcttccaataatgaatacactctaaaaatatatggtagttactttaaaaatattggagatattgggaaaaattattaatatatattttttcttttaaatgctgttaagacactagtcactgtagctgatagcatgggttagtcaaccttcacaagtgattttaaaactgtgagagtatagccatagccctgagcttttcccaagacagcatcccaaagaacaagttaaatgtgatttaaatggaagaagaaaatattttgaggtacaagtggactcaataaatttaggaattactatatttgaaggaaaaaagaaagcatagtggttcctactaatggattgtgcctcactgaccattagaattacatacacaggagagatccttgaggagttaagttctgagtacagactagtgtttatattaaaggacaagatcacatgctggtgatctgttaacctttggattgctttttctacagtgttctttcttaaactgtggagatccccattgcaccacccagaaaagagagaagagtaatgaattttggacctggcacgttgaaattaaagagcatgaagaaagtgagaagttgtttactaggcgtttgagactagctgggaggcttggaatagaggcctaaactaggaaactggaattggaaagaatcacaatactagatagtaaagttacacaagtagacgccctaggcaaaaggcctggaagagaataaagccaaagggatcacttctaagagcagaggcagagaagacaggaaactaacaaggaatatcaaatgaagactcacaggcatggaattgctatacatttagtggtgtttgggggccctcagaaggtacaggtacaggtacagtaacacatactgatgtttacttacacttaaaatgaaataggcactattgtcaaaaccatttaatgagtgaggaaactgagttcacttcagtagacccaggactcatacctgtattactctgagaatagccagttgcctacattaggcttttgaaagcttaattagacaaatgatgaaacagagaactagacatgacagtgaattggcagaaacactgtttcttcagaggcccataatcagcttacatacctagagaccctagactgagccatagaagtggaaacaaatctgatttatatgactgtggagaaaatcttgtacttggaatgctgtaccctgttctcgacacattattggcagaaagatacatatcaaggaaaggacctggaattcacttgtggatgaaaaagcaaaagaaataaatgtgtaaggcagtaaaagtatatagaaagtgaaggtgatactcatgtatgtgctgacataacagaaggaaaatgacctgagtaagcataaaactgatgccagagtcaggaagagaaacatagagcctggaaattgatcactaatttccttcttttttttttttttttttttgttctaggcttgacattttccactttctttctcctaaaacaagaaaggggacaggttgtagattttatgtctttaattttctttaattcttgcctaacagtgataaaaacataagatcagtgggctgaaatttagggacactgagggaatgaaaatagaaaactaaacctggataagttcatcagcatgtctgggaataatcaacaggttatatgagaaacaggttttagttaagttactaatctggaataatcaaggtgataactgtaaattaggagaaagtttgaatctaagagcttgtattaaaagaaagttttcttttcctcttttgggttacataaccaaattatggtctaatattcctagggaaactagcttaataattagttgctgcagttttgtaggtagtatgggttttttgtttgtttttttgttttgttttgttttgtttttgagacagtcttgctctgttgcccaggctggagtgcagtggtgcgatctctgctcactgcaacctccgcctctccgttcaagcaatttttgtgcttcggcctcgcaagcctggctaatttttttttctatttttggtagagatggggtttcaacatgttggccaggctggtctcgaactcctgacctcaggccatccacccacctcagcctcccaaaagtgctggcattacaggtgtgagccaccatgcctggcctggtagtgtgtatttttaaatgtgtgcaaagtgggcttccacaggacctatgttgtttgaataggacctctcttgcctaaacatttttatttacattcattcatctatcaaacatgttctttaaagtaacggtgaactccagacttgcacaaaatttttatattattataaattagtgaagttcacattaataaggttgtacgtgataaactccactgtaaatcctgaaacatgtgccctgtcaagacgggagaatcccattaatatctaagatttcaaaacttagcaacaattttggacaggccaaatcataaatgaagtagtctaacattttaccaactaaaattttgtattctaagatgaggactcacagggcaaaaaggcctttcctcttgttctgaacagatacctctggtgctctgcacttactaataatcatgtcaaaaaagctgatgccaatttcatttttcctcttaaagtcactctattaaaggaaaaaaggttctgttaaaatttaatcaacaaaagcaggtgttacagggaggggtagattcgttgaaagctgccagtgaatccaaatactctctcttttccaggcacacaataaagttagtccacaagggcacatgaaatctttccagcccacaatcatattagaatttgcattgtgttactggaagcagcacagaaatattcccttttggctcacttcagttcttcgtcaccccctgaagctgcctcctgctgattcgaaggtcttgatagtttctggcaggacagtggtatcactctccagttatattgctgcttagcatctggtagttgcagaggaggtttatactgcattatgttccaaaaaaaaacccaatctgtgaaccacattaaggccaaatctagtcttggatatagtgccatggggtggggatgaaaaggggatggcagggatactgactggcaaaaaaactggaacttgatggaataacatattggaagaatgacccccatgtgtgtatttttgttttgttatttccctagaagtatgtgggaagggagagtaattagggggcgggcacgagagaaaagcatacacttttttatttagtgatataaataatagtaaaatttggataatctcctgaactgaaggatctagttctcttcaacaacaaatgcttatcaggaatgatttcagcaagatagcagaatagaagttttctatcattgtctccctgtagaagcaccaattttgacaatcactcatggacaagagtacctttgtgggagtctgagagtctagcagagaagttccagctcactgctggagcaaaaaatttaaggagagatgcattgaagaggttaagaagaatagtttcattttacccatgtcacctctcctgtaaagcagcacagttcagtgccaggagagaccctctttgcccatgattcttctcacagggggaaagttagtgttgtgaatacccagctttaccagctgtgtaaaatgctgtccaagaagcccacctcttttttgacccaccgagaacactggaggagattagcatgtctgagtggctgaaagtagggaaaggtggggatgggggtggcggaaatcacagcagataggtcttagaattcaacagctgtttgtatctgactgactgcatctcagactccattaggaggcctgcccatgagctagttgggatgcctgacctataaacccaaccaattccatgggtgcccccatgccccacatgcttcctcccctacccctcctgtggccaattctgatgcacattccttgggtcatgagtacaagcctttacaggtggtttgtagtcagttggcttgactctgggattggaggaaggtacataaactgagcatttcagggcactgccctagggaaagcaaatgaaaggctctcagcacaaagcctggctttgtgagattgagagaaggtacacaatcttaagaattacctcccaagagaaagcaaaaagagtggagggagtgcattcatagaaaatatcgagagtgcctcagaattctagccaggctgactggtgaaggagttcctctccccaaagctagtcagtaaagactggaggagatgactactacttcagatgtgaaaacagcaacacaggacttcacagaacacacacacgcagaaacccgacaccagcaaaagaacacaataatttctcagtaaccatccccaaagaagtagaggtctacaaattacccgacaaggaatttaaaaataattgctttttaaggacacttagcaggctacaataaaactcagtataaatctaaataaaataaaatcagtgtaaatctaaataaaactcggtgtaatcaggaaaacaatatatgaacaaaactgaaagctcaacaaatagatatacatcgtaaaatagaaccaaacaacttctgaagctgaagactgcaatgaatgaaatgaaaaatgcatcagagagagtcaacagcagattcgatcaagcagaagaaaggatctgtgaactcaaatacaaagcatttgaaattatctagtcagagaaggaaaaagaaagcttatgggatttatgcgataccatcaggagaaataatatatgcaatatgagagtcttcaaaggagaaaagaaagaaaagggtagaaatcttacttaaataaataatggctgaaaacttcccatatcatgggaaagatatggacatccaggttatgaggctcaaaggtcctcaggcaggttcaaccaaaataaaacttcaccaagacacataatcttattgtcaataatcaatgacagagaattttgaaaacagcaagagaaaagagactcgtcacacataaaagaagactgtcagttagactatcaataagactatcagttgacttctcagcagaaatcccacgggtcacgaaggagtgggatgatatactcaaagtgctgaaaggaaaaaactgtctttcaatggtactttactcagcaaagctgtcctttgtaaaggaaggagagataaagattatcccagacaaacaaaagctaagagagttcatcaccactaagactgccttacaagaaatggtaaacgaaattgttcaagctgaaatgaaaagacaccaattagtagcatgaaaatatagtatttttactccctggtaaaaataaatatgtaggcaaattcagaatactccaatatcctaatgatggtgtttaaattcattttaactctagtataaatgttaaaagacaaaagtattaaaaataactatagctacaccaatgttaatggagacacaatataaaaaaagtaaatcataacatcaaaaaaaatggggagtaaaagtgtagagttaccagcttcaaatagactcataactataagatgttttgtgtaactccattgtaacatcaaaacagaaatctatagtagatacacaaaagataaagaatcaaaccataccactattgaaaatcatgaaattacaaaggaacataccaagagaggtataaagaaacaaaacaactgcaaaacaatcagaaaacaacaaaatggcaatagtaagtccacaatggaatgttattcagccttagaaaaaaggacatactgccatttgtgacaacatggatgaacctggaggacattatgttaagcgaaataaaccagacacaaacagacaaatactgcataatataacttatatgtcaaatctaagaaagttgaactcatagaaacagagagtagaattgtactaacagggattgagtgtgaggacaatggggagatgttggtcaaaggatacaaactttcatttataagatgaataaattttggagacctagtgtacagtgtggtgactatagctcataatatacccttgaaatttgctaacagggtagattttaaatgttctcaacacacacacacacacacacacacatgcacacgcacagaggtcagtatgtgaagtgatagatatgttgattgtggtaatagttttataatgtatgtgtgtgtgtgtgtgtgtgtgtgtgtgtatatatatatatatatatataatcacagtatatatctttaatagatatactttttatttgtcaatcactcctaagcttgaaaactcaccattttcaaagcagtcactcctttcatgtccacatttcatcagggaatgattttgtcccattattaatataagtaccatttcccatatattgtttgatttaaagatttctgtttctcccatgttttcattgtgcagtctgaactactattggcacaactatatttacataaacagttctaaacctagggatcaattattgttatttttgtttagaaaatatttttatgaatatcaatggctttttcttttgagattctactgtattcatatagtgtactttactacctgtaccttatttatattttaccagctagggagctgaggggaactcaaaatatccaagactttgggcctaaatttctaaaaatggtcattaaaataggaagtattaaaggagtgtgggttgtggactttcgtactgattagcatgaacatttgaaaagcgtaaaagtagtgctacaaaatatttcaggtttacatatctttattatatgttcagtcaaagctgtcaaaatcggttcttacagttttaattataattgcaaaataaaaattttataaatttcggtgtaatcttttataatctttagcagatataagttcatttaatttatttagaagtgttgcataaaactcctttgctatattttctaatatgtaggtatcattgagaggctctgctgtgaaaaaatatatattgtagaaatgttaggaatttgtggtaaattagtcttcattgatttttcaggttttagaatttctattgagtcataatattctagtctgacattttttctttttttgagaaacagtgagatgatggcaaagtgaatatgtcccattttttattgcttttcatcaaatgttactttctcataaactgcagagtgaacctttctccaccaagtaattatgctgatatgttgtacattcttaatactccttaaaagtgagggaaaataaacatatcaaatgtcaaatagtataaaaaaatttctctactaatctgagaataagaattatatgtttggattcccttgatcatatatctctttatgaggatggtaccaacaacccaataggaatttaccataaaaaaaaacacaaacactgatataatacaactaatataagacattttattataatttatactaaaaccataataaaaaggttgtttatacttaatgggacaatccagggaggggaggaatacaaggctgaacaccagttgatatgagaaggctctgagattttggttgttaaaagtcactctgcaccagcatgtgatgtgtctgcaatgctgttataaatgccatcttaggcagatttgacagagggattcggagattatgtagacctgttgggctctgctaatcagaaaacatctctaaaaagatataagaagaaataagagctgaaatggtaactattgtcgtaatccttcatttagttactaataactaacatttatggagtatttactgtgtcaaagacactgctaagcccattatgttatcttacttactatgatttaatccttacaacaatctatttctatggacacctactttattccatagcctatgctagagattgaggattcaaaaaattaaagttgcctgacttagagtgagttcacagaaggacccactgagagaagtagggtgattgattgcccaaagaaaaagtgattgagaatgtaacagttggtggctgtgccagagtctgaagggctgtcatggatatgctaaggggatgacatttttaatatagaggaagggggaataaaggcacaaaaattatgaggaaatagatatcagtcactctagtgaaatccagatagttatctaatgcttgtgttctaaaacttgatacatagtctgttttgtgaggggtataaaaactgggcacagtgtctcccattagatcacagggcctacagactgatgaaagcaggtatatggataatggggtagcatgtaataggccttttaagggaacaagcagtgtcacgggaaaccagcggaggtagagatttactttgcactggaggggcctgacaaaacatgacatttgtgttaaccttaatgtggtgaggattggactgatggagccaaaataatagtacagtatccagtggtttcaggaacagaagcatcaagataggaaattataggacattttggtgcaatggtgagtattttggtttggttgtagtgtgaattttatgaagggaaataatggaagagaaagctaaacagctgggcacagtcctggtcatgaggtctttgaaaaccacagcagacagtttgcaatcttaattctgtgtaattgggaaatcattgaaggcttttggggagaaagatggttttaaggaaatgattttttaacagctcacctttgctttttgataaaatagttttctctctgtcactaaaaatgtgtcagtttagatgatagtttaggaggaatgttacatagaagaaagcatgccaggagtgggaagtttttacatctgtgctcatttactggcttggatcatggtgtcatcttcactgtgactccagtttctagcagtgtctggcccacagtaggcattcggtgagccttggggaaggatgtaaaagacagatagaacttcaagttccattccaggtctgaagttctttgatataattccagaagttaacatagcttctaaaacaagatttcatacaaagatctaattctgtagccaaagcataacagttgtaggatttaaactccaataaaatacacaagatttttttttaaaaaaagagcaagagttaaacaacaattagattcagttgtggcttctctcacttgcctctattgttactgttttctcctgtgtctcttataatagtaactgaaaggaagtaatgattatctcaaatttggtgttgtcctattgattagcattcacgttttaaatataattgctgacattatattaaaaaatataattgttgaaaatttctgaaccaaagataaataccagcttgtagtaatgccaaaccaaaattgaatcctttgaaggtttcaaaatctgttccctgaatgtctgcaaaattccacactacttacagcaggacttagctttcttagcctttctgaaaatcagtagatacactcagaaaagtttaccaatgcacgtgtacatagtctttggatgcagttataggccggtttgtttacaggcccaagaagataatcaatagacatccccacccctcagttggaagcaaattcagtggttacagaaatctcacttcaatgtatttgaggttttcgcaaaaaagatgtgtactgcatatatctttaaagcaatgttttttgagatggaacatacaaataaatgcctttagaggtaaaagttgtatggaagccaagaaaatattaaagaaattcaaaaatgctgctgatccacacatatttctcaaaggtcctataagcattacaacacatttatcaaagaacatttgaaggtgccaagatacttccagtaataagcgtgattatatgattaaaatgcatttgcatagcctttggggaaatggaggagggagacaaggagagagaaaataaagaggaaactgcattagtgattctctgccgttgttgtgaagttgacttgtagaaaaacaccaatttttctaaaaaagtgtatgctaagacctaaggaatattatttttaacctatctaacgtatggagttgaccccctaaaagttagtgcttctgtggagaaaggagaccaacacaaatcttcaccaccccaacccctgcccacacactttctcgttaaaagaagaaaggaattggtggaatgggtgttgtgtcagtctcactctggcagaaaacagagttaactccaaatggtgtaagaaactctaacaacggggctgtttacagtagacagggttaagtgagcaagcaatggatattaatagatgatgaggcacaaaaactggcaacagctggaagccattatcatcacctgagggctgatggggcaaggggaggacaaggtattgtgggagcccagtgaaaaaggaaactgccaagagactactcagtggaattgcagtcatggagccatgcagccactgccaggggtgctggtccagcttgctgggcacgaagcagggcagagccaaagacagaatagccccagggcaggggcaaatggcgcataaccaggtaccgttctcaactctttgacttctctgctgagaagacaaaacatcttttaagttgccatcctggtgaaactatttgttacgagggtactgttctgtgaggtttttattgcttaacgttaataggcggcttaatcacaccctgagaataatacccaaatattgcttttctaaatgtccttgtttgggagacattggaaaattctttaaagaaagagcagtatacccccactacccagattgtcctttttttccatttattccagaaacctttactgcaggaaaagagagatgttgccataaatgtttgaaagaattccttgtgtagttagtggtggccataaacatatggccttcactaactatttgccctctgttccaaccttgtctttccatgacagttaaccccatcattacgtattcctgctccagtttcactggggaattctgtattcagagccaaagtatgtcagtaaaatattaaaagtaacagcacaacaaataaaaagagataaagttgagaaactgcatggcaaaaagcctgtcacagagttgtagagaagaaagaaggaacttttttttagctaattgagaaagcattgttgtcattattgctaacatttaaagttctcaatttttaagggaattcttgaaacattgtactggggaaaacaggaagttctgacttgaatacattttttaaagtaaaggatgtaatttgagtgaattgatctcagactttacagatgatcttttaagatatgagtattttttgtgcattataaaagtatagttgttcataatggaaaatacagaagcgcttagagcataaaataaaatagaaattacctgtgactctgttgcttagaagtaatcactattaatttggttttcttctcttcttaatatatgtgtattcttaaaattatgatattgtgatccttcattgatatttccaaatgactttccagattttctccactggtttttatttccaccaaaagtatgggaatttaactgtatccttcttgggcttgaaattttgaagacctttgccgattttattttaaaaagtgattagtaaggttgaactttattcatagttatatatttatcattttgtattgaattatttatccatgtcttttgcccatttccttaagggacaattagtattttttaaaattatttttaggagctctttgtatgggaagaaatttcagaagatcatctttcttgttagaaaggataggactaattggtcacccttatcaggtgattatttgatgcaatttttgatgccttcttgcttttagaaaaaacagttttaaaggactaagctcaaaatttttgttatttaagatatttaagggctgggtgcggtggctcatgcctgtaatccgagcactttgggaagccaagctgggaggatcacttaaggccaggagttcgagaccagcctggccaacatggagaaactgcatctctactaaaaaatacaaatattagctgggcatggtggcgtgcacctgtagacccagcaacatgggaggctgaggcaggagattcacttgaatctgggaggtggaagttgcagtgagctgagatcgtgccactgcactccagcctgggtgacagagcgagactctgtctcaaaaaaaaacaaaaaacaaaaaacaaaaaaaaacaaacaaaaaaaaacatttaagcaggaactttgcctttgaataagtgcttgatgaattctgacttagaaattgttagctcttaggtaacttttaagatattattcttaagaaaaataaaggattgttttgaagttatttgacaattaaaactttattcccatctcctcgcccaaagatataaatctcttaggactgagagattaggatccttcatttctactttatgagaaaaacaaataatacacagttggggtgaggaataatgcacagttggggagaggaataggcatattgtgccagtatatgtggcttcatgaaaaaactattaacagctgttgttaagctagtctgtagaaagtagagtgagaagaaggcagataggcattttgcaagtgataattttctttaaggaccacttacctaatattaggcctttttaatttttgtgaatattaccaactttgagatcacgaacaagcttgaaacacagtctttagcacacagagtcaattgaacctataattagctgctctttagtgtaacatataaaagttatatgtaacaagtgtaacatacaaaacaaagatgagaaatgtaaagaattttaatgccagtctcaagttgctaagttatttttagaatcgaattcctaaaagttttgctgtttcctgcatgtacctgtaattgttccttgaatctcttcaagagacaggttttccggtttctaaattcttatctgagtagctcagacataaagagatcatgtatatggtatgatgtggtcacctttttatttacgggactttcttagtctaatgtgtgtgaactcttaaatgcatagtgtcttactctgtaacagcaaccagcagttgtgtgttaagatttttcacgaagagtcccagctgttgtaaaaaggaacaatctgccctggctacagattacagtgctttgggtttagactgcaggcaatacctctgggacctgtcatgcacactgtgaacatcagtattcctgggagagagaaggcaaattagtcacttctggctcttagaagttcttgcataacttgctgttatctcagtacaatttcctggggatgctttatcctggcatgtgccccctcctttatcaaaaggaccattgagtattggactgggatgccattgccattgcagagggctggtgttgtttcctcctcttcatcctggatcctcgcattattgtttttgccatgtggggtgtcttggcttcgtctccaccatcacaagagttgcccatctccctctcatacttatgtcaacgacctcccttgcagtaatctagcactacccatgctttctgtagaactgttatatacaaaccattctaatgattccagatttcctcctggcacttcattttctttcctccccttcccagaatcctcttccttatctctggaatatagagctcagatgccaagaggctgcgggaaactaattgagttaggctttttgtttctttctttttccaccctccgtgttccaaagctggatttctcttatgctttggatttttccctgccctcctcctatctgaacagcagctttcagattatgtctggggtgtagtttacactatataagagaaagtggtttataagataaggtagtttatccttttccaattctcacactccttaaatacatctgttgttgattatttcatctggtatgccttgatttttgctttctactttgtttgcatttcattgttcttctctgagattatttctagacttttttgctgagcccccataactctgtttctgattaagtaaacagctttgataagtcacagtggaatcttaacacaaactggcatatgcacaatttacctcttctctccattaagctgcatttcctcctgaagttgaaaagtcagtggagaatagttctaatagcccagcatccttgtattttaaactcttccatcgctgattatattggaaatactggtattccatcaccaaaagctcttacttatcttccagctagttttgaattttctcaagttggtagctcttttttatccaattggtaaaccattcacaggctccaccttggtatgtgaatggacctcccaccctttccttgcattcagcaagaacctgcctgaagtattcattactgtagcgatgagggcacctgctccccaatcattgccaaagagagctgaaaatgcctaaggaatttgccatacttggtttcttacaattcgctcacgtcactcctgccattatcatgtcaaaaatactctttctctgttaaatattaagtttcatttggaaaaaaaaagaatcttgatatgaagttgccatgggacctcactgtgtataggttgatatggatactaatggtaacattaatctcatgaaaattaggtttttgaatttaaaatacatttgtttttgcactgcttgctgtctgttcctcttctcttttagttgactagtaaggagattattttttcagttttaaaataagatattggctgggtgtggtagctcatgcctgtaatcttagcactttgggaggccgagtcaatgggtttcttgagtccaggagtttgaaaccagcctggacaatgtggtgaggcaccccatctctacaaaaaattagccaggcatggtggcccgtgcctgtagtcccagctactcaggaggctgaggtgggaggatcgcttgagtctgggaggcggcagttgcagtgagccgagatcacaccactgcacaccagcctgggtgacagaacaagcctctgtctcaaaaaagtaattaattaattaatttaatttaataagatacataaagatgattttatgctttatcctaaagcaatgttcaggtaagccttgaacaagtggggtcagggatgttgacccaccacacaaaaatacacgcataatttttgactccccaaaaactttattaatagcctgctattgaccagatgcctaccagtaacataaaaggttgattagcatatattttgtgtgttatatgtattatatacagtagtcttaacaataaagtaagctagagaaaagaaattttattaagaaaattataagggggagaaaatagatttactgttaagtggaagtgggtcatcaaaagtcttcatccacatcgtcttcacattgagtagcctgaggaagaagaatgagggggagttcatcttgctgccttaggggcagcagataaattctgactaagtggacctacacagttcaaatccatgttgttcaagggtcaactgtatttagtatagggaaggcctagagcagatgggtttgttctttattctggttatatcacctgacatgttatggctgcccactaacgttttgctttaactatgtgtggcttgggctcttttactcccctcttgaaatatactttgctcttttattagaattcttactgtcaaagaacattccttgaaataatctggaatccatctcactggccacaaaataaatgtaaagtgcacaggcttctagtcgtcctgtttgctctttcaaaatcatttctagtcaggcttaataagtcagttcaggtgttctccatctcttggtaaagtatgtattttcaccgtaaaaaaaatgtgatgttggtatgttatttggcccatgtacagtttttgtttaaaaaagaaagtcaatttcttaagaagccagggggaaacatgtttcaccataaaatatgggcagtggccagttgactatgagtagaattcacttttgctgattactaaagtgacttgccaacctaatagtcatcaaaatagaagccatattagatggctcagatagggtttgaagtagactctcgtctttgtatggggttgtcaatgcatttgttttgtgcctaaaagcacattattcaggaaatgccactggggtgaacactgcctttcatccactttgatacaaaaatcacagattcttaaaatgtgcaaaataagaggaaagccagttgtagatatgtcaccagatttaggctagtttaagcttcttggaaacattttagattttaagtgagctacctaccatgagttatcaaaaattgtaaaataaagttgcttattagtttaagaaccttatagtactattttataccaaagaaatttgcatttatacagaaatacagcagtgatctaactgaatttcctcatttattttttgaggaaactatacttgagtgattcagtgacttttccaaggtgacagagtttgtttatggctaaattgcgattaactgtagacaccacatatttttaccacatcataaaggaaatctgtagtcgattgccacgttaaaggcattaaaaagtaataaattctgtgtgatacattctggcttttcctagcttttccctatatgattccaagtgaactaacgcccttgagaagcctggggctttttctgacacttttttttctttctgagatttttttcacaaaattgtaagcctagggctacattctttcttacataaaaattttggctattattactttggaactacttgccgactgttgacatattcccaatggttgcaaagaatctcagaagaagttggagctgcgcctcagtgtttgtcaacactggccactcttgacagatccaggccccaggtaatgcccgtcttgattatattgtttcagaagtaaagcgcttttggaagaaattaacttgaaacaaacgtgaaagagctccacgccaggggaaagtaaattctgtccactcatctgtttgacagttttgtttatgtacataaaatgtaccacagccatccagatttgaagccatttataatatatggaaattttccctgtaaacagaagtacaactctgatacgataacttttgttttgtttttattgtgagtgggaggcggggaggtagtcaaacaagggatttttctgttgttttctgtctctaaatgtacatgccgagggtggaagacatactgtgaatttagggggttgaatcctgttctcagcagcacttaatcatggagacaggaaagtggctacagatttttgatgaaagattggcctaaattcatcatgtgtctatagcacattactctctgtagcataataaatgcaaatggctgacatgagtattttctgcagattttgctgtggaataggaatgaagtgggaaggaggtttaggggcctgaaggaagaaggaagaggcagtaaaatattcactaatgtttccaggggtgggaatgtttccaaggatggaaaaccacagagtagaaaccagagtaccaagagataatcttttaaaagcataactaaacttcacattaagtcataaaaacattcagtattcttacaatagagtaaggtagagaaaataaaattttaattttaaatattgaaatactttatttttattgaaaatatggtttttagcgggtgtccttacgacaattgttgccttgttaagtccttacagatatccatatgaaagtcacaagaacctttatgttcaaaggtttaacatttttaaaaaggggcatttttttctctttggcattattcacatataaaatacccatttcatatgcatttccattacagcttcctattacttagagaaggttggattaccatctggtcactttctcttcattaggatgacaccagagggatgtgagcagacgggtaggacaggaatctaaaaaccaaaaattgagatgaatatctgacagtttttttgtatttttaaagaggtgctaagatcagaatatttgaactcagaacttttttggaaagtaccacacacacagtcacctaggatatgagctttagactctttctatagacttccatctcctctctctgtatttagccatttcctaaattataggtgccatccgttcattcagcaacagcttattgagtatctaccacttgtttggcactgtggtagttacaaaaccaaattaaacatgacccctgtgttcagggaacttgaggattggttttaaagtagtaaatttttttttaagagtaaatgtctcaaaacctttatgcctaaattgagttcttcaaagcaattaattttgggagggagaagctctacgcttatttcctatttttctgttatgccatcttctaaccctctttatagctgactttttcctcaatttatgtttattaatgtggttaatactttgacttttctctgtcaagtatttgcagagtgggtctaaaggaaatcttaatcccttttggtattacacagacatgtttgaattgtaaactgttaacagtcattgaaaaacagagacctgtatttcaggaattgaaatgaataaattaagatcaacctggaaaaaaggacacatcttgtatgcatcttttaagcaagagccaaaaagggaatgaaaaacacaatgctgctagccactttagcaatctaaaccagaattttgtcatgtttgtttttctctgtccttattaagcttgactatttgaagaaccactttccaaaaaagcactgattcagaccctggaggtaaacgtgttacatgttggtgactgtctctgcatgcatgctcatgtgtctttgtgcccactgataatttatatttttggtcactagatggtgccctttcactttgaatgaaagtgtattttctgttgaggcgtttgctttttattttgcttgttgttctgttgatgcaaagatggtggaaaatcatcttatttcttgatttaagaaaatcacattctctcttaaatcggatacgaggctccctgtccctctatgtatgcataggaattttaatgcgattatccaacctgtaaagtcacacatttgtagattatcataccactcaaaacttactgttaatttgttttgtgggaaaaatacaaatttatcctatagaagcattttgtataatatatataggaccaatacataaatgactacaattgaaatatctatgtggttcaatctgctgtttctgtacttgagttaaccatcacttggaaagccagtgaaatgccagttactgagtcctgaaggcccagaaacctgtattttaacaggcatgttttgagacacattggcttctaatcacccacagtagtagtgaacattttcagtagaggttaacttcattgtcaaccagcagtaactaaaaccaaagttaaggatagttgagagtgaaattttgaaggtagacagctctttaaaacctgattgaaggtagacagcaactggaaaacctgattgaagagggaattaaggaggctagtccccaccctgaggctttggcttggtatctccctctacctggaaggttccagctcagccaagtatcctacctcctttaagcctattgcctagccgagctattatggatgaaataagaattattgaataaaatgatctgtctgtttacataagtgtggtaaaagttggctagagtataacagagaaagggcagtcctggttcttgttaggatgcattagagagcaagcaatgggaatgagatgctgttgggctctctcccaacttgggttggtcagacgccccttgtgccttgctgttaggcccctcatttcataataactgatgcttaacattttggcaagttttaaccactcttaagacctttgaccttcacagtgtccctgtgacaggttaagtgtcaggggagggattacaaaataggataaggaagggtgcttgagaccaagagcagccaccaggagagggtgggggctggaggtggtgacagagactcaaattaggcacagctgctggacatctccccaggaggccagaggcattcctgaactctgaagcttggtgcactgttattaactgtgatttcaccatcctggtcctagcagtgggtagctttaagaaaaatcgtttcctcccttctttccttcctccctcttttttggtgaggggagtggcaattgcccaattgcaacataagaatatgatatgctctctgtggcgttttcacctaggctgtgggatgggggtgggagatcacagtgtcaggggagtatgtgtggtttagataaaatccccacccagtgattctcatgccttatcctagagaatagatgctttaggagttaaaggattcaggcggaactggtggtaaattgtgaaaggtgtgaaaggtgtgaaaggtgctcagtaaacatttactgactctttactgcctggatgcaaagtacaggatataaaagacttagccagtactaactgactttcttagaagtcagtacattgtagacactcagtaaggttgagacatgatcaatggttgtgataatcataatgaattatctctatgttattcagttttatcataaagctgatgggtatagaacttttgacttatcctagaatgatcttgatctgtgtcaaaggctgacctgtaaaataagagaatacctggattgctgggcaacttgaaaacctgattgaagagagaattaaggaggctagtccccaccctgaggctttggctctgatatctccctctacctggaaggttccagtgtcttacctcctttaagcctttactcatatctccttttctctatgaagtctgatactcctcaagactctctcatagctggtacttcctcatctttttgtgttactcttctttttcttttttcataacatgtatgttctgattaattattaattagataatttatttgattaaattatattttgtctctgcagaagagccaagttctttgtggacaggactcttgcttcttcacttatctcttctctctagtccctggaacagtgcctggtacatagtagaagtacagaaaagatttggtgaatgaatgaatgctttcctgtagaaagtttaatggcagtaataaacaatattagtcactcaatactaattctggataaatattgaattaaatattcctgaatgaaagttaaggttttttttctattagccttcactgtggtgatgtcttttaaatgaagttattgcataaagtgtggatccagagttggaagacattggattataatgtccaagcttctgagtggttttctgggagaagttacgaaaccactctgtgctttagtttcctctgtaaacaacgtcatgaatctgtgctgtggattaagtgaattgatgcacttcaacccttagaacagggcggagacttgtagcagaagctcaattaataaatccaatttataaaaaaaaattatatgatatttttattttgcaattacgtgatatacttattttgtaaaaagaaatgtaaatttaaatggtttagccaattttaaggaagaaagtcacagataaatgaaaacgtgggcattttccatattcctgttgttgttacaataacacacctagaattttattataataataatctccaaatgttgagtttattatggaacctcttatgttctagagtcaattttaaaacagagtttttaaaacaattttaaacagagtttgggagtttcacacaagccttttatttctttcttatagatccccatattaaggtttctggaaagaaagaagatgttaaagaagccaaggaaatgatcatgtctgtcttagacacaaaagtaagtgaatgttaaggacactcagatgtcagaaccttgtctctacaagggctacttcatgccgttatgaaagaaccatttggagaagaaaaaccaggagaaagtaatggtgggttttaaaataagcacatgtgattctacagtggatgtaaagttctgtttaatatttgaataggttctttcatgctgagtaattgaactatacatacacacacacacacctatatgtacctacatctacatacatatatatgtatcgtgtatgtatgtgtatatatgtatacatgtacatatataccatcttcagaaatagaaattggccctgattaatatagggtaagtaataaggattgtaggaattagattatttgcttttatgatgtcagtagaataccagaatgatcttctatatagctctgtgttgggtgtgtgtaatggcatgaaatttgttgcttgcttttgtgtgatcacgtgatgtctctctctctctctctctgtaagtatatgtatagagagagaacagggaaatttcaatatgtaaaaatttatactcatttgtgagaatttattttctttaacaaacacatctaaatcacttattgtataccaggcacttcgctaagtactctacattttacacttattaatttgtttgatcctcgtaactgactcagcacaaaggtattaagtaatttgttcaggaccctagagccggttaagtggagaggtgggattcaaatccaggctgtctcattcttaaccactttgtcttgccacctggcatttcattagaatgatctccctctgatcgctttcttgttttcattcttcctttctgttctttgttggttttcttcgtttttaaaaaaattactcccctgataattattaaatagtttagaattttcttcaggaaagggggatttttttgtgttttaaaggttaaactgaaagaactaaacttaaaaatcaaaatatatttaatgggcataaatttaaaacttaagaattcacaaggtataaaaatatttttgacatattttgatatttcgattttactttttaaagactgaataatttcagtaacagtcttctaaatgagaagggattttatgccagtctttatgattgtacagcactaaattcctcaaatatagtccaatatgaccacagcatttttatttattatgtcttagaattttacattttgctttaatataactaatgtactttgaatttctttatttaagccattttgtgaccagttatctgcactttatgatctctttctcccttctttctaccagcaagagtaatagatctactttgtaaagttcaatatatagtaatacaggagttgggaaagcagtgattctaaaaactttcttattcacagttttgagctttattatttctaattttgtatcatcttagttatgcagtcccactagcatgcatatcttcaatcttgtaattgtgttttcatctgtttttagttatttgaattaaatgtttcgtgaataatgtctttaaagacaaattgagtaatttatttaactgtagctgactttgtttaaagacttctttccaaaaaaattatcttggtaaagaataaatttttctatttcttctgacaaatctttcttaaaatgagaatttctttttttataatcagagaaattaatagcaggagaacacttatagattaagatgatcttattaagaaataagatttcccactgacttgctttttgttaataccattcccttgagggaaagacatttaggaggtcattctttccttttgcatacatcaagtaataatacattattttcacatagagcaatcgagtcacactgaagatggatgtttcacatacagaacattcacatgtaatcggcaaaggtggcaacaatattaaaaaagtgatggaagaaaccggatgccatatccactttccagattccaacaggaataaccaagcagaaaaaagcaaccaggtggtttgtcttttcacatgaacttttatgggatgaattacagccttaatttaattttcagtttgcctatcttttttttctgagaggtgagacaaaaaaaaaatcacatagatgacatacagtgtagattgtacaactttctgcaaggaaattgaaggtgctttgcttttttgaggagatgagttgtagatgggccctaaactcttgatcttgaaatcattgataaaaaatagcggaagatgtaatggccacaaaacaaaaccttaaagaaaggctgagagagcatatcgtttaggacctggaagcttgcctagtccaggaacctatccattgcctggtagagacctggaagtaaatacctttgtggcacaccagatcaccttctgaggagcagtgcattagtgcctgacttcttacattgccttaattatgtctctctctagtttatacacatttgtgcttgttcttctgtttggcagcaaatggaactcacctgtcctcatgcaagcggtttcagtacttgaagaacagatagtattatttgtgatatttggaagtattctctcttctaaactagttacaatactagaaactgtcagccacaaagatgaatagtcttttctctacagggactaatggtgacagtgggatgtgcacataagggactagacagaaagctatagtaaaaagcaaagacaatattcagaatatttaaaaactggtacggcatgaccattggccctaagaacagtgtcctggagcccctgtaccccccaccacaatgccaagactaacaccttgagtcagtgggtcatgggaatgcccaggagatttcagaagtaagctcgaggtagatgttggagcaatgattgtgtaccatctggtatggaaaatgttcactattttcagaacctagtgtagctctgtcattgaatattgataagtatctggtatgcaaagagcttaaacaaaacggagaaaatgcagtgaacaagagtaattataaagagggcaggatgatctcctgggggctgtggggctttcagtaagtccagtgggtgaaacagatcagttgacacaaattacctgaggatctcgttaaaatgcaaattctgattaagcaggtctggatgggggcctgagatcctttatttttaacaagcttctggataatacctctgtatttgtccctggatgacacttttagtagcaagcatatagatgaactggaaaagagatgtgagtttgattaaaataaatctaactttgtattttcctcctcttataggtatctatagcgggacaaccagcaggagtagaatctgcccgagttagaattcgggtaactatttattactttaacattgtaaattgatgtcagcaacatttgcattataaggcactaaaaatataataatttatcattttataaccgaatcatgttcaatcagtaggaaatagtggcaaaagttattttagtgtctatcttagcattcattatctaaatatttattgtatatgttcaaaaagtgagtttctatgttatttataaaattttttcactgaaaatgtttctcagagatgttctggattttatctgactcagtttttctagtttttattcaatgatcataaagaggcctaaggaaaaatgccacaggcaatgtgagttagaaactctcaggtttcacaaaaggctcccatcatttaaaaacacttgtaggccagttgtggtggctcacacctgtaatcccagcactttgggaggccaaggcaggaggatcacttgaggcctggagttcgtgaccagcctggacaacatagcaagaccctgtctgtctctacaaaacatttttaaaaattagccaggtatggtggcacatgcctgtagtgccactaattcaggaagccaaggtgagaggatccttgagcccaggaggtggaggctgtagtgagctgggatgataccactgcatgccagcctgggtgacggagcaagactctgactcaaaaaacagaaaggaaaaaaaaaaactttatataatgtagctaaacttaatatctataagggcagtttatgctttaaaatctatcttcagaaaagaaccaatgaatgatacacatgtctgaatgtctaatgctttaactctctgctttggattctcatcatttcattttaggagctgcttcctttggtgctgatgtttgagctaccaattgctggaattcttcaaccggttcctgatcctaattccccctctattcagcatatatcacaaacgtacaatatttcagtatcatttaaacagcgttcccgaatgtatggtgctactgtcatagtacgagggtctcagaataacactagtgctgtgaaggtaaattattcagataattctgcacatcctatatgtacaagttacatgagtttcatttttaaagaatattagactaatttgatttccagaattttccttcgttctacattttggtttgcagaatatgctgtatttttccatagctgttagaaatgcaatagaatctttccccgtatatgaacagttaatgtataggattatttctttcccacccttttctcttaggaaggaactgccatgctgttagaacatcttgctgggagcttagcatcagctattcctgtgagcacacaactagatattgcagctcaacatcatctctttatgatgggtcgaaatgggagcaacatcaaacatatcatgcagagaacaggtgctcagatccactttcctgatcccagtaatccacaaaagaaatctaccgtctacctccagggcaccattgagtctgtctgtcttgcaaggcaatatctcatggtaaggttactgaaataagtgttacaatttttttaaacctctttggattcagtgcatgtttttccatccactgtactaatgtgatatttaggaaagcacttcggaagcctcgtcaaataaggaagtttcttgctaaaaggaaataaactggaagagtaataaggttcatagtgcctcaacaggtttaatttcattgcatatgtaattttatttcagtgttttctttttaacttagactaaacacagaagagaattatagtgaaataattgactgcattttgtggcaaggatggaaggtgactgttttcatctgacctgtaatattagtgtgcagtttgtatttggcaaaaaaaaaaaaagtcctctgtttaaacagaaaagtaaaaatactatttaaatttcaccatcaaagacaaattttgtcagcccaaaacatttgtacatttcataaatctttgatccaattaaaaaatactatttaagtcacaaattcgagcgtcacttattgaaggaagaaaagcaaagttatatattataattcaatactactttactacttctaatttataattgcaatatttctatccttcccatatttgtttaaaacccctcggccaggtgcggtacctcatgcctgtaatcccagcactttgggaggccaaggtgggcagatcacttgaggtcaaaatcaagaccagcctggccaacatagtgaaaccccatttctactaaaaatataaaaattagccaatgcggtggcaggtgcctgtaatcccagttactcaggaggctgagggaggagaattgcttgaacccagaaagcagaggttgcagtaagcccagatggcaccactgcactgcatttcaaaaatgaaataaatgaaatggaatgaaataaactatcccagtgtatgggttgataatgtagtaacaaaatggatggacatgatgctgggcttacaaatatttgtattaaaaacaccattgtattctctcattcagtgcttgacctttagtggcatttgaatcagtaagcctcaggtgtgacatttactattattaacttgcagagtttatttttgagaaactttcagaaaatctaagtttttattgttgattccattcctctgacagacaagaacttgttggaatcagtaagattgtaatccacgattttaagaaatttgtcatgattttttttagccgagcttattttatcaggttatttttaatatactgtactacaagtcagatttatatttatatccaagaattgttgtaatcttcattttttttctgctttacaagttctttagatgttattttttagtttagtgaaatttttcaaatattctctacagttattaatgcacatttatactttgaccatacctgccaaaaataatgactcatattattgcacaacattgaaataactgaaggagaaattaaaaggctttaacccgtattttaaataccatcaccattttgtatagcactattcttataaaaatcacttcctggctgggcgcggtggcttacacctgtaatcccaacactttgggaggccgaggcaggcgtatcacaaggtcaggagttcaagaccagcctggccaatatggtgaaaccccatctctactaaaaatacacagaaaagttagccgggcatagtggtgaaggtctgtaatcccagctactcaagaggctgagacaggagaattgctcaaaccgcggaggtggaggttgcggtgagccgagatcgcgccactgcactccagcctgggtgacagagcaagactccgtttaaaaaaaaaaatcaatttcttccacaggagaaatggagcatagtattttatttctttttctttttttagtttaggtgaggtcttactctgttgctcaggctggagtgtagtagtgtgttctcagctcactgcaatctctgcctcctgggttgaagtgattctcatgcctcagcctcccgagtagctgagattacagtcatatgccaccatgcctggctaatttttttagttttagtagagatggggtttcactatgttggccaggctgatcttgcactcttggcctcaagtgatccacccacctaagcctcccaaagtgctgggattacaggcatgagccatggttcccggcttagtaattcattttaatcctagtgtgcttaatggtaacctctcctgatatccatttacaaattccagcacccagtgggctaacactggaaattctgtgcatcagagaaagtatattacattgttcctagactcagtagatcagaggctgtgagtagagcattagagaaaaaaaaaaaatctaaaaaatgaggtagttaaaagaagggacagtagtaacaatttactccaggaaggaggaaaggtttaaactgcattaggttaagtaggatttatattggtgaagaagcttttgatgagttaaggcaggggtcctcaatccccgggacaaggaccggaccaatactggtcagtggtctgttaggaactaggccacacagcaggaggaaagcaagggaagcttcatctgtattaacagaggcttcccatcactcacatgaccgcctgagctccacctcctgtgagattagcagtggcataagattctcataggggcatgaaccctattgtgaaccgtgcatgcaagagatttaggttgcatgctccttaggagaatctaatgcctgatgatctgtcactgtctcccatcacctccagatgggaccgtctagttgcaggaaaacaagctcagggctcccactgattttacattatggtgagttgtataattatttaattatatattacaatgtgataataatagtaataaagtgccgaataaatgtaatgtgcttgaatcatctgaaaccatcccccttccctccccctcccctggtccatgaaaaaattgtcttctgtgaaactggtctgtggtaccagaaaggttggggacccctgagttaagataccaaagtacaagatcctcttaaaggatcgttgggaggctggcctaacctggaggaaggggaagacatacagatataaatctgtggttgaacaagcaagtctgggctaaaatgtggaactctttaaatgctcgatcatgtttagttttcattcaaaatacaatcaaaagctgccactggaagtcattgagcaaaggcaaagattagtacccttgatatagtcgagaatctagtttctagcataacttaacaaaactgaagttagagaataaaggaattttccaaggtgcacagtggataaaaaaagtccggggccaaaaacagaaacttaagacatataatttcgtcatccaaaaatggttttctccccctcaacgttaatgccacacctgtcctctaagctatgtgaacttatataattcagctttaatacttcagtttagtctttaaatctgtaaaatagtgcattatttgcaggcatgttaaattatcaggtgtttaaatgattaaatttttacctcctacacattctattgtgacattttctagggttgtcttcctcttgtgttgatgtttgatatgaaggaagaaattgaagtagatccacaattcattgcgcagttgatggaacagcttgatgtcttcatcagtattaaaccaaagcccaaacagccaagcaaggttggttcagagtctgaatccagagaattatgtatcatatcatatgctgtatagttttattttgcatagaagtatttatttgcatatacatgaaactgttactctatacaggttgaatatccccaatccggaatgctccaaaagctgaatcttttttagcactgacatgacagtcaaaggaaatgctcattggagcattttagattttggattttcatattagggatgcccaaccagtgcagatattcccaaatcccccaaaaccccaaatctaaaacacttctggtcccaggcatttcagataagggaaactcaacttgtataatatatatgtcattatatatttagttatctaatataaatttgtaacagtattcattatagatcatcattttctttatatatgtgttggtttttgcagtccatttagagtaaccattatttttccatagttaaatgagaaggaaagaacatttgttcttaatttagaatctggtaacttgaagcttttctaagttacccaagagttgataaggctacttacatgttttgtgtgtgtgtgtgtgtgtgtgtgtgtgtgtgtgtgtgtgtgtgtacatgcccagtgtaattcagaaattgtttagactacttactatatgccatctcctgcgcaagctggagagttaaagaagaggtgcctgtgcttttttgtaaatactttaaggactgaactgtctcaagttcagcgttcttggaatctctcctcagagtgttgtaaaatttcagtaactacatgtagagtaaaaatttaatggaataaatgttttttttttttttctgagacagggtctcactttatcaccaaggctggagtacagtggtgtgatcgtggcttactgcagcctcgacttcctgagctcaggtggttctcccacctcagcctcccgagtagctgggaccacaggcatgtgccaccacacctggctaatgttttgtactttttgtagaaatggggtttggccatgttgcccaggctggtcttgaactcctgcgctcaagcaatccacccaccacagcctcccaaagtgctgggattacaggtgtgagtcactgtctccggctcagaataaatcttttattaagtgctagtaagaatgaggaaagaggaatgtttctacattagtattgttgtttaaactagcacagccactttgaagagcgatttctgatcatcgcattattctaagatattgattaccctacctgcagtagttctacttctgattatacactctgaaaacacctttgcaccaagagacaacacgagaatggtgttgagtaaaaaaagtatattgcatcgtagtatgtagtcaatggcagcatttttgtgtatatatatgtctgtacatttttaagtataaagcattgtttagaaggatgcacacaaaaatcatgatgagttgcctttggggcaatagaaaggaaaatggaacaaagtaaacaagggagatgttctatttatttaacaaaaatccgaaataagaaaataacaccatttttaaattttgaaactataaatcttatatgcatagaatggtgtatatataatatgtattttatataatttggtatatgtaaataatgtggtaatcgctgtccaactgaagaaaaatgatcttgccttctcccaaagaaaactttaaaggaaaagatagcattgattctaagtgaacttgatataattagtttaaagttagggaacaggacattaattttatgtatcgtgaagcttcatgtgtgactaatttgagttgaccagagtcactgtagataccaggactaaaagataaagacaggagagacattagagggcttgtgcatattaagatggacagtcagaagaattccaggagttcagtaagaaatgagcagaagtcagggaaaaatagattgtaaatgagaactccagagccttgcagcatcccagggccatttaattatgcccagctggcccacattctaactactgctttaactgctttctcagccacaattttttttttttttggtccattgagggctttcccctttgagttcacatttcaaattttcttgatgagtccattgtgaaagaaaaatgatttattatttagaattttttttaccataagctttgccatagatatgtcaccaatgagggatagtcatacctcaaggtctattagctaactagtaaaccataaatgtcaaacataagtgatgatgatgatgcagtttatatgtggtcacaagtttgatttggtatgtaatgacaagatgcaagggggaagctttagtgtaaagatgaggggctgtaaaaagggaacccaggttcccatcctcttgctgtctcttcacagctgtgccttgacctgggctaagtcccttaacttcactgaatatgagtaatgattcccaccctataaggttttgctgagaataggaacatatatgcagctactatcacagctcctggaacccagaacatgcccaataaatggtaaccaataatttagggttttgccagaaggagtaatcttaagcacgaagtggttagaatttgcagatgatttaaaagcagcattgatatgtcccctgagtggaattcttattagcgtattcattttccacctccctcccctcccccattcattgtagactacttgcatgtcaccttttttcccccattatgtgttttcatagtctgtgattgtgaaaagtgttgagcgaaatgccttaaatatgtatgaagcaaggaaatgtctcctcggacttgaaagcagtggggttaccatagcaaccagtccatccccagcatcctgccctgccggcctggcatgtcccagcctggatatcttagcttcagcaggccttggactcactggactaggtatacaatttattattacagcgcgtctcagtcactggggaaatgcttgtctggttccctttctttctaccattcgggtctacatttaaaggctatttttttttcctttgggctctaagatcagatgaaaagccatacaacctgaatcaatccattttggggtttcttagtctctgtggatttgttacccagattcttcccatgtttgcataaataatcaaggtctgactattttattttcggtggctgtgtttgttctaaattaagaatgccattgagattgaagtaagcatgctgactgtaatttatgtttgttctctcctgcatttgcaatattgtcttcagtccctagagataaagattatccagtttgctttttaaaaagtaattgcaaatctgtatgaggggtggggaggggggtgaaaataagcagaacccgcatctccagtggttaggcctgccttgcctagatacaaaggaaatctagtcagaggccagacctgtatttctgtctaacgtgaggaatagaaaatagaagaatgaacaaacgtcatcatctcagagcttcagtcgagaaagtagaatgagctgtttaatagtcatggtgatatttatgtcctcatctatggattgctattttataggctgaagttaattgctgtattacagttttgctagatttatttctttcctgcacatttctcagttgcatttattttccttaatcagtactcctagaaaatcatcctgggtcattcagtgttgatttgagacaaaaaagaatactctcagcagtctttaaaattttttttccaatagctattcttgcagtctttaaaattttttttccaatagctattcttgcttttaacttttaagaagtttaatgctcttatatgattgattttccaagtagccctgcctagacatcattaaagaaagattttttttgtatcttggcccctaatctaccaaagttgttccttccactgggacctgaacagagtcataacaacatagcaatgactgtgagtcaggaaatgccaattaggtaacttagcaggaacctagttcatcctgcactacagagaaaacaagtgagcaaagattcactaactgaatttttaaaatgttttcattgctatacctatcctgttatatactttatgctttatatgtattcctggaaacttgtatacaaatccacatttcattctagaacatattttaaatgcccaaaggaaaatttcattatttaaatcaagcattgactccttagaacaacaacaacaacaaccaaaaaaaaacagtatttttttctgaggaaattttcatcattgagatggagcccagggaagtcatgtatatgttttgagatacatttaggaactgttctggtagcctaccctatctgcagcggggacaaatagatctatcctaccacaggaaagcattccctagtcgctgctacatgtgagtagtttgaaaagggtttgtttgtaagcagatgacaaatgagttatgcagaagaataaaaatgagtttccacttgagcagaattttgttcatcctgggtagctgacatgaatgcaagcacctggtgatgttcaatgaccctaactgccatcctggtctgggcacacctatcttccattttctgatagcaactctttgtggataagctgcttcctctgttggagctgtatgatgcaaaactcatgtgagtatttgaaagaaaatctgtcatccatattttatatttagaaaatatcagattatatcattgtgcattcccaatggcaatattggtgccatctctattttaaaatcttaaatttatgtgaattgactttatatattcatttattacaggtcttttgggacccaccaccttatctctgaacacttcaacaaccccaaactcactcttgaatgctcttaatagctcagtcagtcctttgcaaagtccaagttctggtacacccagccccacattatgggcacccccacttgctaatacttcaagtgccacaggtcagtatcatttaagtatattccaagttgtgtattcttaggtgttaccagttttttaaataaaatttacgaagggctcagttttcttaaggcaaaattagggttcaaagcatactccattgaaacagaaattccctgatatgtaaattagttaaaatgaagaacagcaaagcagtttgagtttttcatacaactgaaataccatcttcaaatgtgataaacagacctggtagttaggttctagttggagtaacttgctggtagtcatttacatctgtacaatgagagggttggattaaatattctctatgatattgtccgattttaacactcttttgtgtttttatagtaaatagtacctctgtttacagaggtgtcaaaattgaattcttttctgaacttgcagcaacaaaaatgatatttttattgttaataaaaataatagttgaatctgagtttcttcctaatatctgtcatcataaaatgttgttgtaggtttttctgctataccacaccttatgattccatctactgcccaagccacattaactaatattttgttgtctggagtgcccacctatgggcacacagctccatctccccctcctggcttgactcctgttgatgtccatatcaacagtatgcagaccgaaggcaaaaaaatctctgctgctttaaatggacatgcacaggtaatggccttctgccagaatgtgtgtgtgatctgtactgtttgtaagagacaaacccctggtaaagttaaaacatgctagaatgtgtgtgtgtgatctctgctgtttgtaagagataaacccctggtaaagttaaaacatgtttaaactttcacctaaaatgaattttatttatttttttcaacttttattttaggtttagggggcacatatgcaggtttgttacatggggaaattgcatatttaaccaatcttgagttaatttttatatatggtgaaaggtaggggtctggtttcattcttctgtatatggctagccagttttcccagcgccagttattgaacatggattcctttccgtattgcttgttattgtcgactctattgaagatcagatggttgtaggtgtgcagctttatttctggattctctattccgttcccttggtctatatttctattttttttttatgccagtaccatgctgtttggtttctgtagcctcgtagtatagtttgaagtcaggtagtatgatgcctctagctttattctttttgcttaagattgctttggctatttgggctcttgtttagttccatatgagttttagaatagttttttctatttctgggaaaaattatgtttgtagtgtgataggaatagcattgaatctgtatattactttgggcagtatggccagtttaatgatattgattctcctgatccctgagaatgggatgtttttccatttgtttgtatcacctacaatttctttcagcagtgttttgtagttctccttgtagatatatttcatctccttagttagaagtattccagggtggttttctttttcgtggctgttataaatgggattgtgttcttgatttgactctctgtaaaattgtgaccatatttatacattattttctattattattttagtctccagatataaaatatggtgcaatatccacttcatcacttggagaaaaagtgctgagtgcaaatcacggggatccgtccatccagacaagtgggtctgagcagacatctcccaaatcaagccccactgaaggtcgggaactgtacccttctgaaattcattttggttgttatttggaaaaaggaggttgtagagagtctatgcagtgatttttgagttggttttgctaaacagctatcattcatcctacctcaattatgtggaaagacaacatcctgaataaaatttcaaagagcatggtgaaagattaactgaaaagcactttccacagaaataatcatttccccattacattgtaagttcctgaattaaagtgaaggtaattgtgcagcagaaaagcatcaacttactaaatgttatatatatagttcccccaagtagagtatctttttataacctttttacccaccccctgccccaccaaatctttaaaatatatgcgggtcttctcttcaaattgagtttttgtgacaacctgaacttgttaaggtgtttctttgcagatggaagaggtctctgtcaggttaatcatgtctccatagagtagggttctgatttgtttccattgcagataattgtcaactggaaggtgatgttgtttaggtgtttcacttttttttccttttcctctgcaggttgtaatgatgcttttgttgaagtaggcatgcctcgaagtccttcccattctgggaatgctggtgacttgaaacagatgatgtgtccctccaaggtttcctgtgccaaaaggcagacagtggaactattgcaaggcacgaaaaactcacacttacagtatgtattttaatctttaaagagcccttgatattttgaaatgatatatatttgttctcaactctatagttagtactctttgattcaagtcatgtttgatctcatccatgggtgttttcattttaacttttttaaaaaaaatattaaggaataatatctgttaattttcacccttctctgtcttctctatagtcccttccccatttaatgaattgatttatatctgtgtcctctaaaccgtctgtattactctgaaactgtagcattctctctgctcttcagtaatcagcagggccatttttattctctgatttttgctgttagaaattttcccactgtgaattctccttcatttggctttgaatttctttcttactgtggctctcttttttcccaaggtagttaattgcaaacttttaaataaatgcttgacattatcatgactttgtttattccaaatcactttggttataaatacataagttgtattaaatattaaatataactcttccttaccatagcacagttaaagtatgtcatccttactctttttttttttcctccatgtattttggacagtctctacaatgtaaggttttgttcccacctattccgtccacctgatttcctctgctgtcttattagttcctggtatacccttctagagtgtctttatgcaaagattagcgtacatggttttatttcctcccattcttattaaaatccattttcctttataaactctttggtcaatcattattacccaccgttgtccagttctcctttatctgtgtttttctttacatggagctaatacccaaaattaatgttctcattataggctagagaaacagttttacttccttgaaactattgaagcatttaaaatagatacgtattcttgtcatcactgagtatgtcctgaaccttcttatcatcatcttttggcttaagctgcagcctccagaaaggtctccctgcctccagtcttttattagcttgatctatcctttattttgcttcagcaatttactttcgaaaacaggtctaatcttgtcacactctggcttcaaatcaccaatggtctgtgttgcctgcttcctttcctttacttatgctcttccctctgagttgctgttctcctgacctttggcaccagacaacttgcagatgctcttaagttcccaggtcaaatgtcctttgtgtagcctctgtcaacttttgtcaagcaaagttcattgtccctctttttgtattccccaagtacttttctaaattcctctaaattcccttggcacagcagctgagtagttgaacaaataaaatcatgaatgaataaacaaaacagtacttgattgatattgcaatccctattttgagcctaaggtgcagttagatttgaacttgtggtgcatgcattctgtacatatcatgtgttgtaattcacatatttgctgctctaagaagcacttttacgctctgcctgtccccctcaacagactttgaagaatatttcttatttatctgctacattttatttgttaccatcatatacatatttcatacacacgaattggatcatctacatcccttcaaattgactggatctctgtttggactttgcatggatgaatcattgatatctccttgatgtataaaaattagaaatctcatctgtacatctattccacctatatcatatgcagtataccatatatactatatatactgtgtttgaatgtgcatcatgaaatagtttcaagctttagccctacagtcagagtgcccaatttcaaattccatctctaccattcacattagaggtatgaccttggacaatatacttccttcatccacaaagtggggataacagtagtacctgtgtcatagcattgttgtgaggattaaatgagagactacgtgtaaatagctgatgatgataaacatgcatagtaaatgtggcatgtaggaaacattcagtacatttgtatatatagtggagtgttaaattccacactcttatttcacagcagcactgacaggttgctctcagaccctgaactgagtgctaccgaaagccctttggctgacaagaaggctccagggagtgagcgcgctgcagagagggcagcagctgcccagcaaaactccgaaagggcccaccttgctccacggtcatcatatgtcaacatgcaggtaatggtaataaaataggaaagccactcaaatgtcatatgtttgggttctggtatggagaattcagtgagtgttcagcagtagtgcagaaattaggttttccttctgtgctacattcaaaatgaaatttaaatatatatgtagcagttagtttgctataaacattaaaaatgaaaagcagtatttaccttaagtgagaattctttaaaatatattaaaaatggtgcagaatggtctgtgtcactgtcttatgcaaataacattattcatgtgttacttaaaaaattttcagatgagtttgcgggactgcatttctaagtattcttgcttcatgacatagtcttggataaatagatatactattttctatgtaatgaagatgatgaatgtgtttggtgccatttaaagatagttatgagaataacgaatgtggagtgttctttgaaactagatgatgaatattattgatgattgtgttggttcacagattttttatgattataaaaacaacttcctttaaataatttttatgattaaacaacttcctcaataggaactttctgtgtttccattttcaaactattagtctaattactcagaatagactattgaccatgaaaatgcagaaattatagatgacaatatgaaagataaggatttgtgctttgtgcttttagagatgcctacaagcatttgatgtcagaccagaattgctgagtagacttacctgttttatctttcaccaccaaaaaagaggaagaacgttccacaaaatcctagaaacagaaaagctgtcatagatgtgtcaaagaaattaattcatggagctaaactatattactttaattccagtgcaatctgcagtttagtcctccttctctatttttttaatcctttgcattggaacattttcctaagtttttcgatgaatttttttttaaataaaagctatggcctttataatgtgtcagtgtttaaaaaagacatttaaggccgggcacagtggctcacacctatattctcagcactttcagaggccgaggcaggtggattgcttgagtcctggagtttgagaccagcctggacaacgtggcaaaaccccatctctacagaataattctaaaaaattagcagggcgtggtggcatgcacctgtagtcccagctacttggaggccgaggtgggaggatcacctgagcctgggaggcagaggttgctgtgagccaagattgcaccactgcactctagcctgggagagagagcgagaccctgtctcaaaaattaaaaataaataaaataaaaaagacatttattacattttctctggtggatgtattttcagttaatatgaattacaatttatttaacaaatatcaaatcccctttataatcttttgatggtttttgtcttgtggttcttgtcaccttttccatcagatttatacctgcagtgaaccagtttcttgtttctttcttttaggatggatgagcatgttcttaatgtttgagtttcagcctaactcgatgtatttatgttgttagtgaacagttgactcttaataaatcactaagaaatcaatgataatattcactgagcattgacagggagaaagattgaaaacttggcctgatttccttggctgaaaatgatctgtatctcctgattgctcttggagtgctatatccccagctctctttttatgcttatctcagtttctaatttattttatagttatttctttttcccaaccctcctaagactgcaagtcagccaggcatggtggctcacacctgtaatcccagaactttgggaagccagggtgggcagatcacctgaggtcaggagttcgagaccagcctggccaacatggcgaaaccctgtcactactaaaaatacaaaaattagcccagcttggtggtgggcgcctgtagtctcagctacttgggaggccgagatagaagaatcacttgaacccaagaggtggaggttgcagtgacctgagattgcaccactgcactccagcctgggcaacagagcgagactctgtctaaaaaacaaacaaacaaacaaacaaaaaaactgcaagtcatcgaggctgtagcttatttttgattagttgttgtattcttccacaaagctgagcatagtctctttaaccagtaggccctcaatgaatatttgttgaacaagtaaatttaggttctccgtataccttgcctttaggcattaataattaaaaattgattttaactcccaatgccattttagtcctaggatttaaaaacttcatcaaaaatattatctaaaaatctggctttcctgacacatggctatgtttttagttatcacatgtccttgtttgtctgggacagcctctatttacttttattatcttggcctaattgttattcacagcacatttcaccttcagaaatgtcctgtttcagaccacagattatataggtaccttatatatgatggtatagtctttctggttaaagagctcttgccaattggcccttggtccttgtggtaggcctttgagacatgcttagatcaagtcttagctatttcctaaattggggagttgataacactcagaaaagatttgaaatgtagctgtatctgcactactttcttcaaaatgatctatcttagtcctcacatacacttgactacatcgtagttactcattcagttttaatggaatgaatcaatggtgctatcctagccctgtgcaataaacagtaactaggtttaattttatggcattgcttaatgtcattataaattaaagttagacatctgccatttatctcacatctcacttcaaaagcaaagactatgccagttaggttaaataatttcttaaggtatcttgacatcataccacttcaggccacgcttacctaaatgaagaggggatttttgagaccctaagggggccaatagatacatgacagcattttggaaatgtatactttcaaaacccacattattattattaggctgttcactatattctagcagacattggctctggtgtgctaggtatttatggtaaataagatttttttttctttttttaaggaaaaattctaactcttaaagtcaaccttaaagtcagaagtggtgatttattattactaattaattagtgttggaaacatgtttaaacttacagacataccttggatttctgtggcattattgtgcaaagcttggtgtatgtctcaggcagattcatggaacacagtcaaaacctttgttctctaaccatggagtgttggcatgacatttggagagactgtcaataaaggtattttctgtttcattttcaggcatttgactatgaacagaagaagctattagccaccaaaggtatgtaatacactaataacttacacttgactatattttagtacactcataaatgttttttgagtactcatggtgaatcgagaacttgaaaactcagaaaaagaaacctagaatatttgggttcaagttgcatacattctgttgaatatattttgttgaatggtttagcattagaccaattaagaaatcatttagcattttttcatttatcattacttggataaaatatttcattaagatatttttagacattttgtgttaagaaataacattcagtgataatttcttcacatatatcaaagaaacgacacttatcatcagtattttattgaagaaatgcattaaacataccaagcattggttttattttgtttccaaagctatgttaaagaaaccagtggtgacggaggtcagaacgcccacaaatacctggagtggcctgggtttttctaaatccatgccagctgaaactatcaaggagttgagaagggccaatcatgtgtcctataagcccacaatgacaaccacttatgaggtttgtagagtcatgtcctactcattcttcctgtctgttctttcagcaaaagaggacagtccttcccccaccctcattctttatgtacctaagggaaaatgattagtggtgacttgtttttatttctattcttgtaaacacactgttataaaactgatgcactcttgtgtattatgatcttttatctgtattctctcaaagttgttggtcagctcttaaagagatgtaaatttggatgtgagtttttgttgagtgtgggatgtgtcataaatgataagcgtagggctgagattaagcaaaagggagatgtaatatttcataaaaatgtctaaagagtcctattatccaagggtttcactagcaaggtcacgatgggggaaaaggcaaatattcaacaaaaataggttttcagatatgagttaaaaattcagtgtgctcagatgtgccaagaacacagcaagaagtatctgaaacaagtgctccaaaatttttatgtttcccagatgttggctgccctgctcagggtgagactgggaagctggcattcctaccatatggaagggatggagagttccatactccacagccaggctacacgcgattcaccaagcaggccttttccatttcaaagtatcagattttggctctaagcctttgggagtcggggtgggtctagagagagcgtgcacacatacacaatgctgggagactgtacacacccaaacatggatgaaaatgattaatccaggagtcacagtgttcaaccagagagagcactgtaggccaaaaaacaaacactggttaagggtttcataattgttagtctaataactagcatttgtagattgaccttttctccacccatttgctttgtaataaattaggctattgatgaaacacaaaagcaaacatgctgctttttttttttttgtctcttttgagtaagtgaaaaagaaaatactattgaaatactaaaagagtctcctgtgaatttcattttgggagttatagtagcaacatggcaggctgtgttttaaagattgaagttaccttcagcagcagaatgtaggaaccattatgaaaaatgttgaggctctaggaggtacactcttctttcttccattataacacagagagaaaataaacatctccttttgttaacagagaccataaaactgctgtgctcattcttagagtttcacctgatgtacggtatggctattcctttcagcccatccttgcttttgacggagtgaagtgtgccagattgttgactgtgttcctatagtttcaaagatgaagtatttgctttagaaatgctcattcagttctgctttctaagaccaacagtaggacaagttgaaaatgatgttcatttcggtaatggagtggtcaagttcagggttctgataaccacctctgaccagatgtatagctttggtgagggacttcactcatctgagctgtgtctcattcaggttgtgctgagaagggcattggagagggcatccagtgattagcatgatgtgttgtcagttcttagtgatatttaaaaaaaatttttttttttttttgacgtggagtctcactcaacccccctaagctgcagtgcagtggcacgatctcggctcacggcaaccaccatctcctgggttcaggcaattctcccatctcagcctcccgagtagctgggattacagacacccaccatcatgcccagctaatttttgtatttgagtagagacagagtttcaccatgttgaccaggctggtcttgagctcctgacctcaggtgatctgcccacctcgacctcccaaagtgctaggattacaggtgtgagccgccatgcctggcctagtgatattttaaaaaattttactttattaagagtctcactctgtcacacaggctggagtgcaatggcaggatctcgcctcactgcaacctgtgcctcccaggttcaagcatttctcttgcctcagcctcccaagtagatgggattacaggcatgcgccacaacgctcagctaagttttgtatttttttttttcttttttagtagacacagggtttcaccatgttggccaggctggtctcaaactcctgacctcaagtgatctgcccgcctcggtgtcccagtgttgggattacaggtgtgaggttcttttaagttttttacatttttttcatttttaaattttaatctatatacttatttattttgagaccaggttatgagactggctagtctttgtatttttggtagagtcgtggtttcaccatgtcgccaaggctggtctcaaactgctgggctcaagcaatccacctgcctcagcctcccaaagtgctgggattacaggagtgagctaccacgcctggccagttcttactgatattgagtggctattattatttccagtggaggacttactttatcctgaagaaaaccaagggcttgctgaaagatgagattatgtttatgaatgctcactggtggaaatatttctgcacactcaagctagttatgcttttttatattcaaaggaatatcttagggtattatgtgaacacataagaatttaaggtaatagtagtaattatcttaaatcatattcatttagttcacccacaattttattcaatccccacaaactcctagtaaggaaagaggggcccagaatggctaagtgtcttactcaaggttacttatactcctcttcctaatgatttaacccaagagagtccatagcaaagggtggtatgtaactgatctagagccatgttgccatagttttatgaacataagaatcactcggagagcttaataatccagactcttctcctaggatctcactcaaaaggtagggagtgaggaccaggtatctatttgtgttttcagcaagaacctagtataattgtgatgcatgtgtcccacaggaaactctgctgtaaagggatgtaaccctatggggataagggcaggaataggcataggagcccaaaaggctcttctgctccagcacttgcccaaggacaggtagatcacagatcactttctgtgggcagaaatgtgcagggcccctgacaccatggttgaacttcttcctatggcttttcttgctttggctatcttgggctagcctgccccatcatcctggctggtgtttagcagcacattcacattgaaatttgggaggaagggtgggtgagacctgctagattccagcatggacattaaccatgtaatctgcttttcttcactgcctctttaagtgctactaatggaaagatatgatctttttttttttcttttttgtgaatggtgttctagattctccctggtatataagttagacttgagcttttcctcatgtatcccaaattctttgaaatgtaagaaagggcccctcacatagcatggtctgattttctgcagcagtggctgtgtatgtcttttcctttattcttctatagctcagaaggatcagaaatagggcatccagtgagtattgcctctatagattaggaagaggggaagggcctggggaaaagtagagagggagatttttattaaaatagagaccacatctatgcttatggcactaatatttttaagttggagagtagctaaaaacaccttcctttttcttactttttcatttttcaaaagaaaaataaagccaaatgaacaaggagaatgccgatctgtaaaaagagcaagcatgtttgaccaataggtcctgacaggtgagggctgctcactcggtgtgccagggaccaaatgtttcctgctgtagcaactttgcttgaggcaagaatctgatacttcaaactctgtattcaatattattgagaagctcagcttgagcagttttttccagttttagggcagctttgagaaattaatctacttcaaagagatcccttagataagaagcaggcactttgaagctttttttgttttctccaagattctaaattatgaccctgtccccatatattatattgggataccaaaagtcaaacaaaaggctgctttgacctgcagtaactgtgtcacatcaataaagctacaaagaggtttgggattttcttttcctttttgccacccatctcttaaaagcatgagtaatggtcacatattctcggagcaaataaaaacctgcactgagaatcaaaggtggttttaaacttccctagcactgatagtaacgaggttgtctgattattttaaatcttacaaatctaggagtagaaatattaaagatattttatcaaagatatacaaataataaagatactttgattggaaatccagtttttggtctcagaaaacttcatttccctatacccattgccagaagttagtgaaggcgtcccatagttgtagggaaaggagtccttgagattaattcaataattccacaaatactaagcaccttatgtgttccagacacaattttatacactggtaatacagtgtttgaatacaaggttcttactttctcagatggagctttcttgtgggtagaaggaaacataaaacaaacaagaagtcattagtaacaagagtctctgttacatatgaaacagaaccactttagattgggtagtcataaagcagaccttatgagcaaatgacattcaagctaaaacctagatgccaagaaaaggccatgaagatctggggaaagagtagtaggccaagggaacaactggcacgatcaccccagagtcagaaccagccggtgagttcctgaagccgaggtgggtagggtgggggaccatcagcatcagagaagagactggagagaggcagaggctggattatggagcctgtcagtttatggtaaggcacagtggaaatacatcacaggactttacacagaggcatatttgttttaatttgcattttaagaaatcagtcttgttgcttcatggaaaatggattgtagggagataagcaacaagagtagaattaaaatggcccttagggaggcagttgggacattgtggaggtgcatagaagtgagcagacttggggtattaagatgacactgatgaacttgctgagggattggctgtgttgagggaaggaggaaccaaggatgacccttggacttttggctggagcagctgggtgagtagtagagtcactagctgggatataggaattctgaaagaataagtttgaggatagctgatggggatgggtaacaacaacttggtttcaagcacactgagtttaagatgcctatcggacaggaaaatggcagtgtccgactggcacctctgtgattctaaatttcttttcttttcttttcttttttttttttttgagacagagtctcactctgttgcccaggctgaagtgcagtggcatgatcttgctcattgcaacctccgcctcctgggttcaagcaattctcctgcctcagcctcctaagtagctgggattacaggtacgcaccaccacacccagctaatttttgtatttttagtagatatggggtttcaccatgttggccaggctgttcttaaactcctgacctcaggtgattcacccaccttggcctcccaaagtgctggaattacaggtgtgagccactgcacccggcctatgattcttaaatttcaacagagaaatcaaatctggagttagaagtttaggaatcactactgtcattactttttgaaaggacttgagattacttaagaaagtagacagagggaagggaagagatcctaggaccaggtacagggtaatctgacattttagaatgtaaaataggaagatcctccaaaggacacagtgaggtaggtggaaaacttggggcctggggtgtcaggatgccctaaagaaagaaatttttaaaggagggcatagtgagctgtctttatgccattgcaagattgaattaagtaagtttattgaagtgaacagtaaaggattctcttggaattacctaatgaacataatattttgaaagtcagagaatcttgactttaatactctaggtaatagtagggtgtctataatatagtgattaaataaatacaaagatgaataaatgcaagttcagtgcaaattttaaattatttttgtttttattgtggagaatttaaagagataaattactccaggtatgtaatttgttagagagattgtatccttgtttgtttaggggagggtaacacaggggaaatgacagctccccttccaacctcaggctctattagcattttgagaagccagctttgccacatcaccatttctcttacttgtgtaatacaaggcagagaatctttgctctaccaggtggaagatttgctttttggtctccaaaattggaaggagtctcagcatccactcttccaaattttatagaagggattatttatcccggaggctctcagaactctccctcagaatctactccccataatgaaagaaaaagacttcactgtgcaaattaccaagtgtccttggtgctgcagggcaaaggctgtaggcaggttccacagccttcccgagagtcaacactcatgagtaactgcggtggttggcaagagaagtaaacggcagtggtgtaatgtggattcttttctcctcccaccctgaaaaacccacctgattaaatatttccttatctggctttgtctgtttacagggctcatccatgtccctttcacggtccaacagtcgtgagcacttgggaggtggaagcgaatctgataactggagagaccgaaatggaattggacctggaagtcatagtgaatttgcagcttctattggcagccctaagcgtaaacaaaacaaatcaagtgagcgttgtgttttatgcacacttttaggtatccccagattagaatgtgtttatttgggttggagtatcactgactgtggcctctctgacttcaagtgcttggtgtaattcacatgccatctcctctgtgaagcctccttgtttctcccagtgaagcaggccacctggttctctttcctctcactccattttgtgcgtgctttcactctagcacttgccataccaaagggcaattatttatctacctatctgtatctccttgtgaaatttgtgctccacaaaccaaagactgtatttgttcattttataaacatttatgaagtgtccatgtgtcaagtattctgttatgctctgccttattggatatttcttcccaaacgcctagtgaactgtctgacacctagtaggtaggtgctcagtaaaagtttgtgaaatgaatgcatgaatgggtaatgtacacacatgcatccaggtggtgacaaaaagacaaggacataagaaagtggttgaggccaggcatggcagctctcacctgtaatcccagcactttgggaggtgaaggtgagttgatagcttgagcccaggggtttgagaccagtctgggcaacatagtgagatttcatctctactaaaaaaaaaaaaaaaaaaaacaagaggctgggtgtggtggtatgcatgcgccaatagtcttagcctacgtgggagactgaggtgggaggatcgcttgagcccaggagtttgaggctgcagtgagctgtaattgaaccactgcactacagcctgggtgacagagcgagaccctgtctcaaaaaaaaaaagtggttgagaaaaatgtgattgaattagcatcttagaccattgaagaaagactgtccagcgggtggctactaaaggtgaatagcagggtttgattttgtaaatagacaagatgttgctgaattcgcataaacaggaaaaaattaacttattacagcatgggggttctggcttttagcaaatctggctgagactcagcataagcccattgttttatctacaacagcacccatactcctgggctgtataaacagatgagagctgacattgtcatcacaagatatgccccaatgccttttttcagggtttttgacaaatttggaatcctgaaacatgtagaatatttgaagactccttgaagctaggcaatctagatgagcatggtagacactcagtaacagtcagttgttacgttactatcactcatgtcagctgtattatcaggagtctcagatttgaaaggagtaatcaggttgttggccaagtctaaataagaaagcacggacaactatttcattcctaagtacactgtcaatagtagcctggagacttcccattagttactggctggacgctccaccactgacagtatgatcaagatgagagtcaggctgatgccaggcacagatggaggggtgtaaatgatgtccagtctctagcccaagatacattcatttggtgcttctctttttctatctttatctcctttcccttcatttaacattggataattaaattgactgtactactcagttgaatagaagttcaggattaagatggaggatacattaataaaaaggaatgattaatgaagcacagttatttgggttttgtcactttttttagggtatagggagtttaagagagactatagaaactacaagtagttaagaccaaaaaaaaaaaatttaagtaaaagtacgttataggctactttgaacatttatcactatgaacattttattttcaaacatttgtttttaaaattgttaataatttaacatatgtaagattccttttaaatatgtaatcaatataaaaattattggagatagcttacattctttcttaggttgtacaaaggctttaaaatctgcagtgtattgtgtactgacagagcattttcattcccactaggctcatttcaggtgctcaatagccatgtgtggccaatggctactgtattgaacagcacagttttagataatttctcttaacacccttgtcaaggtcaccaatgtttccattttcctgggcatccctatttataccagttgctgcagcataattctcagtaactcttttactctcgaaaaaaaaagtaaatctatcatttggaccataaattatatgggcagcctttcagccactttgatgtagtcacatcccacatctggtggtcactcaccccaatttgcttatcgcagtccactttgtggctttgtgtcacctttgacccggtacctcaatagtcactcctcctcaaactgtttttatgactttggggcctctgcttcacctttaaatggtggagtgtcccaggactcagtatcttggggtttggttttgggtcctttctctacacattcaccccaagagataaacagcagctatccttaagagaaaaaccttttcaggaaatgccttctgtttgagaatcatagaggacatctcaattgggagatgaaaacaactggagaaagtgatcaatgacacccaaaacagtgcagaacaagattcctagatttggcagacacatggatccccagagtagactagatggatctgattggctttggtcagtgttgtcctccctcacctctttggggatctctcctgaagccacatccttggtgtaagaagacagatttcccacacaggcaagagctcattattggtctgggaggtggaatgcctgcactctgctgaaatctccaaggctgtgtgtgtgtgtgtgtgtgtgtgtgtgtgtgtgtgtgtgtgtgtgtgtgacttacttggcttggttcaatagtccgtcaccagcgcttgcttgtcactgggtctgagagccacagacagtttgttgaaacctttgcccaccaaatcagttgcagaaccaaggaaaagttcagcattgctgtcttaaaagttttccccagagacagatttatttttgtcctaaattaaatccaggaaccccagcatcattcttatcactttatacattactattaatcttggaagtgtgctgttttgtgaccttgctacccagttatattttttagggagcaggatttatgtgttgcaataccatacaattcctttgaccaaaggaaagcacaggtgtagatacagagagccaccctgccatccaacggagcctggacttgtaataactttccatacctttattttgtcccagggatcctttttacagctcctcatttaattcacatccaatcaattttaaacaacaaatgcttctgactactcagggagaatatgatgaatgattattaactacagaggcactgttgctgaatttctgcctcccaagtgtaaccttttaaatgtcaagagcctccctgaaagcaataaccagcatttccttaatggaaagccaatatttcagtaaaggattgctgtatttctacagctactgccctattcagctgaacaatggaagttgaaatatttaggtgattaaaacttttaattaaaccatgttctctctgggcatttacacttcaagcctgtctctcctttgcctttcagcggaacactatctcagcagtagcaattacatggactgcatttcctcgctgacaggaagcaatggctgtaacttaaatagctctttcaaaggttctgacctccctgagctcttcagcaaactgggcctgggcaaatacacagatgttttccagcaacaagaggtcagtcattatttattttcccaagtatctttgttttgattgtgtgtatgatgacttctagaatgaaatcacttattgacctatgagtatgctttcactgagcatttattcaagtctcatagcttgtccttgctactaagaaaaatgtcatctcatttcttatttagtgcagctagtaaacacgggatagcagaaatagagaaaatcatacttgcagaaaaatgtacaatagctgtctaacagttttagcaataaaacccaatcgatatatagattcctaggaatttttgtagtcacagctcccttaaggtcagcaacaagtctgtatttaacatgatttcattttgaatctgttgttatctttatttgtggcacttaaaagtaaataacagcatctgaaatatctctggctgtttttgactcatcctggtcatgctgaagtctgttcttacagaatatatgtttttttcaacatgttaatttattcattaacttattgtttgggttttacctgaactgagacagaactgagatgtctactgaacaatcatgaccatggattttggtcaaactgattagccatatcctattatgtactggcataaagaaaagaggccccaggcatgattcttcctaacagtgctctcatattactggggcacagctaactcaaagtgtcagaaaattaaaatgtttctatacatttgtgtctttttcaaatcaagacatggtccatgtttgatgctagttggcttaattttatgttagagaacatctgatttagtcagtaatttctaggcacgtgtcagttaataaagaatctatagtttttactaggcactttgtatcataaattcaatgtactgcccatggtccaataaattattaagtttaaatgctgagcatttttgttttttacactgaaagggcaattgttgtgtgtattaaatttcagggtattgattttttttttctgtttcccctacatctgagttagtgttcatttaaccaagaattttctaagctgaataaacctttcataatcagtgcattaaagaatatatctccttattttgtcttgctggttagatgatggtagctggaagcagaagtattttaatgtgtccaggcacagaaggtcaaaaagcaagagattgaatgttaattcaatgatattctgggtttgttttcatctatgtttcctatttgaagaagcatagaaattgtaggtatttcttattccaattactccaagaaggaaaaaaacatgaaagtataaagccagagggacttaatgtaatattttattaactacagcaggggtcagcaaactgtggtctgtaggccaactgcctgattttgtaaagttttattggaacacagccacattcatttgtttacatattgtctatggcttccttccagctataacagcgtagttaagtaactgcaacactgacattgtggcccacaaagcctaaaatatttaccatctggtcctttaagagaaagctggggaacacttgagctgaagaatctctattatagaatttctgaaaacatatctttagaactgtgataaatgatggcctaaggttttctaagacctggatgtaccttccaaatcaaaacaggacaatttaaattatcttcaatatcatttaatgaaaagttttacctgtttatggcatgttgaaatttggtcatctgcttttttcagtgtaggatattttctaatactcagatgtgatttaacaagaatcccccataagtaacttcatgagatttaatttattgtaagcatgttgaagattcatttagcaactttcacaggtgatatatcaacatgcattattactaaccatacctgccaattgtcttatttggtaagcccagtactttatatctatagttatagtgaatgcttacaacagttctgcaagatacagtattgtcaaccctctgtgcccacagctagtaatggcagagtcaggatcgaacccaagtctctttggcttcagaatctgttgtctttctcttcttacacactatctttaaaggaaggtgggggatccttgggcagtttcccttcatgctttgttcctgatgccagacagtgcagttttatagttcctgcaaatacttcttttgtgtccctttcagtgatagtttgctgagttgagccaagtgaactgtagatctgattgtgtctgggaattcttctttcaatcctttcaatcctgtgttgaacacaaaggaagatgccatctgttttattatttagtttcttcttataaagataaagatacacttaaccaatttaaaatcccaacctaagaaatatttttctcttctctgaacagataatgctcttccttttatcagttcacaaaaatggtacaatctttgtgtttcctttcttgctatagttgccgggttgctcagagctaagtcttctgctagaatcatcatttccatttcaccacctttcttaattcttgtttcttaggtttgtgctaccacctttcttttctggaagtaggcagagcataattaataaataagtgtgacaacaagttgatcctacagtgggaaagaaaataagtaattaatacattggttatagattgacctttctacccacagatcgatcttcagacattcctcactctcacagatcaggatctgaaggagctgggaataactacttttggtgccaggaggaaaatgctgcttgcaatttcaggtgaatataaatattcaactcatatgttaaaatctgaataacctctgccagtggtctcagccattgggttgtttctacccattaactgctggcttactaacctaacaccttggttgtggtttcagagggttttcctgtcaacagtgtgacagatcctgagactgtcttactttttcatcaaggcattgcctgaaaacctgccttaacaagggtcatatatgaaaatagatctcttcagaaagatctaaccaaaatcgccctatgcagaacatgagaagttggggagaaagtttaattctcctctttgcagttgtgttaaacagtaatcattacattagtgaataattattcttgattggcagttatgtttcaaatgtttgtgtccttgcacaccgactgagttcattgcactgagaagaaaagaatgctggttgaatctggcagtgttacttgtcttaattcttcttagtcttcccactgtcttaatagaatttatgagtcacaggacatagtatcctgaagatagtcacagaatgaaggaaaataatgtctgtctccctaggccactttctttgtgcatctgttgcatatatattttagaaaatgctctatacgtatttattgggtgccactcatttgaaaggaattgagccagatgatgagtcaggagttggcaaatacatagtaatgaacctcaaaaaagcgtttagaaaaatatgcggaaattttaaggagggaatgggattagtttttgaagacttgccaataaagttcttgaatgtcaagtttatatgtgtcccagtctcagaaagacagacacaccaggggcagaagccaagtgtcatgtgctgcggaaaaatgaatgctttttcagaacactgaatttgcaggctatgcctcagtgaagccagcagttacatccaactggtgaaagtccattccagacaacattcactaatcagatcagcagataaaatttaaaacctcagtggttttccattttattttagcggcatgttgaatgccccacccatcttcccataggaaatctttatctgaagcagatacaggcaaagcagctttgaaataggagtggaaatccagccattgagcttcctggtggcagcctgttaggttcttctgtggatagagttctacactcatcagttttcccagaacttcttctaaaatttcttctcggatatactgtgtgtacccaagaggctctattaatggaactccacagggaaaatgcataattcctgctcataagatcatcttggtatagtggaaagaacactggattcaattaggagatctgggctttacttatgctaagtcatgagtccttgagtgagtttccaaacctctcttggctttggtttgttaatcatgaaggtagattggaatttgtgattgtacaaaggtcaccttccatttctaagatctgtcctttcatgtgatatcatcaggcttagtgaaaatggacaaaacgatagttttattacttgttcttttttaccatctatgataatagagtaatttttaaaatttgttttctgtaaagctcatcctcagggggctatccctagactcaagctaactttaaaagttttcatattattttattaatttgcaaatgaaatttatttgcagtttgaaacgtgattaacttatgcattcaccatacctgtactgttgaaatatgcctgcaggccagcaattttctatcagtgaagtgtgtagtccagagctccataatctttcactagagattcatggaatagcagtgaggatatagtgaaaactaagttcattttttggtgtcccaacccaattctgaattctgtaaagattttagcaacaagcagatagctgtaaatacattcacaggttgtagatagatcatcaatacctttcctctggaatatatcagtatcttttgggggaggtaagatgggaatcagaaaggtttcaagctctctattttaaaaaaataatattttttctaatcatcttctttgtcattctgttgaggttatatagtacttttgcagacttcctctctcagtggggttcaccaggtcctcttgcttttaaagggagtttgagactgactaaaatactttatggctgctctgcacagcataaaggacttgattattttaagaataattttgtcttactttgttgagtgcatttgtttgaacctggtaaattattttctctgaaagcaatacatttttattgagaaaattcttcatcaaaaagcttctttctccagttcaacttatctcataacaaagacatccatttatagtcccagaacattctgtctccctatggatgcagtatagctgggcagtctgaactcacatttgtcttatggttatagattggttaggtccagagtttgcttaaaattcctttttaaattttgtagattttaaacttataatctgagtgattctttcagtataaggttttgttttatttttaatctcaggccaaaatacatttaatgttatagcagtagatgaaatttatctccaatggagatggatcaaagtataaatttgatctctttttccccaaatccactttttttttttttggaaaattcacagatttttctcagaatattttcatgattggtcaaatgtacagggactcagtgaaaggacgcttagcatcctgttgacaggcttcccaccacggcctcaggtagatctaacatttcccgacctattcttttagtttgtgactctgttcagatccgcaacaagatcctgagagctgccaggattgtgtgaaccttggaatttcaaagaaaaaggttggtattttcccaaaccatcccgtaggcttactgaaaaatattagaggagtttgccttatcatttaaacaacaacaacagcaattctaaagtctcttcagtaggacttgaccttgataacctctctggaagatttatctctgtgcatcacatttaaaaacatatgtatgtactctcttagaaactgtatcgattagggttggattcccttgtgatcattttactgtttcaaagatctagctgatgtgtcttttcagaataaagtttttaatatttattttgaaaaactttgtcttcatggcccagttgttgtcatgtgctcagttatacatgttatatatgctaaaggagaatgttgtttggcctcattccttttttttctttgctgtaaagtgggaatgtcttcctgaattgtatgttattcccccgtgagaaaatggaggccgaagatagtccctagcttgaagatgataaaacttttccaggctgtgtacttaaggggattcatttattcttaacgcttctataagtttgcctttaaatatattcaattctgtcttgatttctgaattttgaagtgctgtgtttgtttttaacaagatacatgtattcagcttttaataactgtgtttctggaggaacttgaaacaacagccatctgtatgcatgcctgcatgtgtcttttgcttgtaaagataccttccttgcttcttcagagtgaagctgggtttttctatttaaaaattaaatttggcatgttaaaatagcaaataaagctctgttatctggcatacttggaactatcgatttctcagatttgtattcctgatgccttggttggtcttctctgtccagtgggtcactgaaggccagtgctcagggcattgacctttccatcaagcatgtgaggtttcacctctgtcacttagtacctgtgtgggcaagtgacttagtctattttttcaatcagttttttcacctataaaatggagaatggtaatattatctatcccttaaagaagacttgaatagggcaaaataaatgtaaagtgcttgtcatacaataaggctaatgaatcattgttatttttcttctctcctaagacctatatatgaacaaaagagagatgtctccagtgttgctttgaccatataggggcaggcgtttacattttggaaggcagtggggtaaaatgtgaagggtattggtcatcctccagaacttggccataggagtgtgtctggtcatatggtcatccttaacaccatgcagtctgttacaacctgaatctgtgtcgtcagcattactgtagatggccatatcttacattgtaacttcacaattcaaaaggggattgattgtgtgtgtgtggtttaaaaagtactgagtaccatgcaaatataaggtgaatcactgctctagcccctcaaagagacaactttaagcaaatcagttacataatccctctaatctattttaaactgaataaatttgagggtatttgcatttgtttggtatcaaaaccctaatttccatagtctgatgattctgtgtacttgcatgagtttgtcagaatgagttacatcagtgattttgaggtgggggcggaggttgatgcatactcataaaacaacgtaatctgtttcaattaactttttacctttccagttaataattttagttggcaaaagacaaaccaaaacagtgttttcagagtactctaatttctttaccattcaaatagggcacctcaggttttccctgaaattttagattcaagtatttgttgtttgtgagtattaattttctaagctgatatgatttttttactagattaattttttattcaaagaaacctactcatatgcctctttctaaaactatttctgactcaagaagtatagggttcatgagttggcagagccatgggggctgtggcttaatacagttgacccttgaacaacatggatttgaactgcacaggttcacttatacacagaggtttttcaataaatatattgaaaatatttttggagatttgtgacaacttgaagaaacttccaaactgcatagcctgggaatattgaaaaaatttaagaaaaagctagatatgtcaagaacgcatatgtatgaaatatatacagatactagtgtattttatcatttactaccatacaatatacacatctattataacatgttaaaatttatcaaaacctcacagaccatatatggcaccactggcagcagagagaaatgtaaacagacaaagacattttaaatcataactgcataaaattaactgtgttatatacagtactgctgtaataatttcatagccaccttctgttgctattgcagtgagctcgatgttacaagtatccgcttaaagcactatatgacactaatttccacctgagcaattaatctctccagtaagttgcatataacagttacaagtgatctctcacagttcttgagtatttttcattgtgtttagtacaataccatagaccttgaataacaccgtaggacccacataaagtgccgctaatgctctcaaaagcaaagttatgacatcatgggaaaaagttgaattgcttgatatgtaccacagattgaggtgtgtagctgcatttgcccaccacgtcaagataagtgaatccagcataacaactattgtttaaaaaaaaaaaaggaaaaggaaatttgagaagccattgctgcagctagacctgcagatgcaaaagccttgcactttttgcaaaataccttttttatcttgcattgaaaatgcagcttttagagtgggtgcaggattgttataaaaaagcatacttattgactccatgattcaagaaaaagcaaagtcattatatgacaacttaaagcaaaatgaaggtgaaggatctaaagttggagaaattaatgacaacaaaagatggtatgttaattgtagaaagaggtttggcttaacaaatttgaagataacaggataaggagcttttgtcaaccactagataccacatgagttcccagacacggttaagaaaatcattgaggagaaagactatacacctgaacaggtttttaatgcagatgtaagtgtcctattctggaaaaaaaatgccacaaaggatttttattagtaagaaagaaaggaggccgggtgcggtggctcatgcctgtaatcccagcactttgggaggccaaggcgggtggatcacaagatcaggagatcgagaccatcctggctaacacggtgaaaccttctctctactaaaaatacaaaacaaaaaaaaattagccaggtgtggtggtgggcacctgtagtcccagctactcgggaggctgaggcaggagaatgacatgaacccgggaagcggagcttgcagtgagtggagatcgcactactgcactccagcctgggctatagagcgagactgtcccaaaaagaaaaaagaagaaagagaaacaaacacccgaatttcagacaggaagggataggctgactgctgttttgtgcgaatgcagtcacgtttatgatcaggactgcccttatctataaagctgcccacccttgagccttggagggaaaagattaacaccagccgccagtcttttggttgtagcacaagaaggcatggataacaagaatgttttctctagactgtttccattgatactttttccctgaagtcaggaagtaacttgccagtaaaagactgacttttaaagttcttttgatgttggataatgcccctggccactgaaaaccccatgtgtttaacatcagagtcgtcaaactagttaacttgtctccaaacacaaagtctctaattcagcttctagatcaggtggtcataaggaccttaaaggattgttacacatggtactttatggaaaggattgtcaaggttgtagaagagaacccagatagagaaaacattatgaaaagctggaaggtttacaccattggagatgtcattgttgatacagaaaaagctgtgaagccatcaggcctgaaacaatgaattcctgctggaaaaaaactgtgtccagatgttgtgcacgacttcacagaatttaccatagagccagtcaagaaaatcatgaaagaaattgtggatatggcaaaaaaaataataaataaaggtaaagggtgagtgagggatttcaatatcagatcttggagaaattcaggagctaatagataccacaccagaggaattaatagagatgacttgatggcgatgcatgtttctgaaccagtgccagacgatgaggaagacatagaagaagcagtgccagaaagcaactgatgttagacagtctggcagaagagttccgattattcaagactacttctgatttttttaatgacatggattcttctatgataaaacagtggaagaatgactagtaccatatagaaacatttttaaagaaatgaaaaaagcaaaaatggcagacagaaattatgatgtatttttgtaaagttacaccaaatgtgcctgcctctccttccaccaccactacctattgagcctctactatgcctgaaacagcaagagcaaccccttctcctcctccttctcaacctactcaacgtgaagacaacagggatgaagactttctgatgattcacttgcacttaatgaataagtaaatatattttctcttcctaatgattatcttagtattttctctggctgagtttattgtaaacatgtagtataaaatacatataacatacagaacatgtgttaatcaacttactggtaaggctgctgggcaacagtaggccgttagtaaagttttgggggagtcaaaagttatacatggatttttgactacatgggagcaggaggggtttggtacctcaacctctgcattattcaagggtcagctgttcttcagggtgctcctccaatatccctgtgcttaggtatggggtcttctttttcatatctgactttaataaaactaaatgattgccatgtttgacatgaatgagttcagtagctgtaataattttctgtgccatcagtcatacgtcctttcacgagcttagcttgttctccttgcctctgaaatgacctttggagtaggtcaaactatttaatttggttagagcgttctgagaatggtatatcctccaatacagtttacaaactataatagaaactgtttgctgtcaggagtttatgagttgcaacaaaaactatttgctgtcctttgttctctagactatcaatatgctatctttaataccatactttctagtatttcagaaatgccttgaccatcaactaaaagttttccttttgataccagacttgactttcctcaaaaaacctaccacgtcaccattttctgagctctagtgccatgtcctgtagtatacatagaacttctcttgagctcctaacaattctctctttctctctctagaactaaataaaaaccgaagaaagctttttgaatcgccaaatgcacgcacctctttcctggaaggtggagcgagtggaaggctaccccgtcagtatcactcagacattgctagtgtcagtggccgctggtagcagcaccctcttggcacatgcccgctgactaactgtaaagtggacacaggagatgtatgaacagccttcacagcacaccatccttagcactctgggtgtctggtatcaggaccaaagcattttattcgcacctgtactttatggcaaaaaggaagaagagagagaagatgttcttatgatgtcatacagaacac

SEQ ID NO: 696 - DNA, 2520 bp, Homo sapiens
gccaagatctaaccactgcactgcagcctgggcaacagagcaagactctgtctcaaaaaaaaaaaaagattaaaaataataattaggagggagaataaacgacatcttggttttttaaaagtcctttttatgccattaaagtgtggcttgtggtttattattacatttgtatgcaaccttggtactgacatttttatcaaaagatattggagagatttcaggaatgaggagttacattccctttatatcttgttgccagaaattactcttaagcaaaataaattctgcctgaaataaaaataaaatgagaacacagcatatgcgtgtttttggctctgtgatctatgcaaatagttatgtattaactcattaattaaaatgggcttattctacacacacatttctaccattggatttttcttcttaaaaaataagcagagcagagtggggaggcggcaagaggacctgtggcaggccctcttcggccatctctctggcctggtttccctcggcgtgccactgtgtgctcagtccagcaccatggggaagcgggacaatcgggtggcctatatgcacccaatagcaatggcgagatcaaggggtccaatccagtcttcagggccaacaatacaggattatctgaattgaccaaggcctacctgggaagaagtaaaagagcaactagaaaagaaaaagaaaggttccaaggctttggctgaatttgaagaaaaaatgaatgagaactggaagaaagaactggaaaaacacagggagaaattgttaactgcaagtgagagctcatccaaaaaaaagacagagaaagaaaaaagaaaagaagaaatctgataggtattcatcttcttcatcaagctctgattcttccagcaattcttctgattctgaagatgaggataagaaacaaggaaaatgaagaaagaaaaagaagaaccgttcacataaatcttctgaaagctccatgtcagaaactgaatcagacagtaaggatagtttaaaaaagaaaaagaagtcaaaagatggaactgagaaagaaaaggatattaaaggactcagcaaaaagagaaagatgtattctgaagataaacctttatcatctgagtccttgtaagaatcagagtatattgaggaggtgcgagcaaaaaagaagaaaagcagtgaagaacgagaaaaagcaacagaaaaaacaaaaaagaataagaagcataagaaacacagtaagaagaaaaggctgttagttcaagtcctgactcaccataacattaagaaaaatcaggattcccttataaagaaagtgcaatgtctgaggaaatttcaactgtgaaaactacaacatatttactaacatgcatgaattttcttgtttttagaattattcctggactattcagtagccactcagatgctactgtgtgaaagggccataaatgttgcctgctgcttgaacatctatttttttctcttccagtgcttgataactctgggagataatacactgcagtcatactagtggttaagatatttgggaataaaattaatacttttgactagaaatgtctaaggataaaccaacagaaattgaatctggatacatctttaagatgtaatcagaaatgaccagatgactctagttaaaatttttgaaggagggattacattaatatttcaaaacccttactctgtaagataagtgtagtttaatttttttcccctcgtatacttttatttacctggggaaggagcttttagggttgggggggtggtttgctatctctttagctagcagaatagtgtgcctttgatcctcacacatcctgtattatgaacacagtagccatacttcacggggaggtcagagctggctaccagcagtcttgccctttactgagcttagtgtcatccttggatgctgtcatatgctgctttgagtgaaccagagaaacagccatttgcagcatgagaaagccccaaaagctctgggatttacctccacttcagtaataatgaatattttttagcattagaatgtgttaggtcatttgaattaatttttactacactttggcttgggagaggaattattttaaatagacactggtacttttcgaacttgatagctaaagattctaaaatgcatgttttatactaagttttaaccagtcaggaaaattttatgtaaccagtgatagtttatttttttgtatgaattttgtttaggctacaatgtttagcttttgttaactcctcactcttgctgtcttaagttcattactatgtttaatggcgtacttgccaagatatttagcatgtaaaaagcagggttttgattaaaaaaaaaaaaaaacagcttcatattgaagctgagacttacaataacaagttgagtggcaagcctggtatgctgtgtcttattgccagaatcttagtaaatgtaatgttttaaaagtttattgtctttgtatattaataacaaagtatgacaagttaagtttaaataagagttaa

SEQ ID NO: 697 - DNA, 884874 bp, Homo sapiens
tccaccgactcctgcccgcctcaacacaatgccttgtgagtagaaatgaaaaaccacctgaatttaaaattatttaggttgagattttgcattgggaataatttcttccagaggaggttgttagtgtgttatagagatgagggatattacatgtccaatatttgattcatttgtgataattctaaatcatgaacagttggcctccacaaaggtactatttctttttgcatttccagggccatagtgatacatataacacttgggaaacgtgaattcgtatagttaacccagtatctgttactctgcatttttacaggtagttaatatactcattttccctctttttatactcaaactccggtagactatttttgcttaagtcaattgagttgtcatgctgtacatgaaaattacagggtcttaatgcatttctcaccattaattgtgctcaattattaataggatcatagatattaaaatgtcactgagaaagggtatgtgtacctatgtttgagtgtaaaacctataaaatgtctcagcatttctatcagccattgtaacctagcagaacacaaggtttttgaaatgagctcagaagcaagggccattcatatatttaaaatattaaatgttaaatgcaaaaacattaaatttactgtgcctttggcagagaatgaatctaagtctacttgcactgcagagtgattgagtgattcacagagaaagtggaagttaatcattactcaggccttctgattacatggtttgattaaaagaagtaactgttttctgtaagcctgctattctgcagttagtcttcccaatcctcttaacataagcagaaattgagggagtcaatctttcagcagattctactagagttccagtagtgtggagtaagaaaagcttctttagttcccgtccttcccattgtctcccttcttccacccccaaagtacttgctgtcaatcttttctttattccctcagtatagttttattttgtgaaattttccacttacatttagtaataacatattttcaaatgtaaatgtttgaatggctttgaagttgaaggtgaaatatacacttaaagaaggtaggctgagaactccattggtttcatttgcagggtgttggaaggcctgatgaccctatgcattcctggatgactttcttggatcactctccaaagtctcttccaactctgaaattcttatattttattctgcttttactattttcacatggttatccagtgccaagatctacatatcccttcaaattacattaaactagctgtttctggttttctttataggataattaagtagctagaactataaaatacagttataaatctgagatctgagttttttataaaatttttcacatacattttaatgctattgacaactttttgtgagacaatattaatacagatatagctttgagtgacgtatctctctgggttttcatgtattgaaacagtttttaacatagtaatggtttatcttgataattctttattatttttacacaaaggagttatttcacaaattacctaacaaatactaatttgtagtttttgtaagcaaaacacagttaaaagtaacagtagtattagaaactgcagctgtgtaacatatacctttgccacattttaaaggcttagtttttgaagtgaagtttgcagtcggtttccatcttactggattgtcaataggaagatatgatttttcagttatgttttaattatctgtaaatgaaatcaccaaagtccagtcttctagacttaatattattattattatttctgaaatataggtatgatcttattaacattggccagtggctccttatagattattacatgccaaagtccacaaccctaatgccactcaatgcttttcacaattcattcttaaacctccttatgtagattaaaacactgtcctcctggccccccttctgaattcactctttagtccattcacaagactcttaattactattttccccaacactacataccattttaggattttgtggtttgcttatgctaatctttcttcattgatccattccctgcccctctaccccaccccaccaaatatacaccaatgataggacagaaaaacattttagttccttgggtggtctttccttcatcatgatgcttccttcctgtacccttactctgagctcccacaacacagtatttatactgggagtagcccacctttcacacttctaatggttggctttctcactgcacagtgaattgccagagatcaaaagacatgcctgatttatcatgtcattcggaaatgatagcttacctttatgtctgaacatagagtctaccataaatgaatagtaaatgtattatttataaatatatttggctatgaagtaacagaaaacttggctaaccgtggattaagcaaataaagctttatttatctcacataataaaaagtcaggagaagagagttgcttaagcattttatcaggcttcttctattatctcgaaacctttcttctcatgggcacaaggtcactgatgtgcctccaaactcgtgtctgtctttggggcccaaaatgggggagaagaagataacagtattctacctcagggtttctcagctttgacactgttgtcattgtgggctggataattatttgtctttgttatgggggagtgtactgtacattatagggatgtgtagcatcatccttggcctctatccaccagatgctggtagtgcaccccacccccacctcatcatgactatccaagtatctccagacattgccaaatgtctctaagaggtcagattgtcccaggctcagaagttttgctctgagatcagaaggaaggaaattctctgtttcctactcttccctacccctgtttttttttgttttgttttgttttttgtttttttccctgcattatggtggtggcgaggatctttttgattttttgcttaataagtggtagaggacacatgataagatttaaaaaacaaataagaagaaggaagaggagggaaagaggccaaacaaggcttctctgagcattgtgtctttttttatggtgtgaacattctccccatagacttccattctcgtatcactgccagactctgtcagctggctacttctaggtaactgagaggttggaagatagatttttagggtgacattttactaccctcaacaaaatcagaatctacaagaaaagaaggggaaatggatttggttttgaaaacttagtgtttgccgtgatggcagagtgaatcaatacataaaattcgtctaaatacttcagaaaggagaaagagtaaacacaaaataaacatccatcaaagagggtcgatataatttttccacatgctaaatgttaataaagtaaccaggataatactgtgatatttttccttttgatgatattttacttagaaaataaatgggcagaatggaaacatatagcgcttcataacatttttctctgcagacgacatcccttctcttccagtctattgaataaagcaatagactttgctattgatacttaccaattatttagtaatcatgtgagagatgtcaaaggaaataaaaatgcagctctattgtttcaatatttctttctaatgcttgtatttagaaagataacacatgctagtgaatgcagtaggtaaaataatggattctggtacagatgtgttagcatggactatagtaactttaagatgggttgcttatctacctaccatctacctaccaataagtactcttggattctatcataggaaataattctgacttacaaagatatattaacattgctatggacgaccaatgatcttgtctgattgattgtaatcttttttcttcctattcttgtttatattttctgtaagttcgttgaatgcaaatttttgctcaactttgtatagaatatagaaatataaaagatggtgtctgttaggaagcttttgcctgcaagtaacagagtacccaattaaaggctttaacaaaaagtacattcattatctcagaaccagattctggaggtgtgctgatccagggttgactaacttaggagttcaaggatgtcatggctctggtacgacttcactgtaaatctcttgagtctttatcttggaaacaagataaacaatatgattatcacagagccaaacatcacctcttctcatagccccactcaaagcagaaatgaaaaagcagtcttcttctcatggatatatctctttatctagaaggaaacttttcacagaagatatcagcaaacttccctttatgcctgaatgactaaaactatgtcacatttcactcttaacttacaactgtcaatgagacaatgcgttgtatgattgtttttgatcatcatggtcggtcccttgagggctggggaagaggtctgttttcctgtggacttggctgcttcacacaaaaaatcagagctctgttaactgggaagaaggaggcaataactatctagggctcctaacagggagttccacaaacaaactatctgtccttctcagatctcttaaaatatggaatgcctatgtgaaaattaaattcatgaaaaaataattacatggcctttgaatccatggaataaatggtgtatatgtctggctgcatgcttctgatgtagaatgcatactttcatgatgttacagagtttttttttaaaatagaaactgaataattggaaaatgtaggaatgtgtactgcgtaaaattacaaatactaaattatactatattacatgtctaaattataaaccttgctttgtcatcgtatacctatctatatgatcatataatgtaaactatagttaaatcagaggatgtccaccttaccaaacagatcacgtatcctcatctatgtttgtcatatgatttcaccatcataattcagagataatatgagaaatgactgaaccctttggccagttactctcataaagaaggacttcatatatgctttgcacaaataaaaattacttctttgtttctgataacggtttatttacttgaggggctcaagggagggatctaattttcagctcacataccagtgagcatctctctcattgaacattatgactcatttttgtaaacaaggaaagctttattttcattcttttgcctgacttcatggaagctcagagccaattttgtgctcaattgaaaaagatgtccttaatcatcttcttttactctgctttattatttggattcatttttaaactttaactttgtttaaatatttgattattctggagtttttttaaatcgtagctgcttcaaattattttttagaacaagaaatgatgtaatgaatacatgcacaaacaaatgagtgccatcgcgcatcactcaatacgtgtcttttttttccctgaatgaatgtatgtttggaaattagacgatactgtgttccgtaaactgctgaatttgtggcatgagaggagcaataggtacaatatggtgcaataggatttcagggaaaagagatagcagttgtgcttgagttatttttatggagatacatattgtagtttgcagacaggtgggaaactaaggcagtgtaggtgagataaattataaataaattgaattcattatatttattttgctgtatgagcagatataaattgtgtctcaactttttttccctccagttttagaattctaataacctcattgcaataactctttcttcagtataaaggatccaaaaccacaatgtaaaggaaacataaactaggaaaagaatggggttgatatctctctctgtttcaaagcaacttttgtgatggatgttggtgatcttcttggcttaccttcagtatgttagaatgtgccttctgagcatctcatcattccattgacaatgctctattttcaggctccatgcctagagctgtttacaccacagcaaccacctctgaactgggctcctcgcctccaggagaattgatttttgaatcaagcttaaaatggtaattagtaactccatctgtgtttagggtcaggaacagatgcttttcctttttgctttaatggaagatatatttgaaggtggaaatatagtgaaatagagtttaaatagatctatattgtggtgggcactcctgtgtcaggtgatgaccatcatggaagtatgtttttgagtatctacctgaaccctcttatctggacacagtacagatgattagaaggtttatttcacaaatccattgtgaattcattatggttcatagcaatgagcctaagctactgcaagttcctgaaacctctgctagggagttaaatgtttaattatatttaatagaccgtattttatcaaaaccaaggagcactgattctagaacactgcattttattcacactgtggaaagaacaccccagtattaattccacaatcgttctctactacttagaatttttactttatatttttataaaggaggatttttagacaaatagatatagatttttaacatatatccatcttttacatgaataaaacatatattagcaagatgcattagcttaagaatttaaaaaaatttatcctattcagaacctcttctgaatcattttttgactcattcatagccatgtttttccacagaaaatagtatgcatgtgttgatgatgcactgtttttgaagggctccgcgattgtctccagaatttaattccaagcagctgataccttctgaatgatttgatcctggtgtgttgttgattttactagaatgtgacaatggaatgttttcagacaacaaccagaactcatttgccttccttaaattgtcctgaactgtcaggagtggtggttgtctggtcatgctaagaagaataagaagaataccaacaattttcacatatatagtctatggctactatgcctccactactgcttggccataagaaattataaaatgcaccttgatttcagatatgttaaaggtgtcagagtcaatgaaatatggcaactttaattatacatgatcctcgttttttaaacaaactaataccatagcgataactaattaaccaaactaataatctccaaatagataagagaaactattgcataattcttagaaagtatgattaaaatataatcctatctctttttttctctatttgccctccaattatgtaatatataaaatatagctagtcttaagaaaagaaataatagtaggatgaaaacaaatgaagagaactagaccaggaacgaagagaccgatgtctggggagcagactcttctagtaactctctgtgtcatttctagtgatcccttcactctaggctttggttttcgtttttcaaatgtatgtttaggctaattaaaattaaacatgtttcctggctctaaaatctgttttgggtaaagataatcagaaataaagtctgtaataatatattacacatttaagttagtatgatataaatacataatagtggagggatgtactgtaagctggtaagcttaaaatatataacatgtatcatataactttaagatttattgtatcatatatagctttaatattttacatgttttgggagacttgtccatacatatcttacttgttctttaaaataactgttaagcaatgcagaagattcaacagaacaaaagtaggatttaggaactcttatcctcaaatatactggatgagaaagattactaaataaatcacagccaaatagtggatgtaaaagtgggaggaggcaagaagaaaatgcattttccaccaagaacaaagaaaacttatgcaaggaattaactatcactatatatataaatgttcttctttaaaagaattatcagtaagaagcaagagaaaattgacaggtaaaaatgaagtttcccttttttattttatcattactgaaccatattttatgattcagtataaattggcgatgtactattttattttatatgtatatttatatacgaatatatctatgaatcaaatatatatatgaatcacatatatatgaatagatatatatatcaatatatatgaatatatattcatatatattgaattcatatatatgtattcatatatatatataaatcaaaggaagagaagcctatagttggaccagtcagatgctactatttgtggatacatcttgaccgttcttaccgtgcatttccacagacaacagcgtttcttccctgtattgtatttgaaaattgccactgctcttaagtggtcagaaagctgggcacttactttttgatgaataacaagttctccagaggtgtgccactctcctttctttcgttgtagctgtagtcaccacagagaaaacactgtgttgcttctcacctacctgctttgcttaaaaagtgagttgatttatggagcatgaagaaaatccttcttttttattttggctagatattcttgaagttctctcataatacaattaagatatcaaaaacatgatacagtattactgaagtaagtaggtttctataaaattattaattaaattattttaatcctctagttgtgtcactttgtccttaagaaaaatattcaagatactaggtttcaagatggagagtactatttaatggcttagagtctcagatcattaaatagagttcagagattatattcatattgtaatcacatctttatgactaaatgcgtagaatcacattttttgacctaaggtggtttgtaaaacatattgtacaaaggaatcatttatttctaaaaactttaataaattttcaatggtctttccagctgaaaagctgaaagggccatggtgggttttagataacataggctcacttccttagtttacatgtgacaaaactgaagtccagaggaaaaaaatgatttgcttgtttatgcaatggtagagctggaacctgatcttcacataatgccttcatgcattagttttatttaaagagcagtaatacatacatcggcaccatatattctgtatataagttaccatgattacataattactagaattttagaagtataggtaataatcaccagaactgataaaaaaggggagtcatatttttagcaaagttagtggaggaggtattatttaaaggagattaggatatgaataaatagagaagagggagcaagcattgcttgcataaaagcaataaaaatcaagactaagacaggcagcaggggcagttggccattctagattctttcaaaagtaaacacacacatacaacacattgagaaatatcattgtagaaagcaaagaaaaatgcttattgaaatcatacatcttatttagcattcagtattttggtttagggcctctgcagattagaaataacaattatacatttattttgaataaatagtcctcagaaaaattggttcatattactcatatcagaaagagtttgcgtccactaaaaataaattatttaaaatggaatgtatgattttctgagaatgtctgtttgtgacactggttgatacaaaatcaagctgagattatttgattgcctgtcatcaaatgagaagattcttcttatcatttttgttttttttgagacagagtctcgctctgttgcccaggctggagtgcagtggcacaatcctgcctacatatggttctctagcccaagcactctttccataagaaatactagaaacgttctgcctcacacaatatgtcttcttttccatgctccttttcaacatggtactccaagcagtccctccagatttgatgattgcaagacagaatgcctatttgcttaagggagagagaatctagttggtgccaatctgtcttttaatgctcattggtcatactcaccatcacttaaaaatttttaacatttttaaggtctgaggggcaatttcaagagagatgtattcttccgtttctactaaattctatgtaaaatcaacacatccctcctgactctccttgaagtcactctccataaaaacagcagctcattctgggagccagtggctagaataaccagcacctggagattagggagggaatctttcagaagagcataagcatgttttctatagaactgcgtaaacatggcctctataacttctcaagaataggcgcattggccgggcgcagtggctcacgcctgtaatcccagcactttgggaggccgaggcgggcggatcacagggtcaggagatcgagaccttcctggctaatacggtgaaaccccgtctctactaaaaatacaaaaaattagctgggcgtggtggcgggtgcctgtaattccagctacttgggaggctgaggcaggagaatggtgtgaacccgggaggctgaggttgcagtgagccgagattgtgccactgcactccagcctgggcaacagagcgagactctgtctcaaaaaaaaaaaaaaaagaataggtgcattacaactctgccagttgtaactcaaaatacgctgggaatagtcctggtatgctattttgaatgtcatttcttcacgagccttctctagaacccctaggaagcctgagatctcacagaacagcctctcgtgggacactctaccatagaaatctgagaaaaacaagagtatgggtggtgctgctataggggagaacgaaggtataatcactggaaatggaataatttgttagagtgttagaaagagtataaagagccatctttaacattgcaatatcttttatttatcctgctacactcaggtttgcaaaactgccatatgtatacatatatatcaatatgtaaatgtgtatctatctacctctgtttatctttattaattgaaaattatagttgaatgattgatatgagaaagcctgagaagaaacaatcacttttcttggaaaaaactgttcatattccatatgtactgtagacgggaatgtggaaaaacactagaaaacgtgtcactggcccctagaaaacgtgtcactggcccccaggaaaataaatctagcattcatctatcagtccatatatttttttgcttatcttcatgaatattatttctttcccccatttccaactcctgatttcctgtctcctgatccctgtatccagtcaacaatgtctcttacacacgtctcttacatggcatcctttctgtacctaaatccagaacccaaattcaggattttccattgtgcttttgaaatgttgcaaaagccttctaaatgcaaatatcagcaaccaacactctaatatgaataagtttgtctgactatttccctccgccatgtgatacttggctaaaaagaatgaaacataaaaaagacaagtattgatggggaaggccaggaagatcagtttaaaccaagatcattgctagtgagaacaagcctaggttaatgccaggtgcttactagaaggatgttttagggacctgtaggggggccaagaggcaatctctggagagggtgggagattgaggaatttgggtctgggaaaggggtgacacaaatgagcaagataagggggaaaacaaccaaacttgttctgcataattctttagcttaataggtggtactgctgctaagttagtactaaaattcatgattctgtgtggacttcacctctctttgatttagtttttctgtctgtaaaaaatacactgagagtagtcctgctagtctattttgagtgtcattccttcaccaggctattctaaaactctaaaaagtatagggccgttatgggaataaacaaaataacatagcacttttgcctggcacataaaaatgttcagaagtgtttgcattatcatgagaaccctccatacataaacacggacacactgtgctcacctactaatagccatttatcacgtatttcctaagcactgggtgggacatggtgctaggcacaatggagaaggcaaagatgagtcaaacgctacctcaattgtgacagtccttctttattcacctggagtttttgaagttaagatatggtgttctacatccatgtttttgttaatgcaggggagattgggctgcttttatttcactagcacatggaaggagggataaagcatttagaaatggtgaaattggcagctttagaaaattcaagaactctatcagcattagaatgtgaaaacatttgagtcataggcttgctaggggtgagtatttaataggtgcctttgtaaaatctccaaactaggctgtatcattttctatacatgtttaaatctcttaattacaaagcaactttaattatacataaagtatgccacttcaatcatgttttaatcacacataaaaaaattaaatttatcccaaagttattttctgcatttcaattctgatttttaaactctggcatattctgtaccaaaaaattgcattaagctaatgtttatgcttgcacataatcccacactttcaaggcaacacttaaaatattcagaagagcttcacaagagggagtagtttaattctgttgttgactcagagccattgttcttcacagttacagctccgctggcataggctacatatggtcacttgttttctcagtgtacagagtgataatgcattaacattctggctggtggtggaggctgtgctgtgctttagagaaatatagcagggaagatgtgctgcctctttggcagaaaagagggcaagatcagcatgagagagcctgcagattgctataaactaatcattgggactgtacactgtggtggctgacctagaagtcagatcattcccttacggagtctaaatttcaaacattgtctgtctgtgagtaggacttacattgaaagagtggtcatcagagagaactatggaccacagccacagaaggaagttttgccagcttccttcaccactgccattcagaggtgctgttctggagccctcggttgccacttggaagagactttttatgatcccacttttgctctaatcatggctatgtaggccccaggtcaagtggagtgctgggctggtgactgatggccctgtcaaggtccattagaagtagtacttaagtactttcttaggtcattagtattaggcaacaagaatgggggattttggctggggtttagtaaacatgacttttcttaaagcttttgcaatttccttttgtgtatatgaagtgaggaaaaaaggccacggaagatattaagcatctattcctaccccgccctccaaaccccctcatctcttatctaatattattccatgtgggattgtgtgccaagagacatttccagttatgagggcttctacctactttttcctgcttctctgggttacatctgtggttgcgaatagaaaaattaatactagtggcagcaccagagggagccacttacacacttttgtttcaagcagtgacgaagctgacagtaagacttaaaatgcagaaatattaaggtttaattgtattttctgaaagagaatggcagaaaagtagatgatatgtaaaatctgttagcagcaattccaaattatgggactagtagcaaccactttctctctctcacttgaaatatttgtgaatggtaattgcctggctgcaatccagaaagtaaatcatatttcaaaatgtaaaattgtgtttggagcaagaagtattctctctgatcctggaattgtccctctgcagaatactattagcaagtttgcatgtttgaaacctataccagtttactgtttttgtaatgttaatgatgctaccaaaaataaagaatgaggaattaagactaaaacttttcagatgcacatgccagtgctcaatgcattctctctcactctgacacacacacacacacacacacacacacacacagtgtgcacacatatttgcacaggtgattttgctgtagagcattagaaccaggattttgtaaggacatcaggtaagcttgctcttgagtactatgatagggttgagagaattaaaatcctgaaaggaaaatagaatgtatttatctttattagcacactgaccttttttttttaatgaggaaatagtcaaatgcataaagttctgagtgaaactctatcttaattaccacactaacaaaatatttcaggaaaatatattgattccaacttcttggagggaaggtttccagcccttctcttgttttgtcttggctgattctaaaccaaattataaaaacactggaaaggaagaattgctatagttcttctttgaacaaccacaaaaaaagccgtattcttagtactgctcagccttcctccaccccactttgacagcatcaggcatatccaataacatactttcacaagaagggattctatgaaattagatgatctcctttggctctgtaatggtacttttttggcctgattgtgataaggcctgcagtgcataatgctgacaacaaatgctttcttaggtcgctttccacgtaacagtaattctcttcaagaaagtaattgattaactggggtttgtgctacagatggaaaggagggaataagaaagattgcttgtgcttgactccctggcgatatttatccttcttttctttttaagagtctttccttctctttctgccttgcccaccctagccaacatgcttccctcgcagactgcccattcctaatccatttttgggggaagcgatggactaaggaagtcggggatgcaatgtgactgtgatctagtgtccttctgcctgcagaacttttaagaacacaaatttgcctctgagacaaggaagttcatatattttttgttttatctatccatccatctacctattttattttaattttaaaaatgagacttctcggccgggtgctgtggctcatgcctgtaaccccagcactttgggaggctgaggtgggcggatcacaaggtcaggagttcaagaccagcctgaccgatacgatgaaaccccatctctactaaaaatacaaaaataagctgggcgtggtggcatgcacctgtagtcccagctacttgggaggctgaggcagaagaatcgcttgaacccaggaggcagaggttgcagtgagctgacatcatgccactgtactccagcctgggtgacagagcaagactccatctcaaaaataaaattaaaattaaataaataaaaacttcttagtctagaaagagggaccattactgaggaagagatctacagcaattttgttaacttccaaaactctggaagacattggttatcacttccttcaggagccttgaccccagatgtctagagaagttcagggccagagcagcaggtcaaatgggaagccctggagctaaacataccaggtgattctggctaccctatgggcaaaaggtttcaagaaccttcttctccctggaaaaagaacaagaaaggaagcagcagtggttgtggtacaacaggtgactagtgaaggtagaagagatgatgtgagctttgtatgtacagagaaggtgtccccagcacgcggttccacactgtagtgaatatcatgagtccactgtgcacacagaagatcctgggttcgggaaggtaccccaaagtgcctccaaagcatcttcatacttacattgtattaggatgtgaacatatgggaacaggagtgggggcctggaagggagaggggcatgtctggtaccgaaaaagatcatcctcacatcttgttatttcaagctatgtctgcaagcaaactggtagctgtgttgctgacttaacagaaacagagaggatgcttgaatactgatttgagtgtgataaaggagatatgttatatagtactcttcttggtagtatacaaaaagatgggaaagggcagggagcagagtgagtagagggcatgtctcctgcttaggaatgattaaatggctatctttgaattggactggagaagaaggaatcctcaggacgctaggaaaccaatggacttaagtaaggggtcagtgtggtcctttctttgtaatctgagaattaccgctatgctttgtttagcaaaaggtacatagaggcttcagtttgccacctcagaaccttagttaagagactagaactacattatatgatatgcaacatctccatgtgaaaaaaaaaaaagcaccaaaaacttcttagtctagaaagagggaccattactgaggaagggatctacagcaatgtgtccatttgtgtttaatagtaaaacccttgaaaagaaaaggacctgaacattaatgtctttggggagagaaagggaggatgatttaaggagcaacatctcactttggaaatcagatttggaggagcaggaccacgaaaggtgaagtgggtggttttgagaaggcccaagagggtgtgcagcctagaatgacagacaataggaatcagataagaaagcatcctgagacagagcagggaagaggccctaagatgtccacatatgaataacgtcatcagagaagtccacctgaaatccctaaacaaataaattgaaacaagagcccacaataagatgcagatggagacaagagggctatcaaggaggcaactgccaagtgagccaaacttctccttggtctttgattcttcatcaagcaaagtcagaacatttgcagtgttttgaaaaccgcatttgtttttcaagctaattgttattaaagggtgatttcaaatagttagatttaacattattccaaataattgtagtaactcagttgtatgtggttaaattctggacctttgagcaaggctttcggcaaaaacctcctttgtcaagtgcaaaataggcaaatttacagctcctattatatagggattgctatttaaatctgagatggcaggaagtaggaggggggataatttaaagcaactgacaggcattatgtctttctctgatccttattttttaagttctcaacaagcggtttagcggtatgaagacaaatctctcccggaaaaagtagaatggaaagaagcttgatgctatgcatagtacactgggattgaagttggatgatgtagatataagttgacataggtaagttttgactttgccgtatgctaatgattgctgaaggcagtgcaacctggctttcagtgtttttccctataaaataagaaagacaacatattcttgcctgtttcgtagagtagtattaaaggaccaataggtcaaagtctgaaaaggcattttatatactattaaactctatatgaatataggataccattgagtatagcagagaaaaaggtaatatattgtagtagagtcagaaattggatggattcagggtataggccttaaaatcagaggagcctctgccattaagttatttagtctctctatgcttcagtttccctattgataaagggagataaggagaactctacctgtggaacattgcaaggagtaaatatatatatatatagagagagagagagggagagagagagagagagagagagagcttggtatagagcctaacacacaataagagtgcatacataaaatgaatattagctattaccaggtgtgattattggttgacaccactgagtttatttatcttggaaatgatagattcatgagcgtcacagataaggaccttgaagctcaagcactttgtttctatataacacttacatcacttacattatacttgttgacatatagatggtatttaagccatgagattagattacaccaccaaaggagtgagcatagatgctcaatatatgcattccattgcccagacttctaaactgaataacctcatgcaagctccttatccctctaagcctcatttcttcatttgcaaaatagagataatatcttcctcatagaatgagagggtttaatgagatagtatatgcagaatatgcagcacctcattggaatgatttcattctgttcttttggtgataactcagctttcagaaatggccctgaagggccaaaggaaaaacaggcaaccaggagcagcgtcttcccatgaatttcactgtgtgagttgttttccctaactcatatttcttttgctttctattttctaaaagactccgtgtttcagttagttcagaaaatattgctttgatcacaaagctgacccctactacatgtaatcctgaggctttttctggtaaaagacatgcaaaaatatacctacaaaacaatgtgttaatttcttacttagatatcattccaaagcatgtgagcatcaagattcgaaagaagaggtgggagacatatagttgcaaataatatttgtattctttagaatttgatatgattaaatggatactgatatggcccaagcacaaagatttcatcactttaatatatatagttaaagtgagtctaatgtattttgagagacatataaagaaacccaagtatttattctgagatcttctacaaataatgtttttgaaagttcatataaaataaatctttatgataccatgatcaaactgtaatattcatctgtctgtatgaattcaactcttatgttcaataatggaaatatgtgctcttgcaattataaaattgaaacctcttgagagtacaaactggtaaacctggaaatccattacttggaattaataatgcatgttatttttttcatagaaaatgatctaccttttttgtattagatattacatttgacatattcttccatgtctcaaggtaatatctatggtgtcgcaaattacatttgtaattagttattcatgccattaaacttaaatatactatagaagttcaagagagttcgtagaagtagaaatgaattaaacataaattttctgattatcttttttaaatggtctttttcaattttaagactatagaattaagtaattttaaaagctcactgattaaaactatttttaaaatgtcttggtatgtgatacttgaacttaattctctaaataatctatttacaaaaaatagtgattttctattttgcttaattatctgaatcatataagcatttttactttaatggaaacaataattttctttataaaattagcaattcatattttgctatcattatgtggatttaaacactcttagaaaatatgtatcagacactaataggaattattttgagttgcttaattatcatacaccacacagaaatgcaataattcaataacattgcttgcaacaataacttgcaatttcaaagataatgatgtttgggtctctatcagttatacaattattttgtaacttataaatagttcttgtacatgtaacttgtgtaacagatattgtaatacaaaacataaagggaatgaatgcacaatatgaaatattaaattaactatgttttttaggtgtttcttcttaaactaaacttttatgtaaactttctgcctccctattcttctcagactaagttttactcataaaattttgtggcttttattacttttattaaacaaatactcatcttaataatgagaaaaaaaacaattgagcagataggaagaaaaaaacagaattctgtcatcacaaggtagctccttttattcatccattctctttctttttatttgtttatgtgtgtgtgcatattatttgaaagtatatatacataaataaaatataataagtatatataacaaagatggtattttaatgctctgtcatacatttctttcacatattaatatgtgaaatattagaaggcataattataatataattggaagatgtaattattataattttaagatataattagtatacaatgtaatattattgtatactataatttaacaatttattgcttgaatttttttttgctttcatttcttttttctgttaactatgaactgcatatttcaatgcacagtttgattattttcttaggataaattattgatcatgaattcttgggtttaaagatatgcacactttaaattatttcaatgtatattcctaaggtgccttccataaaggtcatagcccagtgaaatgtctcaggcagaagttcgttgtgccctgtgcaatacagatattacattctttttgatattttccaatccaataggtatgatctttcttctcattgtataaattggcaagtctttgatagctaatgatataaaactataaaaatatgtatttgccaaatgattttcatctttgagatttcatctaatttttctaatctactgtccatttattctgtttatgtaaacacagctatagatctttgttactgtttctttctttaacatcaagcttagattctgagaagccaaattatgtacatattaacccatatgttctttagatagctttatgtcttgagtttttacaattacatgtttttcatccaaaatgtgttttgttattaagtatgatataaggatctaaaccaaacttgtccaactcacaggccctgggccacatggggtccaggatggctttgaatgtggcccatcacaaatttgtaaacttccttaaaatatgatgattttttttttttgcagtttcctttctgttctttagctttcttcttcttcttttttttttttttttttttttttttttttttttgctcatcagccatcattagtgttagtatatgtctatatctatctatctatctatatatatcgattttttttttttggcagttaaagacaggtttactttcgataaaacctgagaagggcttctggctgatttcaatcaggagcgctttctcttacagacaaagtacatgagtatacattggttttagggtgagggggcttatcacaagcttggaatgtgtatgtgtaggggagaagtttatggtgaggttggaatgtctctgggtgaaggggggattatcttggggctgacatctttccagcaggaagggggttatctcggggctggcatcttcccagctggaggggggcagctagcatgtctctggttgcagaggaatttggaatgtttctggtcggagatttttttttgtttatgatcatgctgatcttagccatttaggctgatgccctttggatttaggcagtttttgattaatgtgaattggaaaataacagtgcttgtgcaagatggtgatactcctgctctgtcatatttcagcctctcaaagctcagggattataggcatgagccactgtgcctggctctgttgtctgattcaaagtctgttttatctgatataatagtgacccctggttgggcgtggtggctcatgcctgtaatcccagcactttgggaggccaaggtgggtggatcaagaggtcaagagatcaagaccatcctggccaacatggtgaaaccccatctctatctggtaaaaatacaaaaattagctgggcgtggtagtgtgtgcctgtagtcccagctactcagcaggctgaggcaggagaattgcttgaacccaggaggcagaagttgcagtaagccgagatcgcaccattgcactccagcctggcgacacagagagactcagtctcaaaaataaaataaaataaaataaaataaagtaaaataaaataatagtgacccctgaccttttttgttttccatttgcttgatagatcttttttcttttttttttcattattattattattatactttaagttttagggtacatgtgcacaacgtgcaggtttgttacatatgtatacatgtgccatgttggtgtgctgcacccattaacttgtcatttagcattaagtatatctcctaatgctgtccctccccactcctcccaccccacaacagtccccggtgtgtgatgttccccttcctgtgtccatgtgttctcattgttcaattcccgcctatgagtgagaacatgcggtgtttggtttttttgtccttgcgatagtttgctgagaatgatggtttccagcttcatccatgtccctacaaaggacatgaactcatcattttttatggctgcaaagtattccatggtgtatatgtgccacattttcttaatccagtctatcattgttggacatttgggttggttccaagtctatgctattgtgaatagtgccgcaataaacatacgtgtgcatgtgtctttatagcagcatgattttataatcctctgggtatatacccagtaatgggatgactgggtcaaatggtatttctagttctagatccctgaggaattgccacaccgacttccacaatggttgaactagtttacagtcccaccaacagtgtagtgttactatattttatgtgtggcccaagacaattcttcttcttccggtgtggcccagggaagccaaaagattgtaccctaaaaatgatagtattgaagagcctatctttccacactaatttgatatgtgtactttttcatgtacaaaatttttacacatagttgaatcttctggactttctattcattgccattgctctgcttattgggtgaaaatgctacattgttttaatttattgtatatttctaatacttttctaatatcaggtagtacaagccctgtgcattaattactcttcttttttcagatattttcttactattctgtctactgtgtttcttctaagtgtattgtaaaatattcatcaagttaaaaataataatacaattgttataaattagtaaggaaatgttaaataacctcacactcttgattttcagaatcaggactctagtctatttctcaaattttttaaaaatcatttttattatatactttttattttgaaataatcttaaatgcctagaaaagttatttatttggatgtagtcttaaaattagaatttgcaagagtacaagtgtctatttttaaagccatttaaaagtaagttgcccatctttccttcaaatacgttagtgtacattttttacaaataaggatattctccttcctaattacaattgccatcaaaattaggaattaacattggtatgttatcccatctaatccttagacccttttcagtttttctcaggtattccaacaaagtccattatagaaaaaggatcaattttataataataattatttttattattatttgagacagggtctctgtcacgcaggctggagtgcagtggtgcaatctcagctctttgcaacctctgcctcctgggctcaagcagttcttctgcctcagtctgggactacagactgaggcagaagactgggattacaggtgtgcaccatcatgccgggataaattttgtattttttgtagagacagggttttggcgtgttgcctcaggctggtcttaaactcctgggctcaagtgatcctcccgcctcagcctcctaaagtgctaggattatagacatgagctaccacacctggcccagtttagaattatgttttgtttttagttgctatgtctcgttaggcttcttcagtctgatatagtgtcttagtcattctttgattttatacctcaacactttttaattgatacataacgattttacatattaataggatacccataatattttgatacatatatacaatgtttaatgatcaaatcagaataatttggttatccatcaaatgcagacatttattatctcaaacaaataaactcaaacacttatcatgatatatatatgtgtgtatatatatgtgatatatatgtgtgtatgtgtactatatatagtacactatatatacacacacacacacacatacacacaatggaatactattcagctataaaaagaaggaattcttgtcatatgcagcaacatgaatgaacttggaagacattatgctaattgaaataagccaggcacagaaagacaaatatcacatgtacttactcatacgtgagagctaaaaagtttatctcaaggaggtagagagtagaatggcggttaccggaggctgtgaaaataaaaatactatatgatctagcaatcctgactccataccttagctgctatgaatagcactacaataaacatagaaatataaatatcacttcgatttgatttccttttggatatacccagcagtaagattgccaggtcatatggtatttttatttttgtttttttgaggaactattatactgtttttctataatggctgtactaatttacattcccataatcagtttacaaaccttcctctttctccttgccagcatctgttatttttttgtctttttgatcatagccattttaactgggatgaaattatatctcattgcagttttgatttgtatttctctgatgattagtaatgttgaacactttttatatacttgtttgacatttgtatgtcttctttttagaaatatctatctagaccatttgtctgtttttacatcagatttaatttttgctgttgagttgaggttgttatagatgcaagttattgattccttgtcagatggataaactgcaagtattttttctgtattagtccattctcacactgctataaagatactatctgagactacgtaatttataaaggaattctttcctgactttattgtcagtcctttaactgactcacaattctgcatggctggggaggcctcaggaaacttacaatcatggtagagggcgaaggagaagcaaggagcttctccacaaggcagcaggagagagagagagagattgaggaagtgccacactttaaaccatcagatctcacgagaactctctcactatcacaagaacagcatgtgggaaactgcccctgtgatctaatcacctcccagcaggcccttccctcaatacattgggattacaatttgagattagatttaggtggagacacagagccaaaccatatcattctgcccttggctcctcccaaatcccatgtccttttcacatttcaaaatcaataatgccttcctaacagtcccccaaagacttaactcattccggcattaactcaaaagtccaagtccaaagccttatctgagacaaggcaagtccctcctgcctatgagcctgtcaaatcaaaagcaagttagttacctccaagatacaatggaggtgtgggctttggataaatgttcccattccaaattgggaaaaattgaccaaaaaaaaaggggacataggccccttgaaagtccaaaatccagcagggtaaccattaaatcttgaagctccaaaatctcttttggctccatgtctcacatccagggcacactaatgcaagcagtgggctcccacagccttggtcagccctgttcctgtgactgcagggtacaacccctgtggctgctttcacaagctggtgttgagtgactgcagcttttccaggtggataatgcaagctgttggcagatctccctttctggggtctagagggtggtggccctcttctcacagctccactaggcagtgccccagtggagactgtgttgggactccagccccacatttcccttccgcacttccgtagcagaggttctccacgaggactccactgcagcagacttctccctggacatcgaggcatttttatacatcctctgaaatctaggcagaggctcctgaagctcagctcttgtcttgtgtgcacccacaagctgaacaccatgtggaagctgaacaccatgtggaagccaccaagcttggggctcacatcctctgaagcaattgcctcagctgtaaccttggccccttttagccacagctggagctggagcagctggaatgcagggcactaagttctgaagctgcacggatccactgggccctgggcccggcctgtgaagccatttttccctcctaggcctctgggtctgtcatgggaggggctgctctgaaggtctctgacatgccctggggacattttccccattgtctttgctaataacattcagctcctccttacttgagcaaatttctgcagtcagcttggctcaaattccttcccaggaaatgggtttttcttttctaccacatggtcaggctgcaaattttccaaacctttatactctgcttcccttttaaactaagttctaatttcaaaccatctctttgtgatcatatataactgaaagctttcagaataattcacgttctctcttgaacactgctgcttagaaatttcttccagcagataccctaaatcatctctttcaagtttaaagttccacagatgtctagggcaggggcaaaataccgccagtctctttgctaaagcatagcatgagtgacctttactccagttcccaaaaagttccttatctccttctgagaccacctcagcctagacttcatttttcatatcgctatcagcattttagtcaaaactattcaacaagtctctaggaagttccagactttcccatatcctcctgccttctgctgagccctacaaacggttccaacctctgcctgttacccagttccaaaatcacttccacatttcaggttatctttgtggcagtactccactttgccaataccaattctctgtattagtccattctcacacttctataaagatactacctgagactgggtaacttataaaagaaagaggcttaattgactcacagttccatacagctggggggcctcaggaaacttacaattgtggtggaaggtgaaggagaagcaagtaccttcttcagaaggtggcaggagagagagagagaagagcgaggaagtgccacacttaaaaccatcagatcttgtgagaactcctttactatcatgagaacagcaaggggaaactgttcccatgatctaatcgcctaccagcaggtccctccttcagcatgtggggattacaattcacgatgagatttgggtggagacacagagccaaaccacatcagtttaccattctgtagatgacctcttcactctattggtttttttctttgctatgcagaggcttttttttttataaaatctttatagaatctcatttgtcacctgtgttacccaaaaaaatcattgtccagattaatgtcctaaaatgttttcccagtgttttttctaatagattcatagtttcaggtcttacatttaagtctttaattcattttgagtgatttctgtatatggtgagagacaaggttctatttccattcttctgcatatggatatccagttttaccaggattatctattgaagagactgtccgtttatgttcttggtgtcttggttgaaaatgagttggctgtaaatgcatagacttatttctgagttctctgtgctattccattagtttttgtgtttttatgccaatatcatgctgttttagttactatagccttgtagtatactttgaagtcaggtattataatgcctctagctttgttctttttgctcaggactactttgactatttggggttctttgtagttccatgcaaattttaagaaatttttttctaaatctgtgaaaaatatcattgttattttgataggaattgcattgacattgtagatcactttgggtagtatggacattttaacaatattatttttctccaggaacatgatatgtcttttaattttttgtgtgtcatttttaatttcattcttcagtattttatagtttttatggcagagctgtctcacctctttggtgaaatttattcctaggtattttatttttttgtaactattataaatggaattaccttcttgatttcttacagattgttcactgttggaatatagaaatactactgtttgtttgtgtcatgatttagtattatattttgcaacttcattgaattagtttgttagttctaacaggtttttggtggactctaggtttttctaagtataagattatgtcatctgcaaacaaggacaatttgacttcttcctttttcatttgcatgccttttttttcctttctgttacctaattgctctagctaagacttctgctatgatgttgaataaaagtgatgaaactaggtatctttttcgttttccaaatttgacaataaagtttttcaaattttccccattcagcatgatgttagctatgggtttgtcatatacagcctttaatgttttggggtatgtttttttctatatttgttgagagtttttattatgaacagatgctacattttatcaaatgctttttctgcattcattgaaataataggtttttgtccttcagtctgttcatgtgctatagcacatttatttatttatttatttattgaaccattcttgcatccctgggataaatcttgcttgatcatgatgaataatctttttgatatgctgttggattcagtttgctaaaattttgttgaggatttctgcatctgtgttcatcagggatattggcttccaatttgcctttttgttgtgcccttgtctggttttggtttcagggtaatgttgaactcatagaatgagtttgaaagagttctttcctcttcaaattttttggattagtttgaggaaaatcagtattatattttctttaaaagtttggtaaaacttagcaatgaaattatctggttacggactttctttgtggagatttttaaaattactgattcaacctcattacttaatgggctgtccagtttttctatttcctcatgattcaatcttgtaagattgtatgcttctaagaatttattcatgtcttctaaattttctaatttgttggtgtatggttcttcacaataatctccaataatcctttatatttctgtggtatcagttgtaatgtttcatttttcatctctgatattacttgggtctttgtttttcttaattagtcacactaaggtttatccattttgtttatcttctcaaacagctttctattttgttgattatttttctattttctttttcatctcaatttcatttacttttgctctgattgttagtatttttccttctatgaattttcagtttggattgttcatgcttttctatttcctttagatgcatagttaggttgagttttagaagtcttttttctttttcaatgtaagcatttattgctgtaaacttttttcttagtactacttttgctatactgcataggttttggtatgtagtgtttccattttcatttgtttcaaggaatttcaaaattttctttgcaatgtgttcattgacccattggtttttcaaggccatgttgtttaattttcatgtatctgtgcaatttccaaggtctccttttgttattaatttctagttttattccattgtggtcagaaaagatacttgatatgatttctactcttttgaatttgttcagacttgctttgtggcctaagatatggtctatcctggagaagttcaataggctgatgaaaataatatgtattcttcagtagtttgttgaaatattctgtaaatatcagttaagtctttttggtctggaaactctatttttttttttttttggttgagtttctgtctggaggacttgttcattgcttaaagaggggcactaatgtctcctattattactgtgttacagtctgtctctttctttatatttattaatatttgctttatatatttttgtgatccagtgttggagtacatatgtatttataattgctatatgctcctgttatattgacccacttattattatataatgaccttctttgtctcttgatagttttggacttgaagtctattttatctgatataagtttagctactgcttttttatggtttccatttgtatggaatcttttttttctccttcacttttagtctatgtttatctttataggtgaagtgagtttcctgtaggcagcatatgattgggtcttgttctttcagttgcataatttagtttattacattcagtgttattattgataggtgaggacttactactaccattttgtttctgattttctggttgtattgtaagttctccctttttttcttttctactgtctttttttggctaagtgtttttttctggtagtatgttttatttaatttcttactttttatttttaacatatctgtatttttgatttatgattaccataaggcttacaaaatattttatggatataacaacttaaactgatggcaacttaactttgactcaaataaaagaaaaaaatgattcaatttccccacattttgaccttttttgtctcaatttttatctttatatattcctatctcttaagaaattatgtaattatttttgataaatttgtcttttagtcctcatactaaaggtataagtggttgatacatcacaagtttagagtattctgcatttgtatttgttcttgccttttccattgttttatactttcagatgttttcattttgcacattaacattctttttttttcatattgaataactccctttagcatttcttataagctcagtctggtggtgatgaatttccttagcttttgtgtgtctggaaatgtctttaattagagctcctttatatgttgtttcttttgttttgctgcttttacaatcctctttttgtgtttggcctttgaaaatttgattattatatgctttggagtagtcttatttgggttgaatcaggttagtgatctttgaccttttagtatctggataatctttctctaagtttgcaatattttctcttactattttttaaataagttttctacaccttgctatttctcaactccctcctggcggtcgacggctattagatttgctctgttgaggctatcctctagatcttatagacattcttttttctttttcattctttttttctgtcctctgactgtgtattttcaaacagcctgtcttcatactctctgattcttttgtttaatcagttttgctggcaataacctctaatgtatttttctatctagccgttgtatttctcagctccaggatttctgtttatcttttattattttattctttttgttaaatttatctgaataaatttctgcaccgatttactgtgttatcttggagttcactgagtttcctcaaaactactgttttgaatagttgatctgagaggtaaaaaatcaccatattcttagggtcagacattggcttcttttttgtcttttcgtggaggtcatggctacctgtttgcttttgtttcttatggatgtatgtctatgtctttgctttcaaggtttagttatttatttcagtctttgctgtctgccttggtttggtctttctagagtatgtatgactagaagtcctgtgccagttgatttttgagtaccctcagcccaagaacactgcctccttttctgcactagatgacacccttgctcagatttgccacagttcctgcaaataacttgagagtgctgcccatcccagattggggctgggggaatcctaaagtgtatatccccgctgtgtgggaaaggtggctaagggttatgcccacagggcccctgaagtacctcccctaaagcatgttgctgctgaacagattcagtgatttggcatctcctttgacagagatgaagaatagctgctgagttttgtgccctggctggtactagccacacctctgctttatgcctctagtttctcttagaagccttcaccctacgggcatttatgatgcttcctgtggattcaagcagaaatgtttttcctgtgaagaaacctaactggtgacgaaactgtctgtcttccttgatctcactttttccagggtaaaaactgaatctgctagaacctttctgcatagtgcctggcagcttaggggagggtgttgtggccagaagcttttgtttctcttacctcttgcttgcggtttttcatttcgctgtgataactggagtcatcacatcctcagtttttagttctgggatgtccctggtgataatcttggccctagataattgattttggttttctatgagggagagtaaagccagattgctcttactccattttgataatatcactctcttgacacttttaaggattatagacctgtcgttttatagtctctaagtttggaattgtctgatatttcttcatgattacttttataagatgtatcttttggaaaaatgtcacagaagtgaagctgttatcttactgcgtcctatcaggtggctcttgattaaggtggtatctgccagccttctcccctgtaaagctgtctgatatcatttggatatttgtctgctctaaatctcttgttaaaactttatccccaatataggaggtgtgacctagtggaaagtgtttgcgttatgagggatatgccctcatggcttagtggcattctcatgagattaaatgagttctcactcttagttcctttgccatctagttgttaaaaacagtctggcatctcttcttctctgcttcccaccgtgtgatctttacataccagctcctctttgctttctatcatgagcagaaacttcctggcagcaccagaagcagatgctgataccatgcttcttgtacagcctggagaactgtgagccaaatatattttctttataaagtacccagcctcagatatttcttacagcaatacaaacagatgaagacagtattattttcccctttgtaatatatcatacctagctaacttttaattaattaattgactaatttatatcagtatatactcattctattttcattaaatgggtcacagtttattactatcattttattctttcatgctaaaactttccctatttcactagtagaagcattttagggcggaacacatgaacttttagcataaccctatcatactgaaagcactttcttgacttctggcccagtaagatgttcctggctcatcttgtgcttttccttccctagctgttgaaccagccatttctccgaggataattgtgtttcctttttttggtttttaatctacattttagtttgtttctttaggaataagagtagtttggggcaaatatggagcaaacaatttctttttattccttatcaaatctagcacacatatataatatacaaaatctttcttgtacatatataactttttatttgtatgaaatattgacaaacctgatgaaatcagtatctgtgagcattttttcaaattcagtaatcaattttttgcatgatttttggatatatatataatatgtactttaatttttagagcaattttacatttgtagtaaaattgattggaagatgcagagatttcccatatatgccctgccctcattcttgcatatcctcttctattatcagcatcctacaccagagtggtacattgttatgaagagtgaatccacattgacacatcattatcatccaaaatccaaattttcattaggaatgaatgttggtgtagtacagtcagtggattccataaatgtatcatgatatatgcccatcatcatagtatcatgcagaatagtttcactgctctaaaaatcctctagggctctatggtctgcctatttatatcttcctccccaccagcccctggaaaccaccaaacttcttactatttccatagttttggctttttaaaaatgtcgtatatctgaaatcatatggtgggtaacaatttcatattgaattctttcacttagtaatatgcatgtaaggttcctccatgtcttttcatggcttgatagctcatttctttttagtgctaaataatattcctttgtcaatatgcataacagtttatccattagcctactgaagaacatcttagattcttctaaattttggaaatgatagataaaactgctataaacacctgtatgcaggtttctatatggacgtaagttttcaacttctttgtggaaataccagggggtgtgatggctggatcatcgggtacgagtataagtacttctgtaagaaattacaaaactgacttgcaaagatgctataccatttgtattttcactagcagtgaatgagagttccttttgttccacctccttgccagcatttagtgttgtcagcattctggattttgccctttctaatagccgtgtagaagtacctcgttagtgttttaagttgcatttctctaatgacataggatgtggagcatctttttctgtgcttatttacatctgtataacttctttggtgaggtgtttactaaggactttggccaattttttaatcaggttattcatttttttattgttgagttttaagagttccttgtatattttggatgaatcttttatcagatatgtctttaataatcattttcatctagtctgtggcttgtcttctcattctctagtagtgtcttttgcattttttttattgtaatcaattacagcttatcaactatttcttttgtggattgtgcctttgttgttgtgtataaaagttaatgccaaacccaaagtcctctaggtttatttcctgttatcttttagaagtctcatttccttttagaggataatgatatttaaatccaagatttgggtgctgggtatcctcattactatgtgggaaccactccccccaggctctctcagtggacagagttaggaaatatatattcatccaatttatatctctttatatttctctatctttctatctattaaaaataatgagtttgcactaatacctaaaattctaatcaaacaccacagagagttttctcccttttcatatttgcaacatttttgtgttaatgagaaacatggcttttattattcttaaggtatttacctatttgaccgattgccctgtattgaaccaatctcccattgctgccattgtgccttcctctgacagatgtcctccgcaccccacctgggctctgatgctccttattgggctgccctcctgcaggagcaccctcatcctgtttggggttgaacagtctatgtctgaacttgcctctctttggatgcctcctcattctgccaatcccctgtctctccacagtgttccctccctgtctgaaacctctcctcacagtgctcaggctctgatccctttctctgggccatcttggatgaaaaccctcccctattaggatgcctacttttctctgtcttacccagttagtttagcttaatgttcagtaaggaaaaagaaggaaaagggaagagggcctgatctttcatgtccctcagtaaactttataatttcattgttaactttcttagatttctagctattttatatttttgcttgtatggtgcatatttattttcttttttctattttctccctttattgctggtacatagataagtttttatttgtatgttgagtgtttaatttataagcgaccaagctcttgatcattttgctccctccttatatctatttaattgagctcttcctaaaacatcagttgtcccatcactttatgcgtaatggaagtttccttgaactgatacttcttggtagttgagaagctcctggcttaggttatataattagtatttatgggaaacaagttgcttaaataaaagtgtccctaaaaattcattaattaattagcattaagatttgtttatgatttactatataaaatgatgaaatatagaagagtgaggcccttttaaaagtatttaagaatcagccaaaatactgcttgctatttaagcttagattcttttcttccagactgtagaagtagaaaatacatgattattcagaattctagaatcgactttaatccaaaatccttaactagaaagtgggggtcaggagaggtggggaattagaaaattacaactatgtgttatagtttatatcagataatgtttagacatattcaaattactcaaaatattttctcaagtttccttttttcataaaatctttaaaagtagcaaaaagtatagcaaagtagattctaatgttcatattcttattcctaatataatacatgagttctttgtagtagtggttttcaaattttaacatgcatatgaattaccaggtaatggggctaggaaattgcattttgatcaaacactgcaggtgattacaattcatgggcctcacttaagaaacactgatttagagtgaaacaatatttgaataaatgtttcaagtagtatacttttgtttaaagtgcagacaaagagtaaacacactatttctagtgattatatcattattcagggaatacaggacatcatgtagttggagacaattgcactctctacaatctactttcagaataagctgttgatgttcaccagctctctaggatcaagagctaagttccttgaatgttcctgtcctttctgaggttcttagtaaaatgacaccctataaaatagtctaaaaggagttataaagccactctattttgtagttatttatccaattttcagtgtttaagaagctttctattaggcaagagtaggttcagaattatctgtgaatagctgccaaataatggttgttgttggaaactcctaagtgtagcacatgctttagaggaaattttttggtcatttggtctaatgtaaaacttaaaaggtggcctgaaattcacccaccatttgaaaatacgtagttgctcagttccgtgtcactaattctctgctttctctttgctttctgacacttctgaggagcagacctgtgaagcttgaggccactcaagttccaaatttgtgacaaatcccccagggctcactggagtggcagtaagttctcgcagtttgatttcctttcaatcactgaagtgttagaaaagtagtaacaaaagctcccacggcaaaacagcaattctgtttcctgaccatccaccatagtcatgacttacctcttttgttccattgatttttctgttgaacaattttaatacttttagccatacaatatgcagtatagttttgacaagctggcataatcctttaaccatgctttgagtgtacactttttctccttctacccccataacctgccatagaaaaactgattttatttttgaaaatttctttccctttttcagctattattttcacttaaatatataatgtttttatgttacaaagtttgattctcttttgatgatatatacatacacacacatatatgaaaatcttatgttcacggaagcgttatgttgtgatatttataatcacttcaataaagtcatttttagaaaaaaaaatgtaggctgggtgcggtggcacacgcctgtaatcccagcactttgggagactgaggtgggggcatatcacgaggtcaggagatcaagaccatcctagccaacatggtgaaaccttatctctactaaaaatacaaaaattagccaggcgtggcagtgcacgcctgtagtcccagctactaaggaggctgaggcgggagaattgcttgaacctgggaggcagaggctgcagtgagctgagatcatgccactgcactccatcctgggcaacagagcaagactccctttaaagaaaaaaaataagaaagaaaactttagtaaaagtctatacgatgcatttagtcaacaaggaaggctgacatcatttttaatgagagaagaatattttaaagaagaaataatggcttttgggtcagaaagaaccactgatatcaaactgactctctgttctttgtaactaaaccccaaaccaaactgattaacctacagccgcaagaacaaaatcaaacaacacatgatgtatgttattagagcatgtctataactcgctttttacatcaatttaccaaacactgagtgaacccagcacttgttgagaagaaaagacagaaatgattatttagcctttgctaagaaattaagaaatcagttttaaatgaccagcattaaaagcaaaacaatttttcattgtcaccatccaaatatgctaagaaggaaacatctagaatatatttcccaatattaaaattatttcagagtagttataaacaaacggaagactgctccacctcacacaattttgtttattctggttagtggctcccattctttggcaaataatgtatggcacacacatgagttctggaacatgttttaataactcttaatttcctaccactcatgacccatctgtcatgatttgaggaccttacattagggaagtcaaatagggaagactgtgtgtttgtgaccaagagcattaattttaggcgtggtttaactatgtgtcccattaattccatatctacaggtttttatctgtaactcaacccagccagatccatgttctcctcttctttgtcttgttgtatgccttgagaagctaaccttgacttctataagttacatccacccaggcccccttgatagttggcttcttttaaaaatccaacaaatgcaagacaatggtaggagaacagagtgtaagagagagagtttgggttaaaaccccatccccgccattctttcctgctctaagccatgatttctagcagttactacatctttttatcactatgacccaggttgggtggcctttttctatgcctccagctctaactgtactccagtaacactatttttctcttgcccttaggccagtcataacctctttctattgtcattcccttggtgctgcaatgttcctttttatttttcttcaccctgtccagatctaaagtcatccttattaaaacttcttgaagtagattctgattcctgcatgactgactcagacattagcaataagaagcactacataaaacatttgactgtcaagattccatttttggatgtagaaataagatgagaaacctgaggaaaattcccaagtcgtgatctgtttagaaagtacctatacttggaataatttgactgttgcttcctcctgctctttatcccctggtttcttaattatcacagctagatgttcagctgttggtattgtctgtcactgccaataccacatgtgtctattgtggccataactactgctttctgagaggacttggtcatctactgtaaagacctgattactcactgtgaccagaagccctttaagattgaatgaaggaagatgaggctttttcagctacattattaaaagacagttgcagctgcaataaaacatgcattggaatttattcagcactcctgtgtgcagccccttgctcctcctgcttttgaacgttgatggatatgacattgtgtctaatctcagttgtattctatggtacttgtcttggagctggttctctgacttgactcttcatttagcttagtggacttgatttcctctcatttgactaccaacttttgattttctttaaatcttgcctccagactacaaacatgccaagtatcgtgcatcgtgtgttgtttctttcattgccgttcctgccaccatcactcttggctttgcctctgctgctgccattactttcaccacccccacccaccaacacacacacacacagatatgcacacacacacacgtgctgtattgtgttacagacaaaggtctgctatctttgccttcctgatcctgccttccctactatcagtcaccctttaaccactgccaccatcccctctaccatcaaactagcaatttactggtctttttctttcatttcagcccttagactgagtttccaagtatccaagtccccaatgattataaaatttgttactttggatttttttttaacattgcagatttattatcaagggaagtgagtcctgaaggattcattcatttggggtttatagcagatagacatgaatatatttctctcttaaaaaaacagaaataagcctttgatggtttggttattttgacataactttcactttaatggtggttttttccccctttggactgtatttccaaatcaaaacccttttaatttgatgatggagaaaatcttatatcctagatgcataaatgttttgtgttgtaaagtttctatatcagaaacccaatttcctggttaagataggaatatagttttaaaaaggtgaaaaaaaatgagccttatacatatcgtctttcctattaaaagtatacaaggaaaaaaatggcagaaatgaaggaaataactaagttaaagagacatgccaacttgatccagaatttcttccctggatcctgggctcacagatccaatatgcagtcttttttaaacagtatgcaatatagtgctcttatttttaaaaataatatgattctaatattgatacctgttataattatgaatcactgataaaaagttttaatttttcacttttattttcaaagtttagagctgaaattattaagaaaatatagaaaaactgcggaagatttagggatcattaatagtctctcacacgtttcaaaatgggattctaaagaaagattaaaggaattagaaatattcagtagacagaaaagataaagatacagttgccttcagggagttaatgggtactggatgttcctttttcttccttgaatgtaagaagagggaacagtgttatatgttagcaagaaaagtaaaaaccatagttatcgtgtggacattttcaggattatctcttctgaagttccttaaagatagacttatctgggaaatatttcagtattttccaaattcaattcagtagagacacaatttatcagagatactcactttctaagatttccttggtcaaaacagcttgacaaatatctcatattaaattcctctcttggatattagcaatctggattagcatatttaagaaaaatttctggaaagaaaagagctgttgaagtctgtttaatgcttaggcaacaaagtttgtttgcacaagggaagaattttttcccccatagcacatatcacattctttagtttcctcttaacacctgttcaagaagcactggtttaaagcctggagaatgaatttctaaacctgttgaggctcattgttgagttttagtattatattaacaaatggttataaacttgtgaaatttaatccaatggatgaatgggagccaaataagaaatatgcgggaaactatatagaggaattattttgaggttgagtaaatgcgttatgctcctattcccataaaatgtgtcccaaggtgtagaacacaaggaaaaatgtgctcatctcacatctttgaagaagctgaagtttatttcttattgttaaaaggactgctcattcacctgcaaaaaaaaaaaaaaagtacaggaacaccttggatatattgtaggttttgttccacatcactgcaataaagcaaatattgcagtaaaatgaatcacacaattttttttgtttctctagtgcatataaaagttatgtttacactatattgtagtcaattaagcatgcaataccactgaatctaaaaaaaaagcaaaatacgtatcttaatttaaaaatacttaaagctaaaatgctaatggttatttgagccttcagtgagtcttaatctttttattgctggagggtcttgccttgatgtttatggctactgactgatcagagtggtggttgctaaaaattggggtgactctgggaactttttcaaataagacagcaatgaagtttgctgcatcagttgattcttccttttaggaaagatttctttgtatcatgcaagtcagtttggtaggattttacccacagtagaatttctttcaaaattagagtcaattctctctcttagttgctttatcaagtaagtttatgtgatgtactaaatcctttgttatcatttcaacaatgtttagagcatctttaccaggagtagatttcatgtctttgacatccacaagatgcaactcctcatccattcaagtttgttcatgacattgcagcaattcattcatatctttagactctacttttaattctagtttttttgctattttttttaaccaaatctgcagttacttcctccactgaagacttaaaccactcaaagtcatccatgagggttggaatgaacttatttttgctaatgttgatattttgatctcctcctgtgaatcacaaatgttctcagtggcacctaggatggtaaatctttggaagaaggttttccatttactttgcccagatccattagagaaatcactatctatggcagtggtagccttacagtgtatttcttaaataataagacttgaaagttgaaattccctcttaatctatggggtacagaatgaatgttgtgtgagcaggcatgaaaacgacattaatcttgtacatctacatcagagctcttgagtgactaggtgcgttgtcaatgagcagtaatattttgaaaagataggtctgaactgtaggcttaatatattcagtaatccatgctgtaaagagatgtgctgtcatccaggctttattattctatttatagagcacaggcagagtagatttagcataattcgtaaggatcttaggactttcacaatgataaatgaccagtggtttcaatataaagtctctagctgcattagcccctaacaaaagagccagtctttcttttgaagcctgcaagccagacattgacttctctctagctatgaaagtcttagatggtatcttcttctaatagaaggctgtttcactgacattgaaaatttgttgctttctatagccaccttcctgaatgatcttccggataaatggtgcagcttctacaccaggactttctgcttcaccttgcacttttacgttataggaatgtcttctttccttcaacctcatgaaccagtctctgctagcttccagctttccttctgtagtctcctaacctctctcagccttcacagaattgaagagttagggccttgctgtgggttaggctttagcttagtggaattttgtaggtggtttgatcttttatccagactactaaaactttcttcatatcagcaataacgcgttgttttgctttcttaacatttttgtgttcagtggagtcacacttttaattttcttcacgatcttttcctttgcatttacaacttagctaaccatttgaaacaagagccctagcttttggcctattttggttttaggcatcccttcctcaccaaacttaagtatttctagttttgattgaaggtgagatatatgtgactctcctttcacttgaacagtgagggaccattgtaggattattaattggcctagtttcagtattgttgtgtctctggtaatagggaggcaggaggagaggcagagagatagggaaatgatggttagtggagcagtcagaacacacatatttgtcagttaagtctgccatctttgtggatggggtttccaacacccgggcacaatcacaatggaaacatcaaagatcactgatcacagatcaacgtaacagatgtcataataatgaaaaagttgaaatacatgagaagtgccacacaaagtgagcacatgctgttgggaaaatgacaccaatcaatttggctaatgcagagttgccataaacttccaatttgtgaaaaatacattctctgcaaagcccagtaaaaagaagtgtgatcaaacaaggtatgcctgtatttgaagtatacattaaatctgttaaaccaccaagtcatgatgtaaattcctggttgccttctgtattaatctaattttaatattttgaaatgaacctgaaaaatctgtattgtaggaagtcaaggtgtgtattagcccctttaacttcaaaaccatgacatttgcagtcaaattatgtaaaaatatgtataaacagcaattaaatttggagtaatgaatgtgtctttgcaagttagaaaaatgccaataacatttgggatcttaaatctgttacgcagttttcaatgtgcagtgatttgtgttgagtgcattgcctgtttatttttgattttaaaatcattaattattgaaaatcttaatgctataaaaaactaagtggggtttttcgtgtataaagagtattgagttatttccattgtatttaaaatgtatcaaatgtttatttttcatgtaaaattactgatcatattttctatcaaacaagtttttcattatacagttaaattggtttcatctctccttttaataaagcagatcacattgttcctgaatccagccaaaaataatgtgtaacattcaacgtgtgtaatattctccaaggaaaaagagattcctgcaggctaatttttgtaacttcactttgttagcatataaatgactggatagggatgtttgtattgaaaggtttaaattttacactagttttcttgtgtactttcagtaattattgagtcttaatattaggctagaaacaactctaaaattattttcaagattatattaaaatattaacttttgaaagttatttgattaattctattaatcagaggtctgcaggatttgataataaataccatggcagacaatatagcctagagtttctgaatttaaggatgttaataacttgactgctgttagttgtagtaataaatctttcaaaatttatacttctgcctgattaattatagtatgacttggtctaacaagtaagatacacacatattacatatatcttttaagtaacccagcagcctatagtactaagtaaatataatataatactatacaaccagtttacggaaatgacagagtggtttgaagccagttggggtctataatagaacacttgtgtcagcagtctttccaggggaggcaaatggctgtatattttaaagtggaaacacaagatttaaaattaaatgccagtcaggtgttgtacctagtggctataatccctactactaggaagactgaggtgggaagatcacttgatcgcaggaattggaggctgcagtaacctatgatcatgtcactgcactctagcctgggtgatggagcaagaagaccctgtctccaaaaaaaaagaagttttttaaaaaaattgcccaatttttatatttttactttaatagtatatatattatatatatactatatatatatatacactatgactatatatatagtcataaaaggataaattgaagctctttgtgattaaattattaattttttgaaactgtactcccaataccattttatatgactttattgattatgatttctgttgctttgataatttgaaaattattttctatttttgaaagcatttaatgagaatggaaaaagaagtaaataaacatatatattgtatgtgcagtatcaataaggatgcacacagcacattttaaaaatttactttcagacttagacttttggtatttaattttcaattttcaacaatgtttacttttctggcaatttatgaatttttgttgctttaggaagaaaaacgtgtaaacattacgcttaaggtgcaattattttctagagaacaatttcattgtgttttcttagtagaaagactatagtgctagttaaacccataaccgttaatattgaaaattgtaatgctgtaaagaacttgaaggaatcatatttttcaaggtaatacaattttgaaatagataatttacacctactcatgcttattcattgacagcatatcattgtataaatggctcacttaactgatcagtgaacatgcattcttggataataaccaacataagattgtatcgatacttcggtattaatttgctcgtcatttttgctccagtctattttttgtgatatctatgtataattttaacttgaaaagatctgcaaaaaatatagtttgaaaaatatcacatatactgggcatctttctaaaaaggcaatatcactggaatacaatactaagattataggaatttagaattacagtcttgtttataaaatcctgacttaaacatcgttttaaaaagtttaatggctgctcttctaaggttgtcataaaatcactttcatatttgatattatgttttatgcctagataaaacgatagatgtctgtggctccatatctgtataacagaaggacagcaggtaatgctgctcatcaaaatgaataggctgtaatatctataaaatggaagataaaagttagacttctgcttgaatgaaatgagcacgggtgtgatttcatgcaggtctggtatacatttatttcaccttctgccatcttttctcccagtctggataaggcaacttctgcatagttgatttttaagctaaaaattacaactattaatttaaatacaaatgtgtggattttggtctttcaaaaaaatatatatattcactattttactttatttaatttggttccttgaagaaaatggacatttctcaaaaaagctaaaacttgaaaatgcccttactatattagtttactttttatatttcctggcctcaacggctggatggtcacaactatatattgcagtgtctatctatctatctatatatacacatatatacatatgtgtgtgtatatacatgtgtatatatgtgtgtatatataaatataaatgtggatagatactgcagtatatagttgtgtgtgtttgtatatatatacacacatactcacacacatatattacattttgtagccctttaacattacagaaaatattttctttggtgttttattctgctgcttcaggaatgcaatatgcaaggacttgtattaaaaaaaaaacaaggacttggccgggcgcggtcgcggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaacaaggacttgtgtgaagatctattatggtttcctgtcagttggtgtcttttgttttatttggtattctagtaaaatgacctgttccttaggtatggttaattaaagcttaagttaattaaagattaatatccaggctcaaaactctttatacatgtttcaatttacagaagcaaaacctgagacttggagaggttagataatttgccaatgatctcatagctagtacatggctgaactgactccaattcctgaacattttgctcttcccatacagtgagctcaattggtaccgtctgcactaatagagtaatggttttagagcctgctgagatatgttggacagttttcttccacattaaatggcttcagattgctaaaactttggagccattgtgttttctacatatcagcagccttattcttcattcttgttgaacctagcagggttttctttgtgcttgcaccagggaagccaagcattattttagaacatcagaagacagggaagtttgggaacactttaagttcacactgaccaacctcagataagcccttagcagaacctggcaatatgattgctcttctttagtttcctgatttgtgcaatgaggttttcaaaacttctccacctctaacagacatttgatctatccacccttgcccttactgtgagcagattacccctgtttttgctttacagagaaaataaaagctatcagatgcaaattccattaattttccttcttttttcttttctttttttctttttttttttactattattatactttaagttttagggtacatgtgcacaacgtgcaggtttgttacatatgtatacatgtgccatgttggtgtgctgcacccatcaacttgtcatttagcattaggtatatctcctaatgctatccctcccccctacccccaccccacaacagtcccggtgtgtgatgttccccttcctgtgtccatgtgttctcattgttcaattcccacctatgagtgagaacatgcggtgtttggtttttttgtccttgcaatagtttgctgagaatgatggtttccagcttcatccatgtccctacaaaggacatgaactcatcattttttatggctgcgtagtattccatggtgtatatgtgccacattttcttaatccagtctatcattgttgggcatttgggttggttctaagtctttgctattgtgaatagtgccgcaataaacatacgtgtgcatgtgtctttatagcagcatgatttacaatcctttgggtatatacccagttatgggatgactgggtcaaatggtatttctagttccagatccctgaggaattggcacaccaacttccacaatggttgaactagtttacagtcccaccaacagtaaaagtgttactatttgtccacatcctctccagcacctgttgtttcctgacttcgtaatgattgccattctaactggtgtgagatgggatctcattgtggttttgatttgcatttctctgatggccagcgaggatgaacattttttcatgtgttttttggctgcataaatgtcttcttttgcgaagtgtctgttcacatcctttgcccactttttgatggggttgtttgtttttttcttgtaaatttgtttgagttcattgtagattctggatattagccctttgtcagatgagtaggttgcaaaaattttctcccattctgtaggttgcctgttcactctgatggtggtttcttttgctgtgcagaagctctttagttgaattagaacccatttgtcaattttgacttttgttgccattgcttttggtgttttagtcatgaagtccttgcccatgcctatgtcctgaatggtaatgtctaggttttcttctaggatttttatggttttaggtctaacatttaagtctttaatgcatcttgaattaatttttgtataaggtgtaaggaagggatccagtttcagctttctatgtatggctagccagttttcccagcaccatttattaaatagggaatcctttccccattgcttgtttttctcaggtttgtcaaagatcaggtagttgtagatacatggcattatttctgagggctctgttctgtttcattgatctatatctctgttttggtaccagtaccaggctgttttggttactgtagccttgtagtatagtttgaagtcaggtaacgtgatgcctccagctttgttcttttggcttaggattgacttggcaatgcaggctcttttttggtcccatatgaactttagttttttccaattctgtgaagaaagtcattggtagcttgatggggatggcattgaatctataaattaccttgggcagtatggccattttcatgatattgattcttcctacccatgagcatggaatgttctttcatttgtttgtatcctcttttattttattgagcagtggtttgtagttctccttgaagagatccttcacatcccttgtaagttggattcctaggtattttattctctttgaagcagttgtgaatgggagttcattcatgatttggctctctgtttgtctgttattggtgtgtataagaatgcttgtgatttttgcacattgattttatatcctgagactttgctgaagttgcttatcagctaaggagattttgggctgagacgatggggttttccagatatacaatcatgtcatctgcaaacagggacaattttacttcctcttgtcctaattgaatgccctttatttccttctcctgcctgattgccctggccagaacttccaacactatgttgaataggagtggtgagagagggcatccctgtcttgtgccagttttcaaagggaatgcttccagtttttgtccattcagtatgatattggctgtgggtttgtcatagatagctcttattattttgagatacctcccatcaatacctaatttattgagaatttttagcttgaagagttgttgaattttgtcaaaggccttttctgcatctattgagataatcatgtgatttttgtctttggttctgtttatatgctggattacgtttattgattttcatatgttgaaccagccttgcatccgagggatgaagcccacttgatcatggtggataagctttttgatgtgttgctgtatttggtttgccagtattttattgaggatttttgcatctatgttcatcaaggatattggtctaaaattctcttttttggttgtgtctctgccaggctttggtatcaggatgatgctggcctcataaaatgggttagggaggattccctctttttctattgactggaatagtttcagaaggaatggtaccagctcctctttgtacctctggtagaatttggctgtgaatccatctggtcctgggctttttttggttggtaagctattaattattgcctcaatttcagagcctgttattggtctattcagagattcaacttcttcctggtttagtcttgggagggtgtatgtgtcgaggaatttatccatttcttctagattttctagtttatttgtgtataggtgtttatagtattctctgatggtagtttgtatttctgtgggatcagtggtgacatcccctttttcattttttattgcatctatttgattcttctctcttttcttctttattagtcttgccagcggtctatcaattttgttgatcttttcaaaaaaccggctcctggattcattgattttttgaagggttttttgtgtctccatttccttcagttctgctctgatcttagttatttcttgccttctgctagcttttgaatgtgtttgctcttgcttctctaattcttttaattgtgatgttagggtgtcaattttagatctttcctgctttctcttgtgggcatttagtgctataaatttccctctacacactgctttgaatgcgtcccagagattctggtatgttatgtctttgttctcgttggtttcaaagaacatctttatttctgccttcatttcattatgtacgcagtagtcattcaggagcaggttgttcagtttccatgtagttgagcggttttgagtgagtttcttaatcctgagttctagtttgattgcactgtggtctgagagacagtttgttataatttctgttcttttacatttgctgaggagtgctttacttccaactatgtggtcaattttgtaataggtgtggtgtggtgctgaaaaaaatgtatattctgttgatttggggtggagagttctgtagatgtctattaggtccgcttggtgcagagctgagttcagttcctggatatccttgttaactttctgtctcgttgatctgtctaatgttgacagtggggtgttaaagtctcccattgttattgtgtgggagtctaagttctttgcaggtcactaaggacttgctttatgaatctgggtgctgctgtattgggtgcgtatatatttaggagagttagttcttcttattgaattgatccctttgccattatctaatggccttctttgtctcttttgatctttgttggtttaaagtctgttttatcagagactaggattgcaacccctgcctttttttgttttccatttgcttggtagatcttcctccattcctttattttgagcctgtgtgtgtctctgcacatgagatgggtttcctgaatacagcacacagatgggtgttgactctttatccaatttgccagtctgtgccttttaattggagcatttaggccatttacttttaaggttagtattgttatgtgtgaatttgatcctgtcattctgatgttagctggttattttgctcgttagttgatgcagtttctttctagtcctgatggtctttacaatttggcatgtttttgcagtggctggtactggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaacgttgatattggcccccactctcttctggcttgtagagtttctgctgagagatcagctgttagtctgatgggcttccctttgtgggtaacccgacctttctctcgggctgcccttaacattttttccttcatttcaactttggtgaatctgacaattatgtgtcttggagttgctcttcttgaggagtatctttgtggcattctctgtatttcctgaatgtgaatgttggcctgcattgctatattggggaagttctcctggataatatcctgcagaatgttttccaacttggttccattctccccgtcactttcaggtacaacaatcagacgtagttttggtcttttcacatagtcccgtatttcttggaggctttgttcatttctttttattcttttttctctaaacttgtattcacgcttcatttcattcatttcgtcttacatagctgataccctttcttccagttgatcgcgtcggttactgaggcttgtgcattcgtcacgtagttctcatgccatggttttcagctccatcaggtcccttaaagacttctctgcattggttattctagttatccattcatctaattttttttcaaagtttttaacttctttgtcattgtttcgaacttcctcctttagctcagagtagtttgatcttctgaagccttcttctctcaactcgtcaaagtcattctccgtctagctttgttccattgctggtgaggagctgcattcctttggaggaggagaggcgctctgatttttagtttccagtttttctgctctgttttttcctcatctttgtggttttatctacctttggtctttgatgatcgtgacgtacagatgggtttttggtgtggatgtcctttctgtttgttagttttccttttaacagtcaggaccctcagctgcaggtcagttggagtttactggaggtgcactccagaccctgtttgcctgggtatcagcagcggcggctgcagaacagtggatattggtgaaccgcaaatgctgctgcctgatcgttcctctggaagttttgtctcagaggagtacctggccgtgtgaggtgtcagtccgcccctaatggggggtgcctcccagttaggctactcgggggtcagggacccacttgaggaggcagtctgcccgttctcagatctcaagctgtgtgctgggagaaccactactctcttcaaagctgtcagacagggacatttaagtctgcagaggttattgccgtcttttgtttgtctgtgccctgcccccagaggtggagtctgcagaggcaggcaggcctccttgagctgtggtgagctccacccagttcgagcttcctggccactctgtttacctactcaagcctgggtaatggcgggtgcccctcccgcagcctcgctgccaccttgcagtttgatctcagactgctatgctagcatgagcaaggctccgtgggcgtaggaccctctgagccatgtgcgtgatataatctcctggtgtgccgtttgttaagcccattggaaaagtgcagtattagggtgggagtgacccgattttccaagtgccatctgtcacctgtttctttgactaggaaagggaattccctgaccccttgtgcttcccgggtgaggcgatgcctcgccctgcttcggctcacgcacagtgcactgcaccctctgtcctgcacccactgtctggctctccccagtgagatcaacctggtacctcagttggtaatgcagaaatcacccatcttctgcgtcactcgcgctgggagctgtagactggagctgttcctattcggccatcttggcttcctttttttttttgagatggagtctcgctctgttgcccaggctggagtgcagtggcgcgatcttggctcactgtaagctcttcctcccgggttcaagcctcagcctcccaagtagctgggactacaggtgcccgccaccacgtccggctaattttttgtatttttttggtagagacggggtttcatcgtgttagctaggatagtctcgatctcctgacctcatgatccacccgccttggcctcccaaagtgcaggattacaggcgtgagccgcggtgcctggcctaattttcttgccggctttcacattcaaattttcttattgctatgttgacatgtaagtcatattttgttgaatacttacagtatgtataatttatacactgtggatactgatatgaacaggcctgttttcctggtctctagtacttatcattccatagtagagacagaacataaactcatatttaaatgcattagtcaaggttatctagcgaaacagaacccataggagagagatagattacttgatagatagatgattaatagtacaataggagattcagggatacctcagaaatactgtgtgttcggttccagaccatcacaataaagtgaataacacagtaaagtgagccacagacattttttggtttcccaatacatatataaattacgtttacatgacactgtattttaatgtgtataacattttatctaaaaatgtacataccttaattaaaaatattttattgctaaacagtactaatgatcactggaaacttcagtgagtcttaatctttttgctggtggaaggttgtgtcttaatggtgatggctgctgactgatcggggtggtagttgctgaagattagggtggctatgtaatttcttttcttttcttttttttttttgagaaagggtctcatattttcttttttcatgggctggggtgcactggtgcaatcacggctcactgcagtctccacttgccaggctgtagcaattcttcctaagtagctgggactacaggtgtataccaatacacctggctaatgttgtacgtgtgtgtgtgtgttttgtagagatgggatcttgccatgttgccgagctggtcttgaattgctaggctcaagtgatcttcctgtgttggcctcccaaagtgctgggattgggattggtagtttttttttttttaaataaagcaacaatgaagttggtcacattgattgatccttcctttcaagaaagatttctttatagtgtgcaagtcagtttgatgggattttacccacagtagaacttctttcaaaattggaatcaatcctcttaaactatgccactgcttttatgtatattctatatcatttgttgtcatttgaacaatgttcacagcatcttctctggaagattctgtctccataaaccactttcttcacttatccataagaaggaactcctcattcattcaagtttgttcacgagattgcagcaattcatttatgtctttaggctctacttttaattctagttctcttgctgtttttaccagatctgcagttacttcctccactgaagacttgacctctcaaagtcatccatgagggttagaattgacttctttctgctaatgtttatattttgatctcctcccatgaatgttcttattggaatttataatgctgagtcctttccagaaggttttcaatttactctgcccagacccatcagaataatcattatcaatctgtctatagccttatgaaatgtatttcttaaataataagacttgaaagttgaaattgcctcttgattcattgactgtagaatgaatgttgtgtaaacaggcatgaaaacagcattaatctcttgtatatctccatcagagctcttgagtgactaggtgcattgtcaatgagcagtaatattttgagagacattttattcctgaacagcaggtcttaacagtgggcttaaaatattcagtaatccatgctatgaacaggtgttctgtcctgcatgctttgatattctatttatagagcatgggcaagtagatttagcataattctcaagggtcctaggatttccataaggataaatgatcactggtttcaacttaagtctccggttgcattagcccttaacaagagagtcagtctttcttttgaagcctacaagccaggcattgacttgttctttctagctatgaaattcctagatggtatcatcttctgttatcatctttctttagaagaaagcctacaagccaggcttactgtagccaccttcatcagtgatcttagctagatcttctggataagttggtggcagcttctatgtcagcactttctacatgcacttttgtgttatggaggacatcttctttccttcaagtgatgaaccaatttctccatgcttccaacttcttttctgtagcttcctcacctctaacagccttcatagaattgaagagagttagggtcttgctctggattaggctttagcttgagagaagccccttgaggattttgaaagaatgttgtagctgttttgatcttttatccagactactaaaattttctctgtatcagcaataacacattagtttgcttttttatcatttgtgtgttcagtaggtaacacttttaggcttacttccaacttttgattgaaaatgagagatgtgtgactcttctttcacttgaacagtgagagggcattgtagggttattaactggcctaactttaatactgttgtgtcttagggaatagggaggcaggagcggaaggagagagacttgagaatggccagttggtggagcaatcagaacatacacaacatttatggattaagtttgctatcttagatggctgcagttcacagcactccaaaacaattacaaaagtaacatcaaagatcacagtgtcagcccattcacattgctattaataaatacctgaggttatataatttataaagaagggaggtttattttggcctgtgaacctcaggaatctgacaatcatggcagagggtgaagggagagccagtgcttaacatggtgagacctggagcaagggagtagatgccacagtcttttaaaccgtgaaatctcatgtgaaagagcaagaactgactcattattatgagggggcaccaatacattcatgagggatccacccccatgacccaaacacctcctaataggcctacctccaacatttgaggttacatttcaatatgtgattcagtggggacaaaatatccaaaccatatcaatcagtgatcaccctaatagatacaatagtaatcaaaacattttaaatattttgagaattaccaaaatatggcacagagacaggaagtgagcagatgctgttggaaaaatggtgctgatagacttggttgatatgtggttgccacaaactttcaatttataaaaaaaatgcactatgtggaaagtataataaagcaaacaacaataaaacaaggttagcctgtgagtatatatatgtgtgtatatatatgtgtgtatatatatgtatatatgtgtgtgtgtatatatatatgtttatagagatttattttacgttattggcttacactgttatggaggctgagaagttctacaatctgtcatctataagcagaagacgcagaaaagccagtgtagttcgaaggcctgagaacagcagagataatgatatagattccagtacaggtgggagggtggaaagaatgatggcccagcttatactatcaggcagaaagcaaattgaacattcctccacctttttgttctatttaggcccataagtgattggatgatacacagccatctgctttactggggagggccatctgctttagtaagacatcaattcaaatgctaatctctcctggaaacaccctcacagatacacccagagataatgtttaaccagatattcgggcacacttggcccagtgatggtgacgtataaaattaatcatcatcataaataaatataaatgatatttttaaaactgataagctctaagaagagagtaaagaggtgacatgaaacagtgacaagacaggaggtgaggatggggagaaggcagcatttactagtgtggcaaggaaagatacctcttgggaagcaatatagcatgagggttgagaacatggactgaggctcagattctactgcttactgcctgagtaatgctgggcaagttacttagactctctgtttctgagttttctcattagtaaagttagccttgtcagtatttacatattagtgttaatatgaattaaataagtgtaatgtgtttagaagagcacctggattacaggaaacattcaatgattgtagctatagtatctgtcaaagaccaattagcacattcaggagttcaaatgaagagagtttaatgaaggggccatttatggaggtgtaggattagatgatggaaccagcaggatgtggaaaatcacccaggtaatagtaacagtagaaagccaagccattactacccgtaagcatgaagagacacagggaaagaatgagagtatttaccagagcttggtgggagcagtagctgtgaaaaagaatcactggtgtcctttggagctcggcatatgatcttcttccttcagtctccataatcttaccttaaagatgattattttctgtatgatttagctgctcttgcatatggatcccctgacaagagttgtggtcataaagaaactcagccatggaggaagagttgcttgtcagggagaaccatgggagggtgataccctaacctatctcttcccatttttgcatcttctagcattacttactatcagaacatccaatcggaattcatgataagggaatctagaagatgtattcagtggaggatgatatcctgagccacagagaaagacacagaagggtggtgaatgagttgaggaggacattaggcactgagcttcattatcattatcatcaccattatcattattatcatcacagttttcatcattattaaatgacatttgagttgagaagtcaggccattccagaattagggggaatagtaccagaaacagaggacagcaagtttcaatgccatgaagcacagttgctgcatgtggttgtgcggattttgaaccacataagtgtagggggtgatattcaaagaggctaggttcacaaagcataaagacaagtgtgacttgagtaaaataaatatgggaaattgggggagagatgcaattgtaaggataaacaagtccagatcatttaggtttttagaggccatgccaaagaatttgaattttattttacatgtaacaggaaggcccttgaggattttaaataaggaagagatgtgatcctatctatatttacaaaagacaactttagatgctacctgaaggttaaattcttataggcaagcaagagcagaagaaacaggaatgatgtcacggtagtcttgctgagagataatagtggcttggcctaaagttgagattcagtatgtatgaaataaagcaataaggctatcttatgggttgaatatgaggaggtggagatgatgaaaaagaaaagaactaaagataattccaggtctttggtttagacagctaggtggacaagattggcatttatgcaagagtgaaagcctggaagtagaagcatgtattttgcatgcatgtgtgtggtgtgtgtaataggagttagggagatgggtaataggtaattgttgcagaaccaggagttctgagatttcaggatttgaagaatccaaattgacatattaaggagacagtccagagtacagagatgaattaaggcctgagatatacatttggatgtcattgtgatattgatgggatttaaaactatggaaagtagaagaggagtaaggactgaggccccaggtctgcctcagtgttaggaatttcagcaaaagtagagaaagcattggagagtgggaagaaacagagggtgagagaggagggaaatcactgctgtttatgtcatgagtgcaaaaagaagaaaatatttttttcttttgctttgttttgttttgttttgtttttgcataatcctgaaggtcagacgtcagaataaagtgtttttagaaagagggagggatcactggtgtcctgtggagcaatatggtgctggacataccaccttctttcattctcaggtatctcaccctaaagacgatccttctcttttctgtatcatttatcttctcctctgcattcgatcctgccaatgatcatttaaatatgctcaaatcttttctctcttaaaaaccaaaccaaacccaaacaaaccaaaaatcctacagactcctccccaaactccagatccagctacttctcccatcgtcaatggctccttctcatccaagagcagtctaacctctgtttccagttcctcatcacccactctctaatccacaagttgagttgtgattcttttggtaacaagttactgaatacccagatacaagtgacttaagaaatgaggatttatttttctattaagaagaaggttgcatgtgggaagttttaaggttgtttaattcagcaattcagggatgttggtgctctgcaatccccttggcttttttcttatggttgcaaggcagctgcagcagttctaagtcttgtgtctgcacttaggagatgtttatttttcactatttcacatttcactaaggaagaagcaccctttgagaagacactagcagacgccactagagtatcattggctaatattggaacatgtgcttcacccattctccagccacagagagcctgaaagagcaaagatctagcatctttagcctcagtggtgggagacactctgttaagaagaaagaagagggtattttattttgaatgctcagctcatagcccatctcttcctctagactaaattacatgatcttacagcagtaatctgttttgttgttcatcattttcttcttaatgctcagcccattgctcaactcagttagttaaaatatatttatttaatgaatgcacaaatacctttcaatgcattttttaaaaaaaatagctacaccaacaattctaatttcctgtttccactttgttagggattaaacaaatccccacgttttttcaggtgcatgtatgtgtgcatgcacatacacatgtgaatttaattgcaaatatgcttggaaagaatgactgataactttcttttaactaatgcataaactcagtgacatttctttgcttaatcagaggctacacatgctaattttctagttcttgagtttgttatggtaagcagagattgacaaatagttggcttccaggtaaatgagatattatttcattgtagaaaacaagatcatgagaaaccatggaagttttttccgggttcacattttaaaataatttctgaaataatctgaaggaaattaatgtctagttaaacttaaagatgcaaaataaaactattgccatcaatatatttataattttatgctataatgataagccatacacagacctatttcaagagtccttataatatgtttgagtaataggcaagtcctcagtaatttgcagttaaatactataatagcatatttttgtgtatcaaatacatatttttaaagaagaaattataatcaggagccttatttataaagctgttatcaggggttgttaggaatttttgagcttttatttaaaacaaaaagattatgagaagcaattatttttatagcatatgtgaatgaaaattgacaatgcagaattattttttgctgtgggattcttagatacaataaacaataattttaaaaatcaatattttttaattaacatattaattaacacatatttggagagctactaatgtaggcctggtactgtgttaataagagttaattgaaaacttcaattgtaatatgtagttttataaatcatgtaggaatttttatgtgtgctctaattaccctttggcctcataatagtgcattgtaggtatttatgaaatactcataagatagctagaccaataaataatattaaattaaaggaggcaacatgcttcataactaatactacccacatgaccctcagaaaatggtaagccttcaggagacttacggcttagttgaggagatcagacatgtacaaaattataaaaagctgggacagtaagaagaaactgttattctctgttctttctttgaaacttggcatcgcttcttcccataatagttcaaccagctaagattgaactattaaagtgttgaatgttatcatctaagtactgtcacagagctcaagaactgaaggtatggtttttgtttgtgtttttgttttttatcatttctgggaacatgtataagtagaagtaccaatcactagaagctgcaactaattgtttggattctttgcagttatattgttggccaaaagttagatacactctatattccagaatttctattttcttggcccagaaagaagttgggtctacaaatggtaaggaaattgtaatttgtttataatccatttttttgatgtctacatggaaataaaagagaggttttctgggataaaccatagggaataagcattggacctagtatcccaacctcagttgactttgatgtcctcacagtgtgaagagctgcctagggaatgctctctcgccagccctaaggcacagtcctttccactcagcaatcttgcatgggtgagattgaaagagacttagtctatttctgtgattacatctggatggtatctcatacaaggatgaatcaaagagaaagacaatagtatggagagacagtagtttactctagaaactattgagcaccagggcggtctattataagcaaggcagatatatcttgtagtcaactccaaacaattaacacctatatgagccttgatgtaaggaaatcaatcaaagagactgaactgtccatgcatggccgaaatccttgattctgaatcaaaagggtggtaaagtaccaaattcagttagtgattttagtgagcactaggggaattttatattctagccaaacatgtggttatccaatccccttaggaaaaatgtagggtcctgagtgtactagttctcccagacccatttgtttttattttttttttgttcttgcattaatcatgcactatgctaaatattatatggaccacatcatttaattctcaaatgggggaaagattctattatgaccattatatagacatggatactgagattataaagactattaacttactcaacctcactctatttgaacatcagctgacctccattctgcataatatgatattgtacatatatgagaaatagaataataataattctcaagtcaacatcaataccactaactttcaacttcatttgacattgtcctataaatacttgtgatttagtaaacaaatattattgaatcatgtccggttactcacaaaagaaactagaaagattatctctctatatgatgtaacctgaaaatatattgtaacattctacaaaaaaaatctctcttcttccctggtttctcgttttgcctcctcacctactttttcaaatttttcttacctgtataggttaaatgtcttactacttagtagctgtgacagttttcctagtgcctcaaatcttcacctgtaaatttcacataagaataacatttatttcgtgacatagccatgaaaaagaaatcagataaagcctgtaaagttgtgcttctcaaaccatctatggtgaatgaacattttctataagttattatcaattgcagactgataaaacatcaaaaatcaattgtaagagaaattaagtaaaaaatagaattttttattattaggttcagtgctgttactgttttgaattcctataaaagtctttcaaagcttgctcagatttctttacttatctcattgcaaattgatagcaaatagttggctcattggcaatagtccattggccccattttgagcaacactgatgtaaagctcctaaaagagtgccttttacatattacatgctcaataaatatttgcagttttattgaaaataagcaaggtaccaatgacactgttagtttttacctttcttaactttttagctttctcctccaaaccactcttttcttcacaaaattttctccattagattttactacccccatcctcctcaatgcttttgttcctcttgctaatttattttgaatgtcccttaaagtttaattcctggacttaaggctctctctctttttgcgtgcatttccttgaattcttcatttcattagaaagtcaccttctccctgactccaccaccttctcccctggatttttgtcttaccatagccagtctccaattcacacacctctgcctcccaggtgactttaaccttcagccttgttaccttgctttcatatcagtgcaacaatcttctattgctgtctctaccatcatttatttctgtttcaacttattttgcatgcagtggttattatgtactattttgataactgtttacatttaaaataattgtcattaatttgttttcttaaaaaaatctggcaggaattgagaacttgacagtaccaaacaaattcaagaaaaggtgttttatattctgctgagactttattttggcagtaagtcctctttctagttcttctcttcaaaattcagtctgtgttttcttagcttccttcagtcactcactttttaattcctcacatctttcttgaggattatttgtaactctggtcatgctgaattgctttatataggagaggcaggatctccaccttgtcctaatccctctgggacactttatttgctcaatttagctctgagaataaatcatttgtttccagactatgggctagagatcagtagggcatgctaggatgtatgcaagtggtctgtgactctacaggtaacctctacccaaacatcagtcttattaactattctgaataattcaaactatactttcccttaaaaggattatattgttcaaaaacatgagtagaacattattcattgtaaacaacctgaaaacaaatcaatacaaaatatacataaaatgtgcttgttcttaattgtaacgctgtgttttccccacacttgaaattccatctccaatttcttttcatctctcttccatacagatctgttgctcccgctgaccttgtggtacattcagttccacattccaaccttaactacaaatgttagcactgactagaatgttctcttgtagtgtctctgccaattatcattcatttattaatactgttattgtcattatcatcatcgttgtcattgttgaattggctcacttcttccaagaagatgtcttggctaacttcttaaggcaagcagttttcaaagtgtgataagaggatccctcgggattcctggtatcctttcaactatgtatttgtgtgtgggtggattgtcttctaatacttcaagcaaaacactgtatcatgatagattgaatgaaggagcagatatggcaatccagctgtctcatattaatcctagcattaaatacacttgcaaaagtgtaaaatggcacagctcttctcactaaatgattttgtttttgaaaatattgttttatataaaacatttatattaatatataatgggtttatagttgttacttaaagataaattgatacataaatatacatttttcaaaattcaagcatattatggtaaatatccatagagatattctaaatattaaaaaaaaacctcttaacatcctcaatcatttctaaagtctaaagacatggagagaccaaaaagtttgagaattactgctttaagcattaaggtatatagggcattttgttactatatatatctgctcattctcttcagcttcataaataataataaatagcatttactgaaagtctactatggagaagcatgatatgatatgtgcattatctctatccacacagtaaacctgtaaattagctttcttactctaattttatagatgtggaaactgatgtttagagaaatcaaggaatccctaagttttcccaaaaactatgctggtagagttaggctactacttaactccaagtctctgctatttcttaatatttaccactattttgtataaatccacattattcatcaaaccacctcccatggtatcagttacaattttttttttttttttggagatggagttttgctcttattgcccaggctggagtgcaatggcgcaatctcggctcactgtcacctctgcctcctgggttcaagcgattctcctgccttggcctcccaagtagctgggattacaggtgtgcaccaccatgcctggctaattttgtatttttagtagacacggggtttctccatgttggtcaggctgctctcgaactcccgaccttaggtgatctgcccgccttggcctcccaaagtgctgggattacaggcgtgagccaccgtacctggctggtatcagttacaattctatatgcaaggagttaatgaacaaaataattattaaatagatagagtcagcctatctttagaaacccctaatggcagaggttagtcttcaaatgacctatttatctctagaactatttttttttgtggactattttttttctaaattattttcagtctgaattgcctcctatagacagtggaatattggttttgcaaatcaatgggtttcaaagaatgaacacaattcattcaacttctacttaagctttctaagcttaattctatattaattcacctgtagatgcttaatttgatctggaaacattttataattccacttcctgataatacgcttaggcatttctcgcagaggaattaagattttcaaagttatcagtacataattaagccttgttcaattaactggcctgctgccatgcttgcagggtgctgtgtcctgcgactcaggaaactgacacagcatcacagaggattctggcttttgtagacaagagccaacactgaagatgtaatgcttaggaaaaacacccaaatgagcaatccactttagttgttgctgagaacttcttggaggaaggagctttgcaggacaactgactcatcttgcagcaatgtgtaatgcttgtgctggaagagattctggtaggtgagaacaattatggcagcaaggggcagaaacatcaccccctagcacacaaaattacaaaagttatttgagaaagggcatttgtcagaaaaataataaatttggttttagccaaatttgatgtaaagcctatgtttttaacggaaatgccaagtaggtagttagaaatgtcagaatgaacatcggaaaataataagacaaaattcatagaagtgaatgttttagattagaggtaagagatgaagtcatatttttgaaaggaaatcacaaacaataagctgaaaaagatgactgttaaactttgcataaatcctattgttatattgagagattaagaaaagtaaaacttaaaaatggcaaagaaaaatatggtagaacatgcagttggaatatgccagtgcctccaacatctagtgagaaagaagtttcaagaaagaagattccatcgacagtgtgaagtattccagagaaagtgaaataaagaggaggaaaatatttggcttgttaatgagaagatacttggtgacttgtgagttgttgatacgggagctagattacatgtcagtaaacatgagaatagaaatgtgataatagcttaaggaactagtggaaagacaacaattataaacaaagataaatagaccaggttctagtgaaggctgaaagttcaagttaggatgatgcatgcgtaacttgagggaaaagtttcatcattttcaggttgtctagtaaaaagatgaaagacatattcattgagcaattgtggtatagagacactgtcttaggtgcttgaatatagcagtcaacaatcaaaaccaagatatctaagctgtggagcctgagatctgttttgaatatttaacaggctcctagccctgggctaattaagcactattagaaggaacacactcttgtgttatatacagtgctgtgctggtaatctggcttactgggaaaaaataaaaataaaaaataaaaagccctgatagagtatttgaggagttcctagttgtaaatattcctgtactgtagccaatttctagctaccaagataataccactggtgtagagttgggaaggaggtgcagaataggctcctgagttggctgcaacagagcgctggtactggtgtgttttgttttgtatgctaggtgtattaacatgcttctaccttcgttttattcatatgtaaaataggaaaaatattttgcaacttttatgaagttgtttattgatgaatatttttggtggaaccaaaaactggagaaatgcaagctatcaaattaatcagcataagtgaaatggttagacatttacatgtgaaaacaatattaaatttagatttggaaaaccatagacaattaaaattaaactcacagatggtagacaactttagaaatgctgtaatacacctcacttacctaacgtcttcagggaatgagctgtttcatttaagtgaattttcctaataaaacttacagattcaagcactagcacattttcatttaaacaaatttatgtggaaacctttcaaaaatggattcaaaaatttgttgccttctttatttttataacacatattttgaatttcaaaataatacgtgatcattatataacatttgaaaataaacacatataaaggagaaaataaaaatatatttctaatctcatcagaggaaaccagtgttatcaagatgatttaatttaattccatcttcttacttacatgtatatttttaagtaattgaaatatttttaatcaaatatatgttacatgaatttatttgcaagcattttctcacatcattaaatattctgtaaatgtatgttttttaaatggcagtactattttgtcaaatatgtgcactagaatcattttaaatatatacatattgttatcgatagtaatttacattgcttccatttttcataattataatgtgctgcaaagaataacctcatatatctctttctaccttaggacatttctaattataaattcctaaaaatggaattagtgggtcaaaagataaggttattgttttagacaattaatgaagttggtcaaattttagtgcaaattggtcaaaccttgcctgcagaaaaagtatgacaattaatactttcactagaaatgtatgagagtacccatctctctgtattccttgtcatcagcagacattgccatctttatcattgttttcaaacaatgtgctacatgtcataatgattcagtcatcatcatgtttataagtgagataaatgagataatgtatggggtaacacctagaacactccatgacacatagtcactatttagtaaataactaggtcaaagttgaggcttaacacaatgtttatctctcattcacatttcagtgtgagtcaatgagtccatgcagtcctttagagatcaaggcttcttccatctgttggcttcaccatcacttaaggccttagaatccttgcttcaaaactcacttctgtttagtggtgaccacaggcaatctaaggcatagttgttaatttgagtaaatttttgttttattcatatacaaagatgcacctgtgatttattaaagatcataagcctgtttgccaccactataatgcattttcttctttttattacctttatgtctcagacaaacacatactatactggttcatgattgcacactgaatgtctgcccctcttctaggctggaagcactttaagagccgcgggctgtgctttattcaacttactctcttcagcacttgatatggtgtctggcacttattaatattcaatgaataatgattgggtcaatgaataaataactggattagtgtatgttctttttgttcctttgcctgcttttgtggtttcattcatgtggccatatattctctcagtgaatctccctctcctttcaccagttatcctaattttcaaacctcttggaacttctgggatggtatatataaaatagaatattaactgtctgtgggcctaaaataactcttgaagtagttaagcttagaaactttaataaaattcctttatatcaccactgccttactctctggcccattactatgttctggggaactgaggccatcaaatacacaaatctgaatgagtgaggcacattttcacatcaatgtaggtggatactctattacctaaaaaagaaaaaaactggatgtgcattatcctcatatgatgaataacctttttccgtcagtagtagtatttggcatatttgaattcaacgttttcccatgttttgtgtttcctggaccaggtcttctttggaataaaaggaaacaaagagttcctgggatatcaagaaggttctgtccgtttaatgacttttaaaaaatagcacatctatagtaagtgagttgaatcaactcagtttcatattatggtttaaaaaaactgaaaataaaaaaaaattgttctaagagttatccactgcaatggaattaaaagccagtgcataataggaaactgtgttctggagttgaggaactgatctgacttggtgtgtgactagggtattgcaggatgagctgcttcagattccactgctactggatatgtggtcttcatatgaaaaacaagttttgtaatatctgttctgtctccatcagaagtttattaggcttgagatcaaatattcagaagaaataaaactgttatcaatacttaaagcaacactacttattttaaataatacactattgatacttcttgtaaagccttaatttttaaattttttccagttcttactggtaaaatgaattttttcaaattacaataatttgtcttgaataatttattttttattataaaagataatgtacctttaaaatggtttctaaaatctcttttcaaagagggcaactttgttaatttccaactaggctttcaccataagtaggcatcccaaacatagcaatacctcccagattgttaattagttctcctactccaagttacactgatgatcccctccttttctaatagttcctaaggaagcagtctgattacacaggccattgcatatttagttggccaattaaaatctttgtcatttcaaaatgttccttggcttgtatcacttatgccagcaatctttacgattcaggagaatattcctaaggcagatggatgctaactgacatttgggtgatgcctaggaagcagagttaagtcctcagaaagttggcatatgcacttttaaaaactaaaaaaaaaaaaaatgcattcacaatggtgtgtaaccaccacgtctgtgtagttccaaaacactttcaacacatcagagtaaaaccccttacccatcaagcaatctatccttatttccccttcctcccagaccctggtagccgccaatctacattttgtgtttttcaaaacttcttaatgtggaagtaatttaaaatttataagaagttttaaaataaaaataatacaaagaacacctacatatgcttactccagttcatctgttgtaaacatttacctcatttgcttctctattatatatgcatacaatatataataattatacttttatgttaattatatatgattatatatatatgtataattattttctgaagcatttgagggtgaccctcagacatctgtgtggtctggacatatgttctcagattcaactttagaattgacttgccctctttcagtagctgccaggggtgcatctaaaacacagagatgattgtatctctaatatgctcaaaacccaatggggacttcttttttaaacagagaaatctcttaactgctttgcaagggcattcagtgtgcaccacaccttgtttttaaacatcctgtcttgcctcttctgctgtctccatttctttttctttcatcaaccccatccacactgaactgcttatgattgctagtgactgccatcatatcatcatatttttggggatttcttcctccagatatatacatttctctttctctccttgtgaaattcacccatggcccagcttaaatacatatttttgtttttgcttccctgacctcatcctttatccccaaacacacgtagcgcttgtagcagagggactaacagcatgggtttgtcttgccaaatcatgggtctgtcacttgttagccatgtgaatgtgagcaattttcttctcttttcttctgtttgttcttctgtaaaatgagaataataataatacacacctcctaaagctgttatagaattaaatgagagaacatttccaagtgtctaaaacagtctttggtagatagaaagcactcaataacatgtgaactacagttttagcaagactcagctcagtatattttgattaggtgtttatttatcaatctcccagtgcaggctatgggattcttaatgatgaaaacccttgtttattcatcttcatatctccagccttgctgttagtagagctaccttgtgaataataaatactgctaactctacaggtaatgcccttctttagacagagtagagtacaagagacatctcaaagtcacacaatttaaaagaaaggtggaatctgcactaaggaatctttagcctgtaactgcttgcatgctctggaatgagcaaacaaaaattctaattatctttctaggaaatggatcaaataaaagaattagttgatctccagaaaacaacaacaacaataaacgcctgcatccttacagcaaatttattaaaggaagacattgtactttgaagtactactgttgcctcgggtcagcattaagtttctaaattctgtgatatatctacaggtagattggttttttagggctgctgtaacaaagtacaacaaattaggtggatttagcaacaaaatttttttgtttcacagttctggagtctagaagtttgagatcaagacatcagtaggattggtccttctgagggctatgaggaacaatctattccttgcctttctttcagcttctggtggtttgcaggcaacctttggcattccttggcttgtagataaaccaacccattctctgccttcgtgttcacatggcgttctatctgtgtatgtagctctgtgtcaaaatttcctgtttataagaatgtcggccatattgggttaggggcccaacctagtctagcacaacttcataataaataattacgtctgtaatgaccttatttccaaataacattctgaggtactggggggttaggatattgacatatgaattttggtagggacataattcaactaataacaatagacttttagagaatgcctttaacatttattaaggatggaatatcaacagatgtgcttttgttcttcactgtccctccaatgaaaattgtttttgatgctgctttccagaacctaagtgttaagaggaaacacttaatgtttctaaacttagatttatgatacttgatattcctgtgcactagagaaattcctatctaaatagatagatttatgattgtgaacctgaactttgctgaagcaggcaggtttgcaaattttagcagtgttgacattccaagaaagaagataatgaattctagaaattcaaatctgattattaaggtagaagtgctggggttaatataaaactcaccagaagtaaaatatttagacaaacagtagaggtatcatagcatttagggacttggggaacattcaatccttcccttaagaaaaagtcattatatgtaaagtaatgcacacgctattctcagttctcaaacacagaaataggatgctgattacattaaagtaagaaatttgaaaatacctagcttcttaccctgcccagtggtaatatctcttaaaatttgaccacaaacatattctactctctgtttcctccactttttttgttttagttttacctgcagaaaaacttctgccatttctattatttttatccttagtcataatgtctttatgaatgatttcattgttttaccttccaaaatcttgcctcgtatagaaagtttaaatgtgagccatataagaaatgatgttccttgcttagaaagtatatttcaggagtacaatttgcagagttagaaattatattaaataattaaaatggagaatagtttcacttatcaaattgtatttgagttaaccttgagaaactctcagtatctagtattgtgccttgggtagaaggaatttattaatatcaccaacccccttggacttattaaaattatcctgtattcaatatttctgactgacattaatactttccctttttattactaacaaaggaatattattaacctggggtgggaatacataaaaaacgtcatgaggacacaagtgcttgaagaatttaattactgcgactatagcatcttttttctcagcatttttcaattgtcgacctaaaaaagaattgtctgtactatgtaaggcattttgactcaaccctgagtgtttgacccaaatggcataagtgaattgttttaatctgcccctttaggagtctgttggctttacggatcttgcatcatgaataattaaacagtgttggcctataaattccatcagaagcacagtatctcagagattcatatttatttcacaaaagataaatatattgaggaatcaaatctggcaattgtgtataaagcttattttcaagtataagaatttttttgtgcagtgagaattcaaaatcctcaatagacatcatgttagtaaccccacaacagaaatcccacataagtccattattgcttttaaaaccttcatattaagatttcctataaaaatgtaaatgttatgtctctgaatttgtgaattcaagctatcacacagtacgaaaatatagaaaatgttttgataatactgcaagttgagaatatgaactgtctcagcaagagtacctggcctttctagagtaatgaaacataacttcaaagaagactttattttctctatgcatttggatcattgaccattgggttaaaagtagagattaatcccccactgtgggaaatgagcattgaaatgctgacttgcagaaaagatgtttagaatgaattcaactttcccttttttaaccttcaaatatggaccttgaagttcaggaagacagaactatttacttcactaaaatagttgctgtttgaggactgtgtgctttgggtagtactcttctcagacagtgatgcagcatgatctatttcagaaaactctttcttttttcaccttcattctccctatcccaaattggctgtttataaatgaaaatattgtataataaaacaatacgttattttttgcattgtgcagtaatttctggtgtattttaaagtgtgcatttcctactcagttcccaaataaataatctcaagtcaacttctctgcatcattttgctggtcaggaggacaagccttctgtgtgcactacagctgctagatgctagcgggcgaataacacagccttcttctttaatgagacggcagatttcctacctctgaaaattaagaatgttggtctctgcagtaatttggcacagggctgcttttactttattaaatttcttctagtagcaataaaaagagtgccagcgttagcctcaaacccagggctagaaagaaaatatgttgttagcctaggccaggtctcagttgaactttttaatactgggtgtatttttttttcttcctcctgctcctcctcaccctcttcaacctcagcctccccctcctccttttccttttccttctgtttttctttctcttcctcctcttgctccttctccttcttcttctgaattctagtctgtttttatttgagagtcctcagaccactctgaactagcatggggtagaatcttcagtacttcatgaaagacttctccttcttagaactgagaacaaagaaagtaaaccggaattaacaaacaatactgaaattcacagattggaaaagtggcaattattctgtgaagcgttgcatcttcctaaaaaaaagccccaaacccttcaatttcttaagaatatctatatctatatgtgtgtgtgtgtatacaaactatatattctcatatgcaaatatgcagcacttaaatgaaatgttcaaaattatttatgagaaaaggaaaacctgagaatcacttgcctaatatgaggttattctgacatatagtttgattaatatgtatgtactgattgtcacagttttccttggttagtttcagtataaaatatgcatgttattattaaatatgcttaagaaatggcagaagttgggctgggtgcagttgctcacaactgtaatcctagcactttgggaggccgaggtgggtggatcacgaggtcaggagttcgagaccagtctggccaacatggtgaaaccccgtatctactaaaaatacaaaaattatctgggcatggtggtgcacgcctgtaatcctggctactcaggaggctgaggcaggagaattgcttgaacccgggaggcagaggttgcagtgagtggagatcccgccactgcactccagcctgggcaacagagtgagactctgtctcaaggaaaaaaaagaaaaaaagaaaagacagaagttatacataacaagctactatgattctgatactatgaaattttatgcaatctaaaaatagtttttatattatcttagatgcagcatcaaaattaccaatataaacttatactctggctaatagattttccaacatagaaaagaagtgtcttactaattaatttccaactcatcacctctgtaattactaaagtttgtgaaatatatataatttctaaactaacgttatttcaattacttgttagggcagtcaaagctatttatacatgaataacaagttattcatatatgctttaaatttttttctaaatgaatcattcttttgttttctgattatcaaaatcctttaaaagaaataataactatatagtctctctgtgtatatatgtgtacatttatatattcactatttagcatctgattactgagctctctaacatgctgtctcaaacatttaaagttatttgtcactgtttttatttccaaatcttaaacaaaatataagatttaaaatcagcttgccaaaacttcagcatcttatatggtttgctaatttttttcttataattctaacaaaaagcaaacctttttgggagcaaatacttcatcttgtctgccagtgaatccccagatccttatatgatgactgatacatggtgggagctcaacaaatatttttagcaagagttaattaatgactgatcacttattgcatagcaattaccactaatcattcctcaagtatgttttatctctttgaactaagcacatcactcttaatcagatttacaaaatttttggatgtgatgtaaatactctaatccttgcatttgagtcagtttctaaaagagaacaactgcaagatgttgttcaaaatcagttaattgggtctattaattgggtctatttattaactaaacaagcactgcactttaagagagtacagttaatgagatgaaaggaaggaagcaagtcattttcttctttaagaaattattgaagtcaacattgtattatgatattttatggctgtagttctctggctacagtgccttataaatattgattatttaagagtagagtaagacaagctggagaattacctaaggagaaggccaagaagacaactaacatcccaagtggccagtagacataattcaactcaaaagcaagtttggtttctttagatcagcagagtgctgcctgagtggggactctgtctctagagatggtgctaatgctagatgttgaaaataagttttgaaggaagcattagcaaaaagtcaaaattttataataaggtgcttaaaaatgagtttccttatattattctgtatgtgggagaaaaatttggataagtttaatgttgtaacttttaggagttaaaacaatcaggcaagataactacatacataattataaatctatttatcatctattttaaaactgctccaaaaaattgtggccttttttggtatatatgagcccatttaacactggaatgtaggtttcagaatgaacgaccagaattggtaaaggtctggagtcatagaagaatatagagcgtttggggaactgtgtaatgagtagatgtcataggtgatggagatgagactgaagaagtaaggccaggttataaagggtcttcctgtgctacactaaggaatctgctttatccattcttaaagtgaagtggcaaggtacggttgcattttgagccatcatttagacatttccatgaagggtaagtgggtgggtctttactagagatagagagaacatttagataatagataatagaacatttcagtatattacaagagatagaaaatgtatttatttgaatgtagaatggaagaaagatctaccattctccattatagattgattatgtgttggagaaagaaggggtctaggttgttaactgagtcaacgtagttgtggaagcaattgaaagggtgatggcgacactgattaagataaagaaggaagggaggaggaagaacagattgtagaagagtatgaaaaattcatgttttgatttgttgaagtggggttatctttaatgacctagtgaaatgagcatcagcagccagttggatatattgctcagtgttcaggggagagatctggactagaaatgggatgtcatttctagtaacaatgtaatgtaagtgggtgtcaatgcaatgtaatgtaaatggtgtcatttacatataggtggaaggtgaagccatgaaaagtgagatgaggtcaagaatgaaaccctgaccaggtgcagtggttcatgtctgtaatcccaccgttttggtaggttgaggcgggaggatcccttgaggccacgaattcaagatcagccttggcaacatagtgagaccttgtctctatggaaaaaaaacaacaacataaaaagccaagcatggtggccagtatctgtagtcctaactactcaggaggctgaagtttatcacttgagcccagaaattcgaggctacagtgaactatgatcctgccagtgcattccaaactgcacgaaagagcaagagcctgtctcaaaaaaagaaaaaaaataatgaaacctttagtattgacagatttgtaagggacaagcacagaaagggtagaaagggacctcctgaagggatctgaaactgaataatgagagaaacccaaagaaaatggaagcatggaagctagaggcagattaagaagttcatcatgcatttctctaatgataagtgatgttgagctttttttcatgtttgttggctgcatgaatgtcttcttttgagaagtgtctgttcatgtcctttgcccacttttgaatggggttgtttttttcttgtaaatttgtttaagtgagataccatctcacaccagtcagaatggcaattattagaaagtcaagaaaaaatagatgctggccaggttgtggagaaataggaaggcttttatactgttggtgtgaatgtaaattagttcaacgtttgtggaagatggcgtggcaattcctcaaagatatagaaccagaaataccatttgaccaagcaatcccattaaagggtgtatacccaaaggaacataaatcattctgttacaaagatacatgcatgcatatgttcattgtagcactattcacaatatcaaagacatggaatcaacccaaatgcccataaatgatagactggataaagaaaatgtggtacatatacactatggagtagtatgcaggcatcaaaagaatgagatcatgtcttttgcagagacatggttggatctggaagccattatcctcagcaaactaatgcaagaatagaaaaccaaacacagcatgttctcccttataagtaggggctgaacaatgagaacacatgaacacaaggaggggaacaacacatactggggcctgtagggagtggggagggagagcatcaggataaatagctaatgcatacagggcttaacacctaggtgatacattgataggtgcagcaaaccaccatggcacatgtttacctatgtaacaaacctgtacatcctacacatgtatgctgcaacttaaaaataaaaattaaaaaaattttttacaatgaacaatgtcatgtattggaaataggccaagtgaaacaaggacaaaatgtgaaaattgggctgggcacattggctcacacctgtaatcccagcactttgggaggctaaggagggcggatcacatgaggccaggagttcgagaccagcctggccaacatggtgaaacctagtctctactaaaaataatcccagctactccaggggctgaggcatgagaatcacttgaacctgtgaggcagaggttgcagtgagctgagattgagaatgcaccactgcactccagcatgggagacagagcaagaccgtgtctcgattaaaaaaaaaaagaaaaagaaaaagaaagaaaattggatgtggaaaatagtacttcaatctgactattacatgaggcatttcaatgtaataatcagggttgatatcagttgaagaactagaggaaatgagtatagactattctttcaaaagtcttacttggagaaggaaataggtaaaacaggatatactataaaagatgtctgtgtttgtttgttaaataaacaaggctgtttgcatgcagtggaaaaatactaaatagaaaggcatcatttgaagacataaaaataagggctatgatggaatggcttggttcctgaggagatggaaggcatgagaactagaatacaggtggctatatgtgtggcattgggcaagagtgaggatgaaggaagtaagaaaataaaagagtgaggaagagaggaaaagggccacaactgatgtaaattatagaatcccaagccagaatatataaacaaacatgggaatgtgttgactctcataattgggtaggtcaggaatagaactggttccatagagctggatacaaaggagcctagttatcacaatcgtgaaatctggtggtgctagcttaattttgtagacaggctttctttgtgtcattagtttgatggtcactgtgatgtccggattctacttgcattttagcctcaagggaaaagactcttccactcccagtgttggtatatcaacccagaggagttctgtgcatgaccttcattggccatgtgcctgtctcagatcacagacagaggagagggtgaaaaaccattatagagaccccagacaagaccacaggaaatggagatgagatgggaaaacaagaaaaaactgacaacaacagggaaaaagagctatgaacttatatgaacaatatgaacaataaagaaaaaaattggtataatttgagagagggcctaagtgtaagagagtaaacacataaccatctttatttttatttttatttttttgtagagttgtaaagtagaaagagaagttgttaaagtgagaaggatcagagtcaagttagggacttgcagacgatgatgatttccaactgtcattgaagagaaccagaaagaaagctggcctgaatatgtaaagagatggacaattttgggcatatattatttaagacagttgaaaagatactagagttagttcagacggtttggagtatattctagtgctgctgcattttgcttgtatgtgtttaggcaacatctcttctctggtcctctttttttccccccttttttatttgtacaaatgaaatgtgcaaaacatgtgattctcggtgctagccacaaacaaggtattgcattatggagtcatagactgagaatcagatgaaggacattaaagtgatctagaagacaaatgtatgacttgcttcctggaaaagaaatgacgaatgggtttctattgaaattgtccaactctcactgaatagaaaacgtaaaataaaccaaaactcacttttccttccctagttttaaaatatgttaaagatgagcctgctatattggtgatggtttgcacgtatgcactcagatttgaataaaccagtggagaatataaaaagaggaatagatccaagatgttactcatggggtctggataatactaagacagatttatagcagttactttccttatctcattacataattacccaatcaaggacatcaacaggatttagtctcattaaattggtagtaaatgtagtaaattttttaattaatcaataggaaatctctaggtaattcaactaggtgatagctttagctttttaattattccactcaattagtcaatcacttgtctagatctctaagatctttgggtaaatgtcacatgaatttattaagtataggttctttgaaactatctagactgtagccaaactccacatagtttagttaactttgctcatctcagaagaagtaaagtaagatcaattgggtatgaataataagtgcttcataagcacaatgagtgtacgtgtatgtgtgtctacacaaacccttaaattgcatttatcatgtgtcaggtattcttctaaatacttcacatacattaactcatttaatcttcacaaatatgcctttagatagatataattgttattattagactagtggtattctgatttttcagataaggaaattgaggcatagaaagctggcattcaaatcaaggcagtttggttccagaatctgtgcccccaataacacaatagttatgccataaatatatgctattttagagagattatttacacagggttaaaggtttttgtcagaattgacaggatttggtaatgttttataacaactaaacaaatatttattgttcaatgtctcctattttaaaataaaaattattttctgactaatataaaattatcatggaaaagattgaaaggaaactaaatattacacataaactgcaatgcagaactaataacgattattcattttggtctacttccttccatccttcttatgaatatgttaattgattttacaaaatttggatcaagtattaaataaacttgtatattttgtttctttcacttaacatttgattagaatcatatttctttacataatcttcaatatgactttgttcttcatttgttttggatgtaatattttcatatgaatgtatcatatgctaaataagtctcctattttgtttactttgaaaattcaagtaatttattatatcagataatattatggtcattgttaggcattttgaacattttttaaggtagctgcttagatgttgaaattattcaattaaatcatatggtttttaaggctttttaaaaaacaaacaaattgctctccaggaatattattattccagtttgcattcttaccagcagagtgtgacagtattcaattcatcacatactaattagcatgaatattttcatttaaaaaaatctttgacactttggtaagtgacaaaattatatttcattggtgctttaatttttatttctttgatattaaaatgacacattttatgtttgttattcatttgtgtttcttttatgaattgctgaggtcttttatcatttatctttcttgttatttacacataggcaatttgtttttcaaatccctctccactctccctacattgacattgatcattcagttttgtttgtggtaatatttgatgatgttcacttgggtgtaatcaagtcaagtggtcctccatgtgttatttttcattttgatagcatatatggaaatgcctttctcatgtttagattacagtcatctgtatacctttctagtgcttgtatgtctacattttttataattacactttgatacacctacatttctcctttatatgtgtgagaggaggacgtcaacatttctttccagagtactttggaaattactagtttaccatgtgatataattttttaacacattaatttttttccaggtggatctgatctcttcaggttttggtactctcaaattcctaccttcactcccagccccatctccacactttcaatacactatcagaaatttcctggatagattttcctgcttctgtaaattataaaacatttcttgatttttctcaaaatatgatgtagaaatttcaatttaaaaatttgctaaatccctttatattttaacatggtctcttaattttttgaacatttctctcggaggctattttagatacagtggtgagggaagatcattctgagacgatgacagttgggcagagagagctgagtgaagtgagggagaaaaccagaattattaacagacatgaaggaaaagcagtctaatgagagctaggttaagaagaccatgaaacctgataagaacactctaatttcctgaatgcctaaaactgtaggcagacaatgtccttaattattaacaactattattacatggacagaatcttaggcttcccagaattagaagggtaacttaggacaaaaaacgtctactttgataccctttctcattggtaggaataaaatcgcttagaatttaaatgtgttatagatctcgtaatcagtggtagaatttagagaagatacaaatcacttcacttcctgttttatatccagtcttttaagcctcccaacctccagtagttgattctgtggtactcatgttttgggaactatagattacctattacacagatattcttggtaaaaagctcctcaataattgaacacatctttttgatgttgtttatgttttttctttttgaaaaacagattctaaacttccaaaatgtaatttaaaaaatactaagagattctagttttcatatcaggatatagtggttaacacacttataatagttacattttgtgacagtctttttcattaaacatgtaaattagcctttctgactttttataactcaataggagggggtagaatttcatgaaggtcaaagcagtatgatgttattgttatagattgtgtagaaaattagcattaattggaaaatccacaaattaatataattaatgttattctactagtcccacaattttaaatgaaaggataacagtttatcattcaaacataccagatgttatatttaataaatacatttaatttttaaatgagaaaatatagaatctacaaacagttaaagacaaagttaatgatattgaacattttaaaatgtgagcaactttatttaaaatttatttttttaagtcttaagaagttgttccacttggagaaaaaagatttgctgatacatgtatggcaaaagcccctgacttatagagtggaagggcccttgcagatcatctagttcactaggaagatacagaaactgtggataagagaagccatttggcccacacccctaagaaacaaaagcatcacatgtcactcctctactactatcactgttcctttgaaccacataaatgaacagatcaaagggtatgtccatctttaatttcattaaactttgcctgaaatgtaacagtttataatacagtcagcagtacatgagagttatcatttctcccaattatttctggctttaaatttttactaatcttgatgctagtagattcaaacatcttgtcgtagatgtttaactacagatgtttccacagataacccagattataaaaggctataggaaattaaataatatagtatcaccataagaataaacagtagatcaattaagcaggaaaaaaccttaaacctatgtgtatttaaaagatatacaaagcagtggggaaagagttgctcactgagcaaatgatgctgggatattttaccacctatattgaaaaatacatgcttaatggatgacaaaatcacatccaaatggatttaagatctgtatgtgaaattcaaactttgaaacattttaggaaaaaatatctttttgatcatggggagagggatggatttgttataaattctcttaaaaattttctatttgttaaacaaaatttaaaagatggaatgtgtaagagaaataataaataagattcattaaaatgctagaaacacatttttaaagggcccgcaagcaaagctggcaaaaaaattcacagactgagtgtagatgcaatgcatatttctcttagaatcttaataagcaaaatattcatattaaaagtctccttcaagtcaataagaaataaactctaaaaggagaatgaagatggaacaaaagacataggccaatatatctatgaaaagatatttaactctacaagcatcaagactggtaaaaatttaaagcgtattgctgatcgtattataaattcttacatttcaggcaaagtttaatgaaactgaagatggacataccctttgatctgttcatttatatgactcaaaggaacagtgatagtgatagaggagtgacatgtgatgcttttgtttcttaggggtgtggaccaaatggcttgtcttaccctcagtttctgtgtttttctactgaactagatgttctgcaagggccccttccactctataagtcagtgactgttagtctattttcactttgctgataaagacttactcaagactgagcaatttttgaaagaaagaggtttattggacttacagttccacatgcttggggaggcctcacaatcattgtgggaagtaaggaggagcaagtcataccttacttggatggcagcaggcaaaaaaaaaaaaaaaaaaaaaaagcttgtgcaaaaactaccatttttaactctatcagatcttgtgagacccagaacagcctgggaaagacccgcccccatgattcagtcatctcccactgagtccctcccacaacatgtgggaattatgggagctacaaatgagatttgaatggggacacagagccaaaccatattagtgactttagccatatacacataacacagattataaaaaactataggaaatagcataataatttaattaataatcctcttttccctccttcaaaaattgttgtgcttatgtttactttctcttccgtttgaatttcaggattaatttttcaagtcccataaaaaattatgctagaattttgttgggagtcgtattgaatttacattaatgtaagaaaaattgccatgtttaaaatattgattctttccatttatgaacatggtttctctcttaatattttcagttcatctttcatgtccttcagtccagctacataattttctgcaaagaattcttgtatggttttgaaggacttactttgaggcatcttttaaaatagttattagaaatgacattgttttacaatgcatatttcctaataaaatgcaactgatttttatatatttacatagaatcccgtaatacttttttgcagatactttttcctacataggtaatcaaataatctgaaaataacaatatttagttttttcttttcatatctttccttatatatttttctgacattaatttggctaaatagtccaggaaatgtcacatttctttctttaggtcttatctttttgttttgttttttgtttgttttttaacctctcagaaatctggcaaggcctcccagtgtaatgttgagtagtgctagtgattgcctctttttctagtttctaactttatttttatttttatttttgagatggagtctcactctgctgcccaggctgcagtacagtggcgtgatcttggctcactgcaacctctgcctcccgggttcaagcgactctcctgcctcagcctcctgagtagctgggattacaggcatgcgccaccactcctggcttttttattttatttttttagcttttagtttttagtagagacgaggtttcaccatgttggctaggctggtctcgaactcctggcctcaagggatccgcctgcctcggcctcccaaaatgctgggattacaggattgagccactgcacccagcctagttatgcttctaatgttcaccgatattttgaggtgaaattataggcttcactagactgtcagaggagttcatggcacaaaaaacgctcagaaccttacatggaaattatcagtctagggatttggagcaaacgctgtggagaaaagacttcataaagcttgctggttgtccttctattttttatcattccacaaagcatagggctttgtaccaccctgatttacttctgtggatatcagaactagagctctgagtcactgcacctcttaggacaggcattatttagctcaaggaaatggaaggaaagaagcaagaacataattcgatttgttctttactattttatccttccacactcctgactatctcctgctcaaggtgcaaacctgaacaaaacagttcaacttttgcctgttatcatctttattgtaactaatatgtatgtttcactaatttctgttcaaatagaagcttctttctaataaattaatattatatttaaaaatctgaacatcttaagtttcaagtttagttcattctttttaaccttttcttattttctgatatatgcatttaagcttatgactactcctctaagtaaaacagttcaacttttgcctgttatcatctttattgtaactaatatgtatgtttcattaatttctgttcaaatagaagaagcttctttctaataaattaatattatatttaaaaatcttagcatcttaagtttcaagtttagttcattctttttaaacttttcttattttctgatatatgcatttaagcttatgactactcctctaagtactgctgtagatatatcccacaaaacatatatggtgttctcaccacgtcaaacatgtatatttattatttcttctttaagccatctatttttaaaggggtatttataaattttctaagccttggtttgggaattaggagtttttttttattatttctacttttgttgcagtgtggtttgtatgctgttaaatccttagtatttattaagactttcttggtgatcaattcttgtagatgttccatgtgtttgaaataatattgattcactgactgttctggctagggtttcgtaattatctattaagtaatattatctttttttctaaatcttccatgtcttagtattgctttcatttgtttaatacattagatattaacctatctatgttaaaattgtcaaattccatattggcttttgtcaaattctctttataattcaagttatttatgtattttgcaacaatattgttaaggaaatacaggtgaagtattattgttttcctagtgaattgttctgtgtattacacattttatctctaatatttctttttgccataaagtgtattttatgtgaaatcaatgcaactatgccagttggcctttctgagtatttgcctaatttctctttcttcattcctttcttgaaataccttctccgttgttatgttttaatagttttttaaacagtaagcagctgttattttcaatgcattttaagtttctgtctctgaactaagtttatttaatatctatttattttggttactgatccatttgaatttattctttttcatcttatgtgctttataattactagtttttgttgtattttatcgcttttttatttttgctttttcattcttcttttctaccttctgtttgatattttcttcattctactttttatgttgtacattttatttctactttttagtgttaacattagattttttaacactcttacttgccaaaataatgcttaacattaaaccataattatatcttcttttctaaagtataagaatcttagaatattattttactttgatcactacccacctcatcattttatatattcatactactttgatttgttttagttccaatttgtgtttaaatcaacctaaactaaaacatactctttgttcatattcttggccattatttttttctctatgtggacatatttttctatgtatttgccagccattattttttattttcccccactttcctcctggattgaattctcttttcttgatgtgcgttctttgtcatttctttcaatggcattctgtaagtggtacacttttgcctatgtctatctgaaaatatctttatttcagtcttagttttaaattatggtttagttgagtataaacttttagggtaaccactagttttcctgggacagcttgaatatatattccattgtagtctggtctctatcattgctgttgagaaatctggtattgtgttcttggtattcaaaagtaatctttttatccctggtgtcttttttcctttttcttgatgtgctgcactattattttggtaggtctaaggtttgatcttatttattctacttaggatttgttctgaatctgatcattaatatattgtatctatcatgaaaaagtctcagtcattgcttctttcaaaattttttccttcacagtttctccatttttctcctctgaaacttttattaggtgatccttcagctttctttttttttttaatttctatctctttatttctctacattatattctgggtaaatccttttagttaaactttcatttcactaatatctcctcaactacacctaatctgatctttagattttcttctcaaccccctgttcactcctttctcagcctttttctttttctgcttactttttttttctttttttattattattatactttaagttccagggtacatgtgcacaatgtgcaggtttgttacatatgtatacatgtgccatgttggtgtgttgcaccaattaactcatcatttacattaggtatatctcctaatgctatccctcccccttacccccaccccacaacaggccccagtgtgtgatgtcccccttcctgtgtccaagtgttctcattgttcaattcccaactatgagtgagaacatgtggtgtttgggtttttgtccttgtgatagtttgctgagaatgatggtttccagcttcatctatgtccctacaaaggccatgaactcatcattttttatggttgcatagtattccatggtgtatatgtgccacattttcttaatccagtctatcattgttgaacatttgggttggttccaagtctttgctattgtgaatagtgttgcaataaacatacgtgtgcatgtgtctttatagcagcatgatttataatcctttgggtatatacccagtaatgggatggctgggtcaaatggtatttctagttctagatccctgaggaatcgccacactgacttccacaatgcttgaaccagtttacagtcccaccaacagtgtaaaagtgttcctatgtctccacatcctctccagcacctgttgtttcctgactttttaatgattgccattctaactggtgtgagatggtatctcattgtggttttgttttccatttctctgatggccagtgatgatgagcattttttcatgtgtcttttggctgcataaatgtcttcttttgagaagtgtctgttcatatcctttgtccactttttgatggggttgtttgtttttttcttgtaaatttgtttgtgttgtttgtagattgtggatattagcccgttgtcagatgagtaggttgcaaacattttctcccattctgtaggttgcctgttcactctgatggtagtttcttttgctgtgcagaagctctttagtttaatttgatcccacttgtcaattttgtcttttgttgccattgcttttggtgttttagacatgaagtccttgcccatgcctatgtcctaaatggtatttttttattgcctaggttttcttctagggtttttatggttttaggtctaacatttaagcctttaatccatcttgaatttatttttgtgtaaggtgtaaggaagggatccagtttcagctttctacatatggctagccagttttcccagcaccatttattaaatagggaatcctttccccattgcttgtttttctcaggtttgtcaaagatcagatagttgtagatgtgtggtattatttctgagagctctgttctgttccattggtctatatctctgttttggtaccagtaccatgctgttttggttactgtagccttgtagtatagtttgaagtcaggtagcatgatgcctccagctttgttcttttggcttaagattgacttggcaatgtgggctcttttgtggttccatatgaactttaaagtagctttttccagttctgtgaagaaagtcattagtagcttgatggagatggcattgaatctataaattaccttgggcagtatggcgattttcacgatattgattcttcctatccatgagcatgggatgttcttccatttgtttgtatcctcttttatttcattgagcagtggtttgtagttctccttgaagaggtccttcacatcccttgtaagttggattcctaggtattttattctctttgaagcaattgtgaatgggagttcattcatgatttggctctctgtttgtctgttattggtgtataagaatgcttgtgatttttgcacattgattttgtatcctgagactttgctgaagttgcttatcagcttaaggagattttgggctgtgacgatggggttttctagatatacaatcatgtcatctgcaaacagggacaatttgacttcctcttttcctaactgaataccctttatttctttctcctgcctgattgccgtggccagaacttccaacactatgttgaataggagtggtgagagagggcatccctgtcttgtgccagttttcaaagggaatacttccagtttttgtccattcagtatgatattggctgtgggtttgtcatagatagctcttattattttgagatacgtcccatcaatacctaacttattgacagtttttagcatgaagagctgttgaattttgtcaaaggccttttctgcatctattgagataatcatgtggtttttgtcattggttctgtttatacgctggattatgtttattgattttcatatgttgaaccagccttgcatctgagggatgaagcccacttgatcatggtggataagctttttgatgtgctgctggattcggtttgccagtatgttactgaggatttttgcatcaatggtcatcaaggatattggtctgaaattcactttttttgttgtgtatctgccaggctttggtgttaagatgatgctggcctcatataagcttacttcttaattaatatttttctgggtttcatgtctgctaatactgtctgaagcagtcatgtttgtgctaggcttcaattatccgccatacatttatgacttccatatctatatctctaggatggttcttattttccttgatacgtcaaaatctcctaaactgagcattatttcctttactaaatctgctcctaatttagctccctatagaatcacatgctgaagccagttttaggagtcatcctaagttgccattaacccctgaactatgccattaatatcctatgctataacaccactcaccaaattccatttattctactacttaatgtgacccacctgtgatccttagcacccttattattctcacttgagtgctgtaattcctcctcactgacaaggaagcaagatagtgggtaaaggatgggatatgagagcaagatagacagaatttgaatttacacctctgggtttactctatgtataatttctccaagcctcagttctttacataaaatggtgaaataataatacttacatcataaagttgatgtaaagaatttaaggaaaaatgcacgaaaagtgtttagtgcagtatctgacttctagtaggtgtcaatgagtgttaacgtgtgttattactaggaatatgtctccctgcatctgcattcgataatacctctgtataaagtagacctgtcacatagaatcatttaatgagcctaagcatttcatgtttaccttcttagatatattgcttaattcatttatggttagggttctaggcatattaattggtacatgcacaatactgcagatatatatttcttatgggtcaatcaagctgtatttgattgaagaaaaaaatgaatgttataaatgataatatttgttacagtagaatttcctatatatttggatattttctaggcaaggttgaaattagtgtgcatatatgtggctcatgcttctatttaattaaattattacaagattagaatacaataattacttagtcataattacatagcaagaaatataattggcaagggagatatttttaaagatattaaatcagaatccattgcaaaaacaatagtttactgtatcagtacaaaagtagaataggttggaagaaaaccaaagaaggaaagaggaatctgtaatctttgattacattatttgcactgaattattaaagcagatgatagtgtgaataaatcatgctagagaaaccctatgctttaggctgaaaatttggaattccaatgttctaacttgggaaatattagtatctccttaggaatcctgggtagaaggaattttctggatattcgagtctatcctctagctccaggtcattgtcagtggcccctgaaacatattattattatatgttaatgaatatttctccagtagtaaaaagtgagagctgcacttattgaattcacattatacatcatactttggattaaagttttacctatggtaaatttcatttattcttcaatatatgcctattgggtattatcaacttcattttacaaacgaagaaattgaagttcagcaacattaaatatcatgccccaagtcacacagctattgagccgcttttctgagaattctatccaggcgtgtttatgagatatgaaccacagtccctgccttctggatgtgtgccatattttgcctactagtgaagggactcatttttacatgctccttggtccaaagagtagaaaatggcctaatttcagcaagcaataatgaactgcagtttgtgttaatcatttgaagctgctgataaaattggggattagcaactcaactttagtaagcactcttgtctattgtaaatatatttggagtgggtgatgtatgttagttaatatatgtatttaataatactataatagctaacattttatagtgtttaccatgtgctgggtaaaattccaagtcctgtacattcataaactctttcagtgttaacagcaaacacatggaaatagtactgtcataacttatatattacagatgagaaaattgaggcacagaaggccaaatactttgtccacattcacacaaccagtaaatggaaaactggattaaaatgtaggcagtgtagcacaagaatttagatagtcaacaactattctatgaaacaaatacacatagaaaaagatttgacatgtgtaaatgatttaattgaatatatatatatagagagagagtatttcttcagaatttttacccttatttttgatttttttgaaagtttctaaaaatttattaaaattgaaataaaactatattaaacttccacatggctatcctcagattcagcgattactgcattttgccttaccaaaaatggttgatagttctctaaagtgttgtataatccagacttctctggttacttgtggtttcttttatctttttcatctgtgccctgtttttcccattccttcacaactttgtcaatatttagtgttataggtgagtgtgtgtgtgtgtgtgtgtgtgtgtgcgcgtgcatgtgcggggagtggtggtggtggtgtttggttctgttgttggtattgttctgtttagttttagccattctggtcagtgtataatggtatcttattgtggttttaatttgaatttgtctcctgattgatgacattgagtagtttttcatctgcttttgggcatttgtgtatcttctttagtgaaatgtttttttttctttttttcagttgttctgcccatttgttttagtggttatctttttattattgagttgtagttatccttaatatatcatagatactaacccttggacagatatatatttttataaatagcatctcaagttattgctttcctattcattttcttaatggtgtttttcaaagattagaattttttgatttgatgaagtctaatatatcatttgtttttctctctttgcttacattctgtgacatgcctaagaaactttgactaacatcaagttatgcatacattttatgtttctccaatagctttttatttcagattttgtgtttagatatatagtttgaattatttttatgcatgatttgaggtagtggctgagagttcactaatttccatacgaatgttgttactctagcaccattttttaagaagacttaccttttcttatttgatcatttttttatatttgtcaaatatctaatgaataaataattggggatttatttctgatgttgatattctttcactgatctatttggccagtatcatacagtcttgattattgagaattgtactaactcttgaaggcaagtagtgtaaatcctctaactttgttcttttactaaattgctttcaacattctagatgctttgcatttccatgtaagttttataaacagcttatcaattttcataaaatagtcactagagttattaagttttgttgaatcttttgtaatttgaggatcattactatattaacagtgttaagtctttcagttcaggagtataactatctatatcttctttactttctctcagcaatgcttttatcattttcagtttataggtcttacatacctttgactaaatttgttcctaaatattttatggtgatgctattgcaaacataattgatttttaaatttcatagttcagtgggtttctcctggtatataaaatatatacaatttttatacattaatattgtgatatttgagctgtctaaaattactcgtttattctatcaattttgtacattcctttggatattctatgtaaattttcatatcattaggaaatataggtggttttacttctacccttctaatgtttatacattttatttctttctcttattgcaatgagtatggcctctagtaaaacagtgggtgagttgtgagactatacatcattacctttgtcttaattttaggaggagaattacattcaatatttgaccattaagttagatattagctgtagcattttctagcacctttatcaggttgaagaaattttcttcttttcccggttttctaagagtcttttttgaaaaaaaaaaaaaaaaactctattgaggtataaattacaaacagcaaaatacaccatcttaagtgtattatcataatcaagatacagtatattaaacatctccacaaatttctcttgtaccccataccagtaaatcttcaccctatcccagtctctgcttctgtctctgtacatgaagtttgtgtttcctagaagacatatatcttcttatgatttgaatcatagagtttgtatacttttgtaactggcttttttattcagtataaggttttttgagaaatactggtgtggttccgtgtctctgtaattgacaattttcaattctttttttttatattgctaatttctctatctatgcttgttctcatctcctgtcagcttttgcagattttgtgctaccaattatacttggattttcctgtctccctgccttcttttatgtttctccttaacaagattccatctccttcattacccaactttgagactagagaccatgtcttcatacactttatattcatttagtcagtcctttattgagtgtctgtgttgtggctgccatcatgggctcttaagtgatgccaatactgctggttcaagaatcgcatttgaatagatagcttctagaatattctaggatactggggacaggtgaaggttagattactaaatatttcctcatctaatacaaataatatatgtaatttcatgtaaacatacaaaatattaaaatttatatttatcaagaaggcagattatactgcaggtgatcagaactaaatttttatgtacatatatatggttattcaattcataaatgtttttataaaacatgggaatatctgagatacactgaatttacaaaccttggagagaccacctatatggattcttcaatcaggagcacgttcatatttagcctatctgttagcttatcacaattgacagagatgctttggttgtgagtttggaatatgaacataaatgtggttgatggagagacaaaataaaggatttttcttaatgagaatatagaaaaatagatggatttacctaattaatattactcacgtgtttaaacagaatacacacaattagaataagatttaaagaaataagacttcgtattgtaaatagagatcttattattaatatttactaaattcctttttaatcgaactctaggattttgaatcttagcgcttcttatagtcttccagaagactttttacttttctcattctattgtttaatccttttattacagagtaccaattacttttaaaatggcagaaaaagaaagttttgcagtggtgtgagggcacctttcttgatgaatcatcatgataacattttaagtagacaaaggctatttgttttctgacttactttgccattgttttctcagatatccttatttaggccaggtgcggtggctcacgcctgcaatcccagcactttgggaggccaaggcgggcagatcacctgaggtcaggagttcgagaccagcctggccaatatggcaaaactccatctctactaaaaatacaaaaattagctaggcatggcggtatgctcctgtaatcccagctacttgagagggaggctgaggcaagagaatcgcttgaattcgggaggtggagattgcagtgagccaagagcatgccactgcactccagcctgggcgacaagtgtgaaactccatctcaaaataaataaataaataaataaataaataaattcttatttatatcttctcttaaatagctatccagtaaactagcattatcagctcacaagataatttagacatttctttctatgaagtttgagattaaaattacatacatatacacatgtatctatttcatagcataattttaagagcacactttaaaaaaataacaaaataattaaacaaccaaaaggtagtgtgtaagctacaaaaaatgtcttcaaatcaattcctgcatttggaaaaatcccaaatgttaactagtcaaaacttctgatgattcacaaattgatattctattaaaattcagtcataagaatgaacatttgcattagaaaaaaaatcaatattcaaggcccaggtagcctaggctatttttaatgtttgccttaatataattatctttattgactatgacagttattttatggtatctagaaaaatagtctgcataaacaataatgcaataaatatctttatatatatgaatgtatctgataattttcataataaaaattcctttgttgttcagaagataggcactttttataaggttttagttatcactaacaacatgcttcctctcaaatttgtatttggatggtaaatgtcagtttctctaaaccctgagtaggttcatttttttttagtattatactttaagttttagggtacatgtgcacaacgtgcaggtttgttacatatgtatacatgtgccatgttggtgtgctgcacccattaactcttcatttaacattaggtatatctcctaatgctatccctccccactccccccaccccacaacagtccccggtgtgtgatgttccccttcctgtgtccatgtgttctcattgttcaattcccacctatgagtgacaacatgcggtgttgggttttttgtccttgtgatagtttgctgagaatgatggtttccagcttcatccatgtccctacaaaggacatgaactcatcatttttatggctgcatagtattccatggtgtatatgtgccacattttcttaatccagtctatcattgttggacatttgggttggttccaagtctttactattgtgaatagtgccgcaataaacatacgtgtgcatgtggctttatagtagcatgttttataatcctctgggtatatacccagtaatgggatgactgggtcaaatggtatttctagttctagatccctgaggaatcaccacactgacttccacaatgcttgaactagcttacagtcccaccaatagtgtaaaagtgttcctatttcttcacatcctctccagcacctattgtttcctgactttttaatgatcgccattctaactggtgtgagatggtatctcattgtggttttgattttcatttctctgatggccagtgatgatgagcattttttcatgtgtctgttggctgcataaatatcttcttttgagaagtgtctgttcatatccttcgcccactttttgatggggttgtttgtttttttcttgtaaatttgtttgagttcattgtagattctggatattagccctttgtcagatgagtagattgcaaacattttctcccattctgtaggttgcctgttcactctgatggtagtttcttttgctgtgcagaagctctttagttgaattagatcccatttgtcaattttgtcttttgttgccattgcttttggtgttttagacatgaagtccttgcccatgcctatgtcctgaatggtattgcctaggttttcttctagggtttttatggttttaggtctaacatttaagcctttaatccatcttgaatttatttttgtataaggtataaggaagggatccagtttcagctttctacatatggctagccagttttcccagcaccatttattaaatagggaatcctttccccattgcttgtttttctcaggtttgtcaaagatcagatagttgtagatgtgtggtattatttctgagagctctgttctgttccattggtctatatctctgttttggtaccagtaccatgctgttttggttactgtagccttgtagtatagtttgaagtcaggtagcgtgatgcctccagctttgttcttttgcgttaggattgacttggcaatgcaggctcttttttggttccatatgaagtttaaagtagttttttccaattctgtgaagaaagtcattggtagcttgatggagatggcattgaatctataaattacctcgggcagtgtggccattttcacgatattgtttcttcctacccatgagcatgggatgttcttccatttgtttgtatcctcttttatttcattgagcagtggtttgtagttctccttgaagagatccttcacatcccttgtaagttggattcctaggtattttattctctttgaagcaattgtgaatgggagttcactcatgatttggctctctgtttgtctgttattggtgtataagaatacttgtgatttttgggcattgattttgtatcctgagactttgctgaaattgcctatcagcttaagattttgggctgagaaatggggttttctagatatacaatcatgtcatctgcaaacagggacaatttgacttcctcttttcctaattgaataccctttatttccttctcctgcctgattgccctggctagaacttccaacaccatgttgaataggagtggtaagagagggcatccctgtcttgtgccagttttcaaagggaatgcttccagtttttgtccattcattatgatactggctgtgggtttgtcatagatagctcttattattttgagatacatcccatgaatacctaatttattgagagtttgtagcatgaaaggttgttgaattttgtcaaaggccttttctgcatctattgaggtaatcatgtggtttttgtctttggttctgtttatatgctggattacgtttattgatttgcatatgttgaaccagccttgcctccaagggatgaagcccacttgatcatggtggataagctttttgatgtgttgctggattcggtttgccagtcttttattgaggatttttgcatctatgttcatcagggatattgctctaaaattctcttttttttgtgtgtctgtgccaggctttggtatcaggataatgctggcctcataaaatgagttagggaagattccctctttttctattgattggaatagtttcagaaggaatggtaccagctcctctttgtacctgtggtagaatttggctgtgaattcatctggtcctggacattttttggttggtaagcttttaattattgcatcaatttcagtgcctgttattggtctattaaataccttattttcacagagataccttctccaactcctcagcatgggtttagtccccttgctacaagctcccaagatatcctgggcttatgcttcacaacactgagcccatataatggtgttaattgagtaactgcttttattctttgctaatctgtgagcttcattaggaagggaaccaggtattatttactctgcacttaacacgttgcttgcacatggtagacactaaaaaaatagctactgggtttttacagtaatcaaatgaccgtgttagtatcttcgaaattgacatcctccaggtttttaaaaatctttttccaagatatctcagagttttatgtatttatttattttgttaatttttagtttattttaagttccagatacatgtgcaggatgtgcaggtttgttacttagtgccatggtggtttgctgcgcctatcaacccatcatctaggtattaagccctgcatgcatcagctatttatcctgatgctctccctcccccggcagtccaccagcaggttccagtgtgtgttgttcccctccatgtgtcaatgtgttctcattgttcagctcccacttacaagtgtatctcagagttttaaacaggtaattggatgacctctgaaggcttatctctcagactttcacagcatccagtaataattactttgtaagaacctagcaaattttgataagcaaacatctaaataaaaacagaactttaagccccagagactttatctacttcccacttagaaattctttatcataatacagtagttctgtttactacataccattgatgttactattgttgttagcgatatggagtaacagactttgtccagttttgagagatgggaggaaaatgtgaagtggcagataattatgtataattatatatattagaattatatataaaataataattatagaattctctacgtatagaatttctatacataaaattctataaattctatttttatgttcagtgtatgtaaaaacatctcatagtgtaaagaatagatatagatagaagatttttatcaaaaggaaattgatttttctctttcttattaaataaatgctgaacaattatttaaagaatattggttggaaagactccaagttgttagcctgcccagggcacccacataccttggtacagtcatggtcttataataataaggcagtgtctgagtactcacagttttaaagtacatgacagatccttacatggtatctgctcactcatgcttgatttaataatgcttgtcatgacctagactttgaggttgctaaacacttatgactctgtatgttaagtcacactgtaatatttttttccacaaatatttttacaagagtagacctttcaagtggtgagtagttcattttgacaacaatcaactctattatcaagagtggatattctatttttcaatgttcagaagtgattattaattttttggccataaacgttaaattctagttcttggcaattttcctagagacttagtaagagaagatcttactttcccaatttccaaagtatataaataaatcttcaggtctaaaggagtaatttcaatgaaatgtgatacctttatttgtgtgtgaactcttagatgacacaaattaagttgatttgaggtttgtgctgtgtcaagctatgtatataataaatgcttccagagaatatgagctactgttctgatgttgccagaatttcatttttcacaaaagggatacatagttttctagctaatgttttcttcatgagcacacgtttcaagttcacttatgtgtgtgcacgtatgtgtgtatgtttcaccaaacatgtaagcttgttctttatactgacaagtatatgtaggaatacttgttatatgaaattaggtactacaagacatgtattaataatttggttcagcatataaatattaagtgtagagcaactgggaaagagaaatagcagacggcacaaatcactgaattttaatcgacgtcccctcccctggcagtacttttaagttcctatatgacattcacaaagggatttgatgttaaaatattcagaggaaacaatgatcaggccagctgcagaaggtaaaatgcacttcctagtcttgaaagacttatatttgaattgctgttcactgtagttacataaactaaagttgaattatatatgaatcacattgtgtttatgaattatatatgtaattttatagaccttttgcaacttatacagccttattcatagtatcttcttttttcccccacaattaacatgccatatagatgtatgtatatggcatgttgtgtgtgtgtgtgtgtgcgtgtgagtgtatttaaccctattttataaactaacacttaaggatattgaatgactaacctgaccttacaagtattaagttccatatccaattactggaagactaagaatcttagttaacatctactaagtaaatatataagaattctgcaatatggaaatgaaacaaaccttctagcaaatatatgctgagtacctactgtgtgcaaagcagtgtgggaacctcattttctcagggctcagcagcatgttctaaatcccttgggtgttttatagttgcattttccgtcattataaaggcatgaccctcttctgggcttcaagccaaacactgaacagcatgagataatgtgcaaacgcttattcttgacatctgataatttataaaaacgaagttgtacatgagaaagattcctataaatatattttatataaaatcatttgtagaagattttactttttaaattaaattatttgtttttcacttaaaagattgttgataaatttggcctactaagctgttacagaccagacatccctagtgtctgcaattctccctgggaatgcttgtcactttgtaggaatcatattatctttttgaggccacctgaagatagtttattaatttgttggtttaccagtctcttaattatcctgaaagacttaactccatttccaaaggtgctacagggtgtagcactgtaaatctgatacttgatggtaatttttacattatataaatttctttcatgggaaattccatatgcataactagaagggaatcctgactgggatttttttttcttttcttattatcttcaatttaaagcactttgcttcttttgctcgctgaagagaagaaataacacatatgagttattggtagcaagataggaaaatagcaacatcagaaatctgataattaggaggtttataatggcacatatgtgtcataaactgccaattaatcttgatgagaaatgtaatcaactttagttatgaataatgcctcccttcagaagatttagaaaaatgtcaatggtccatacaatttttatctttgtttctgtttcattggaccactataggcacaccccttcagaatgtttatctgcaggctataggtaatgctggttctagttattgagtgtaatccacacacttgcttatttatacactatatacagcatatgtgtacagcatttggtgaattaatgaggaaatgtatgtaatggaatacattctgagattctaaactgatagctcatatgtgtgctttagcgttttcagaaatagtgtttttaatccccgtatattgaatttacttcagatttacattttcaacgtcagtaattcaaaatctaacctaaaaagaggaaaaatagagtttgcaaagcacatatctttctgttaaaatattttgatattatggagacccttgaaatctcttaacctcccatctgctatccacacttgtctactgcattcacagcccaaggttaagaaagacctgtttatacccaagatttccatgtcctcttttctctttcacccttcaacccactccagtctggtttcacacgaactctccaccaaaatagactttttcatcacttgatgtcaccattcatcatctttcagtcctcttcattggtgatctctcagcaacatttgacctccattgaccacgttctctttcccttatcttttcttcctaccattcccattacttctttcagaattccctgcaggcttgtcctcttaagtctatttcgtgttggacttcctcaagacgaaaaactcctaaataaatatttacaattaaggcctcaaatctaaagagcagatccagagatttcagagcctgtttgatatcttcagttgactctctcatggacacctcaagtttaacaagtctataattgaacaaaatatgcccttcccccaccccttgcccccgccacacacacatggactccttcacatccagacttcctcttccattctgtgtctctgtaaatgacatcactcttcaaccattgcttgagtcaggaaacagagacttactctggatgcccaactttttcatcttctttattaagacatcacttttaatttatgaacacctccttgaattatcctagttccagtttccactgctgtaacctgaattcaagtcactttaacccctacctggcttacagcattggcagattgtaatggagctccatgcatggaatccagcagccatattgcaaccaaagcaaacttttgagaacatagatctacatcatgccagtgccttacttaaaattctgcattggcttcctataattctttaattagtgaccatgtgtttaatatagcccataatgccctttagaatttaatatctgcctcctctccagagaattctgatattctgcaccactcttctcctaagggtctttcagtatatcaagctccttggtatactgttccttggtatacttggaatattacctccaccttgaaagttctctgcatccgttgtaccttacctcatctcccattacctaaactattcttcaaagcttggtgaaaatgtcacttcctcagaagcccttcctgaccattcaggatcttcttgttatcctaactgtcattggcagtcgattcctctctgtcactgaatttagcacaattattaaataatgacttaaataactacttgtttgaagtctttctcatctgctataatagaggctttatgggataaagaactatatgtatattgttcattgctgtacaacacccaaaataataatttgcctgttacagaatttgtatgtatatatgtttaatgaatgaacaaatgaacaagtaataatttcaagagctaataccacgtatttctaaaaccactagcatatagttggcaccaggtaaatatttataaataaatcaacaaatataatgaaaatatacatttttgcttagtgttcctgataaaccttgaaccttgaccatattattaaccatactttttacaaaatggtgtctgctgttttttcctttggcaaaaggaattttctatcctcttgaaaacatacttacgagagaaaagaatttggagtgcttctagttcgacatactaaaggtgagggttgccattttatatctaggaaatgtcttcctgttagagtctatatatttcagattttaacgaaatgaggttgaataaaactttctgcaactcttagatttaactgattttaccattatattattttagttttttttaactgtcaagatttcttgggcaaattcatagtcctttgctgaattgtaacatttcccttaattatgaatttagacaacacaccacactagtaactagctataattgtgacttcaacagttacagaaaacacaaatatttcatatcattttacagttgttacaggcattttaaaatattatttttactcatccctaccttgaaattatggtagctattaaacctgctactatgttttgttacagaatgtgctaagagacatataaatacccatattacatttatttaaaatattgttaacagtattactggttccatcagaattctatatttgtttacttttaatgaattttaaaacattctgggacaatgacttggttcaccagattgccaagagatccctatcacaaaatgatcaagaactacagcattatgctatattttcagttgtgtcagtcattgtgtttagtgttcagaaaaactttttaaggaggagactctagtttttaaaagaaaggtcaaaatgaaaaagaatgtcacaagttgtacatttaaactcagttgtaacacttggtttttcaaatggttgtgcaagtgtcttgccttacttaatgtgcagtattctttttcgtccttactcttctttgcacccaaacccttctcacttcaggctgaaacagattttaatgtagagttgggtcactgaacacttgctacttcacacttctctgcaggaaaataattcttttggattaaattttttcacttctgctgtagggaataagtacatgtttgctgctgatgagaaagaattaacctcaggtttattctgttctggaccacacaaatctatgcttttgaatggaaggaggaaccaagaaccgcccttaacattttgtcacactgagagtggaggaattggtcgaggaatcttttcatggtttgtaaaggacaatcaaatccatccaattaaaataaaaaaaaatgatagcacaattagctctctcttcttaactggattgttttgttttggaatggaaattttcatttctcatggtcattactaatgcccaataggagaaaatatatttgaattctatgattgctattgaaataattatgatttcacttagtatgtccaccatggtacatggtcttcagcaaattagcaagtaatcatttgtctttgtgattgttttcaggtaatagttatttatgtaaatgtagaattttttatatgttgtattgatgaaattatttcaaaatgcagtacatctttccttactttcccaaatagtgtgtgtgtgtgtgtacatatatattcctgcctacattctaaaaatgatttaatcgtgactataagtattacattatgctaaatatggcccacttttcctgacagttgttagaatacaaaaaaatgcaaacaggcattggtattagggaagacattggctttgaagcaacatatctgggtttaacttctggctcctttgttaaacatgcagttttgtgaccctagacaatttatttagttacagcgcagtttactcaactgtaaaaagagggtgttaacactacctcatactacctcattaattgagaggtacatatcaggtacctaataaatgttagtgatagaattagtgtgttgtaaatgctgtcttcaggacaactgaatacttggtgttttttcctataaagaagatccactttagggttcttttgtctacttttagaggctaacatatcactgctaagagtatttgtaacctgtaactcctttcttatttttgctttggctttttcttcttctctttgtaattttggttcataatgttagtgttatgattagcaattcttttgttttacagccagggttacaaaggtattactacatgtctcttctatttgatcaatgaggtaataaattaggttatgatgcatgtaattattttttctgacagatccttttgtgtcttaggtgattttatgtcatctagggacttttcttttccacttggtcttgattgagataccatgaaactaccatggaaaataaaatgtaagccagggaggctttcctgtgtaatcttcgctatccctgaggctccccgtattatacatctgcaggaacattattacatcttagaagtgccaggagaaaatgggttggggtagaggtacgtgactcttcccgtggaagtggtttttcctctatggttgttcttctctggagccctctactcctgccttccctctgctcctttttggtctgctggtcctgtgggtcatttgccagtttcctctgagttagcaaccttgagtttttgtcctgctcattaaaaaagaagtccacagctcttcagtttgctccccaaggaatacagttctccagtcttatcgaactctcctctccagggctaacagccctagggcgaatatgagggaggcagactgtttcctagtagggtcgagcccagcccgaactcttttcttggtccacctgttcattctaaccccctgactccactgctccagctcaaccagcccatttgtatcaggtgtcttctcatttataatgcaacaattttccatgatagtcctgatgttcttttgatattttcatgtcaagttccatcatcccaagtccatcagaaagatggcacctctagaatacatacaaatttctttcataccgggtccatatttaagaatatgttgaaacctgaagttcattaaatagtatcttattgttataaagtctccttttccaccacccacccactgccacaaataaggcactaagtaaaattctaacataacctattcagctctaagtcaaaacttgatgctacaaagtaagtatatgtataacacatcttgatgtttttaacatttagatatttttaaggatttttaaactattttcatcccatttgacgcttttttccatatatagttcccattactctttctagatttgtttttattttttcaaatttttgatatcaaaaatgtatttagttcgtgacctgcctgggtaacatggtgaaaccccatttctgcataaaatacaaaaattagctgagcatggtggtgtgtgcctatagtctctactactgaggaggctgagttgggagggtcacctgagcttgggaagttgaagctccaatgagccatactgtgaaactaaacgctgcactctagccagggtgatgggagcgagaccctgtctcagaaaataaatgaataaattataaatagtatttctatattcatggattttaaatgatttttttcactagcaaacaataagtcaggatatataactaaatagcatagttagataagaatagtgccaacatgcttagattaatttgggaacatcaaaaattataccccatgtgaaatgataaggtccatacactacgtttgaattttaaaagtattattgtatattttttctatagaattatgaattgattgttttgatatcttttgcaccaacaagttaatttcaggagagtaggtttgcttgtaaactatgagaaatatccaatttcaatggatgtgaaggagataagcacatggagtatgcttcagtgcacagaacagcagttttagtcacaggaatagatttgataggaatcacatttggctgtaacaagaatctacatatggaacaatgtacaggataaattctccacttgcaggatcaaaatgtaaggtggatttaaatatcttccaaattttggaactccacataacacaatttttctttctgtttgtgaatagagaagaagcctgctggagaacaagtagagaaactgagactccaactctttctttaaatttggttcccttattcaatgtgatgattgatatcactcacctgccatttaacttaatactgcactcttggcaagggttagtctccattaggctcagcaggtgatatcatcactgtctgtatgattaaatgacacttagtaatatggatttcccaaattgtgtagtatcttcctagtatgtcatcactatccccattttatagccagaacacaggtgaatttggctctgcagtgaaaggttcaggtagataaatacgagaatgggaggttttcatttgctattggcattgtttaacatgcctaaaaaattgttttattgcccagatgttggaaatgtattaattatcgtattggctcttgggcctagttcttgcaagaatgatagtagatgccagaagctaaataaaccttttgtcatactgctgaataaaggattgtttgtgctctccagttgataaattatctttgtgccttgtcgttataaaaagaaactcatcttgttcactagtctgacaggagatgagaaggccctagagagagcacagagagtttttcctttcacaaatcacatgtaggatgtatgctgtgggtcctgtctggaaatgaatgtggaaagaatccaggatgaagcatacaattttcattgttactacttggtatatgatagattattacaaattcgcgagattaaggttttccttttactcatactgacttatcttaaatctaggaaccaattctagcacggacaaatgttcttttgtgcatagttgagaaagaaaaggatagtttaaatttcagtgcagctaagataatatcagtaattttatggttattctatgagtttatgacagggatttatggaagcatttgatatgaaggcgtctcatttagtattgaagagaaaaagcccagctattcctttagaccagtgtttctgctaaacaaaatgcactgaaacttgcaaacgacaagttgtttttgtttttgttagtaataaactttattttatatagcctgttttaggttcacagcaaaactgaggagaaagtaaaaaaggttcccatatgtccccagtccccacacactcaccacctcccccattattgacagacaccctgaactcagttggtacctgcattgatacatcattatcacccaaagtccattgttaacattagggtacattctaagtgttaacacgttctgtcgatttagacaaaggtataatgatttttatcctgttgggtgttccctgagcttccttgatctgaagtttggacattaatgtggggaaattatcagtcattattgcttcaaatattgcttctgtttctttcttttccttctggtgttcccatcacatgcttgttagaccttttttggttattctacaattcttgaatattctgctttgttgtgggttttttcagtctttttttctctttgcttttcaggtttggaagtttttattgtcatatcctcaagctcagagatttttttcctcagctgtgtccactctactatgagtttactgaaggcactttttatcttaattctttcttagaattttcatctctctgcttacattatccatctgtatttttcaagttgcctacttttttcattaaagttctttgcatattaatcatagcttaaaaaattccttaccttataattatattgcagggtattttcttgaccccttcctaagattcatgacaggggtgcatcacttaccaagcccacccactcaacccctcatgggtggaagcatgcaaacaaacaagggcaggaaccagcctctttggtgctggaagaagtgaactccaggcaggcccatgggagtgtccaggtcagggtgcctgtgacctcaagaccccagaggctgagctctcttagctctgccatctgtagacagcagtgtgttatcagctcagtgggccctttgtcttgtagcatggggcagctgccttccgccagcaagggcaaagtgtcagtgtgacagcctttttgggtattcacacccagtgcatcttgaattctagtctggtgcccaagaggattgaggtcacatggacgaattgaaagatggtgaatgtggagaattttgttgagtgatgaaagtggctctcagtagagaggggagctggaaaggggacaggaagggaagttactctcccctgaagtcaagccacctctctccgatgtccagccactgtctctgaagtcaagctgcctctctctgacatccaggtgcttcttcccgatgtccagctgcttctaacctctgccggctgagtctggggtcttataggcacaggatggggacaaggtgggccataggtagttttcaaaaaggaaacattcgattgataaaaagacattattcagaaagaaccaatcgggagagagtggacacacagggatggaagttctcactttgggctgcgagtttcaggctttttggttcaaaggtggggatttgccagggaccaacccctgtctgcctagagtttctctgcacctgtcactgtcagttacaacatttctatcatatctgactctgttctgacatttgttctgtttcatttttgcctttagtatgtcttgtaatttttatgttgaaagatgagcttgatgtatgggtaaaagaaatttcagtaaatatatcttcagtaatgcaaagtaagacgtgaaaagaggaaaatgtttcagtcttacaattagatctcagtcttttggtgaccccctatccctggactgtgaactttcaaacacttctcaggtcccccacctcccaaagtgggctaggaaaactagaggaagctggagttggatatttcccttcccctaactgcgttaggctctgataaacattggcacattaggttctggtaaaatagtttctcctgagggcagactttgttacagaatgttctgatgtatttgaaatggctacaattcccctccctctactgaaaatgagatttttttttcctttgataattgctgtgaggaggtggtagagctcctgtaggtaaaactcacaaaagaacgggtatgcccctatgactaatcctttctagacacttttggaacaagtctcactttcagacttgttcaaactgagccttcaccaatttgtcatttacagcttaggttttccttacccagcactgcttccagtggaggtttatactcatggatttctgctcaggtaagttgtgattttctatatttgcctttctcaccaatttttgaagcagtggtttgccctgtaacctcacttctctgattaatctaagaaatgttgttgatttttctgtttgttcagcttttcataagttgttaacacagaatggcaacttctaagctccacagataccaaagtagaaaccaaaagtcctggttttcttaatgaaatatgttctcattttttgatgaataaaatagatatgttctcactgtttggtgaaatcttccatcactttcattaatatatgtgttggctgggcatgtggctcacacctgtaatcccagcactttgggaggccgaggcgggcggatcacttgaggtcaggagttcacaaccagcctggccaacatggtgaaaccccgtctctactaaaaatacaaaaaaattagccgggtgtggtggtgggcgcctgtaatcccagctactcgggagcctgaggcagtagaatcgtttgaacccagtaggcagaggttgcagtgagcagtgtgttgtgttatacattgtgtaacaatgtaacgtgttacattaacattgctgtgtataatgataccatgatatcatgttaagttactcactgcccttctaaaacatactgactgcacacataaacaatgctcagtacataagtctgatgtattctgaatgaatcatatgagatttaatgagtatgtttttaaaagtcatacagggttgtattgaagaataattacctgaaatttatctattttttgagatttttaaaaatgtttgtttcaatagttttttagggtacaggtggtttttggttatgtggataaattcttttgtggtgatttttgaaattttagtgcacctgtcacccaagcagtttacactgtaccaaatatgtagtcttttatccctcaactccctcccatttttccctaccccaagtacccaaagtccattatatcattcttaggcctttgtgttctggtagtttagctgtcacttgtgagtgagaatttatttatttattttaaattttaattatggtaaaaccacttagcatcagatctaccctcttcacagatttttaagtgtacaatataacattgttatgtataggcacaatgtcacacagcacgtatcaagaatttattcatcttggaaagctgaaattttgtgcccattgatcagcaacttcttgtttccccataccacttagccctggtaaccacaattatattgtttgcccccttgaatctgataattttagtacctcatgtaaggggaatattgtggtatttgtccttctgtgattggcttatttcacttagtacaatgtccttactttaatccatgttgtcacatatggcagcatttccttcttttctagggctgaatagtattttattgtatgcatataccaaagtaaattttttatgcatttatatgttgatagacatctagattgttttacatttggctattgtgaatagtactgaaataaatatggaaaaaatgtctcttagaaaccctagtttcaattcttttggataaatacccagaatgggattgctgaattatatggtagttctgtttttattttttgaggaaccttcaaacagttttccacagtgactgtaccagtttacatccctcccaacagtgcgcaagggcaacaatttatccacaacctcaccaacacttaccttttctgtttttgataatagccatcctaacaggtgcgacatgatatctcattgtggttttgacttgtatttcctcaattattagtgatattgagcatcttttcccacccgttagtcatttgtgttttttggaaaaatgtctattcaaggttttagcccatttttaaattaagttattacttattttattattgagtcccttatatattttggagtttaaacgcttatcagatatatgatttgcaaaagtttcctctcattatgtaggttgctttttcactctattgatcatttcctttgatttgcagaagatttttagtttgctgtagtcccacttgtctatttttgctttggttgcccatgcttttggtgtcaacattcatcaaatcattgctaaaaccaacgtcatgaagttttacccagtgtttcttctaatagtttcatagtttcagatcttacatctaagtgtttaatatattttgagttgatttttgtgtgatagaagggtccaatttcattcttttcatgtgaatattcaatttttacaataccatttgtgaagaaattatcgtttatccattgtggtacttggtattcttttcttttagtttttaatattttatttttatactcgtagccctcatttcctgaagattagattggcattcttgctgaacatcagttgaccatatatgcatgggtttatttctggactcactattctgttccattcttatatattatctgtctgtatgccagtagcacactattttgagattcttcatttttatcataaaagggtcttgaattttatcaatttttttctacatttaatgagagaccatatgatttttatcctttgtgaactccattttacaaatttatttttttgactgctaccttcaatttagttttcttagattgtcattgaccttgtatatatagaatgtaccatcttgggtgcttctaaaaatatgctgatgaggaaatcatccctgatgatagtgacagattttttaatggagcacataatattaaaatagaaggaataatacaagggtaagagtttggatattctaacttactattatgtattgcattctctaattcctttttattgaatatactgaaatcaatatgtctaatccatacaactctcttgagttctagctccaccttttcatatactgtcttcatatctccatctagatagccagagatttatcaaattccaggtgataaaaacagaattcatgcttctcctacaatatactcctcttcctgaactttttgtatcagctaatggtatatcactcctcttgaactctcacccaaactgttgaaatcaccttccaacttttccttccacctccagtctcttctatctttgacatagatgccaataattatctttctatattgtaagcattgctatatctattgccccctctaaaacccttcagtggctcatcattgcctagaaaacaaagtccaggtttctcaacatcacattcaagaaatctgcctagctgatcaactttatgtatgttcttcatacagtattttcatggtattctctatcagacatattgcttcccatcattctgacaccaatagggcttaggaagtgaaagagtattagcagaagaccatgattttgagccaataaattactgagtataaaacctgacttcaataatttggtagtaatatgaataatacaaattgattagctttatctacttcatagaattatattaaggattcaaaagactgattctatttatatacatattatcttactatcatcactctgtacttaatgtattaccattctattcatatatctttaagtattagatctgccacttagtaggcaattaataatttgttaatgtaattatcctcatcagtcatttgttatgttctcataaaagcttcttctagtttctgttagtgaatttttgacacgcatcaagttgttcaaagagggatatatgcacattgttttataattccttgtgttcactatctatctcttccagtatgagtttctcatggcccttaaatgaagtaatgagaagggaattcagtgttagaatagaagatgcatggaggaattagttgcagaacaaagaagggcaaacacagaccactcattgtggaagtttattcatagctactattatttttcacttccctcactctcagaaaacttcttgcaaaatatctctcactctgtcttctgaatctcagtactctctcttactcctcaaccaaagacagtatgaattctgtacccactactcattgataaaattatttattcaaaacatacaatggactaatatatatatatttcactatatttcacaatataagtatatatagagtattgtgtcctctgtcacccagtcatgcttttccccatcctggggacaattcctgtgattagttttcttttcatccttccatatacagtctatgtattctcaacatctatgtttatatgtatgtgattctttaaaacattttatacagtcagcagcataatgcacttttctgcactttgctttcgcaaatttatctatctatctatctatctatctatctatctatctatctatctatctatcatatctatctgtcatctatctccatggtggtaatatagcatgccctattttctaaaccttcatgaagttccaatatatagatgtgttatattttatttaatctgctctacactagtggacaactagactgttcaaacctgtgacataaaagatatcactacaatgtatattctcatacaaccatccttttgtacacatgagaaaagcctttaaatgagaaattagatcaaagggtgtatctgtttttaattttgaaaggttttactaagttgtctcatcagaaactgtactactggtcacgttcctaccagctagatcttcaactgccttcaggcaatgatatcagtgcagtgtgttaccagacaaatttctttttgccaaactgattggttaaaaagtatcttattttcatttgcatttgcatttgtgctaatataagaaagatacatttttttcctaagattaaaagccatatgttgacttttttttttctttttggtaaacagttcacatgctttgctcattatttttctagtgagctagggattttttgatgagctgtttccaaattatacagagttatagatatttatatgtatatacatatatagttacatttactgtaactaattatatgtaggtatgtgtatacatagttatagttatatatacttatatattataaagtatatatgtatgcatgtattatatatatatgagtatgtgtatgtgtgtgtgtgtgtgcatgcatgtgtgtgtgtgtggtgtgtgtgagatatgagttgcagatatttccctcatttatctcttattttctgactttgttcatggagtttttcctcctgcttttgagaatcttttgtttcctgcttctaacaacctatgctcatatgtgtgagcaaagaaataacataaaactggaacttatatttaaagaggaagcagagtgtaaaactttgaaaaatgtgcagcccagctacgtggtagaaaagaaaaatccattttcaggggagaaattcaagctggctgcagaaattcgcataactaaaaggaaggcaaatgcttacacaatgggggaaaggcctcgatggcatttcagtgaccttcacagcagcccctctttacaggcccagagaggtctagaaggatataatgatcttgttggctgtgtccagggccctgctgtcctgcacagcctcagaacactgctcccttcatcccagaagcttgaactccagccatggctgaaaggggcccagctacagctcaggtcactgcttcagagggtgcaaactataagtctttgcagctttcacatggtgataagcctgcatgtgtgcagagtccaatagttgagtcttggaagcctcagcctagattactatactatgtatggaaaagctggaatgtccagtcagaaagctgctgcaggggtagggccctcatggagaacctctactagggcagcatggtggggaaatgtggggtgggagcctccacagagagtccccattgggacactgcctaagggagctgtgataagagggccactatcctccatactccagaatggtagatctaccggcagcttgcaccatgaacctagaaaagctgcaggccctgaacactagcccttgagagcagctgtggggactgaaccctggaaagccacagaggcagagctgtccaaggctttggaaacacaccccttgcacaagtgtgccctggatgtgggacatggagacaaagattattttggagctttctatttaatatttaatgactgtcctgctgggttttgaacttgtgtggggcctgtaggccttttctttttgccaatttctctcttttggaatggattatttactgaatgcctatatccccattgtatattggaggtaactattttttttttttttattttacacccttttaagtgactttccttatctcagatgagagtttggactttggacttttgagtaaatgttggaatgagtcaagacttttggggactgttgagaagggatgattgtattttgcagtgtgaggacatgatatttggaggggccaagggtgggatgatatgatttgtatctgtatccccaccaaatctcatgccaaattgtagtctgaagtgttggaggtgggacctggtagaatcatgggacggagttatcatgaatggtttagcgtcatcctcttggtgctgttctcgtgatactgagttcttgtgaggattggttgtttaaaagtgtgtagcaccttcctcctctctctcttctcctgctttggccatgtaaaatgtgcctgcttcccctttgccttctgccatgaatgtaagtttcctgaagcctccacagaagcaggagctgctatgcttcctatacagcctgcagatccatgagccaattaaacctctttacaaattacccattctcaggtatttctttatagcaatgcaagaatggattaatacagtcttgtaacatgctgctggattctatttgtacttagtccaatataacaggagtagatgcaaaattttgttgagatgagaatgaacaaatatagggacttgatattgataacctttgtcatttcactgaaataaaaggagtgataatccatttagtcacctagcatttgtaaagcccacactagaaaacaagtactgagttaatgctggggctgagaatatggaaagggcattatttctgtcttcaaaagcacacagctgagtgagtcagaaatatattcaacaaatcataatgtagtgtggtcaaagcttttgtagtaataggaccatgaaaaatcaggggccagcataacctagaatgtttgagggagttgcaggatgcataacaggtagtgacatataatctggcttggagactaaaaacttagtttttggagaaacaactgggtggagtttgttaaggaacaaacaaacagaagagatggttttaggtaacccagatagtaaaagaagagccaatttgaatttaaagcatatttttagagagctacttttataactagaattattgaatacaatagatgaaaagaaacttaggactaatctcatttttgtggccacctcggttggcagcatccttctttagcatgagaggtgaaatagtgagatggcaattgaagttagcaggcataataaggctggatagtgttcagtgtgtgtgcaagagtctaaggagtttgtaaggcattatgggcatttatcacagacaggagtaaaattgctatactatgtgaagagaggcattaagaataaacacattctgctggtataagatgcaagaaataattcagatagggagactgtatatctagtatttaataacctgctgctgaatgcatggcagacaacatacatataatatcctctaattcacagaaatcctgagacattggtatttcataagtgaagggttagatacactgtataatttgttcaagtcaaaagctggtgaatgacagagccaggattagaatgaagatatttgagactttggtgaagccacagatcacatggagaagtgtgtaagatctccatagaggtgctagccttctatccctacaaactttacttgttaaaaccatggttctccttgtagacaatatatgcctaaaagtattgaacacccaaatgaggcagtgattcaaaaagagagtagtaaagcctagaatcagcactgtacttatggcctggtgccttgtttttcactaatttttcagatcacaaattctgagccttttttctgatcctcctagttatatctgctcccatagaaagtttgaccttttatttattaacactgttacttccagaacctcccaggctgattaggagctctgagcctagtaataataataatgaaaatactcctgtagcatttattatttgcttgacattgttctaaacactttacatactcgtttaatcttcacagttaatactatgaggtatattctacagcattaagaacagtcacagagcttctaatgacagcaggatttgggttcagattttttaaaattttaaacatgttttatttggaagaacacaataaattctacttgtttttcaatacattctatgcattttcttaaattaaattacattttatattcaggggttacatgttcaggttataaccatagtagtgggtaattactagttacactagaagcccaatccccaccactatagcctaactgtcacagaaagaatgaacattgtgtccgacaggtaattttcaactctctgcacaccttccaagctccttatcttttgaagtccccagtgtctactgtttccacttctatgtccatatgtacccattgtttacctcccacttgtagatgagaacatgcgttatacattgattcttttgtctatgagttatttcacgtaggataatggcctctggccccgttcatgtcactgcaaatgacactgtttcattcttttttatggctacacagtattccatggtgtatccataccacattttgtttatccagtccaccactgatggacacttagatacttagattggatcactttactcttgcaaatagtgctgcaatgaacatatgcatacaggtgttgttgttgttgttttgagacagagtcttgctcagtcgcccaggctggagtgcaatggcatgatcttggctcactgcaagctctgcctcccaggttcacgccattctcctgcctcaggctcccaagtagctggaactacaggtgcccgccactacgcccagctaatttttttttgtatttttagtagagacggggtttcaccatgttagccaggatggtctcgatctcctgacctagtgatccacccaccttggcctcccaaagtgctgcgattacaggtgtgagccaccctgcctggccattgttgttattttttaaatacaattatttcttttcctttgggtagatacgcagtagtgggatttctgggttgaatggcagttctgattttagtcctttgagagctctccctacagtttttcatatgggtttaactatatttacattctcactaacagagtataagtgttctgttttctcctcatccatgccaacatctttgttgttttttgactttgtagtaatagccattcttattggtgtagggttatatcaccttgtggttttaatttgcatttctctaatgattagttatattgagcattttttatatgcatgttggacagttgtatgtcttcttttgaaaaatgtctcttcatgtcctttgcccacattctaaaaaatgaggttatttgtttttgttgttgttattgagatgtttgaattccttataaatgcataatataaaaatattttccctcactctgcacattgtctgttcactgtgtcgaatatttatttttctgtgcagaagctttttagtataattaaatatcatttgtctatttttgtttttgttgcatttgcctttgggatcttcatcatactctttttgcataggcccatatccagaagagttttccgagcttttcttctagaaattttatagtttcaggtattatgtttaaatattttatccatcttgagttaatttttgtatatgatgagagataaggatccaattttattcttttgcatatggctagccagttttccgatcaccatttgttgaataagatatccttttcccattgtttatttttgtcaactttgtcaaagattagtgggttatagatatgtggctttatttctgggttctctattctgttccgttggtctgtgtgtccatttttgtaccaataccacgctgttttagttactatagccttatactataatttgaagtcaggtaatgtgatgcctccagattttttcttattgtttagtattgctttagctatttaggctcttttttgattacatatgaaatttttgattgctttttataattctgtgaaaaatggcattgaccatttgataggaattgcatttaatctgtagattgctttggagagtatggtcattttaacactattgattcttcccatccatgagcatgagatgttttctcatataatttctttctttccttttttttttttttttgagacagagtcactctctgtcacccaggctggagtgcagtggcacgatctcggctcactgcaagctctgcctcccaagttcatgccattctcctgccttagcctcccgagtagctgggactacaggcacccgccaccacgctcagctaattttttttttttgtatgtttagtagacacggggtttcaccatgttagccaggatggtctcgatctcctgacctcgtgatctgcccgcctcagcctcccaaagtgctgggattacaggtgtgagccactgtgcccggcctcatataatttctttcattagccttttgtagttttccttatagagatgattcacctccttggttagctatattcctagatattttattttctttgtgcctgttgtaaatgggattgtgttcttgatttgactctcagcctggacattattgttgtgtagaaatgctactgattcttgtacatagattttgtatcctgaaactttaatgaagtcatttatcaagtctaggagttttgcggacgaatcttaagggttgtccgtgtatacaatcatgttatcagcaaacagagattacttggcttctcttttctaatcaggatgtcttttatttctttctcttgcctgtttgctctggctagcactccttgtactgtgttgaatagtagtggtgagagtgaatattcttgtcttatttcagttcttaggaagaatgctttgagtttttgcccattcattatgatgttggttgtgggtttttcatatatggttcttactgttttgaagtatgtttcttcagtgcctagtttgttgtgggtttttatcatgaagagatgctggattttattaaatgctttttctgcatctattgagatgattatatagttttggtttttaattgtgtttatgtgatggatcacatttattgatttgcatatgtgaaccatccttgcattcctgtaataaaaacccctgcccccaatcatgatgaattatctttttggtgtactgttggattcagtttgctagtattttgttgaggattttgcttgtcttttcatcagggatattgtcctacagttttttgttgctgttgtgttcttacctgatcagagggttgctggttttatagactagttataggaggaatacttcttcctcaggtttttagttagagaggaattattctttcttgagtttttgaaatagtttcagtaaaattggtaccagctccttttatgtctggtagagtttggctgtgaatctgtctggtcctgggtgggttttttgttgttgttgttgttgttgttgttgttgttggaagatgttttattactgatttgattttgtgacacattactgatctattcaggatttctatttttttcttctttaatcttgggaggttttatgtttccaggaatttatccatttcctctaggttttctagtttgtgcacatggagacattcatagtattccttgatgatctttgtatatctgtggtatgagttgtaatgtcacttttatcatttctgatatgtactcatttgaatcttctttttttcttggttaacatagaaatttatcctttctaagaacaaactttttgtttcattgatcttttatatcttttttaattttcagtctcatttaattgtgctctgatccttgttatttcttttcttctgctagctttgggtttgaattattcttgtttttctagttccttgagttgcaacattaggctgttaatttgagatctttctatctttctgatgtaggcatttaatgctataagcttttctcttatcactgcttttgctgtatcccagaggttttggtatgttgtgtctctattttcattcatttcaaaaatgttttttgatttctgtcttacttgtgttgtttacccaaaagtcattcaggagcaggttacttagttttcttgtacttgagtagttttcagagttcctttctggtattcatttctaattttattccaccatggtccaagaaaatagttgatatgatttttatttttttgaatttattgagattttctttatggccaaaaatatgctcaattttggaaaatgtaccatgcacaaatgagcaaaatgtatattctgttgttgttggggagaatgttctgtaaatatctattagatccgtagatatttagtatctatgggtctgtgtactgttgtcagtggggtgttgaagtccctacttctgtattattgaattgctttcagtctgttttcttaggtctagtagtatttggtttgtaaacctcggtactcctacgttgggaatatatatatttatagttaaatcttgttgcattgagtgctgtatcattatataatgcctttccttgtctttttttttaactgttgttggcttaacatctgttttgtttgatataagaatggctactgctcttcattttttaatttttaaatttccatttgtgtgatatatctttttctatccctttgtattttttaaaatgtttaaattgttgtgggtacatattaggtgtacatatttatgggtttcatgagatattttgatataggcatccaatgcataataatcacatcagagtaaatggggtatctattgcttcaagcatttatcctttgtgttacaaacaatccaattatactcttttagtgatttttaaatgtacaattaaagtatttttgactgttgtcacccgctatgttagaaaatattaggtcttattcacactttctaacaattttttgtacctattaaatatgcccgctttccccactaccctttccagcctctgctaaccatccttctactctgtcttcatgagttcaattattttaatttttagctctcacaaataagtgagaacatgcaaagtttgtttttctgtacctggcttatttcacttaacataatgacttccacttccatctatactgttgcaaatgtcaggatctcattcgtttttatggctgaattgtattccattgtgtatatgtaccacactttctttatccattcatctcctaatggacacttaggttgcttctaaatcttggctattgtgaatagtgctgcaataaacatgggaatgcagatatctgttggatatgctgattgtttttccttagagtatatacctagttctatttttagtttcttgaggaacctctacacctttctccacagtggagaaccttgacagcaacagtgtatgagggttcccttttctccatatccatgccagcatttgtaattgcctgatttttggataaaagccactctaactgaggtgaaaaagtatctcatcatagttttgatttgcatttctctgatgatcagtgatattgagtacctttaaatataattgtttgccatttgtatgtcttcatttgagaaatacctattcagaatttttgtccatttttctttttttctttttttttgagacggagtctcgctctttcacccaggctggagtgcagtggcactatctcagctcactgcaagctccacctcccgggttcacaccattctcctgcctcagcctcccaagtagctgggactacaggcgcccgccaccacgcccggctaattttttgtatttttagtagaggcaaagtttcaccatgttagccaggatagtctcgatctcctgacctcgtgatctgcccgcctcggcctcccaaagtgctgggattacaggcgtgagccactgtgcctgtccccatttttaaattatattattagatttcttttcctatagagttgtttgagctccttatatattctggttattaaccctctgttacatgggtagtttcctttattttgaatctgtaggtgtctttaggcattaggtgaatctcttgaaggcagcagatggttgggtcttgtttttgttggtgttgatgttgctttagtttttttaaatccaatttaccactccatcttttaagtagagcatttaggtcatttgtgttcaaggttaatattgatatgcaaggttttattcctataatagtgttgttagctagttgctttgaagtctcaattgtgtaattgctttatagggtcttctatgagctttgtacttaacatgtccttttatgacgatgagtattgtcctttcatttccatgtttagaacacctttgagcatatcttgtaggttcagtgtagtggtgatgaattctcttagtgtttgcttgtctggaaatgactttatttccctttcatttatgaagcttagtctggcagggtataaaactcttgactgacaaaattttttctttaaggaggctaaaaataggtctcaatgtcttctggctgagatgtttgcagtctgatgagattccttttataggggatttgatgtttctctctagctgcttttagaatttgttattttacattgaccttgcatagctttataactatatgccttgatgatattcatctagtatagtaacatccagttgttttctcagtttattgtatctgaatttctgcatctctagcaagatcaaggaaattttcctgcattattccttcaaatatgttttccacatttcttagtttttcttcttctctctcaggagtaactataattcataggtttggtcacttcacataattccatatttctccaaggctttgtttattttttaaaacatattttctctttacttttgtctaactgggttaatttgaaagaccaatcttcgagctctgaaatgatttcttctgcttggtctagtctactcttaaagctttcaactgtattttgaactcatttaagtggatttttcatttccaaacgttctgtttgtttttgtttttaagacatctatctcttccttcatttcctgggttgcttttagggtttctgtgtgttggttttcaaccttttctttgatctcattgaattttcttacaatctatactttgaatttttatgtaatttccgaattttcattttggttagggtccattgctagagagctagtgtgatcctttgatggtttcacagcattcagattttacatggtaccagaattcttatgctggatccttatcatctagggaagctgacacttcttgcttttgaagttacttttgtttggatggaactttaaaaatctatctttattttatttatttcccaccccaccttgaggatgtgactgtacagtatgttaggtaggggccttttggctttgcttctatggtcctgtgcacttctgttggcaggttttatattgcattgtgtggtttgacctaccggccagtaggtggcacttccgggtaagagccagcagcgcaaaagcaggtgagtacgtacttgacacttgtttactgtgaggtgctctctgttgtttcatgtgatgggctgggcagccctgttcggggtgaaggggggacaaagatgggcagatctgggccacctggcttgcccatgaatactccaatgaagagcacaagcaccagacttaagggggtgacagtgggggctcctggttaaatgcactgagatctttgctggggttgaagaggctgcaccagctgcatgccctagatcggcaagaacttgatctgtttatcacacccctgtcctgggggcttgtgactcttagttcagatccacaccatttgtccatctatctctaggccacagtgcagctgaatgccgtgggaaatgcctgaccctcagctctcagtaggaacggttttggggtggaacctctttgttccacccaataaagacggctttgtggctaacctgttcgtcaatgcagtaatgttgctactttgtgtagagaaggggaggatacctttcaggatgtgcgtgaggctgggtattagctgtggtggagttggctggttgggttgaccggcctctagccctgggtggagtggtcaggtgtcagtggtgtagaaatggactaggtaattccccaactcccatgttcctaacttatggaacactttcttttccttttttttttagatagagtcttactctgtcacccaggctggagtgcagtggcgcgatctcagcttactgcaacccccgcctcctgggttcaagcaattatcctgcctcagtctcctgagtagctggtacagttacacaccaacatgcctggctaatttttgtatttttagtagagacaaggtttcaccatgttggccaggctagttttgaactcctgacctcaagtgatcctgctgtctcggcctcccaaagtgctgggattacaggcgtgagccaccatgcccgaccttatggggcactttctgtgtgcctagttgcaccagccttgttttcattcccactgtgactctgaggtaggtattatgatccccatttggtcaatgagaggaaggaataaaggacactgatgagttctatgtgttgtcgtcctggaagagagagggtgtggatgaatgaaacagaagttaaactcacctaggggagagatattttctgttggaaagtagtagatatcaccctcaaacataaaagctattcgtgagggtaattttctgaggtgagtttagttaaattacttacagatatttaaccatatgagtgaattaaaaattttcatcatatttacttaatttagtactttttattgaaagctgttggcgttggtcttctatcagcagagaaaacattattgagttgttatttaaagtgttaatctgatggttctttaatttttcacctttctactaaaaaatctgatttgatgctgagcaaatgcctgctcttttgttttaattctgaaaacagagtttaaataattactttctaggctctttatagttcatcatttttcttttgtcatttagtttataattatatttaaatgctctttgctttagttaaaattatttttactgttcgatgctcattttttaaaatgagtttttaaaagtattttgggttttcttgggctttgctttaattgacataattttccagttctaccattttctgaagcttttaaaatcgttctttcttctaaaattctcactttcatttttgctagtgtttgacctactctgctcttcatttttagaatatacaattactttattagaaaaaatttatggctgtgtattgtgacacttacttttctttaaactaacatgcactccataaattttatgtttaagcatacaaatctaggtaactgttttattttgcctttttattgctattatttcctcaaatactttgatgccaagaaaattggtgaaaatatatagaggaatagcacttggagaccttgatttttcaagaactttaaagtttggtataaatgtagaaaaatagtgtataagcaaaataacatggtgctgtgatggacattgcaattttttaaaattttatattattgcttattctctaggatgtttaaaagtacaagaaacctttatgatattcaatttttagaaaaaaatctttacttctatttagatttttattccttttgaaagctatttctagcacatatgatgaacttgatttttattcacttttatttttcttaaaaattgtatttgtttttacctgtgtgaaatacacacacacacacacacacacacacttctatggaaatcatgttattagtcagtcaagttctcatattctttattccagctaaactttcaactacctataaatctcatgctttatattcaaagttaagttaaccaattatttaaacatgtaattctcaacagatcaaagatttcacctttgattggcagccagtctaaagctctaccttacatttgattcttttaagcctccagggaggatatttgatccttttctaagtcctctgctcttttttgccctcatgccactcatctccttgtaaaatcctgcatttcattattagctttacacagacccacaaatggctgttttctcttattaagtttccccgggctcttcagccaaagtggagttctattttatagaagtgcatttcaactcctactattactattgcctttcactcattgcttcaatttcctcttcactagatttcctttgaatttcctttaatttggcctcttaactcatgaattcgccaaagctatacttccaaatgtcactaataatcatttcttgttaaaatcccagagcttttactctgttcttgtctttctttcactcttgattgctttagatatgtttaaaagtctctcttcatttgctatatacatctttcagttccaggaccctagagaatggtagatatttgatgccatctctttgagatacatctgttaaagaaaaccatatatattatttggtctcttagggcaaattgtggatatttcaaggtatagctatttccaggattggaaatgtaaaggataattgtaattaccttcatattcctaatgttctatgccttctttattttgcattttcgtatagcctattgaacatatccactaggataacccatagtcgtcttaaagcaaaccagaatttaccaactccttcctatttctaagccacttgtcttacttgtatatgtgtgtttcttgaagaaatcttcatgattaaggagatactataaattgtctgtttcatcataataagcaaagtccgatagagtagtcactagtaatgtgtggctgctgaacacttgaaatgtaactggttacatttgtttcttttttatttctaaggttggccacttaaaaatttaaaattacatatgtggctcacattttatttgtattggacattgttggtataggttatgccacagtcataatcacaaaaccttagtgactcacaagtacaaatacttattctccctgatactccatgtttattgcaggttggctgaaagttctgctcgatatctccttactcctgaaaccaagttgatggagcaaccatattctaaagactgccaacagtgggatagagggaaagagaactctagggatcttgcattaaaaatgaaatgctgtggcctccagctgattaattttgcatgcgtattcttgattcactgaccagaataagtcccatggtcctttcctgtagttacttagaaatgctattttggcaatcataccattatttattctagcataatggtaattattagatttaatctttagaacaaccttacattattttcagtttctgattagagcttagttattattggataactcacacaaaactgttatacttcaattaaatctgtattagaaaatttaaaaaagcaaacattggaaggtgtttacttatcccctttacttacagattgttttcttcataatttttctcaaagaatttttaattcttcagaattctacagagatgcatgcccagtttaacagagatttcatagcaattaacactgttataagctgtaatgactggaaaaacacagaaaataattgagttatttattaccccatgagtatgcaggcaactccccattctctgagatgtggcaggtcttaggatcacttggttcttctggaaaataaagcccgtaatcttatttatggaagttctcccatggctctctcagagaaaggttgtgaaatcctgtatgacagacccactctccatgaaaatgaatgaccaaacgacatgtttgacacaatcatcaaaaaatatccttaagatacaattacgtatagaagcaaggttgatcatgtagaaaggtcttggggccgggctcggtggcacgtgcctataatcccagcactttgggaggtcgaggcaggcagctctcgagctcagaagttcaagatcagcctggccaacatggcaaaacccagtctctactaaaaacacaaaaattaaccagacctcgtgatgcgcgcctatagtctcagctgcttgggaggatgaggtgagaagattgcttgagcctaggaggtggaggctgcagtgagccgtgatcgtgccactgcactccagcatgggtcacacaatgagactctgactcaaaaaaagaaaagaaaggctttggaacatgggctttttagccagaaaacatcttcatggcaccatttgctaagtgactttaattaaagtacttaagcttattcagtcttattcctgatcaggaaaatggggataatgcttaccttgtaggtttattatgtgtctaacagtcttctggcacatattaattccacagctattttaaaagaactataatgtaatttcatatcctaattggtggccacataaacaacatattacttttcagatagattcttttgcaaataagtgtcctcattaatttcttaatagtgttttcactttatcttgaaattataaatcatgttcaatttgcccttctactcggattcttgatgtacctttactatatattatcaaattcattaggttgcccttcattcaaatcactgggggcttttcttcaaactggccccagctgggtctctgtcttcaatcatttctttctgtctctcttccccccatggcactttgcttatgccggtttcatggcaattattacatatgcccttaaactatactcttgtatacaagaattattgctctctaaatcttatgctttctagggcaggagctataatagtaagaatcaactaaaatgaatggcaaacctattccctactaagttttctaatttctttatctcaatttaaatgtctaaaggacataaagaagtgggaaattaaggccaagacagtaattacccaaggccacaccaatacaaagtggcagagccaggattcaaatccaagttggcttctacctaaaacttaacttttaaatcagtttccacatttcctttcctcacacctgcccaactctggtggagctccccaccccctgcaacattcaacataaagccttgattcatgcttttaattgattaataaataaattcaaatttccttaactatcattacttttattagtaagcagctgttatgttctttgcaaacactgaagggaacaaaagcactaataacttacagagaataataccactctcccccaatcacagggcatgctgagagtgcccgtttcaaaaacacatacaatttaacagaatgaaaacggatagattaaaaatatagagtaaagggaaataagagtagaaaaaaacagatatttcaggcatatggttagtccacaaggatacaaatcagaagacagtgagttggaacagacttcaaatttggtgctgaccttctttacatcaaagtaaagtggaaagacaatgagctatgaaatatagtgttcctaatatggaaaaaactgtttgctcaaggaaatttgttaacatatgaaggcacttttgatgttgtgaaaaatatcctgcattaaatacaacattcctttttgcatggctacgtgataagttttgctttgtgatgcagcagtgtagcagaactcacttattaagtagcgtgcattctgtctctcagccaaacacccacattattccctactatattcagatatcagatcataagtgacaggactatagacagtgctctgagccttagtaatatgtaaaaaagaggaaaaaatgcaaggagaattgtatctaggctgctcagattatcagacaccacatctagagtgagaggatcaaactagtataaacagtgaccataagatgttgactcacttttgatgaacaagacccacttttaataatggatttatacatttttaatagttggcttacatttcattatcgtttattcagtaccattgcaagcctttggttttctgttgtcaaaataagtaggaaaaacagaagatcaaatggtcatagtattttttgcttcgaaataaggcacatgatttaaatacaggcaagggcatgcacagatgaattttgatagaactgagaaaacattcactgtcatcaagtcaggtctcactgtctgagacatattaactcgtttgcagtcatgtgataaaacaagagaaacctcagtctcagaagttttacacagcaaagcacagcatcagggagtggtcccctgtgaggttagaaagtataaaccaagttgcctcttggattgtgctttttgggtgggtgggagccttaggaaacttgactggcttagggaatccttttctgatgattcctgtcttccccttctggtatctgtgaggatgggaagctgacaattgatccagcagatgtctcaccagctactgagttcttccaagaggtgatcaggcataactcttaggttctgctacctcttaatcacagtctattctggagatggttaatcttccttgctaatgaggatttaattctattttaattgtgatgttccgttttctttgacttattcccagctcccagcttccatttccttacctttgttcactgagagttaattgctcatcaatacctgggggaaaaaaagtaaataatcttttcagttttgatgagtaaatagtaagatattaaggcagtattctcagttgtgtttaaggactatctaaattggagtatcttcatgtacttgttaacatgccaacatggcctctactccaaactcactgaagttggagaaccaataccttacattaactagcatagcaaaaatgtaattcctactttatcttaatggttttaattacttaatgatttactctgtataaaaatgttgaataatagctagctgtcttttcatgatgtattagtcaggactctccagataatcaaagccaagagtaggggatatgtgtgtgcacgagtgtgcgtgtgtgtgtgtgtgcgtagggagagataaatttattataagtaattggctcacatgattatagaggctgacatgtcctaacatctgaagccagcaagttagagactcaggagaactgttgttataatctgagtccaaaggcctgagaaacgagagccaatggtgtaatttccagtctgagtctgagtccaaaagcaacagaagaccaatgtcctagtttgaaggcaggcaaaaagagtgacttctcccttactcaacatttgttctcttcgggcctacagtggattggatgagacccacatacattggagaaggtaatctgtgttactgagtccaccagttcactgttaatctcgcccagaaacactctcaaagacacacacaaaagaatgtctgggcacctcatggctcagtcaggttgacaaataaaattaatgatcacaaatccacgtgttgtcaacttgacatccatatgtatctccttaagtcacacttaatctccaaataaaaacaataactaggttataattccaactattatacaagtctcctgcacacaaacagagaatacgctaattccttccatagacaaggaggtaaagtcctcgagtaatgttaacttttctccttgacattccataacttaaatactgtgatataaagtcagtacatcttacgttacatgacaagaagggaagaaaaaaaggtatttgcttagtgtgtgtgtgtgtgtgtgtgtgtttgtgtgtgtgtaaatatatttataataaaataaagaagaactactcataacaattacaaccctagtttctgtaactggttatatagttgtagctggtatttatggctactttcttctactatgcattctgtattccctttgccttcagcaagcacctcagctagctgtggttctttactggtggagtgactcaaactttcattcctgaagggtctggactatttgtagtgctgcttggattgagttggtgtactctttcattgactttatgcacaggacatagtgatatcaagagatgccctaaaggatctcctatgttccagacatcctctttcttacctccattgtggagttgcactccagttttcctttggtagccaggatcagtcagcacaactagcacagtaactcccttctttgtctgttgattcaaaggcataaagagttcaaagtggctgtgtggcagtattagcttccaggtcaatggaataattgttgtgtcacctaggggaagcatttctttccctgaaactaagacttctaggccagcaaaggataaagctgtggaaataggaagcaaaaatgttgtaagtggtgtaatagtgactggtactacttctgtttccacccttgattcccagacccgtgaatcctgggagaaacagcaccatatattggatgctgattcagaccgcatacagccttctggagaaccttgccccatccctgcaaggtattgccagctagctgtcactgtaacgaaatctttagaagaccattccaccattctctgaaaccagctgcttcagggtggtgggaaacatataaaactagtgaattccttgagcatgggctcactgctgcacttcttttgctgtgaagtgagttccttgagcagggacaatgctgtatggaatatcataacagtgaataaggcattgtgtaagtcattggatgatagctttggtagaaacgttatgcgcagagaaggcaaatctaaatccagggtaaatgtatatttcaataaggacaaaatgctgcctcttccataatgaaagcagtgtaatacatttaacctaccactaggtaactggctggtcactggaggaagtggtgtcatgtcagggactcatagctggtctccgctgctgggagattaggctatcagtgatggctctagccagttggcctttgtgagtagaagtccatatgtgaagcccatgcctaaccttcaaccctaggtaattgcggaaagaagccgtctggaatccacagaatatgtcatgctattcagtaattattaaaatattcctctgctagggtcaccctttggtgaacatttacatggagcaaatatcttcatggtttttttttttttgctcattcagaaaatcctatccacacacatcttccccaaatttccttgtcaccaattttccaatcatgtttcttccaagtccctaaccatctggacaaaccatcagccacagcccctgagttagtatataatcatacatctgaccatacctccttacaagaaaagtgaacatcagatgaactgtctgaagttctgcccactgggaggatttccttcactgctgtctttcaagggtgtcccacagaggtcctgtggtgctacatttgtccactttcgggtggtgcctgcttattgtgcagaccatctgtaaatcatacctagctcttttcttcctctgtcatctgatagtaggaaagtctccattaggccataggtgctggtggggagaaagaaggcagtgtagcaagagtggggatatgtacatttgggtcacctctttatgcaactcacttgtgctttcaggatctgtttgggctccatcatatatatgtgtatatatataaaaaacatatatatgttatatattatatatgttatatataacatatatatgtacatgtatatacatacatgtacatatgtatatacgcatatgcatgtatatgtatgtatatgtatatgtatgtacatgtatatgtatatatacatatgtatatataaaatatatacataatatatataacatatatgttatgttatatatgttatataatatatgtatgttatatattatatatttatatatacacatatatacatatataacatatgtgtatatatgcacatatataacatacatatatgtacatatgcacatatatacatatatgtacatatgcacatatatacatatatgtacatatataacatatacatgtacatatataacacatatatatgtacatatatacatatatatacatatatacatatgttatatatgtatatatgttatatatattatatgttatgtatgtgttatatatatcttatatatatgttatatatatgttataaatgtatatataacatacgtgtgtgtgtgtgtgtgtgtatatatatcttagtgatagagtgctgttgagtagggcaactttataatggtttactgggttagataagacccagtttatgatgggcagctcagaccacttggtaatttggtggcttctggttaagtgttcagtttctacgaaggcccagtagcaggcccagagctgtttctcagaagaagggtagtcatctgcagaggatggcagggctttactcccaaaccctaaaggcctgtgctgagattcccttatagggaccattcagaggctccaaccagcatccctgtctgccactgccacttcaagcactgttgaatatgctaggtcatatggttcatgtggcagagcagcttgcacagctgcctggatctgctacagagccttctcttttgctgggccccactcaaaactagcagcttttcacatcactcagtaaatgggccagagtaacacatccaaatgaggaatatgttgactccaaaatccaaagaggcccactatgtgttttgcctcttttgtggtcataggaggggccagatgcaacaacttagccttcagaaaaagaaggttgtgcattatgcattggctcttaaaccctccacctggaagtgacacatgtcattttcagtaacaagtctttggcagtggctcctttcatgggtccatgaaatcttaagcagggccaggaagtgcagccctgccatgttctcaggggtcagagaacagggaatgtttggtgaacagagctaatgactgactgcaagttctattgaaaagcaagtgttcttgttgtcaaactcctccctcctcttagacactattccctagtgacaactactcctgcttctgtgtttagctcctttggtgcatattttaatatgacacgttgacacatttttttctaaatcaacttatatattatgtatctattcctgctatatcactgaagggtttagttcattcacaccatcaaccttttctctgctcttggcacccaaccctttctcccacaatcacagtttcttaagaagttaattgaagatgtacttgggtaaaaaaacaggatgtatcaaggatgataaatacacaagcacagtgacgtgccatcccactatgatagctgtactgctgacctagaggtcagtggacagaacactctaggaaacagtatatagggaatctataagatataaacaatgttttacagcttgtacacaataaagaacattataaaggcatttatagagtgctaaaaaggagaattcattctaaattgacactaaaagtattttccttatagaggcatggggctacaaagtatatgggggatgaaatataatcctagtgtatgactcagggttgcaacaaattatatttgtgtcattattgtaataataacatttattagatttgaaagtttggaactaatccatgtaaacataaaggtatatttaaggctttgtgacttgggtggtgcaaaaaagaaggtgaagagagagggtaggaacattaatatcatttcttattctataaaatggggattcagtgcatattgtctatgattcatgaaattcaaaatgaaggtttagctatgctgtttgaaattgtaaaggtatcagttgatgaaatgaagacagtgatataattatttgtaggtagggggattaacttagtaagaaaggaaacagaagtggtaaactttctgattctttgcctatctaaaaatgtctttattcagtcctcatactcaactgatagtttcactttacatagaaattatttttgtagtgcattacttcaaaagttttgtcttatttgtttttatacatctaatgttgctggcatctggtttgattcctgtttacttcatcggtgacctatttgtttctctttaaaaatatttgtgatgtcacctttgagcttgatgttaatttttacaaggtgtacgtagatgtggattttgttcattctttttgctgggcatttgatggaccctatcaaccaaaaagttaaatcccttacttagggaaattatcttctaatatttatttgataattttctactacatccatccctccccttattctctcatacttaaactgtgatttatgagttactgggacctctctgtttgatcccctgcattaaatgttttcccttatttactttgtatttttaatataattggtttattttaaaattattttataaaattttagctttatttcttctattgaattttgattttgaaaaaattcatttcccctttctaagagccctgtcttattcttgtatggctccatttttgttgaatcctctttttgttttatgtatgcagactctgcagatcttctctaaatatacaaggggagacttttaaaaagttttattctgttctttaaagggtgttttcatctctttggaagttaacttttttatttgcctagtttaggcttcctccccctcattcccattgcttgatttcctcaaatattcactaatcattgctcaccttttatggttagaagtgaggtaaataaacatttcctagaagcgctgtagatatagacagatttgattattagtctctttatggtaaacaggcaagaagctaacccttatattgggggactgataatgtgagatgtttaagttttcttcttatattttatttaggaaagaaacttctgttttttgttttgttttgtttcttttaacctagtataagtggtgtgcggggtattttacagtatgaggacttctctttagaggctttcattctaacccctgtctcatctcccaactctggtattgtttatatacagttgtcttttatatttaaagaagattttgctatagttgacatttatactctaaagtgattgaaaatacgtgccacatgtctattgtcttttcaattctcagtaactatagaacgtatccttttatctaaatagttgtagctgatgtgactgatgtctagagttctgagtatttcctcttactttcctaccccatcatgtccaggttccatgtcttcaacttttatttcacagtaggtggtgtagcagaatgtattgaagaaaactcagtgtttacttacagcattttatctagctcttttgttaccctgcctttgcacaactcagatgaggatatgatgtagcttaattctgtttgatttcaggaccatattattgaattttttcttgtatgctataatgtaagaaaactatgtttttgaaccagaaatcttcctacagaaatgttgcttttatagcttccagctaatttcacaacatatgttctgattttctacttttgtctattagcatagcacttaacagtgttctgtaaaaatagcaaaaatggatgtattgctaatgaatctatcacttggatgtcgggcttccctaacataacttagtaaagaacttttagctttttcaagataatctttcattcccagcattattctgcctttttaaagcagtacataaactcctgatgtatacttatgaggatatacactggggtaaaacagttcttgagtaattgtcttgaggatttttgatgattccgacagtgtccactgagtgaaaagtttatcagaagatagcaagcgtattctaatattgtgttctgaaacacgactaaaagagcttgaataaagccagatattataagtgaaattcttgtaacagtaaccaaagaaccttggatttttaaaaataaaacttctataggattgataatgattcttttatttatatgtgcaatttaaattgtttattgaactctaaatctgtgctagtcagtatagtagaagatagaaataaaatggcatagaaacagacacaatctttgcactcatgaagcttagagacaagtacagagagaattgtaatacaggataagttcaacaaaatgttatttgttatgaaacataggtgaatgacagtaaaccaaggtttgagtgcagtgatagaagtcagggaagacttcttagtgggaataatatcttagatgaaatctaagtgatatatagaagccaggcatctaagaggttaaagatgaatgtttcagagaaaactcctatggaaaattctgaagtatggatagaaatgtggtataattgaggaacagaatgttctgagtgcttggagtattatgttgaattgcgggtaatagtggaataaggtggtaaggcataatagcatgccaagtcatcataaagacattgccttcttccaaaaagaaaaagaaaaaaaaggaagcccttatttaattttaagtagtaaagtaccaagattatattacgtgtgtgtgtgtgtgtgtgtgtgtgtgtgtgtgaattactctggctgctgtgtggagaatggtttatagagagcagcagagaaagcagaaagaagactatgcatttatttcagacataaggatgtggcaatcatgacagagaaaagtagatgtcataaaataggtaggttctagtaattgattggctatcatgaatggggaaaaggactcaataagcaccctaattctagcttgggcaactatgtagccgtatagtggctaccagttccattccctgaaaatgagactacaaggaaaggatttaatttgaaaaaaatcccttgagacaagtttgagatacattgagtttgaatgatctgtgggatatccaaatagaaatgaaaagaaagaccattataagaaagaccaggaaaaaaataagttaaaaaaagatttggcctagatatacagatttggaattttcagtacataggtggcaaattaaatcacagagttcatgttataatcaagaaagagactataggatgaaaaggaaaagggcgcagaagagaaaactaaggaacctcaacattaaagacatgggagaccaagaagtccctagaattagaaagaacgggagggagaggtatcacaaaaaccaggaagagaaattgttgcaagaggtagggtgtaaataaccaaaaatttgaaatgatactgatggatcaatatatgataaaagataaaagttgtctattatatttaactataaggaggtcattgataactctgcaaagttttgtgtgtgtgtgtgtgtggttgttttttttgtttgttttgttttgttttgtttgagatggagtttcactcttgtcgcccaggctggagtgtaaagtcgcaatttcggctcactgcaacctctgcctcccagattcaagtgattctcctgcctcaacctcccaagtagctgggattacaggcatgtgccaccacacccggctaattttgtatttctagtagagatggggtttcaccgtgttggtcagggtggtctcaaaccgctgacctcaggtgatccacccacctagacctcccaaagtgctgggattacaggcatgaaccaccatgcctggccctcggtaaagtttttattatcaaagatgaattgaagccagaaaggcagaaatagaaaaaaatgtacatttcagaaaacttacaactttaacaaagtatgtggaaatacactttctttaaagctttgtcaggagagaatgtagattatgctaggttgataaacagattggtttttttaaaaatctgagggtaatggccccaccatccatcccattactggctatatacccaaagtattataaatcattctaatataaagacacttgcacatgtatgtttattgcagcactgttcacaatagcaaagacttgggaaccaacacaaatgcccatcaatgatagactggataaagaaaatgtggcacatatacaccgtggaatactatgcaaccataaaaaaggaggagttcatgttctttgcagggatatggatgaagctggaaaccaccattctcagcaaactaacacaggaacggaaaaccaaacaccacatgttttcactcataagtgggagttgaacaatgagaacacatggacacagggaggggaacatcacacactggggcctgtcagggggtggggggctagggaagggatagcattaggagaaatacctaatgtagatgatgggttgataggtgcagcaaaccaccatggcacgtgtatacctatgtaacaaacctccacgttctgctcatgtatcccagaacttaaagtatatttttaaaaaattcaaatggtattgatcaaagatatgaagccctgatggaaaggagttcaaatatatacaatgtaacaaatatgtcagcataacactgataggctggaggtatcattatggttggatttatgcagacatttagaaatacaccactgcattctattttgtgaaatagtgaaacccctggcacttgggattttctgaatcagcactaatttttgtatcacatatgataggtatgtatatttttcccgtaccgtgaaccatctatataatcactttaattgtcatgttttgtctgttgaggtccctgatgtacatccaatccctaaaatactgtctggaatgtgtgagatgggcaatatatatttgttaagtgaacaaaagtttattagagaagtgctgttaaataaaaatatattggttaaatgaagaaaatctgaggcgttctcataggagtaacaaaaaagaaaaatgcacataaattatattccactagatctgaggtttctgaatttttccaggctatagttctaatattccgctatatttcctctgtctgttatgtataggtatgataagccttggcagctgggctgcgctattaaattcatggattattgttcaactgataatgaaatgataacaactgtcaagaatcattcctttacacaggcttttacttatacacataaagttgagcagtgtccaccaatgttctatatcttggatgaagaagaaaatgattaaatatcttatattcttgattataatgagaaatactatttccttgcaaatattatttataacttagaaagtaatatgtgcatatgcataaaaaagcaatgagtacaaaattaaacagtataaaataataatgtgccctcttattataagtcccttgcttactccctggaggaacccattttttcagaacattcccatgtttctataagtaagatgttcattttggagatactccactttggcatacttgttaattaaacttgggactcgaaagacttgcattatttaaattattcttgggtaaaattgctattttttttctcatgactacttcagcgaatattagtctgaatctctccaaatcttgttttcttactacagaccaccatcaactgtcatttgagttctctatcattatgaactacagtcttgtaaatctttcattcactcaacaggattatagcgcatactctgaaagaagtacttcatcctaattagttccacaggtgcctttcctttaaaaaggaaatagtttccacactgtctccagaagaatgttatcgggtcattatgcctttgataaatgaatgtgctgcggagcctgggtttccctgaagggtctctgcaacgcacaaaaatgctgtgttataacttttgatccatgattgccctaattttctcaatttatccaatattatatccagatatgcagtcccagatctccaatgaaccacactgatgcttctttgttgatcttatatacttatttttcctcaggttgctactaaacataagttcttctcttcatactaggtattatgtgtcagcttttagcgaattagattgtttattgcattgggatgagaataaagtacttacagacaatggattagtggtttgaattcttcccaggctatcagcaatcagaagttgttagtactctcttggggtctatataaaatgaaggtggtctgattacaattctgggccagcaggaaggagtacaatttctattacaggggggtaggaacggaagtcttggtaaggaggccagatgtctccttctaatggcttataagaacaaaacctgaacatgttttaattttttttttcctcaaagcactatctcgggagtagtgctaaggtatttcattccctccccacaatcattttctcccactataataacttattcgttaatttacttacgcatttacttctttctctaacactcaaaagttcaaaaagttcattgagattgtctctattttacttgttccaagccagtgcctaccaaaaccaaacacttttggcccttcacttaccatatgcagccaccttgttaatcactgtttctctggacctcatagtttattgcctttgcaaataggggctgtaaatctattgtgcttctctaaaattaatttctggtcaatatatcaaagaagctttgatgacatttgaccaaggcagacgaagatacaaaaacctatgtaaaatgattctgaaatgcttcctatagatcagccagacttttaaatcgtgtatgccttactataatgaaaaagtgaaagagaaagcatgaggaaactagagtaaactgggaactgtgcttggaacccagagtgataccagcacctcacattttttttttttttgtagatcatgtgatgcttctgtagtggttatagaagcagtgtgatctgcctgtagagctaattggcatcaatgagttttaagacaactttctgaaggaaaatacagtatgtgattttagtttggtaatgaaggctggatttttatactattgaaacagcttgaaacttttgaccaaggcctgtagaaagaaatatatgtatttaatattagaatctagcgaacacaaacacgctaacacgtgtgtgtatgaaagtatatatgtatatatttatatatatgaaagtatatctatttctatatgaatataatttgaagtggagattctattaaatgattcttaccttgctatgtgtaatgtcctctgacatattctagtatttattctacacggtaccactaaaaaataactcaagtatctggccatataccattagatctatttcatgcatgcttaatggcttacgtactgcagtttgaaaaacattgttctattgttactccttacgaattgtggatatatatttctatattatgtcatttttaccacaattgctttcatttcaaaaaaaatttgtgttaaaacatgtttacgcattggttttttaaagtactgaagactacaaatatgttcaccatcattgtggattgaaatagtttgtaactattcccttttcacacaactagataacaaatccagataaattatatgtttgagagtatcaagatttttcttttcactcatacttacctgtttcctgagtaaatgaaagatagcttcctagagtgttattacaacatatttacaagttctaaatattctttagcaaaaaccaaaatatttcttttttattcttttggttttttaaattttaaatttgtatggctacataataggtgtatatatgtatggggtacatgagatgtagaaaacatttcacattttgattaaacaaagtgattagatttatttcacctgtatgcgtgctttactatagtttcagtgttaccatgcagatttttccatttattggtccatattcctgtgttaataaaaaaaggtacctctcattttataacaaaatttaccttctccctgaataaaaacaaggcttactctttattagattaatttatttacaggagggatgctaaatcatgcaatacttgttgtaaaaattgtttgaagcagttttttatatgcttatattactggcggaagatgactatgcatatttctgaaccaaatttagatagctgacaacattaacccttaggatttgaaggacaagccaatcctgtataagctatttaggatttcttctacgtacaagtcatccaacattgctcactctattatggaagtcagtcactaagtctctcctaaaagctaaccttttccagtgaaccattattggtgacataaccttatcttctacttcagtgatgaattccacaggtcactggcataagatggttttcaaaatgtagaagatgacgaggagattatgaggatctaggtcaactgagttaaactctgaaagctgtaaaagtgtcatgaatcctgttgttggttcagtcaaggcttgatttttaatatctcaattgaaggtcttcatgctgcctacatgccatacaatatggcagcttgttctaaatttttctttagcaatcttaaagacttttttcaagggacatgtgaacgccaattatatttagataattaaaatgaataaaattttgtttataatatatgcagagagatagaacaaaaatcagctataatattatcctcttctcttgattagataatgggataaaatatatgtcatgttttgatgaatagcgtgtttcggcacacatgcatgttgtcaaggaaggatcatctgctgttattatatcctccaccaatcttcacaaagaactcaagttcaagaagagcaggaaggtaaaggaaataacccacatgaattcatcaataagaattatgttagctatttatcttacatttccctttaacacataggagctctgatatggccatttgataataagtatatttcctaagactgctgaaaaaaatagcatttgctaaatacttggaaaatgcataatgtttacaaaccacatttgtaacctgcaatgtctttttgagaccattagacagctacttactgaagttaattttactaaacctgcaatgtctttttgagaccattagacaactacttactgaagttaattttactaacacaggcgttaatggtacactagtgtcttaaacagcagaatgcaaactagggtactattcagaaacattatagacattgaatggctgtgattcattaaaatatatattataacctattcacttttcgctacattgtataagggatacatttttatttaaatattcttccgatttttctccctatacacttgagagcttccgatttttctccctatacacatgacagcttgtctcctctcatctcaaatatttttacaaatctaagcagatttctgcctttactgcattatcaccttatttgagaaagctcattctggttcttctaatcacttctaatcttgtctcaccttcattgataactttaacggtggagaagtcacagattaagttggactggagttgtggaaataaggtgaggtgatttgtcacagaaattagaggaatcttagtgataaatagtgtaattttcaggatcttgctaaaagtttttccaaataacaagcaaaaatagagttgaaattaaaggtcatcatattttagaaaacaaaccacaaaactaaagcagctcgatgtgtaagctacaggcagaagctaatatctgtattatggattctgctaatatctgtattatggattcattaaattgcttgtatactctttaccacttagttaatatgtgagctttaaatagcttaaaagctggagcaattgtttcatgttttttaaatattgtgtttgacatcaattcttgttaatgatctctgagcctaagaaggcttatatttatgcccagaggatagttcacatttaaaaaaatcattttttcttttacatgtactccgaacgtactatgatggaatcctttaattttaaggattattataattacttgcttcaagagaaaactttttatggagtaatgtgaaatttctttcaaaggcaggcagggttgcattgtgatcttggtaccgaaatcatccggctccatattccaggttacccatttactactcatgtgacccccacacaagctacttcacatctctgaacttacgttttttcactcatataatggtaactattgtacctacttcttcagaattctgtaagcctggctgacaccaaaactttacatgaggtggacactcaaaaatagttgtagtggctgctatttggctcctaggcacctattagtaaatagtaggaaactaagtaaaacaaatatatcaaaagtgatagaaaatactctttgtaagccattcaggagctggctactgttaagaaatgaatgatctcctcctttgagaagagaaaattacttcctccatattgaaatagacttattgcagaatagtcatactatcacacatgagaaaatttctgcagtatgtgagcctaatcccctggaggagaaatttattttcaccctcatgaaaatgtggagaaatctttttgatggctatagtaagagctgaccactggggaggagagaaagtcagcctatggaaatcactctcaacaggtcagaagaagtcattgtggttttaattacaggacaagttttgagcaattattgacctttaactatgcagaaataatttgagagagttttttttttctcaaaggatctatgcatcagataataattgttagcagtggagacctaatatgagtgcctctaatttttcctacaaatttgaggttgttgcattaagtggcattgttgcaggacttttccctaggttagctgaaaaaggagtccttgatccacagccacaaaacttgaggcttgcagacgatttgaagggtgagaataatgggatttattgggcaaaaaggaaaaagggggtaacaaggactctccacaaggccagagttcttgctagtagtcttcccacctcacagattgaattccacgtttcacacaggaagaggaggagccaggctcctcctgcctgcaaacggcatgaacttcctgagtctctagctgggcacgcaggccagttgcagttttgccagggagcccttcccacctggctgtctcagcatcatttgtttatacatgtgtggtactgttaatgttttgtcatacttgtatgtttatataacacacagtagtgtggaaaaacatgctatatttttgaaacttgaaatctgtatgagaaattctatttagatcctgttactcaaaatatgatccatggatcagagacataaaatcttgctaaaaatatgttctctctgtccctggctcagaactattaaatcaagtactatgttttagtaaaattctcaggtaattcagtgcacattaaaatttacggggcagtgcgttagatcacaaagctattcctgactttggagctccttatgcctccaaattgtaaatacttggaggattcgccttgaaaatccaaattcccaaactatgggatcaccatagttaactagtaccttaagaaataaatctggataaaaagataactaattgcctgtgaatagatgcaaaaaggaaattatattatttactaagcctgatcccaagacctaaggaaacatcaagaagaggttctaaatatatgaagggttgtccactagaataggaatggcaattactctttatagacccagagagaattaattactaggatcaacaaatagaattcacaggaagagagattttggtgccagataattgaactatgtgtaagtgcaatgctttttctcacaaatgaaatctatttatctcctttcttcaagccgaggtttacccaatatctgtcatgggctctgttgaaagagcctcataagtaagaggtttgaactgaaagactacagaaaaatgacctcagaggtcactttgaagtctgaaattctaggatttgtccagtcaaggaataacaaatgcctgtgaataattgaatatatgtgacaagtgaaaagagaactgtttgagtgaacataagtagtggttaggtttaacaactaataagaataatcagctacacagcctgtgcagatttaagaggcaaattatatgtttagaaaagccgactaacagaagggctcttagctattttgtgaagacttggaaagttactcattgagccctctgctggctgatatgcagggcactgatttttggatcggaaaggagactaaattttccccctgggaataataggtgatattcgcacatcaaagagaagtagtgagaaagagcaaggataagttgattaagatggcttatgagaactgcaacttgtttgattcttggacatttatttttgattatctttgtaatagcagttgattcaattgctaccatatggtgacaccagcaaataattttaattttttaatatttgaatccactttatttttaaaatctatgtggggaattataattctataaagcttccagatagtataattaataaagtactagcagtttccaaaactaaaaattaaagatgatttagaattactttagaagagaaacacacctgtatgaagtttcttcatgtctttctgtatgtttagaagcatgtttattttcagactaaatctacagtgaaggttaagttactatcatttctagaatgcagtggtaagagagagaatccagtgtatggtaatgaaaaatacccactgtagagtatttccatcatccccaaatgaaacatatcatcatcccccgaagttcctcccattgtgcatttttttctcagtcagtttgtaacacctgcacaacccagaaaactactcttctgattttaattaattttgcttcttctagaacttcagtagaaatgaattgtgtttgacttctctggatttgaaagattcacccaggttgagtttatcaccagtttcttcctttttattgatgaatagtattccacaatttatcagttcccatggtgatggacatttagcttattatcagtttttggttcctttgaaaaaagctgctatgaatttttaatttctcttccataaccatctaggagtggaatttctggtttttagggtagatgtgtaactacagaaatctctcaaactgtttttcataataattttaggttcatttattatgaagaagttatatattctcataagtactgtatgtgtgagagctcaaattgctccattatcttgccaatatttggtattttttggcttttttgttttagcccttctaggggatgagaaattgtatctcattgtggtttttaacttgcattactccaatgactaaagatgttgaacaccattctgtgtgctaattgaccatgtatatgtcttatttaatgagttatcttttcaaatatttgcccatttttattgagctgtttagctatgtattgttgatttcttaatatattatagaagtaagtttttatcagatgaaggaaattcattattgttggtttgtgaaatatatcttaaaatcatgaatgggcataacattttggaagtattttttcctctatcaattgagatggttgtatgacttctgtcctttaactggtgaattatattgaatgattttttaatgttaagcctccttggacttactgaataaactttaccaatggaatctttcttatgtggttccatccatttgctaatattttagtaaggactgatgtgtctaatcttaggagaattattagttcacatttatctatttttcttacatgttccttctcaacctttttttatttgtttgcttgttttctgtttttgagactaggtctcactctgtcacccagcctgaagtgcagtggcatgattacggctcgctatggcctcaaaatccccgggctcaggtattcctcctactcagcctcccaagtaggtggatgtgcaccaccacatccagctaatttttataaatatacatatttttttgtagagatgggattttgccatgttgcctagcctggtctcaaattcctgggctcaagcaatcatccaccttggcctctcaaagtgctgggattacaggcgtgagcaaatgctcccagccccttgtcaagttttgatatcaggattatacataaaatgaattgggaagcgttctatactcttatgttatctgaaaaaatgcttttaaaagattgacattatttattccttgaatgtttgaaaattcaacaataaagcctcttggcctatttcaggaagtttgttttaggaatatttttaatcattaattcaatttttaaaatagagatgaagctgttcaggtttttaattttctccatcgcttttgataagctgtgtattaacagtttgtctgcttcatctaacttgtgaccttattcacctaacgtccctactatttacaaattttatttctatgatctaaaagattttttgttgatcttttctttttcattcatgacatgcctaatctgtgttttcttattttccttcatcagtcttcctaatgttttttgatgctattgatctttacttaaaagaaacttttggttttgttgggtttttaaagattaatttctgtgtacaagcacacattccttggctatatatgctcttctttttctaacttattgattctagctgtcagtttctctctaagcactgctttagctgcaaatcacaaatttcaatattgtatgcttttattatcatttagttaaaatattttctaaattaccttataatttccttcttctttttctaatttgtttttaggagggtgttcttaatttctaaatatatggatgtgtttttatttaaagacttttatttttggctgggtacagtgacttatgcctgtaatcacagaatttagggaggctgaagcaggaggatcatttgagcctattcaagaccagcttgggcaatataatgagtccccttcttataatttaacaattagtccagcctggtgcacgtgcctgtagtcctagctactagggaggctgagtaggaggattgcttaagcctaggatgtcaaggttgccttgagctatgattgcaccactgcactccagcctgggtgacagagcgaggacctgtctcaaaaaaaggaaaaattgctgttgatttctaagttaatgctattgtgcctgagaaaatattctttattattttaatatttaaagttattgaaacttattttttgccccagattatggtatatcttgataaatgttccatgtgcagttataattttttgtgactatatggatatataaatataaatatccattaggttgatatatttattcagattttctgtaggcatactgattttttttgtctactcattctatcagtcactgagaaagtagtgataaattttccaaccatcattctggatgcatttacttctccctgaaataaattttgatgcttatttattaggtatatacatattcagttgtcatgtcttcctgatgaatggacctttttataattacgaaatgttacttttatctctgataaaactctgtcttcaagcctgtttttctactatcatcatagccacaccagatctcttgtaattagggtttgtatggcacctgtgtttctatttatttttaacccatttctgtctttatatttgaagtgtgtctcttatgcacagcgtatgacttatctcatttttttctcattttcaaatcttatctttaaattatttactccacttacatttaatataattatttataagattgtgttgaagtctactttcttttattgttttctctttgccctatttaactttcttgattctgtttttctgtgctctttaaataattgaatgtatttaagccttctgttttatatcttctattaactttttatctgaatccctttattggtgcttgctattgaaattacagcataaattcttaactcatcacagtctaccttgaattaatattttaccacttcacatataataccagaacccctttccatatattttatgctgttgctgtcatttattcctatgttagtaaccccatgatgctttgttattgcttttctttaaatattcaattgtctattaaacaaatttttaaaaaagtattttatatttacacatatagttaccatattttctgtagattcaaatttctacctggcatcagttcctcttgaagagcttcctttggcatttttcttgtaattgacatttggtagcatcaattttttcacttttatttatgtaaaaatgtctttaaaatttattttttgaagtatttttgctgtctatacaattttggattaacaaatattcttttttcccctttctccaccttaaagatacagttgcattgtcttcttacttgtattatttctgatagaatatcagatgttatcttctccaccttaaagatacagttgcattgtcttcttacttgtattatttctgatagaatatcagatgttattttctaattattattttcctaattgtaatattatttttcactgcttgctttttaagatgttctatataccattggttttcatcactttgaatattgtatccctaagtgtgattttcttcctgttcatcctactgtggtttgttgactttcttatgtctgtaaatgcacatttttcatctgattggaaaacatctggtcactatttcctcatttgcccccccaaccccatcctatatatcctctcctcctgtattccaaatacttacatgctaaagtagttaatatcatgtcacaggcactaaactctttcattttttagcaatgttttttctttgcttcagtttgaataatttttattgacccgtcttcaagtttactcattcttctacaggacctaccccattcagttcatctagtgaattatttttgatggctttttagagtttctatttctcttttgaaacagaaaatctcttcattcattatatccatttcccctcgaccttttaaaatcatagttataatggttattttgaagtctatgtctgttctgttacctgggccatttgtgggtctgctttaattcactgcacttttaacttggatatggtcacattttcttgcttcttcatatatctcataattttcttttgtatcctgagtattatgtctaatagaaaagtgaatattgtagtaaaggctttgtttgatttttgttgttgttgtttatccaagtaggtaagctcttttctcttcctggtggttaagatgtaggaatcctcggtcagaatttttttggttgaatagatctgatatggcactcatatttaattaattgaattcatctatgaatagatgtactagctaccatcagtattgcctctacctttttgatcttagtttggactttggaagtcattgggctgaagtttcagatatttggtttatctttggattcatttctagtaaagccttaaaatcaaaggtgcttggaatacactgtgatttctctcaattttcggccccttttccactactggtttcttggcaaaattcaataggcgagaattgatggcccaaacatttgttttagcatatgagtctctttctgatctacatacagtctacctactctgcgctgtctaaggcatggcctatttatccttatccctgaaaagtctccctgtctgtggcagaccctttcttgtgtctgcctatacatagactaaggacttgacccaatgaatacaagatgctatactcatggctcacctattgaatgcttgcccttgtctggactttgattcattaaggctttctagcacccaccatgcttcactaaccacacagaatattagaatttttaaatttgtctaggatttttttattcacatcatgacagtgaaggtgttttgacttcccctatatcctatccagaagtagaaagcccaccagcaagtaaatactttaaatcaaatctcaatttttaaggcatgtataaatagaagtcgagatataacgaaagagaattagagatgtaaagaaaagtgttatcttaatatatgttttattttctatgaatgctagaaggtttttgatatttttatggctagtaaaatgaaatatatataagtagattttaaaattgcatataaacgattttctgtcatgaagagaatacttctaattattaatgaaaaacactaatgtagattatcatttgacttcagtgataatgttactttgtctagatacacttttttttttttttttttttgagacgagtctcgctctgtcgcccaggctggaatgcagtggcacgatctcagctcactgccagctccgccttccgggttcacgccattctcctgcctcagcctccctaatagctgggactacaggcgcctgccaccacgcctggctaattttttgtatttttagtagagacggggtttcaccgcggtctcgatctcctgacctcgtgatccgcccgcctcggcctcccaaagtgctgggattactacaagcgtgagccaccgcgcccagcctagatacactttttaataaatctgagcattatgaattttttcctaagccatggaaatatggaatggcaaggaaactgagtaaaaataggaaagaaagaaagagagaaagaaaagaagcaaggaagaaaaggaaggaaggaagaaagagaaggaaatgaaaaagggaagaagaggaagggagggagggaaaaggcagaagaaaacaagggaagagaagagaaaggggaggactaatttcttatttactccggtaaatttactcctgtagatttaaagcaatcaacagaatgattttttttttttattattctagcttcaaatacccgtctattttaggttagcaccagttttactacaggtcgtttagttttggactagattcttgggtatattctagcatgttcaaatttcagaggtttgtaaaatttgcagaaagttttagttagttccgtttaccccaagataacaagacaaaaattagaaataaataaatgactcaagattaagtaaaaatctatgaaagcaccttaaaaacaacatttatatttatttttcacatctggaaaaccctttttgagatagttcagtactagagaagttcttcggaatttgcaaggtatcaacatatctatatctttctttctctacaccctataaataatattcattgataatagctatgaaatgctttgaagaacagaagatcatatattactatgtttaactgaaaataaatatattaaagatatatagcaatctatcaactatcatcatacagcggggtttgtattgtttgtttgtttcttagtcttatattaaagaggagcctagattgttcctaatctagtccacaacaccccagaactaacaagtaatttcttctgggcataagatttctgacactgcaaaatgtctatcattacttggcaggaacttccggtagccttccagactttcagtttaggaatgactgctctctagaaaggctgacatttgatctgttttagcaagaaaactatcagataacttgtgtctgaggaagcgttgcctttacttccaaagcctcttgtctctggtacaacacgccttggttccatatgtggttgtgatgttgacttctagcgtctgcctcctcccttcaacatctttctgccttttgtttccaaatctcgtagcttcctaaatcctagtacaaaatcccatcccgaagccttattatcttcaggcagagatgaagtggaggtcatgatggctgtagatatatctctcacaacaagatcccctgagaaacataagcagcacaaagactttccctttcaatttagaaaacataatggcaaaaattaaatatatgtggtaataatatagaattaattaaaattagagaccaaatactataataaatattagttaaagacttttctgtgcaaaagaagtgaggcattgctccaaataaatatttattaccttactaatcaacagattcattgaatttttaaataatttattgagtccatataccatatcaagcattaaatttgatactgtgaagaatacagagattatttaagacattatccctgtctgtaatgaatttaaccatccaatgggagagagaaaacgtgcacattaacaggtatagtacaaggtataatctgctgaaggctcgaaaacattgcagaaaaatgctctagtggtttttttgtttaatggtgtgacaattaaacaaaataaagcattggagaaatagggctatagatgatcagcacagttaaggtttttgtttttgttttcgtttgtttgtttttttagatggtggggaagcatgaagacattttagacagcaagaataacgtgagccaaaaaataaaggagagccattgaaaggcatgttcaaggaatgaaaggcagcacgtttgaccagatgccagggaatgtagaagagagtagcttgagctaatcctagaaattgcatatgtgtgtgcatgcatgtgtgtcttggccatgaggaatgctgcaagtgaacttaattcaactaataaagacaatagtagactgggtgctgtggctcacgcctgtaatcctagcactttgggaggccaaggtgagcggatcatgagatcaggagatcgagactatcttggccaacatggtgaaacctcttctctattaaaatataaaaaattgactgggtatggtggtgcgcacctgtagtcccagctacttgggaggctgaggcaggggaatcgcttgaacccaggaggcagaggttgcagtgagccgagatctcgccactgcactccagcctggtgacagagcaagattgtctaaaaaaaaaaaaagacaataagtaactttaatttatgtaagactttgaagtttacaaagtacgtttatatgtcaccttgctcatcttatcaacagagatctccactgataattccatagtcttcttggttggatattcctcatctcgacatttaagatacaacattcaactgatctgaagttcaattactgggtctcatcttatctgtttatactcactcctttggttttcttcatgcagcctcccagtgagccacagtttttcaaagtcatgtctgtattccagaaagctctttcaaaaatcagatttgtagctaaggacacaataactttcttttggctatctccaccaagatgtctaataagattgacctaccatgtccaaggctgaactatttatctcaccaaaactcccctacccacacacatacacacaaaaaccattccacctgcagccttctccacctgagatgatagggattccactgtttgaattagtcaggcttgtgctataaaatgttgcagtgtccagcaaatcaaggtggttaataatcattcactgaatgaaataatacatttttcttatgaattcctgttagcttactgatctggggcatctgaggacatgagctggcctgtagctttacagccatcgaatattgaataaagagaacacagtgtgcttgctcatagtatttttacataaaaatttacgaacataagaacattgataatgtgcatgcacttgctagttaataaacatcagctgggcctttgagagatgccccatcctcacctgagaaaatcggaacaaaccaatatatctgttgaaaaaatctaaaggaaataacgtataggtaaatctgccctgaaagccaaggaatgatttaagtttatcttccataaagagaagtagtaaagttaaatttaatgctgaaaatgtaagaaagcaacaactttatctaattgcagacccgccagcattaccaggactcctgattctctttgatacgcttgtatctgttgtctctcatgcagacttacattttactgacatctttaaaaatgtgataatattctgcaacaaagccacagaccttagagtcattcttgggtcatctttttttttctcatacccttgtatattataaatcttttgggatttacctttaaatacataagaattccatcctttcctcaccgcctctattacatccaccccagttaaagccgtcggcatcttccatttggatttctgcaacaggcttcttgctcgtcttcctgtttccatctttgtccctctacaaccagtttctacacagtagccaaattgaatttttacaaaataaaatgtattcctctactccttccactcttctgctcagattcctgcaaggggttccagtttctctctggataatagccaaaatccctacaaaggcaaacaaggcctgacctgatctggcccttactacctgtcagtgccgtctcttgtcttgcttccctcctttccctgctctagccacactggtttctttgttgctctgtgaacataccagttgcagtcctgccatagggcctctgcactcactgttccatattcctgaaatgtttttctactcaaaagaagttagctttctcatcacaccttccacgtgttgtaggcacaggtttccgttaaatgcttccgtattttcctctatgctctttatagatctgaatgaagggaaaatacaaaaataaaggatcagtaacaaagaatacagattttgatttatccaccttaggaagacattaagtaaaaccatcctactgagaaatgaatatttaagtagatcagagtttgttactaactgtgtaaaacattatgagtcctcagtaatatttccagttctcttcatggattacactgccatgtgctcttgaagtttgagtgctaccatataacttgccttgaccatatgagacaatgttaagtgatcttctgactgagcatgtaagatccagtgtagaatcttccatactcttttcaccttcatcaactctgagctcctgaggagatagcagcctcagaagatggtgtaactttcattactgtgaacccttgagttactgtgagaaccaagaaccccactgaatcatgttggacatgttgcaaacacaagaagtcaatcattgttgctgcaaacaacaggaattttaaagttgttattatagcctaactgaacttgttttaaattatatcctcttcaattattgccttatgttgtacctgggttatctcctgtgaagagatcagcaagctaataggaattcataaggaaaatgtattatttcattcagtgaatgattattaaccacctctatttgctggacactgagaatatagtgataagcaaaactcctatcttctgggagcttatactctagaagttgaggttctgttgagcggagggaatgatgaggctacatcctgccaaaagggaaactctgcccaggatgataaggatgagagacacaaggagtacggggcaaagttagagaagatgtcagtctgggtatgtgcagtataaggttgggaagaagcagaggaacatcagaagtcagttctaggaaataggccttatgagaaggacagccaggtgaaaatacaagacagtagtcagttccaggcaccttgaatagaccaaatatagtgaaataggctgccttacagatggagaatgaagtgactgtgaaggctaaagcagatgttttgcagtgaagcagcatgggattgagaagagggagattgcctggaagtagaacagaagtgaccgggatttggaagttgagcagcaaaatattttccacatcttactaaatcccaagacctatgctgttgaattcctatttggtctactccactgtagccaggaaaagagctagagtgcattcagaaagctatatatctacttctaataattatgatgggcataggggagggtaggaattaaaagatagcataagaacactggcacttccccagagatgtaggtttattacattgcacaggaaaatagaggaaaactacaaggtaactctcaccacagagaaaaaagcagcagctccagacatgcgtcttcaaattcctagttatatgtattaccacataaaggtaaaccaatttatactacccccaaatgctttgaaagacagaaatattctgagacctgacaatttttatttgagcacaattaattgcaaggaagatgaagcagatattagaatgaaaattttattaaggccatagatgtatgtattgaagagcatttcttttgtgtgaaagtaaacaataccaattaaagctgtttaggtatatgaaaattcagaggattgaaccaattttccattaattgtaaatagagatttaatctctcactatgttcatcctcttgaaactcaaagtaagtaaaattatttgtagagaaagaagggatgagcatactgggattagataaagaccggcctatacggagtgaggtattgtgaggagacgtaagcctgtaatttttatacagcagtacgttattatttcaaattaacctaaaaaagagcttgaaaatattcatgactgtatctggttagtaaatgggttaaccgatctgtacatttcatgcatcatggtttcagtaggaaatatagcttcaggatggagattgaagctacagacctgagctgcttctctaggttttaatcgttaggcattgttcttgaccttccttaacctcaacttcaacagcattcagacaaattggttaattgtatgggctagtaggtcacccaaatatgtgtaattggacaaatcttatgcaaattaagacaatgatttgggaattaaataatgcttgcaaaatttgattatttagtaatacccattaataaaattctgtcaaattaataaatttggaaaaaaaatatttcctttctgaaatattctcgctctctgccccatcttatttcattaaggcttacttatcctccatacttagtctttctcaagtacttttccagactccctctctaccctctaccctcaccctgcaaacaattaaatgtttccttaactatctgctattaatccttgcttcagcacttatcatgttgactcatacatatttatttttgtgtacatcttcactcttaagactgaaaatcctttaaaaatgccctgtatattggacacttctttatctctagcatttggtagactacctttacatagtatgtcttcaaatttgtattgagtaaaaaagagtaaagaaaatgtaaataaatgaaattttcctctattttgaaaactttagaaagggagatttatcctctatcagttcagtgtataatgaagtattctgttatcaaatggtaccatgagatgccactaatgtcgagtaaacaattggaaatggatctcatgctgtgcccttgtgggacctcattttcctctttagccttagttattaaaaaagaatagtgcctattcttcttaaaatacctattcctcttattgactttaaccttggtagttaagagaattgaattattttatgtgtgtgtgtataaattctgagaactgtaaaacacatacatgtaagtttctattactgcattaacatggtcaccttctaaaaaataagataaattagagagggcagattcaccaagttcaagaaccctcatttgaagttaggattgaatgtatgactaatacatacatttaattggaaatagttaataatactcttaacccatataaagttgagatattgatggaaaaaatgaaatattttgtagttttttagtttttaaaagtctgttatactagctttattagataaatagaaataaggaatatatacactcattcaaaaaataacgtttaatttttatgtgcttcaaatttctggaattcaaatgcatatatttttatataattgaaattatagcacaaatttaattttgaatactttcttcacttaaatcgtatgctgaacattttactgtatttttatataatataataaaataatatttatcaagtgtattagcatattttacctaaatatttcactatttctgggtattttaattattcctaattttgctgctataaattattgtgaggagcatatttccacatacaggttttccttctctgggattattcttttggattgaatttctagaggaaggataattaaagtattggacttgatttacctctagcaaacccctgtagaggaaagggaaaatatttaccctcttagtaaagaaatctcttattgaacatcaagactctgaagataaattaaactattaacagtaatttgaataaatgaataatgaaaaatatttttattcattttttatttgacaaataaaaatgtatatatttatggtgttacacatgatgttttgaaatatgtatacattgtgcaatgactaaatcaagctaacatatacattacctcaaaaaataatgatttatctttagtgacaacacttaaaatctactcttgtacaatagatttccttccttccttccttccttcctttccttctttctttcttttctttcttttcttcccttttcttttctttcctttcctttccttttcctttcctttccttttccttttccttttccttttcttttttttcttgacggagtcttactctgttgcccaggctggcaatttcttggcttactgcaactttcgcctcctgggctctggcaattctcctgtctcagcctcccgagtagttgggattacaggtgccccccaccaggcctggctaatttttgtatttttagtaaagatggagttttgccatgttggccaggctgccctcgaactcctgacctcaaagtgaaccacccgcctcggcctcccaaattgttgggattacaggcacaagccactgtgcccggcctcaatagatttcttaaacttattcctcctaattgaaattttacattccttgagcaacagtgaacaaaagtatttaagaaacaaaaacaaaacaaattaggaaaatcaagttagcttcaggagggaaaggagtgtctaggacttttttgtttgtttgtttgagatggaatctcgctctgttgcccaggctggagtgcattggcactatcggctcgctgcaagctccgcctcctgggttcaccccattctccggcctcagcctctggagtagctcggactacagacgcctgccaccatgcccagctaatttttttttcttgtatttttagtagagacggggtttcacctgttagccagggtggtctcgaactcctgaccttgtgatccaccgggctcggcctcccaaagtgctgggatataggcgtgaatcaccgcgcctggcctaggacttctttcttcaacactctgtgtttgttttctcagagcttttccccaaggaaaaaaaatgctgtagcacaagggaaatgcatggttcttaaaaagtgcagtaaaattactcttcaaaaggattttacactaataatgtgttagtttatcctatcagttctaggagaacattaggcacaatttgaaaatgtgttttattagacataattttaataaaattattatatttagtttttcttgaaaccagcagaagtaaaataaaacaacacggatacctgggattgtgagctttagtttatttacttattacttcaaaatctattataatactagctctttttaagtgagagatttttccttcatctgtcggtttatgaattaatcggcagtcacatgcattttgttactcagggcttttattaatttttttaaaattttaacattcaagttctatcaaaaatctttactatattatagacatattttcggagaaggctatttttattttcttaaaacagtagtccctcaaatctccttaagagtaataggttaaattttaatttttttttcttttttctgaaaatatctgttttctcatcatggtttcttttttttttttctatttatttgtttttcctttttaatgctatttgtttttcagatgcttgctgtttctttttttctgttcaaatttatgaataaaagattagggtgcttaatgtaggtatctagcaagacatctctgtcatggtcctagaagttttaagagctgtgaattgggagctgctggggtccatgactgtcattttctggcaatatgatatagcataggcagtaagttcaactgaggcccatttctttggaatgtattctacactaccacacattcatgctttctctaagaaattacttagcagatagcattcattcattcatgcatttcttcttctacaaattctgattatgatactcaatagattcaaaatgctggggaacaaaggtaggaatgtagataaaactctgtctcccaaagaacaattaatataagcaaatatgataaaagataaggataagcatagtttgagtaggcttaaccccaacctatcttgggagtgggggccagaaggggtcaagagtggcagtgaggggtgaggtaggatagattgtatctctgaagggttaatagaggcagtgctgactaaagtaagaattgatggatctatagaaattagaaaggtggattgattaggaaagggcatccaaaaggaaagcctttcaaacagggagaaaaccatgtgcaaaggtgaaatgtttcagaaagagcaaggtggatttgaaaagccacaagtagcgcagcatgcttagagaggcagtgtgtggaaagagagattgctgggcaggaagggaagtggccagcttggaggtggtagctgaagctattcacaaccatgtgatctgggagacactataacatggcatttcattaggaatccagagacctgaaatctttaactgggtgagcttaaccaaataattttaatttctgaggcctctgcttccttctttgtaaaaggagcatgtgatttttagcgctccaggaagccctccccccaatgggtgctggtggggatgggaacttggtggccagagctctttgtcccctgcctctttcacttatactatgtcagttttgttttcgcctgaattatttgtttacaaattaaagtgaatttatttatttaagagagagtctcactctgtcaccccagctggagtgcagtggcgtgatcttggcttactgcagcctccacctcccaggttcaagcgattcttgtaactcggcctcctgagtagctgggattacaggtgtatgccaccaagctcagctatttttttgtattttagtagagatggggtttcaccaggttggtcaggctggtctcgaactgctgacctcgtgatccacccgtctcggcctctcaaagtgctgggattacaggcctgagccaccatgcccagcctattaatttattatttttggaaaactggcctccacaaaaaatatgttgaaagccacaagactaagttatctgaggtctttctgtaccccacaccacttaaggaaaaatagcagtgtttactattagaaagagcagtagacctggagttcaaaggttggatttttatggttggcagacctctgtgtggccatagggagccaatttttcttagctgattgttttaattataaaagaggaacaaatattatctgcccttcttgtcttgatttttttccaaaactgaaataaaatcagatatgttgaagtgcttagtgaatagtgaggtattttttaaatgactgttattcttaaggaaaatattacctacgctgaaagctgtctctaggtgtgagtatctaatatataaaagatgcccttggcatgatgaatctggttatttaatggaggtgtcacactttttatgttgcatttttcttggctcaagttcccatacctaaaagtgagataaaaatctctgtactggacaattttatccatagttttctagatttatcagaatgaattttattaaaagaaaaataaatattaatggtcattttaaacttcattggaaagtgatggtaaccttatatcccaggatgcttccttgagttattcactgtgcttaagagcatgcattaggctggaatattatgaatcttcttttcatagtagtttcataacaaagctcaggcgaagtaggtttagatgtttgttttttgttgttgttgttggtggtgatcttttaatggagcatttcaaatccaagagccctttctcctattaataatactgcccattctcaaaagcaaaacttaggtatgtgttaggttaaaagatcttcctttatgcaatgtgaacagggtaaaaaattaaggttgaaggaaatagataactctgtctttctacaaatattacagccacttccacattgcagatgaggaaaaagaataatttttccctctaagaagttattactcagagggataatatagttaaatatcactcacgtttttctgaatgcaaatcctgtgcacatctccacatgctatcaggatccaatttaaggaggactttgttaccattctacagagtctaaaacatgtctggatccctgttcttaacccaggctgcatgtagtgataatttgaaagtgtgacctagccccagctccagagattctgatttaattggtcttgaaggaggggaccaaatattggtatttttactcccctcccaagggatccaagggattctaatgtgcaaccatagggagaaccactaattctggtaaaaattaagcagataaatgatttgttcagatttgtagtataaaaaacattattttggtgtcagtgtgaaaaatagattggatgaaagttagatgaggagggcagaggccagtgaggctggcacagccatgcagccatgaaccaatctgagtccatgccaagaatttccaatattgcttgcaatttctggatgaagaatcttgttgttaccaaatcctctgtgatctatttccctgaccttagttgacccttctgctttcatatttactggtcattctctcctggtgcttctagttacacctttctctggttgtcatagttatgatttcgagccagtgccctttcccagataaagagggaaaccaaatatgttgctgtgaatgcagaattttgaatagggcatcctgggtattttctctcatctgatcagtcctttcaggaggattttgcttacacttcccaatttgcagtctcaccagagccctcctcttgtcttcctttgccttaatacatagttcagcttcacccagggaggaatcactgtatctcactacaaggagacaccttcatcctctgagtaataacttctcctgccctgtgtgaggcaggagaactaaagctaccccaagtcccggtgttatttctgcctcacaagaagtgctgggagcatcccatcactacaaggtgatgctctcttttttagaagaacccctcaactgtccattccatttgtattacttccgaaccctgaaactatttcctcagtacctgttctcttcagctctgagttaccacccttcacaatgaacaggaagtacaggaggcttggatttaaacttggatgtaatctcagtttaatccgttgctagcagcagcaagtcacttagtgttagtgggtttcagttttctgacttgtaaaagtaggaaaaattatatgtaccctccaaactggaaaaaaacctgtaagcttaagaactgagtacaatattggtacagaggatgcattcaacaaatgagagttgatattatttttgctgttatgattattaagtgtgcatgccttcaagtcagctgagagagcaaatacatagttaaaaatgttagtctttgtaatggctaaatggggatacatgtatcttcatatgtatattatatatattaattatatacatttaattcagtatatttaatatataatcatttataatataattatgtatattgtatgtatgttgaaacaagggaaatagagtaggggagaggaaaatggataatgagtataggaagaagacaggctttcctgagatcttattatttttatgctattattattattattttttctgttatatttgtttcctggtctagttcttagtgaatatgggaagaggaaggatagagaaaaaaattttgattgtgtcaggattaagagtcaaaaaaagatgaaaaggccgggcgcggtggctcacgcctgtaatcccagcacttaaggagactgaggtggtcggatcacaaggtcaggagatcaagaccatcctggctaacacgctgaaaccccgtctctactaaaaatacaaaaaattagccgggcgtggtagcgggcgcctgtagtcccagctactcaggaagctgaggcaggagaatggcgtgaacccaggaggcggagcttgcagtgagccgagatggcatcactgcactccagcctgagcaatagagcgagactccacctcaaaaaaaaaaaaaaaaaaaaagaaaaagaaaaaagaaaaaacattgccattatatcatgaaagttcatttaaaatatatgcagtcataattagttttgatgctaaattgcagtttaattaccgatttgttttaaatttagattaattttgaagtttttattaaatgtgctctttttataaggtaaagttctttttaagtcaattgaatgctgtcaatagaaataccttttgataactaaagtatagttgattaattaaatagaaatatttgtgtagcagggagtaacccaaatataagatcttgacttctgtctttcaattgaggacacagagagaaaatagatgttaaactttgactaaattgaattaaaattcaatttaaaattttatatttaaataatttaaattaaactctttattagtaagtaatttttaaagcatcattgaaaatactaattccaaaacagttgatggttttaaataatttatttaaagtctgtaatctaaggcaggcaccttactaaagtctcattcctatttcccatgaaactaacatacttaatggacaagcccaattacaaaacaaattcctttaggaattttatgactcaaaaaaggaatagagaagataacatgagagaacatatattgaatactacagtagaatgattgttcaacttttaagggatttattcaactacaccatcatttagcccatatgtcacagttttgttcacaagaaaactaggggtgacttttgtaaaagcccttggatgcagttaagataaactatgcaaatgacacatttgatctgccactccaataattatttaaaaaacacagacaggatctcactctgtcacctaggctagagtgcagtggcacaatcatggctcactacagcctccaactcctgggcttgagtgatcctcccgcctcagtctctcaagttgctagaaccacagtctcatgccaccatgccgggctattttttaaaaaatttgcatagagacagagtctcactgtgttgccaaagctggtctcaaattcctggcttcaaaggccttggcctcccaaagccctaggattgcaggtgtgagccactgcacccagctccagtaattctaaaaataaaaaataaaaaataaaaaaataaaaaaaaattatggtgactttacacttagcaaacacatatgagcatcagttttagaatttcagttaatgtcaagattggtaaacttcagtttatggaatcttgtttgaaaaccaggacagttaattttcatggcactttttcatggtgacttaaaaataatagatattagttccaagaacacttcttcacgtacttttggtattctaaattaggtaacaaatttggacctgaaatcttaaaacaaatttaagttaccttcaggcattcttatttcttcaccatcatattcttttccagttcaaacaccattcttccctatgaagcaattggagctgagatttaatagttttgcttttctcttggtcatttgttcatattatatagttggctccaagcaatcttattctgatcccatccttggctgtcattttcttctaaaaataccacataaatttctttctattattgctggcatttttacaaacgtcagtcaactcagtatcagtatcattaggtaatcatactcttctttcatgttgtttttaagtttcgtttcttttcagatctttctttttaaatataattctcaaatacaaagttttcagaaacttgcctgtaaaaccatcctgataatttgtagaagcctttgtgatcctttatctagattgtgacagagctttagaatgatatggaataatatataaaattttctttttaacttgtttcttataatctaaagctgcactatcctttatggtagtcactagccttatgtggccattgagctattgaaaaggaattattccaagttgagatgtactctaaatataatatacacattggattttgaatatatttatatggaagcaattaaatttctcaataatagtctttcatattgattatatgttgaagtgataatattttgacatattgggctacatataatacagtattaaatttaatttaacttgattcttcattttttaatgtggatgctaggaaatttaaaatttcctgtgtggttcacattatgtttctatgggcagcactgattatttccataatatttttaatatctttaatatttttaaataagtgtattagttttctattgtagctataacaaattcccacaaatttaatggctaaaaacaacacaaatttattatcttacagtttaggatgtcagaaacctaaaatgattggcaaagcctgtgttctttttggaagttctagaaaaaattccgttttcttgcctagagaccacctgttttccctggcttgtagctccttctttcgtcttctaagctaagagtgtagcatcttcaaatctacctgactctctctttctccctcatctctgtttctgttatcacatctcttactcttattctgacccctgaaccctctgccttcctctaataaaaacccttgtgattacttggtacccatctagataacccagagtaatctctccatctcaagatcctcaatttaatcacatttgcaaagtctcttttgccatataaagtggcatatgcacagattccaggaattaagacatctgtggcgggggagggtggtggagggtattattccaattaccgtattaagtatatttaatgctattctttcttgatttgttaatttcaatttttaaattttgcttgtggtccaatattttaagatcaacgaaacggtaataccaaaaaacaatcataagaaacatcgagtcaggtgtggcatggcacaacagcttctcatctgggcgatgctgctgacctcaacgtgatcttagttaagtcatttatcttcttgtgcttttttctgtttagcaaaaggagtctgtgagtctatgaaggaactttaaaactgcagttctttgggccactgttcaaatatactgtagttgttttaatgattagtttgagtccttgtatgatgaatttcagctataagatatatcttctagcttcaccagacttatgaatgatgaggatgtgaattgtgagttggtttaatgtattacacataagccaagaattatattctcattctatcaaataatgagtatactttctgttatcacataaaccatctatcctcatagtctattttgtgatgtaacaaatcatgctttgaactttcttcacattgccttttctgcttcatctatgtaaacaactatgtctgaaatattaccatgtcctgctttccttctctcccttcctcctagtacaatttataaataaagggtcaaaatttaattgttttcttttgtaacaaatccaccatttgttagcttgtttatcactagggaaggtttgggaaacttttatagaagaggacacaagaaaaggctgagagtcatgaattttatgatggttggaaggttgaacaatttcttatgcattgaatgtaacatagttttgtcattctgtttaactaaatcattctgcttgtttctaggtcatcagaaataattttattcacatacaagcaaaaacaaactctaaaaccaaacacacatgatcttagaaaaatatatcatctttgaaaaacttgtgacatattttctcagtttcttgtaagtaatcaaagcttaaagggacagattaatgtgtagatagataggtgatagatggatagatagacagatatatagacagatagatagagacagagagacaagaagacagagaaataaccattcctttagaagatgtcattttaggccggatgcggtcgctcacgcctgtaatcccagcactttgggaggctgaggcaggtggatcacgaggtcaggagatcaataccatcctggctaacattgtgaaaccctgcctctgctaaaaatacaaaaaattagctgggcgtggtggcaggcacctgtagtcccagctactcgggaggctgaggcaggagaatggcatgaacccgggaggcggagtttgcagtgagctgagatcgcaccactgcactccagcctgggcgacagggccagactccgtctcaaaaaaaaaaaaaagaagaagaagatgtaattttaagggttcctttatttaatattttggaaatcatggaactaaatattttgggacaggtagaagatgctcattaagttgctaattgaacaataatgaaaattcaggctagtgtttacttttaattatgtaattagcataaaatcctatccaaaaaaagagtacccaactcttgtctgtgaagtcaatgagatgtcaataccactgggatataactaaaaatttctctttccatctcgaactatagaacattaattttcatgtggtttcccatcctattaggtcaaactttatagtatattctgctaatactggaaacatagactcaaataaactaatattttacaataagcattaatagatgatatttaataagatggtttcctgattgtgttttttcagtacttaagaaacatctaagataattttatacaatttaactcattctatactacattgcaatgtcaaaatcaatcatggtactatggaattaaaagccaccaaaatatcaagagaacctgctctgaggttattagagggtcagcgtaaatactgcctcacaaatgtacttacattcaaaaatgaagaaaatattctgcaaaataatgcatcatgctattattagctaaaacatttgaaattggaaatttctatatttttcaattttaccaattaaataaatgtataaattatagatgtaaaaaagacctttttctaaaagaaaacagaatcttaattattagcctaatggcaccattatttgaaagtttttaacaagtcagaattattcaagtctgttttgaaaatctggatttatttctgatttaaacccttttaagagtccctctgtaaatatcttttagcatctctaaccaacattgatgaaaaagccccatttcaaaagtggcagtctcatgctaaaatatctagtcttgggtagtcgcagtggctatgcctgtaatcccagcacagccaaggtgggcagattgcttgggctcggaagttcaaggctagcctgggcaacatagtgaatccttgtctctagaaaaaaatacaaaaattagcctgatgtgatggcatggcgccggtattctcagctactcaggaggctgacatgggaggatcacctgagcccggggagtttgaggccgcagtgagccatgatcgtgcctctgcactccagcctgggcaagacagtgagaccaggtctcaagataaataaacaaacaaacaaaatgtctagtcttgatcatcacttccttagtttccattaccaatctctattccatgaaatataaagatacatctggtatatttagcatccaggcaggtgtgttctcccaatacgtatctgaaatatagtcagtaccagtcaagcattttaagtagtcttttctaattaagcaggattgtgggagtagattcttccccgtagaaagaacctctttgtaaacagtcacctttgcagtagttagaacttacaatgttgcaccactttttatttttgtttctttcataattcccaattgccattcatttagattcaagtcttgagcacttaatatgaggttacatcaggggagttctgaagatggtagaggatttttttttctccagacttgctttacaattctgttttattttatttctagcttcagaatttttaaaattatttttaaaaaattgttgtgggtatatagtaggtatatatgtttatggggtacatgaaatatttcggttatttcttctttttcagacactgagctgctatctttcacaacatcctaaaacgtttatcacaagccagagctgaattgatttgacctggtcataaaagatgtgcatttatatgatttttcaaaaaaaaccccaccttttctcaaaataactcttttgtattaaaagcaacaatgaaatacttactcctctatttgttatgaaaactatgctgcttcctcacatgatccatttggtattaatcaatccatcattttctatttggtatagaaaccaaaataagatatgtaattctaagatgttttttatcagagctgaaattttaataacacggttaaattggaatgccctatagtgctcaggtttaccaatcttggtcttttatttccattattattattcatactaatttttactttcctcctgtattgatttcattttctgaagaaattagcaagcccatctaatgaagagattctcttcattagagaatttattctcttcatatagcaactagttttattgtttgatctattaagtcagtcatttactaataatttgtatcatgaaggatacaaatattaagtatgtttctatcctctctgtcagtaaatcaccagggagataaatgaatttgattcacatttttattctcaaacacctttcctctatccctccttctcctttcacttctccttttactcctctttcttcattgactaccttactctgtgaactcattttacacttaaacatactgaaaaatgaaccttcagttctatattaatatctaatacttgttcagtatggatgctgaaatattaattgataatagtaatagccatttgcactcaacaaataaatcatcaataggaaactaaggatttgtggtagttggctgttttaaagtcaactctcctatgatatactttggattatgcccagtatacaggaggtattcaataagtgtttgctgaaagaatgtcagcctctccaaatttcagaaatataatggtacatctgcttcttctcccttatctttctattatcaaaggaaattaaattggcatatcactatttccttatcacaaatctgttttggttatttccaggaaatctattcagaatagttgaaaattgattgtttgacaattaactcaagcatttttcctgagtccagggtgcattgaatagtattaactgctcaattgagttataaaaaatgccttttctaatatttggtatctcttttgcatggattatgaaatataatgcctagtgattgtgaaatgagatttccagtccccatatttcatatcaacaaagtcttcttatttgaattcacatacatattttaaatactctgggtgagttttctttcatgttgtaatttcagcttatggctactctggctttggtagtttttagttaactggtcagactgaacatgatcaatcagttgattgactgtttcacaatttcagaggccctgttactatttgtgagatcaaaggaaaatacaagaaagagctagttgaggattacatatatatttttttcaatttcaaccatattttcccatttaggtggtaatttttgcttcctagctagaatttctaatatcaattatagaagtaaataagcaccattccatttacacttcttagaaatatttagtagtacagttttttaaaaaaatctccatataaaaagcacattatgaaatattgatatttcattttttcagacttaattagaaaattttataatatggtaaagattcacaggaataatgtagtctaaatctttaattttaataaaatatttaaagcatataaacaatttatatagtaatattgtaaacacccatgtactcaagattcaggctgagaaatagagcacagtagatacagttgaagcttctggtgatgcctttccaatttcatttacttggcaccctccccacagtaacctctaccctgaatatcatgtttgtcattatcatacatgttgatatattttgctgtatataggtatgtgatcaaatataatagatgtaattattttacctgtttttgaattttatatacaaatatcatcatcctataagcatctttccgcaacatcctttgttgttgttgctgcatattatattttttgagattcatttatatcaactcaaggagctgaggtaacattcatttttcttgttaccgtttctactattgcagtatatgaatattctataaatattttgtccagctatttatctgaaggtgtttagattatttctctctcctactgtttttttctctttcaaatagttgtggaatgaatagttctaggagtggaaaaactggattataggacataaaaatgttcaactattgctaaactgctctctgaacttgtactatcatatactctctgtaatttcttcacattttcatcaatattaagttttgctggacttgtaaatttctgccaatttcatgactgggaaacaaaaatctcattattttgaattgcatttctctaataactagggggattgaggacctttttcagatgcttattggacattgagaatctttttctgtcaatcaactattcatttccttaacccattctttcctattatattttttatcttttataagcccctttatgtactttggatagtaatccttctttgattatatgcattgcaaatatcttttatgagtgtacattttgatttatataattgctttattttaatatatcaaatttaatattatttctttatggactttggcttttttatgttgtttagtaaacctttctgttctcatctacccaaaatcataaagctatttccctctaaatgttgtaaaattttgctcagcatctttaggtctttaacccaccttaacatacatacatgtgaagttgcaatcttgtattatcattatttcatatggctaattcagtgtctgaatatgtcatcttccctcagtgctttctgatgtcaccagttatttatcaggtttccacaaatccatgaatatttttctggactttctattctgttccattggactagtttctagccctgaaccacatctgcattgcctcagttactgttattttatgttaagccttaatagttcatattggaacttcctgaacctttttcttcagattattcagattatattgataatttcttaccctttgcccttgcaaacacattttagaattaacttttaggcttccacaaaaaaattgtagtagattttattaataattacattacttctatagattaatttaccatattgattctcccatccaggaacatgtatatttattgatttatatgggtttaccccttagtgttaatagataaattagccgtgggccaaaaagtgatggcccaaagtcacatagccaattaatagcaacaccagtggtagaagaaaggtcttttgactccttaacaccttgtacactaaaaaggcttaattatttagtcagttaaaaaagagtgtcttggactgcttgcagctacagaacccctcacaatgaaagagaattcaacttctctagtttactaggcccaatttgtgtttcaagccctcaaagtgtgattagagcgcttgggaaaacaaagtcctgaaattccttgcattgactctttctctggagcctgtcggaaatgctaggggtaatcttgaggtcattgaatttaaaagcattcaggtaagcaacattgaggcctatgtaatgactcttaggtcttgttctgtgaccacaggcttacaggagctatcacttgctttgctgaatgaacactaaaagtcccaaatgagtaagagattatctaagaatacacacacacacaatcatattcctttaaaggaaataaaattttaaatgtttttctaaaagcagcatatctcaggaagagtgaggcttcttttaggtcgatagttattaaagaaacaaatacaattgctttgaaatcaccgaattgcctcaaattggcattttagctactaactgccattggggaaatttttgtagacaaaaaaaaaaaaatagaatccagaggagacagaaacacagaagattcagtctttaaacgtaaaacaaagaaacatcagatgctgtattcaagtagtcatatactattcatgttaattgcagttcagccttctttaactactgcagtagccagttatctaaaggggcagaaagaaaaaaaaaaaaaaaggtgaggagaggggatgggaaaaaaaagtgagatccctgcaatatcgcctggagccactaggggtatctttgtaccatttttcatcctgcaccgatttggagtagaaacctatattagggtaaaaccagggtcctcggcatttttttttttttttttttttttttttttttttgcgaggagtgcacccagaatccaaaaaagattttttaaaaaagaaagaaagaaagaaaccagagttttttttcagtcacccgaacagggttatgaaattgttcttctggacatcagcaccgggaattcatttttgaggtcaatttccaatcgagataaatctattggattagtaggattatctgattgcagccgaaagaagtaacgttgtttgatcatttgtatttcttgcctgatggtcggatttacatggaggtggctttgggtccccaggattctggatcgtggttgcatctggagagaaaaaaggatcaatcgacacgttttagaagtgtccgtgggtgaataaaaaaggaggggggggtgcaaaactggggttgcggatgcttaaagcaaaaaaagagaaaaggaagcgtcttgaatcctggaacaagaattaccgggtgctcgagatttcaaaaaagcgtctagaaactggtaaatacttggaccatttcagcttgaatttgacggcgaagtgttgtagagaccgtctccttgaatcattgcaaagggaccggggaaagatgagggggctccctctgtggatttatcttgctgagggtaagtttgtggctcttttattgggagggggctgccagggttttgtgccactgcgcggaaggtgatgcggacgcggtgcctgtgaaatggagagagaaaggggaatataaaaccacctcgcgcatccccggggggatcgctagggagctacctagatcgagctaaaaaaccttgtttttgtggcgtcggtgggggagccaagcagctctccaagctctcaactttgcattgaaaatctctcagttgggagacgcttcccagatccagtgctttctcctagcaatactttaaggagaggaggcagcggtgccttggaaaacctgcatgtagagcggaaaagcccaagtagaaatcgctggtgcttcggccgccgtttctgcggctgtcgtggcttctagggggatattttgcagggggaattggctgttttcatgttgtctcctcccccacccctctcttcctaccccttcccgcttcccgcttctctcaaccggacactaaagggttacagggtcactgcaccggatagagacagtagaagtgggtggctggccacacatgttgtcttgtaattcacttgcacgactttccataatacaagtccgaggtaactttcttcgagttggagcagcccaggaagacgttgcaggctttttgccgagggcccaggctagcgagtgcgccaggcagacggctgcatttctgatgcatccctgccctgcctgcctcgccacttactggcttttctttccaactgagcggtgcgcgcgcgttcccagacattttcttgcagctgaattcaggaatttttttctttttttaagaattttgtagctcccaagaaaaactcatctttatttgcagaaggaaatcaatttcagcagctataattaatcactcaaatcagtgaatatgaattgactcaggcaactaaaagttgctttggaacccagaaaagcatattattctgaagtaattttggagtccacgtagcttcagaacaattgcatacaaagaactgatttatttgagggatgtatataaatgtgttcagtaggttaacgaatctgagacttcaacatcacaattttagttggcttttttttttaaagccaattcgttaaattttaaacttgtagacattcaaatgctttggaataaaatggagatagataaaagataaaacatacattttgtatgttctaatctttagaataaaagtgttaccttttttcagggatttctggtttacagattatgactgtatgcagatacctttgtggttttaccactgaagtctgtgtgtgtgaactcatcaaaaggcaactcttcaatgtcatctgaagcacactcattctctagtactttttttcaggaattccagatacatgcgacgttctgactattaaaagattagtctaaccaaactttcttcctggatttgtgtgtgtatgtgtgtttctgaaatctaattttgaagcatgcatgtgagatttgttttctaaagatgaaatagcaaaatataaaacttttgtctcccaggaattctaaagtggaaaaggtagatatttcttatttcagtagacgttgtgtaggcttatttagagattatagaaataacaataaatagtttctacaaacccaattgttagttttaaggcgatatctgagaagctaggttagtctctttttactctgctataacccaattgttagttttaaggcgatatctgagaagctaggttagtctctttttactctgctataagtcacgtggttcacgtgcagactgagagtagaagaatggatgttctgtgtattggcacagtctagccactgatcctagccacactgtctaatagtatttaaaatattttcaaagtttaaacggattttaaaaagacagctagcaaatatcattaagtggtaatagcaaataagtaatgaaggtgagtggtaggtgggttggaatttctctttttaagctaatagagaatatggctgttgatataaaaatagatagataatttgaaacatgaaaaagaaggtccttttaaaattgatttgcatattccaaaaccattaaatcagtagtcattgcatgtgccatagtgttaaaatggaagacttaactgaatgtgcctttgtagtgcctggaaaatacatttctgtcagaataaacaatactttctactcccctattatattctcttttgtcagttaaaatgaaaagggagaaagtgaccttctctttgttataatctacttggaggggctgtatcctttgtttctacaagcagtacatacacaaaactttcagtaaactttgtaggtagtaaatccactttggaaagccaataacaatggaaataagtatatacaaaactacacaccaaaattttttaaaaagttgcggccagtaaacgaagagcaaggtacccagttagataaatgctctccctaatagagtggattgttctaggaattattgaaaaacctgaggaattcacttagaaaattaattccatttagctccatcttacccaatacatgtttttggtcctaattattaaaaagaacatggtagccttgatgagttgtgaattttctatcagagtaacacaaaatgtggtagtttggggtaaagagatggaagctgtcaattagccctggaaatctgcaagcacagtttctgatataagtgacaagaaataacattggattcctctaagcttatcactatgtaaaaactgatgttgcattcactggagttttgcttgacagctgcacctgtccctcaaaaaccttttatgtgttgcaactggcctaacattcaggaaaagctaacacatttgctatagattctttctatgattttgagatgattaactacattaaatgttattttacattaaaaagaagttagcaacacactcttaattagaagcaaagtgataagggcaattatttttaaatgacttgttgaaatttaacacatgacacttccaagtgcaaatcttccatctcttttgctttattgagaaataaaaaagaacaaaaaccaactttcaattaatttaaaattcaagtttttgacatattgaatttgccaagcattgaaaaatatcaaatttgtgaacactcatgatgagtctaatgtttttattgctttttaagagataatttaaaacatcatgaggtagctaaccatataatcctgtgggatagcaacattctgtttctaagaaaatgatttctaagaaaaatgattccttaatagtaacccatttgctggtcacttttgttctgttattaatgaaataatgttgataatgtcaaatattactatgttggtataaaatgatctgaataatctctgccttcaagagtcatcccccaaacaaagtaaaatcaaacaaacaaaaatccccacagccatttggtagctaacctgtgtgatagagaatgactgtcaactcgaagcttaagtgaagtcagggaaaactagtgaatcattccaggagtttgaaattattagacattaaacttttgggggatttttatatgaattctttttataacagtcagtataatctcttctgtgcctatttccgttgcatgtgagagaaattctagtcaatggcaaagcgcttcactgctgccattactgcagactttatagatcagagatgtgtcagcatgttagctttagcagtaatgcctcttttgtgtgaaaccttatgggccttgcaggcagtctgtcatcctgacactcataaaacgttcaagtccccatatttattatttaattttcttcctatatatagcaacacagcacttcaatatatgaatgtgtagtcaaaaaaatgacaggcaattgtggatgggactaatgagttttaataatacacatattagggaccgctaaaggaagtttaattaagaaaaacaagttgagcatgaaattcattttggaacaaatgcaagttaagttactactactgatgtaaattcaaaaaccacagtgatatatcacaggaaattaagttccagcctgagactagacctaactaatgcagttgacatcttaggacttagctttaagtggacaaactttgatttgacttatgaaacagaagaatatgtacttttttcactttctcctggtttgtatagaaattttagtttagtattttcactgcatatccagctacgctttatgtacataatattagttcacttgtgacaggccacacagtagctttttctttttctgtagcctacttttctaatgctacatatgcctacaattagagctacctgctgaggcccatgctgtctctttggaggtgctgtaggtggtgcttcattaatagaactgcatagtcaactttcctctacctataattctgtttatgttttgcataatttagaaaataaatagactaatgtgtttgcttgcttacttttatttatttatttgatggtggcagtgcatgtggaggaaaagcagaagttggggaagagattgaatattgggcaactattttcttagaatgtgattttcttatattttgcttgtattgaaatagcacagacactttctataaagagtaaataatcaggcaatgatatgaaggtcttattgtatacatatggttctcaacaaatgcctattgggaaacatccaattgatatactgttttttataccaatgtttgtcatcagttttttgtaaccataatgattcttttttcttccctgacacacccaatgaatggtagatctacaggagaagaaaagaggttacttgtaatgtttgaaaatgaattgaaaattgtcattgctttttaaaaaacagtcacaatgagtactctcatattgtcatatggaatactttctatgcttggaagatcaacaagttcaaacatgtaatcaagtaatattgagttgataaaatccaggttgagattatcattagtaaaagtttttttccatgtgacaaccaccacttctatgacagaactgaccagaaaaagtgattacagcatagaacgttgtgaatattgtgaatggttgtcacaatattcacaccttgaaaataaaacttgagcaatttaatagttaactatagagctaaaaggaataaaagttcacttcagcaaccattatgttacaagtcagtgcatctgtcatttctaatttaaatctgtattacttactgtccaacactttacacataagtgacagtgttatctattctttttcttatgggtagaaaaagtcaccagtttcattacctgtttaactgtgccaagtgttctaatacatatgttactacaagattgatgccaaaagtccctgttatttcacgccacggtctttaataacaacatctaagaaggaaagcgttttttgttttgaaggaatactgtactagtagtctgtataacctccaccatagtaggggatttttgtctggtttgttcggagctgagtgtatttctcttcatcgcctagagaacagtacctggtacataactggaaatcaataaacgtttattgaatgaatgaatgaaaatcgacttgtgttctagccttggatgttagtaactaaacatgtaacctctttatgtaatgaatacctgggatcttcatttttgctttttaaaaaatgtataatcagtagttatttgaattgacaaataattttaaataatgtacaaaattccaaagggaggaaggattctattcaaaaattgaatattaattagagacaaatagtaactgaggctttttagtgatttcatatagagtttatatacttcactttgataaattatttgatcaagacttacaagtgtagtaggattatttatattgttataatttactgaaggtacattagagctattttcttccatgaagaaaatgtgatatctcagggaacgttggaattactaaaagttatttcaaacaggtagaacgtgaacaataagacaataagatttaaaatataacggtttgggattttcgtcattacttaagatctttttccattttgtaaaactttataatcccattctccctattataaaatttgaatttaaatggtgactttatttggcaacctatattccatgtgtatattaaattcttgttaatattctattctattcattaatatattgatatactatttgtgttacacaaatggcccatgaacagggcattattttgaattttgttattgttattagtactaatgcaacttttatatgaaggaagaaaatgatgtagatatataaaggagattgctagtgtgatattctttctcctttggatcactggttgagctctaagccaggtcaggagtgacaggaaaccattattgctgttcggtgccttatgtgaaaggcgttggtggtcttagtccagttcctagtagacagctactccttaaacaatagtcaccacagtatttgccaattccagcaaaagcctgggactgaatggacacaaaggtttaactacccactctctgctgatcatcctccaaggggtcaagattgacacaccctggcacagggccatactcaaacttagcactgcctctgccaaagttgcagctattctctggcaacaagggattttttttaactggactttaattaagcagggaaccaggaatggcaattttccactcttcccaggcatgagcaactcactacacacaaaaataagcttaaagaatgagttgagactgtagcactcttcttaggttgtgctagcttctctataaagatactagcaggcataattaagttgcttctggaagcaatgacttgtgacccaaaggtggccccttccagacaaaatcatcaacttaatatcaagggaagtaatcagctctaccaggctgtctcttctgagctcttgagtgattattcattttcttctgtgggatcacagggtcatcaattggttttaaaaatgtatcctgtggtattttacatatacattaaaactgttgcccatgacttttgaataacattctgcctcattgatttttgcccctcttgcccccttcacctccctgttcatttggaagtcaggcttcctaagtagattctagatttaacaattaatatttggagattacacctgaaaatagtttcagaataaatagaaagtaaaacttatatagttaatgttaaattttttttcagccctcctcttcagaataacaaaataaagaagaagctgtctaatatttcgccattagttgtaatgatggttatagcagaaatactcagttttgtaatgcagaagacgatgctgtcaccttaatctttttctctttttgttgtcagaaaagctattatggcatcttagaatcttattgtattttcttttttgccacacaatagtggaattagctgccagtctacatggatatctatgcacacgcctacatgatgagaaatttccattgtattgtcatttgtttccacctcttctatgtttcgtcccccctggctgcaagtttaattaagctaaagccttcacagaggtcaagcatcacagatggataaataaaatctgagggttgtgttaattgatgaaaaatagtataatgaattaatgggtcattcattcaagaaatattttctgaggacttacaatgtaatgcattgttctggggatggttgttaaaaaccaacaattcaaaagacacaccctgtactctcaaagtgtaagggtaatctgatcatgccatttgtatgattataatgattctcatcatagtttggataagatctcacacccctaaaatggccaacaaattcttgagttgtcacatcctttctcctctcctgtctgatgggctacccttctctcagttcacagtgatttctttggaaagccccagcctccacagcatttgggtttcctgttacttctggcacattctataccttggttttcaattgccaactcctactcaatctcagaccctggtttccagattaattcttcaggaagatcatcattcccactccatattcttaaatctcccctcaaaataccctgcattatccttcttcatacagtatttattactagatagctctctgtgtaattgacttacttaaagtctatcttcccccattgaacttcagtctttttaaaacaattatttttgattcaagggtacatgtgcagatttgttatataggtcaacttgtgtcatgggggtttgttgtacaggttatatcatcacccaggtactaagactgttacccaatagttacttttttgtcttcatgaatattagcactattcctctcctgttcacgtcgtcctctccaatgcctagtactattttgccaaatataggaatgaagatggaaactgagattacaaattactgtggaaaaaagtactgtgtgtttagttgcaaaaaatgtaataagtgttttgagagataagagaagggagtatttttatgacttgaaggactagggaaggaagtcttattgacttttgagccaggccttgaaaggtactagctgtggtccctccaggagaaaactgatggggaaggcattctccaggaagaacaatcttggtgaacaagttgggcccaattaactgagcgctgcttccagggctgtgctgtattagtctgttttcatgctgctgataaagacacacccaagactgggaagaaaaagaggtttaattggacttagagttccacatggctaggaaggcctcagaatcatggcgggagatgaaaggcacttcttacatgttggcggcaagagaaaatgaggaagatgcaaaagcagaaactcctgataaaaccatcagatctcatgagacttattcactaccatgagaacagtatgggtgaaaccacccccatgattcaaattatctcccactgggtccccccgacaacacgtgggaattatgagagtacaattcaggatgagagttgggtggggacatagagccataccatgtcattctgcccctggcccctccaaatctcatgtcctcgcatttcaaaaccaatcatgccttcccaacagtccccaaaagtcttaactcattccataattaaccaaaaagtccatagtccaaagtctcatctgaggaaaggcaagccccttccagctaagtctgtaaaatcaaaagcaagctagttacttcctagattcaaagagggaacaggtaatgggtagatacagccattccaaatgggagaaattggccaaaacagaggggctacaggccccatgcaagtccaaaatccagcagtgcagtcaaatcttaaagctccaaaataatgtcctttgactccaggtctcacatccaggtcacactgatgcaaggggtgggttcccatggtcttgggcagctctacccctgtggctttgcagggtccaacctccctcccagctgctttcatggactggcattaagtgtctgtggctttttcaggtgaatggtgccagctgtgggtggatctaccattctgggatctggaggaaggtggccctcttctcacagatccactaggtgtttccccagtagggactctgtgttggggctctgatcccacattttgcttccacactgccttagcagaggttctccatgagtgccccgctgctgcagcaaacttcagcctgggcatccaggcatatccatacatcttctgaaatctaggtggaggttcccaaacctcagttcttcacttctgtgcacccacaggctgaacaccacatgaaagctgccaaggcttggggcttgcaccctctgaagccataggctgagctgtaccttggccccttttagtcacggctggagcagctgggacacagagaaccaagtctgtagattgcacacagcacagggaccctgagcctggcccacaaaaccgtattttcctcctaggcctccaagcctgtgatgggaggggctgctgtgaagaccttagacatgccctggaggcattttaaccattgtcctggggattaacatttggcttcttgttacttatgcaaatttctgcagctggcttgaatttctcctcagaaaatgggtttttcttttctatggcattgtcagactgcaaattttctgaacttttatgctctgcctcccttgaaaaacggaatgcctttaacagctcccaagtcacctcttgaatgctttgctgcttagaaatttcttccatcagataccctaaatcatccctctcaagttcaaaattccacacatctccagggcagaagcaaaatgccaccagagtctttgctaaaacataacaagagtcaccttttctccagttcccaacaagtttctcatcttcatctgagaccacctcagcctagattttattgtccatatcattatcagtatatttgtcaaaatcatttaacaagtctctaggaagttccaaactttcctacatttttcggtcttcttctgagccctccaaactgtttcaacctctgcctgttacccagttccaaagttgcttccacatttttgggtatcttttcagcagtgccccactctgctggtaccattttactgtgttagttcattttcatgttgctgataaagacatatctgagactgggaagaaaaagggatttaactggacttacagttccacactgctggggaggcctcagaattattgcaggaggcaaaaggcacttcttatgtggtggtggcaagagaaaatgaggaagatgcaaaagcagaaacacctgataagacaatcagatctcataagacttattcactaccatgagaacagtatgtgggaaaccacccccatgattcaaattatctcccactgggtctgtcccacaacacgtgggaattatgggagttcaattcaagatgagatttgggtgggtacacagagccaaaccatatcatgtgtgttaccttccagtagtattgtttattcacaaaattagtttgctaccaggtataacgtctaccatgtactcaggtgttactccttgttatttaaaaaaatattttgttggtaaatttttttctccaattaatgttaagttttagttggccttttctcattaacattctattttctctctctcttttttttaatgttattggagaggtacatttagtgtggaagtagcccaaggggaaagagaacaaatagaaccgtttatatactctgcagagaaatggggaatatcatgcaactctggaaaacttttgggggctgcccacgatttctcccaggaggaggttctgggcaaaattaagaaggaggcagcgtttgtctttagagagtgttaattcttctgccttatctctttctatttcttgaagcttactgaatccataaaatgtgctcttgttttattgaaggatgttactgtggctttgtgtttctgacttcagtttaattatctgttacaagaagatgataatgatctctacctcatggtacttagagacaataaaggagatgatgcagttagctcaatgtttagccccagtacttactcatttggtgcttgttgttaatccagttattattacatgatgctcatggcagagtaaacttgtcaccactttagttctcaatagccttatgttaatatggtcatgacatgggtcctagcatcccttggaacttctccatgatcaagaccttcaactttgatattctcatctcagagtaaaccctttttggccttggttttaattgttttatatttttcccctttgtgtccttctggtactgcttaagtctatgtttagatttagttgatctgttcaacattaggattaccatttctgtaacctttgctctttgctgttctatcattctttacttccttatccccaaccctgacttctatcatttattctctgccccaggctattgaatgttgctggaaaaaagtttcaataccacactctttggagctgctgcaaattatgactattaactaaccccggcaagcagatgagcagcctttttattttccttctgttgatattctgtgtgtttcactctcctcagttcctcaacctgagcataggactttattgaattggtctcactgaggtgcagagcacaaactcctgtgtcacaaaggtgcaggatatgttctttggagttaggcagtcttgggtttgtttcttggatctgccttttcctggcattgtggccttcagagagttatctgaccactttcacccacatttttctcacctcaaataagagggcttgtcttctaaatctgttatgaagactaagtgacatgaactatgtaaagtgttttggacagcgattggcaagtagagggtgacctacaatagtagctgtttttgttgccattttcacataattgtggatgaatccagctgatatttcaaactgaacgtggaattaagattctctctggtttcttttacaccaattcattcacaaaagtaatgattcccacacctttgtatctagtctgtacgtttgataaccaaaccatatttttgctaaaaggtgaaaagtgtatgcatatatacatatatgttactttttagtaaaaaatatggtttggttatcaaaaatttatgtaggaatatacatatatatatatttaataaatatttctatcaccagattgcaaaacatacacaaaaatagacactaagaaaatgagaaagataaaattaacagtattttaaaatgtcttataaatactgatgacttcattgcattattcactaatatctcaaggcacagagatttttagggcacagttcccagctactaaaatgggcattaattcagacttcaagttatcttcttgaggttttcaaacatttttttctgatttgttattatatctgattagatggccattatttttaatcttgtgatatagctgaagaagagcttgtcctaaaagtagaaatttcattttgcctttttacagttctttatttattattgtatttctagtactccctttcgttgatatttgataaaaagttaatccagtagtttgttttttaagggttactttaattacaacttgatacaaatgtgtaaatttatttatccaatgatgtaaactctaatgcatcactgcacattgaaaatgaacaattaataaaaacaaagtgctattggtggttaaccaactgcactacagaccaatctaccttcccaggaacactgtaagtgctatatgcatcaatagccttgtgatgacactgctgttacatcatatattcatattagcaaactttaattgctttctctttttgttttacataaaaaatggcaaatagaagttcaaccatttagttcccttatctaatcatcttgtggtggggtatgaacacgctgctttagagatctctgccccaaaataccaccggtttaattttcttgtgaatgaatttgataatactttccttctgctaggaacgtgtaatggcttttcgtcatctagagaataaaatccgaactctttagcctcttaatgaagggcttgcttgatttggctctagcctgccatttcaatcttatccaatgctcatcctcatttactctgtcttctgggcaaactagactgtgcgttcctcaaaaaagccttttacttttctttctgtcataagtcaggcttccaaaggaaaaaataagactttgagatgaaggtttgtctacaagaagtttcctgggatgtgccattggaaacaattcctgtaagggagtaggagaatctcaaccaactcctccctctgcccattttcatggggagctttggggctcctctgattattctgtattgagaaaaggaggccaggcctttgaatactggcaggaaccagtcattaaaatgtgagctgccctcaggaagggtgagcagcacagtatctactgaacattctttctgctgtgggatcccttctgtgaccaacagtgtttgtccagatcgtagttcttttaagcccatcttaaatttccctggattcatgaactcgtttctaatttactagctggaggtagacttgtctcttcttttgaagcctaatatcattttgtaaaattgtgttcatttgtttattcatcccattttaagtacttactatgtgagttaattacacattagttactttaagtattcatttgctgaaaggcgtcaaacagtttatatacattggacagctttattacaggcaaagaatacagtatggcaacagcagaagaaggatatgcattaaactgaatttaaaaatctcagactctggcttctttgttctcccactcctgggtcatgaagaatatccttttgtctctaggtctttaaccaccactagtgtatatgaaacattttgctacagggaactcagtatctgtcagtaatcaggttctcttacagtgaactgatcacatagatatattccaagtacatggctagccttggtcatcaagtttcaccacactctgctgaaaccagatattattaaattaccttatttgttaaattagtattactaagtccatttttatatccacttattattaccatatatagttaataagctagggtggcctgacttcaaacaacccacagacctataagtgcaaaacattatttgtctagttagtacagttgatcttcattattcctggtttctgtatttgcaaacttgtctgttcactaaaatgtatttgtaatcctaaaatcaacacttacagcacgtttaccatcattccacagacatgagcaaagcagcaaaactttgtcaccctatgagcatcttgccagctgaagtcaaacaaggcattgctctgccttcttgtttctactttatgaacacagattggagatagtagaggccgtgcagtgcagtgcaagatgcttcatctttgggatcaattggggggcattttaatcccaactctagcacctgttagtgaggtggcctcaggcacttaatgctttagaacctcagtttttctttcataaaataaaacagaatctactagttgcaagcattaaggattataacctataatctatgtgagatttgtatatctatgtatgtgggtatatctatgtacatgtgtgtacatgtgtgtacacacacacacacacacacacacacgtgtatgtctttaaaaacaaaaggtctgtgttccctaatttagtgttcatcatgactatagaacataactaccatgaataacaaggatccactctatattgtatagcattggttaagagtcaccatcaagccagggagctctaatggtaaccatgctgtccaatccagaccaactgagattcaaccatgcttgcactatataacaaattttcatatacattttatgagggacataaagatattttttaaaacacatatgcaaagtcttgccccaggtaagaaatttagcagggaggagttgagttcaacaagaaaacaaataaatgcaaacaagaaaacaaagcaaggtagaaataaaaacatatctttttttttagaaaaagatatgtaaaaggtacgtaaagttataagtcagatatttcctgctaggccctgctcccacattcatcatgtatttattgaacacatgtcacatttcatcttgcattagagtaattttttttagattacttattcctttacaatgtcataagctacttgggagtaatgagtagattgttcatgtctttcaattctccttaacattcagtgcaatagcttgcacattgtaaatatctaatgtttgttgagtgaatgaaagattggatgaatgtggccacccactgtagttatctaatgttctccctactcctttttctgagtttctcagaaacaaactagttgagggaccagcttttgatgaattaatgtaagggagaaaatgtattaccatttatgatgcacttttaattattatttatttttattttattctgttagtgggactatacatgctttaagtcaaaaagaggaataatggggaaatttatgagctagtatccccattgacttcgaagtcagacgaagctcgtcctatgtgtggattgataggctaatctgtgggtaatatctgatttggtctactgagtaagattttctggccttcttattttaatacattctgaaatatttcaaacatacaaaagaatacagggaattcaaatactaaagttttgtcaaacttgctgtagtttgctgctggccttttagggccttaccacaggttatccgtcttaggtgtcaattaaataattggcccaattaattgattagttgctagaatgagccttattctctttcctttctactcagagatgacagctatcctgttactatgtatttatgtatttgagaataatatataatattcttttacatactttaagctttaaatagtatttgctgtacctaattttctgtgacttgttttgccaaaaattttgagatttatatatgttgatattttgggtttaggtcctttattttcactaatgtatacaatttgaatttctgaatacatcataattaatttatcaatatctattgatggacatttaggttgtcatagtttggggtttttttggttactaataaataaccaaattattacacaaatcattgttttaacatgattttgtgtaatgacgtaagagaaacctatcactacattcaatagagtaaaactggtaaaatatgtataaaaatatatagcaaaataaaatattaacttccaataagaatagggtagatcattttttaatttctctgtcctatgaaactgtcagaatatttactgagacttcgtcttctgaagaaacataaaatacttttacagttcaattttaaatacactaggatcaatttcttaaaaagtgatcattgtgaattgagggactgtattatgtgcggtgatcataaggatggcctttaaatcagatagcaacgggctcctggatctgctactaattagctaagaggccctggccaaggtaaaaattaacctcttcaagtctgagttcctcatgagtaagaaggggataactgttgaatccacttcatagggttgtaaatgagacataaatgcatgaaaactgaggaatttttaatatactaaggaagcatcaataaatagggggaaaattgtcaacaaatttgagactttctgtttaggcatatatttttttaaattttagtactttaaataagccacatttttacatttgatttggatgactgctattattatagtagcaacttctgaaaattttggggggtcaatactatagttctccaaacatacaacatgtaaaatgggatatttttgtaacctcaggagctaaacatcattcaaatttgaaaatccatcatggcatgcagaattccaatcctgtgcaatttgcgttaaagtagcacatcagtgggaaacaggagcttctttatccttaacacagggatttctaagtacaaaaaaaggagtgttattttgttaataacaaaacaagtatttgatatcagttgtgcgaagaaaaacttttggaaattgctgtagagtacttgaaaattaggttgaataaaacatgatgatggacttttaagacctcaccacaggttctctgagttaggtgtcaaaacagtgcatttttaacaccaaaaggaacttgcaaagactcattcatgctgtggcccactatgatgctgcagaagagtcagcattatatacactttacagaaatgggtttgtgtagctgaatcttcgataaatgctagagttctggaacaggaattggattggtctaagcttgtcttttgtatattaatgtgctttcacagcaaaggtatgtgaattaacacagactaaagtattttcaaggaaagacatttatctccttatagccttctgtgatggattgttcagagctaaagacacactaggccagaaccaaatctcctgctgccctatatagtttttacaatctccttttaagtaacacaaagtcagggcagtctcactgccagaccaacacttctttagcaatcttcccataatatacaggatagaaccatctctaatacaaatcaacactttattttcaaagtaagcacttcaaaaggttgcttgaacaagaaaagacacattttttgagctgtgtgttatttgacagttaacatcacattgctctgtggattacgttgcactgaatgttatattttagtctgatgcagtttaagttgaactgtgtaaacagtgatagatgtttgattagtgttaatatgcaagatgctgtgattaggtatgattatttttttaatcaccacactctctttttgtaatcttcctttgatctctaacagacagtgagaaaaaaactgtaatttaaaatatattgactttgagtcataaattaatttttgcattgcaaatttattgatatctataatatatagcaagatggtaaaataacttgtctgcaaaaaaagatgtaaacttctatcccttttacaaattgtatctaatgccattttctcttttaaattcttgaatcttaatttcaaataggaaacctataagcaaaattttatgaaaacatttgagatacagcaaggaagtgaggtagtttcatctgaataatcatagctgaactcatatgaattttcttgtcctcatattatcttgctttttttgataagcatgggattgggagccacctttttgtttgttttccaatgcatacaatcattcttacagagtttgtatctgttctgctagtttactgccagtttcttaaaatattttctgctattgggttttaaaactgaaacagattaatcttctattgcttgaagtgattgaagactattaataaagtataaatttcacacctaacattcagtatttttaaataatttactgtgacatgtttctaaaactgtgtattttaataaagcctgcttccatgtaaatgtatataaagtcagcagatgcatttctcaataatcttataatcagttagtttacttgtcatctcacttcaatcgatgattttcctatggtaacatttaacttacctgatgctagtcattattaatgtatttctgtagattgtaaaacatctagttatcacactgtctatgttagcttgttccagctcatgatttattttcattttttctaggatatagacctgcagctaactggatttgatttataagagagaaatctgcagtcaatgcccactcttgccacactgctaatatggaaaacagaatgttcaataggatatggtctgataaatagtgatgattgaagatgctgctccaatacatgtgaaatcaatgggagatatctgctgtctgaagatctttcagagcttttctcgacaagctcccctgtaagaaatcggaggtatattctaccattatacagtctttctcaagtggatataaatacgtttgcctcactgtaaccagacaactagacaactaatgtgggaccatggcactgcccagatgcacgtggccaaattatgtttggagagcagtgatggcatgcttggtacaccggggattgggtgccccattgactctctgtatgttgggatgtttgcttcaggctggccatgtgctatcacaaaaattggatgatgtggacccactggtggctaccaactttggaaagataagagggattaagaaggaactcaataatgaaattttggggcctgttattcaatttcttggggttccatatgcagccccaccaacaggggaacgtcgttttcagcctccagaaccaccatctccctggtcagatatcagaaatgccactcaatttgctcctgtgtgtccccagaatatcattgatggcagattgccagaagtcatgcttcctgtgtggtttactaataacttggatgtggtttcatcatatgtgcaagaccagagcgaagactgcctatatttaaatatatatgtcccgactgaggatggtgagtttattgcaggaaaaacagggagatatatttatatattttttctattctaagttctaacaatattaattcatgtgtactggtagtatgcatggcttttcctgttggcatgtagacatattttacatgcgtgcatggtgctctttttgtttatgtgtgtcagtgtatctgtacttatttttttcctgtgcttactcattttctttcctccacagcacgtatatttaggtagaaatgggtttctaatttccatttcctaccaaatgacttctgagaagatgcatcaacatttcctcattgcatgtgcaggctcaacgaattggggatctttcgcactcagtaaatgcaggagcgtattgagttagatagtggtgttgcatgttccggcggtctatgatggagcgccatgttattttctagtcttctattcatttttcagtaaaaagaatatccaaggaatgtgccagaaagcccggcaagaaaatatgtagaaaaggaggtatgtataaaagtggaaattaaaaatgggggaaaaagcttgcagaggaagaacaagatactctccctaaggatgatttgctgatgctgggaagtaaatggttaggtgatgtttggaatctgatgaaggctgtcaaggaatataaaggtgtttaaggagagctctagctgagtagattacattggcaaagctcattggttgtgccttgtgttctggtgctggtagcatcggcaagagttgaatcttggctttgagtttgtgtttagtggaatatgtacttaggctattatgatacctgcaaggaaccaaaacaatgctgtcttaggaactggtaactttgatctctgaactcttttctacagatatatatttgtgttcctcttagaatttgatcactcaatcacaaatctagttgttttgtttattctcagcattccatctgaacactctatggactttctcatcctaaggataaattttccataattattgagcaattattattattaaggtaatagtgtttttttcttagtcttttcattttcagtcacttttccagaggagaatgagattttgcagatttgatactaaatatttacagtcttaaaattactttaacatttttatatttacgttaaacaatttaaaacatagagaagtgcatgattcagaagctacaattaaatcaaccttcaaatcatcctctagccagattgagcaaatgtagacactgacagctgcaagcttgcatctgaatgtagcttgtccacactccacttttatataacattcagtaaatcactcataggagagtatgcttttctatggcagtaaatcatctaagtgttattttgaccttgttcataactttgtagaatttccaatcttcatacagaagtcatattaatattctaatgctgcacattctatctctctatgcacttctaatatcctggctggaccaagtcagatttcattatagcatccttgtggggcagggaatgtctaaactgttctgttctactgggattgcatttatatggaagacactttataaataacaaaattcataactcagttcagaattatttgcattaaattgagggtttttttgtttgctttgtctttgctgttatttcttgggtaatactggtagagtgggatttaaccttcattctttattgatgttatgaattgggttaaaagcacactatacttaagaagatggatatggaggcaataagggtgttttaaatgactaaaaaagtctctttttttctgcaaatgaaaataactgcagtaatttacatacctttaattaatgtacaatactgcagtagttattatgatgcagcttatcaagcatgtgtaattagctaagtgactttcgcctcctattacaaagatgttgattcacaaagtcataaataaagatgctattgaagaatgcatagagcataataaataaaaacatgtatgatgaagaaaaagataagagcaccaaaaggtaagctagtgagtgagaaagtgacctttcttctcatacaactttagaggataaaagatttattagaaaattctttttcattgttctttgtattgttggttccatttgctttagtaagagagttggcaaagagatgtgtaggcaatgctatttaccttcacaaactctgaactaagtaataattagaatgaggacaacatctatcaatgcccacttgagcttgtatggtttacagtttaagtcggttgtgcttattcatactattaactatgcattctaaaaatcattttggcttgggaatttaatatatccaattattattattaaatacattctgctcatttattagctctttgtacattatcctaaagtctaaataacaaaaatttttgatgtaattttattatataaatagtatttttaaaataaacaaaaactaaagtttagagtttagcttttaactagaggagtagaaatcatttttccgaacttttacctgtttttttaaattatttttctaccatgaaggggctattttggttatttcaagataccatattttgggagtcaagaaattattagtccctttatatctgtttatatatatactaatatatactgcatgtggactgtgagattttcagtagaatgccaagagtgtataaatgatggtttaggaactgtgagaatagttgctttgccaggactttatgaatgatggttcaggaactgtgagagtggctgctttgccttttatctagatgccattaaaatcctgtcttgttattatttattcttttattatgtatggatcacctgcagagacagatggactcccatccctgagccaagtactctataatctgtgcatattgtattcatgcaaaactatttcctaattgccaattacaagccacatactattcaagtcagtcctcttcccatagaacttataatcaaacaactttacaaagagcaaagtattttctgtactttgttgtgtataaaagaaaagaaatcttatccctcctccaagagatgttgttctataatttttaaatagagcatttacaatattttcctgcaattaaagaaaaaagctcatttttatcaataggctgccttcattttaaaacgggtcccagttgtactttttaatctgttttttaatatttcccatgatagttttagccatatgttaattaacctctagatctttcttcagagttttatccttacaaaatggaaaagaagaatgaattcttaaaatgagatgattttcaacacttgaacaaacaggcagataacatgatagaaactggagtttggttgtggagaacagacacctggttttatatattaggtgttttgcgtaatttatccatttaatcatcatagcaacattaggagaaaagtatattactctgtctgttttttaattttaaactttttatctctattttacaagtaagaaggtagactctgaaaagttaggtattccaaccttaccactggctgctagttagtggtagaggcaagtttggccttaattcttttttacattagatagatttccgttatgttaaattacctcctgtgatgatttccatagcagagacttatatctatccatccttcctctctctcttttttccttctttctttaacacattcaaatatgtcatgagttctttttattctatcagttgaccgtattttagacagacttaatgctcaccttaattgaattgaatcaagctaatgttagcagccaatttccaaaaatatattcagtaatcatttagtgaatactttaaacctcaattacttttgcgccaatctaataataccacatgcttcttactgtccagattaagatccccacatattcctcctggctgctatcaaggagttgctttaacttgcttaagtttccctctgtttctttaggttgctctcctgtgagagtcgctaacaaacaagaaagtggtcaaatattagacagtaaacatgagaaggagaaacaaaggacccagagaggattcacaaacacattgtctggctcatggattctctagagttgtgtagtcttgtgtttctccagcacttttactattatttgcatagctcttctaagatggatacagaactaattttcattcctgcacttgtgagacattaacttgcttttctatttaccccaatttgtattgtgcagaagattaaaatctttgtatatgactctggtacagtcatttactctttgagcattttggtcgtgattttcaaaagtgttttacgtgctctggttcatggtctttacctgagataatattgaattctttcaagagccttttccacaggtttttggtttgtctggttgtctatttaacatagggactgattttttcctaatttaatatgtataacaatgactcctagtactgtcaaggtttttaagactctaaaaggggattatattccagaatgttcttcctttttgcttatacatttctcactcatttacttattcatttgacaactatttattgagtacttactctgtgctgagtattgctctaggtacagagtaaataaaagaagacaaaaacctttcctgcttgtataaagcttacaacctagtggtagagacagtttgtaaatgatgaacacaataaaaactaaattaaaaaggtgtgagagggtgagaaattgaaacagagtatgaaagaccaagagtgctggtatggagagtgaaaatagttaaaaataaaatgaagactacctcattcgagcaaagatctgaaggagataaagtgagtatctagagaaagatatttaaggaacaattaggaatatagcagatctggaaagggggaaaagagagagagacagaataatctgacttgatatttttaaaaagtcactctggtggatgtattgagagtaggttgtaggagagcatggagaaatggggagagtaagaggaggctccaggtaagacttggtcatggtccaggctcaaaccagggtagtaaccacggaagtgatagattcttcatatattttaaagatcacattccttgatcaatttgctgtgggctgtgaaagaaaagaagaagtcaaagaagattactatgttttttatctgaatacctggaataatagatttgccatcaattaagatggaaaggaagaagggttacgggagaagcagagtacaaaaataagtttagttttggacatgtttaatttgaggtgacccttagacattcaagtcaagacatcaaaaagccagtttcttgaaccaatatcttgaattaaggtagagagaaaggtctatgtagagatataaatttggcagttactctaatatagaaggtaaagatttcaagtcatgagcttgagagagaataaaaggaagtgaatgaagataacaaaagaaacaagacaacaaggtttaatttataggaacattccaacattatgaggtctggaagaagagaaggacagcaatggaaactgagaaagaattatgtatgaggtggtaggtaaaccaagattttttttgttggcctggaagttaagtaaggaaaatgtctccaagtgggcatagtgatcaactgtgccaaattaacttttgtggggtggtgtgggttttacacactggagtgtgtctaagagagaatgggtgaagatttggagtggcttaacataaataattattttaaagagttttgctttttaaaaaggcatcagaaaaatacgagaagtgaggaaaatagaggttgcttttgttacggtaggttaagatagaagaaataaagaaatatttttatacaacagcaaacgaacaatattaaatacaggcaaaagatggtagaaattctggaacagtatccttcagtaggtgagaaaggtgggatttgcagattttgaattaaaggaaggaacgtgggtagaaaaattagtatgttgctatgcacagtacatgagtgtgagtgcatgggcagaagtatagtggggttctgctgttatctgattctttcaattgtttgatgtgtaatgttaaggaaaatgaagatagaattaacatcagtgagatcttcctatggtctagacatcatggcatattaatttatttgatatcgcaacagcctcgtgaggttctcaccgtcactttccagatgtagaaatggaggaacaaagaagttaaattatcttgcccaaagattcataatttgttgttggccaactgtttcctttgaaagagttattttagaatggaggaactaaaacacaacaacaaaaacagcacaaagcaacaataaaaatcatgtttatatgggatttaagatcacatagaaaatgaaattggtggccaatttgctagtagaaaaatcaccacacactgaaataattaaaacgcctagttcacttagagtttgaagatgaatgtaaaactatattgaaccagagatttggcttcatatttgaattagtaactgtggacagatgtggttatgtcttctaaaagctaaacagtgtaagttgggactctgaaatgaagtagatctaaagggctgtaaagttttaaaagaacaacatcagttgttccattgtttactgacagacagagacagtctcctgaagcagatgattaaaagaccattatagttgtccaattcaatttttccaaagaataaatactttttttcttatagaaactggggttgaagttgaaaacatttaagatttatgccaccagcagaaagagttatgctagaaaataaattcttggtaaaaactgctatcctttctcctaccgtatgtaatatctttccttatttattcttttcacatatatggcattcgatgagcttaataattagaatgcaatggtttttttttaagttgagttctatattactcaccattacacattttgtagataatattctggtctttaatatctctcctatgaatactcttctccttcttcctctcctggcaggacatgctaacgtagtttaggacatggcagaattcgaacgtcacaccagtatagacgtttgctagtaacaattccggagaatcattctgagtttgatcaccttaaactctggacaagttgtagaagcataatttctaatcataaatcttcacatagccttttataactggacagagtactttatgtaacacttcttgtataagttgcctaggctgctgtaacaaattatcacaaactgtgtggtttaaaacaatagggatttattctctcaaagtctggagtcaagaagtttaaaatcaaggagtgggaaggattggctctttctggaggctctacaggagtacctccctgcttttttctagtttccagaggttactaatagtccttgctgttccttggcttgtagttgcatcactccaatttctagctctgttgtcacatagctttctttcctgtgtgtctccctacatccccatgtcttcatgcggtcttcttacacaggtgctggcccctagacttagggccctttctaatccagtgtgacctcatcttcattatatttacaaaagcctatttacaaataaggtcattgtatcgctttggtgaattgctgtaacaaagtaccacaaactgggtagcgtaaacagcagaattgttgttgttttgcagttctggagactaacaagtctgatatcagcacatgggcatggttggttctttctgagggctgcgaagaagaatcagttctgggcctctctttgtgtcttatcaatggctgtcttctccctgtgtctcttcacatggccttctgcctgtgtatatgtctgtgttccaatggtcaatattttagaaggatacaagtcatattggattatggcacaacctaatgacctcaacgtaattaattatatctgtaacgatctcatttctaaataaggtcacatttgaggtactcaggttaggactttaacatatagaattttggggagacacaattcaacctataactgtcacatctgaaggttcagctggacataagttattgaaggacactaaggacattgccacttttttccaaactaatcctcagaatgatcccaaatgtttctatcattatgtctattttaaatgttgaaaaactatagcttattggggttaaataagttgcccaagttcacatgactgttaggagtactgagactcctattcaaatcaaaactcaatgtgatagctccctttaccacgatgacccttcctacagataatgaattttctgtgccctcctgagaagttcttttaatttgttttttggtatttttctatcaagataggatacgatgcattagtccatatgcttttataaatccaagtgtttgactttgtgtcaacaaaatgattcagttttttgatatatttcttgaattttaaacattttatccagatggttgcttatatgcaaacatggtttaagttaaaatgaagatcctaccaatttaaaactgtaatattattgcttttcagttctgttccatttgttactttagggaattgaacaacgttatttttaaaataatttttaagttaagacctaattctttgtttactataatcctattcatttggtatctatgaaatgataccactaaagcaatttaagcatagctcataattttcatgaaagcctgtaaaatgttgcaaaaatcagatttaagcaatgacgaaaagaaaataaaaggatctggagtcattgtaaccataattatcatttttaaaagtagaaaaatctgattaatgaacagtggtcctaattttttggtccccattgcaggaatgaaggagggagtcttcactttccttttcttcttcttcttttttttttcttgaggcaaagatctttggagtagttattccacttaaaaaaaaaaaaaaagaccatatcatctcctagtcttagaagcatataaaaacatctgccttttcatcttacaaaagtgctcacattttcttttctccaaaaggtttggggctcctcttctagagtcttctttctgagttcccctaattggaaagtgaaagaaggaagagcaggggtagagggataagtatgagcaggggcagggggataagtatgaacaggacaggttgacactaggacaagtaatgtaaccctgtcgagtagtagtaactatagctactctcagtaaaggaagagggatccctggttaaaattattaaaaatatatatgtgcttcctaatttggactcctaggcctcttgggaacaggtatgttctgtggaggatctctaaaaagaagaatgcctgcaacatcctctaactctccatccctgctaagttcccacaaaccatcttcctcagctcaccatctttctcagcgcaccatctttcctgacaatgagcaggccaggcctcagtttgcaattctgagctttcattaaagagaactgatatgttgctttggcacagtaatttacaaggaggcagatcctgaggtttctgagctcctccaagctaggcagccaagcagcctatcagtgcttctcttgacctatccccaacttcccaccaaagcaaacacccacactcccacacacacccacttggacagcttcctcatccctcacacatatgtatatggagacaccacctacaatggaaagatttctttccttttcttcacttttcttctctccttccttgatttctttcttccagagcaaagggagcttctgttgccttattaaaatgtttggaagtcattcatttaaggaataacttcatttcagtgaaaatggaaatatttataaatttgcattctgaggagaaaatatttcctaaaatggccgcttaaatgattttgtattccaactgactctgaaaggccagagatgagttgtttttttttcttctgtatttattttatgaaattctttggccacctccgcagtttagcaaagggtgttcttataggggtagaggggaagaaaacataaaactttgtataatatttactggggcctcagactatcatcaggtagaaactttgactattgcaagtggtgcttttatcaattaattgattgattgattgttattctttttggtgttgttgctttgctggtgttgtgtcctggaggccctgcctcaggtttcccagtttggctgtttcctgtctctctcagccatggcctactatggacaaagtgccccatctggcactttgggaaagagatgttctttgccctcagagggtttatttacattgcaagaaaaacctcagtaacaagaaatagggctttttttgttgatgtccgtgtcaatattactaagtaaatgtaagtttgatatgtattaaaatctccaaaaaacaaaatgaggaaatagctgcttctgtaaagaaagaaaaggtaatgatgctgatatttggcactgtgttccccataataaaacatttaattaaatctttaaactgtgtatagagcacaaaatatgcacatcagaataaaacacatcaggcataaccaaaactataattatatcagccctgttgcctgagcccaccttagttgctctgccaagaagcaatggtttaaaactttccatccatctgttttttttttttttttttaaagcctaaagtgtacctatacaaatctctttaaagctggggaatgctttggctactgatacaacagctgctggattacaggctgttgcttccagaagtaaaaatgaacagctgatgttctagggctttttctcacttttgttggaagtcttctcagtgcagagccctggggtaggtcctggagatactgagataaaaaaaggcattaaagagctgccctcaaagagttcactgtcttgtgggggaggcagatacagaaagagaaaataacaatgtagtaagcaccctgaggaaaggaggcaaggggcattgagggaacacacaggagaggtatctgtggtttgagattttgaaatagaagttaccccttacatgagcactcacggataaatactgtagtctctcaataccttcaaaggctaatgtagtctatgggaccatatttcagatattaaaatatttttgagtgctttttaaaaatatgtgtgtgttctctttttttgcatggatatcagttgtctcttcttcctaatctcactttgccaggattttagaaacactatctgctcacttctgtagtcctgaatctgatctgtcacccacacttgagacacgcaaacaaacagaaaaacttgtttgtgaaaaaaactggactcaaaatgagagttttcaccatctgtaacccatgggaacttaaatatatagactttgtttgatggtaatattttttcagttttatgttctgaataacaggccgctgaagatgtaggcttcaaataagtgaggtattactaattgggaatctatagaagccaaccctcccgacatgaggagacctttcagggctgtgtacaggcattgcttactcccgacattcaggacacctgcagacaccatccttcttccctggtgcacgctctccttccttctccatttctcgcatcctgatcgagagcctccatcatttcttgcctcaaccactgtaatagcctcttaacagttcttcctattcccattcctgcttctgcaatctcttctacacatagcagccagtgtgatctttgctttaaagtctgaaatcaaattatatcacctctttcttaattcccctcaaggattctctattgctttttaaataaatgtagaactccctactatcgcctagaacactctgtaagactctacgtagtaactcttgtctgccgtttcaatctccttctgtatatttctcccttctctctactttctagctttgttgatattctttttgttcctggaatagtcaacctccatcctacctcaggacccttgcacatgctgatccttctacttttaatgtacctctacctcttttcatgtcagactaagttttataattcaagttttggaaaaatgccaccttgtcaaaacagcctttgctgatcaacctatcaagataaccctacccttttcctccagttattctttgatatctttgtggttattttcttcattacatttgtatcttcatatgaaattattttgttcatttatgtgctgatatttactctctcactgccccagaagaacgtttctcttgctcactgctatatctatagcattcacaaggaattcaataaacattcattgaaaacataatcaaccttaagaaacaatgcaatttgttggagagagccttcatctcccaccatctgcatttatttgagtaatactacacctgcagtaattcctcaccagacatagtaaattctgttcctttctgctatgccatcactgtttgtttatggcgcagtgctccccaaatgaagtaaatttcaaagccaacatcagagtctttaactaagaaataacagtgttcagtggctcagagtctgacagatataacctggactctgtcacgggccctcgaggccaagtggctgccaacagccagagctcttggctttctgcctgtgcacgttactgccagccttattgcctctgcactgaattcatattttaatacaggatgccgacaatgcatttgtgtaataggagcactgaaaatggtttttctttagtagacacaagcttcatttttcctttcccaccttctattttaatctttttcttcttattcaaccccaatttccctcccctgacaaatatatcttctaattattttcttttttccttgttttaccatctacctctgtaaataggacttcttgctaacgttttctccaaggcatttaacttgagattatgagaggcaagaagcctgaataccagataatctaagaagaggtcgaattgtatttgtttaaggggttatatagcattaaatagcttctccaatggcctgtgtggggttctcattccttatgatttggccttccgttggttatcaccataaacatatacgtgaattcagtgggtttttgtcattgttcttcttttcttcttttttttagagacagggtctcactctatcatccaggctggaatgcagttgcaagatggtagctcactgtaatccttgagcccatgggctcaagtgatcctcctgcctcagcatcttggatagctagtactagagacacacaccaccatacctggctatttttaaattgttttgtagagatgcggtctccctaagttggccaagctgatctctaactgctgactgcaagcgatcctccttcctcgggctcccaaagtgctgggattacaggcatgagccactatgtcttttcttcttttattagatattagcaaccacagatttcccagggcaagccagaaatcactttataaaatgaaggaaacgagagagtgagactatattatatattatttatcaccataggcagagtgtttggaacatggttagtgtccccaaaacagctgataaatgaaggagcattttgagtatggtggaaaatgggccagttagatcactgagataaatagagtggccagtggcttttctagtggatggtggaggctgaatcctggagagtggtggtggagaggcatactaagaatgttattgacctataacatctcaatctaggagtgagagataaagctggcagtgagagataaagctggcagcgagatcaactggatctgtgcctcagaacacattgcagagtgatagagaagagggtgttggatttctggcagggctggcttcatgggctggtagtctgtgcagtccggctgatccctgagctcagaatggcctcacccttggttaaacaatcttttttcaccgtcttgaaattcataatactttttgaacaaagtatcctgcattttcattttgtactggatcctacgaattatttagccaatcttgtttcctggttttgctggcattttccccatggtgcacatcagtaaatgttcatgtaattatgagagatgatagaatagaaaccctctgtgcacactgaataattagattaaaactctcaactaaaacactatgaccacttgtatttttacccttacagttagttcccttcacatctaaggggagcaatgaaaaaaagacatgttgtaactttgggaaataaaagatctgttcctctattattctgttattcttgttttaacgcacttgttcattatctgatcaaacaattattgagtgtttaatgagtcctaggggctatgctggaccccgaagataaaaacaggaagacttggtacttgtcataggggacaatcaagcaaggactcacaaaaatcattattataatagctacaatttgtatagtgcctaccacaggccaagcattgttttaatggctttatatattaacttacttaatcttcacaataaacttatgaaaaagttactattagtatttccactttactaaggagaaatatgaggcacagataggttactgtgcaaggttccacagttagaaagtggcagaaccaggattcaatgccagatggtttagctccattgactgtgcccttagccactcactataacaaacattagagatgctatgggaaataagtaaaatttacatatggtagaatgctacccaaggcagggaatggacatctctatcttggatgggagctggagagaaaacacttcatcatggtaatgatacttgaaatgactgcagaacaagaggaagtggcccatccactgagcacaggatgtgcagggatgagtgggagagggcttctttaggtagagaacagcttgtgatcagagagtacagtgagagatgagcctggagctctaggtgggatccagatgtctccggagcttggagtatttctctaggtgataggatgtcattgagggatttaagtaaaggcttgacataatcagatgagcactgtagaatgttctttctgacaacagtataaatgatggaatccaaggatgataaaccacgatagggaataactagaagttcagtacaacttagtgtgtcagtgacaatgaaggccttacccaaggcaataactgtggggtagaaataaagaaataaagggtaagagatatctatttggcagcttcatagggtttgtggagtaattggttgttatggggtggcaagactgtggaaataatggaaacaaggatgactctaagatgtcttactgtccagtaccttcctccttgacctgatgtccttacttcccctaaccagccttgtctaatgtggtttcttcactggaactcaagaaggcaggatagggaagacagtgagttagaataataaaaaaataagttggaggaaagagaaagtgtcaaaattagaggagaaaaagggggaaaggcaccagaaaataaacagaagggcaggctggaatactgaacaaatttttaatcactcatatgccagataaaaggtaagttcttgaaaataaagacatctatatgaatttattttattgagtcatcttttaaaaatagaacttgggagagagataagtatgtcagaatgagacagagatagataacacagaagtggggctgggaaagaatcataactctgcagcttacccacggttggggtaagctcaaaattgagaagaaaaacatgcagagacaggaaatcataaactgtcaactggaaagaaagcaaaatcatttagttgtagtggaaattgctaaaaagaacaagcaggtgcataatctatgcagatttgtataaatgactagacaaatgaacataagttttcagaacactggtaagtcagaaaatgcatattgattgaattcaacgtgtatttccgagcatttactgtgtggcacacctcatgctaggtactgaattacaaatcaagtctgtacaaattagtgacacacagaagcatacaagtactgcacttgggtactcaaaatgtgatataaaggcagattacaaataatcaaatatgtacactacaagactagagaggtcattaaggaggaagaaatgttatagctcttcataaaaatgtaagaactcatgaagtttaggttgaatcagaaaggtatcttagaagaataatatttggaattaaccttgagtgatggatagactttcaacaggcagagatgtagggcttttgtctggtaaggggaaaggcattacagttggtaaagtcgggagacagtaagtgtgcagttgattagagcacataaaatattgaattgtgataaaatattgattgtggtaaaatatcagaaccctggagggtcaggatgaggcattttactatcaacaagtatgcattgatggtttttgggcaaggagctgtgataacaagagtggtttcagtaaagggtgggccgggaatgggaagagtagagaattaattacaggaaaggagactagatatggggtaatagcactgtagtttatatgaaaagtgactggcagtggaaataaaaagataacaaatttgagagacatttcaaagcagaaattagtagaattggaaagtgactgcatatgggggtggacagtgaacaaggaggccttggcaatgttgacaacagattggaaatgaaatggttgggaggaaggtgatgctgttaataaatcctatttccaaatctactctgaggatagattagcttgtgaaattttcagcaaaattgatcatgggaatgaatttaccattctttcctttattcttgtcaatataaaggtataaaaaagctatttatgcctttgtagtgtgttcaaataaaatattaacctcatcaattcaaagaaatgcactgaaaaatcctcctttcattttttaccaaagcagggagaaaagatgatacatcttacgcactaaaatttctctattactgtcatttctgagctgtgtatagctctagatttccaaaagagaaatgaatagggtacataatcctttctttttaaaggctacccactgccataggctgtctgagtataattttcaatgacaatccaagattgaggaatgtatacaaggccaattacagactcagcttgttttttgagcatttaactgttctcatctagtgctgtgtttatctgcatgggagtggaatggacccaaagaatttgaaagcagtgaaagccacatgtcttgctgtgagaagtacagatgggactggttaggctgtttcctgagactcatacacctagatcattaaaaccacataaacctcagagagaggctgagaatacagaatgtgggacatgaagtagaaaagtatctaaaaggaatggcaaggacatctggaaagatcagagcatgatagaatgcccaaattgctttccgatgctgacctgctggaagaagaagaaaaatagtcccggtaaaaagaggaggaaaaaaaaaaacccaaagcttattttaagattctaaaaaatgaacagaagtttccacttgtaagatgattatgctgatgccaggactgcatcggagaagtggttttatttcaccttaggtagtttaaaagggcagatattacacccatggcatttaacattgctgagaactattttttgttgcaaaaattaggaaagtaaatcaacagtttccacaatgtgattccaatagaataattatttattgtttgatatttccgaaagaacaaaattactaactgacccaattactaaacacaagttgccatacttcctgctcaataacaaatgtaggccttggggaagctgcacatagccttccagatcatttagcaaataaattcttcagaaatcgttaacagagcttctaaatgcattctataccctcaagggagtgttgagtcccagggaacttcagctgaatgaagaactaggctatgaaaccacaaagagccagcaccgtgttttttttcataatcattcgacagcaacatatagtatttagacccattctgcctctaaaatggcctctacataaacctcggtgaaggttaagtcattctcatgtattctgtccataaagccctttggcatgcaagtcaacaatactagttggatgcttatagcagtgggacccactgactgtgtcaaggagttcagtctgattggaaaagaagttaggacaggtgcatacatagtgtaaaaatggggaaatgtgattatttttgtgaaaaaaaaaaacagattgttggagagttaaaagggaggaggagtaatatctaattgtgaatgtgttttggatgaggttaaagtgaacaatcagaaaataatgagagttaagatagccttgaataatatagactttttgacaggtcactatggaaggagagaatgtgtaccaacaagagagaatagcatgggcaaagagaagcattgagatgggaaagaacaaggtttgtgaccatcacgtggctgcagttgagctggggaacaggtaataagtaccaggaaggaaagattgattgggacatattgtgaagggcgttgaatgccagtgtgaggattttaatttggtaggcaaaggggagctaccagatgtttgtgcgtaagagagtgacatgattaaaagtgttttaggaagattagtttggcagttgtctttggttagattgatgatacaagagactgggtcttgtgaaaaataggcttttgcatttgtgccatctgacaagaagttgatcaggaatttcaaaaatcttttaaatatttaaattatcttgccgtcccattgacatctatttaaaaggccccaaaagataggcaataaataactttattagccttttttcttttttcaaatacaaataggaatcctggaagaacatgtatagagttcaggagttgttctccatgaaaggggcagggccctctggctctaacaacaggtcagctgttgatagagttcttgacccaaggcttcctgttctggctctgtcattctgttgccgtgtatttgagcaagtcatttttatcgctttgggcctcagttttcacttgtgtgagatgaaggtttgggcttcatgaccttcagtgttgcaagatttctcattttcagattctttctaggaacaaagggaattgtaatagattacagggttaatatttgactgcactttctgcctacttcactgacttttcaagaattctagtaaggaggatgagtttcaagacttcacttcatgcatggatttaatgtagcatgagcttgtttcatttgttgcaacagtttaaatgccatctttaatgttttcttctcatgctactgctgctgttttccctgtttccaagaagcgaaacttttgcagatatgcctgctcccacctcctacaatgaattaaggatacattaaggagacaatttcttctttatatttaagaagatttagaatacaaatttaaataaattagctgtgatatgatattgtatatcttagttttatctgtcagggaataatttgaatcagctaactatactgtgtagtaaacaacatgaatgtgagacagctaccacatgcagtaagaatgagcagaaggtttctcaattaatttacttaattctaatagaaggtaaataatattaggaaaccaatggtagtattacccagactaatttatagctcataggttttaaataggaagatgacgatttataattgtttttttttttcctattttatccactctctctttatttatattttttttctggaggctttcagatagttcctaaaagacttgggatgatggtgagagtcttcttgaactttaacttagttgacagtgatttcatccatgtcagtctggtcagacagatgtggagaatgagtgagtgaaatattgttaactctgcccacttaccttttccctgattttaactagagagtcctcaattgtttctggatttactataatacatttaaacagtacttagctgagtttgagtcatcaaggaactggggataccactgtcagaagtcccactcttttttaattttgcagaaaaatgggcagataaagtagaatggtaaagaagtaaggaaagggactgacattttgtaatctagggaaatttttcatgatgtgtattttagacataagatgtgttttgagatgtgtgtgtaagtattttatgattgtacctaactatttcctgtcccctccccccagcacacgtaccaccactaccaccatcctggtacgtctgcttagattgcagctgaataaagaaatttaggtttgccagttgactgtactaaatttgtttaaatggtgacatgtgtacatttactcatgcttttgcacttttccaaataatttccaagggcatgtggaaaagtggagaaagtctctgtcttccccatttttctttgataagacaagaggctttcaatgtttgtaatgtttcaagttacaaatcattaactgtttattaaataacttttatgtactagttatagattaataataaattgatatattatttactgatgaaacattaagagatattaactgataaaataatgaggttaaggagtattcggttaacttggctaacctattcacctgaatctgcatagaaaatcttggaatgttaatgtaataagtctttatgtagtctatagatacaaatcaattgactttttatttaaaaccatatttccagtttgaagagctcagtataaaattgaaataaactttctgttggggtatggactttgttacactataaaagatgatagaaacagttttgaaatttagtgtgatttttcttgtaaaaataaatacagctttggtaattgagtttttattagcaactatatcataatacattcaaatgtataatgtcccttctctgtttataacctgtatattagtgctatccaatagagctttctgtggtcatagacatattctatatcttctctgaccaatacagtagcgtctagctccatgtagctatcaagcgcttgaaacatggctaatgtgactgagaaactaatttgatttaattttattaatataaattaaaatttaaatagctacctatgattaattgctaccattttgggcagtgcagctggaaatgaatattagtattaccaggagaaagagaaaaatcatcttggattttcaaatatgagtaaaatcttattctttacatttttatatttttgaatttacaagatagtggctagaaactgtcacaagaaggtacttgttcaaatagaatatgtgtggtttatttttacttttaggcattttgagaataggacaatgtaaaatttattttaactactttgaagtttttgctgaaattttgtcataaatgtttcaaaattaaagcaaaattcctttagaatagtctgttacatcaagggctattttatatatggcacttttgctaatattttttagaaatataaagtagatgagaattatgtttttgtttctggaactagtgtttactatattttttcccagtgatatagaccagtgtgggccacatacctaggctattctagaactggtccctgaaaaatgatgtcaccatttggaaatattttattagttgtttttatgactcttggtttacaaacttgtcacaccttttcttcgggagatttaaaatagattattataactggtgacttttcaaataatttcttcaagactgtattgatgattcataatctgttcctcattttggaaaaatagctgttgtaaaaactggcaaaactatcctagcaggaggaaaaggtagattttccttaaaaaaggaagtgactttcaagtcactccttgaaagtcactgactaggaaacaaaaacattttcataagactggctcataagtaaactacgtcctcaaaagtgatataatttttctttccctttgttctttactctgatctaccatgggttttttgtttgtttgttttttcggtattattgaggtataattgacaaacaaaatttgtatgcatttaaggtgtacaatgtttgtatcctttgaccatcttcccattcctcccactcctcagcccatggaaaccaccatttgactctgtgctttacaaatttgactttttaagattccacatatcaatgaggtcacacagtatttgtctttctgtgctttgcttatttaacttagtataacatactccaggttcatgtatgttgttggaaatgacggaatttccttcttttttttccattacacacacacacacatcactttctttatccatgtgtttctcaatgcacacttaggttcattactaccttggctattgtgaataatgctgtaatgaacgtgagagtgaagatctctcttcaagggagtgattttatttcccatggatatatctacccagaagtggtattgctagatcatatggtagttttatttttaattttttgaggaatctgccatagttttaagttgagcatattatatggaaacatctgaaatttgtaattttccagcatattatccctagagcccaaattctactcattacttgcatcatctctcctagttctgtgcttgtttgtagcaaatgaaagtaccttttttggcattttttttcttaaaaggacttatgctttaagttattcaagcagctgactgtatatttcattcagctgagactcttcattttaaaatgttggctgttcagaaaaaaaaaaagctattcctgaaaatctgtgtgtattatctgaattcttttgccatcttcccatgaggcttatattgattttatacctcattccagtatttgtccactgaacttctctcctttgtatttttatcttttgtgtgaatgtttggttctcttcctgtcaggtattgctctcttcttctgtcactgcatagctgggagtttaagcactgaaaatagtccgtactgactggggcctgtcccacctggataagcaagcttttcggagccctgtggttacccttaagggcttggagtcctcacctctaggatgaccttgctctgtaacatgttcttcttactggagactgttttctgttcttgtttataggtatgagaatgtcatttgatatcaactttaggttgagctcacttagctactgggtggtgggggctaaacaaccccaccttattcttcgtttactactgactttttctgcctgtaatgcatgtgaaaatgccttaggttttgccttttacagtagacattaataagcatccacatgtgcagaggtattgcactatgattcaataaaaataaagaagtcaatgtaaatatgcacataaaaagagaagttagagaatactacaaagtaaagttttacatatatattaaatcaatatgttaaacattgttagttactgtctaataaaactgggagtaattttagagatactttaggctacaccatcttttttttttaagtagaataacttacttggggtctgatgtagctttaaaattttgccctaggaagctggatgtaatattttattttatttatgttattattattattatttgaaatagagtcttgctttgttgcccaggctagagtgcggtggcgtgatctcagctcactgcaacctctgtctcctgggctcaagcgattctcctagctcagtctccctaacagctgggattagaggcgtgcaccaccatgcccagctaatttttgtatttttagtagagacagggtttcaccatgttggccaggctggtctcgaactcctgacatcaagtgatccacacacctcggcctcccaaagtgctgggattacacgctgaatataatatttttattacttatctcagtgagatcagagcactttctacattatgtagcattatacaaataaatagtattactgtaaaagtaattttaggatgcttatcatcctttccttttttttttttatttttcaatttaatcacaatggtgaagggatatacctgagttttagactatcttgttgcttctttctttggtcagtcttctagacaggaggatccaattatttctttgtgcatagatcatattcccaggctggagttgatttaatcttcattaggctggcaaacaccatctctaatttatcatttatttagtagagtgggggccttgctatgttgcccaggctggtattggaaactcgggctcaaacaatcctccattcttggcctcccaaagtgctgggattgcaggtgtgggccactgtgcccagcttccaatttcttaaaaattaaatattaagaatagcaaatgatcaatagacaattacctttattaattaacaatatttttaaattaaaaagacatattctttattcagagacttagctttaggtatgattagtaaaagaaaaattataagttatatttgaatgaagatctaggtaacaataggtcataaaatatccagtgaaaggttatttgacacttggaaatccttagacaaagggcttttagcaagttgtatatcaagtttctattagacaactcctttgaatcatgtatgcataactaatgcctttatctccagctccttgacaccttgtttaatattgctgttataaatgtatatctctccattgcttaaaaaaaagagacacgactgtgttaaaacattgaaaaaatcaatctccacttcagagtttatcagacttgtacaattttcattgaatatgcttctaaaattcaataaattccttttctaacctttatagaaacttttaaaaaagatagtgtatgccaaaaatagaggagaacttaaaaaatgctgaaggttaaagaggacaaggggttatttgagaagtattttctattttacagacaaaggaaaggagtgggaaaaatgcttgtctttagaataaactatgttcctaggttacatgtgagacgtgtctgggataatgaacaaaatcagagccagtaagtgtaattgggaaagtaagctattttagaagttattaccaagtctacacaacaaggagaaaagagcttaagtgtttgacattctttccaaggtatgaggaagaattccaagggacagaattaatatttccctctattgacatcctgaacagtgaacagtgatctatttatataatgaatgttaagttctagaatccctaactgtaatagtcacatacttatctgattttctttaatttgggaataagtctgctacatttaagaagacagaaaccaaaggacatttcaacataaagctcggtataagctaagaatttaaaaaaaaaaggaaaaagaaaagctttattaaaatatgcatggatggcagtgttctgcatttccctaaaaatcaagtggtctagtatttttttctaggtacatcttactgacctttaaaaatcagattcacttttttttcagtcatctatttttaacatcattctaatttaatagtatcatccttcaaaatttcttctcttccacagagagaaactcaatcctttgtgaggcctatttattatctcttcaatgacatctcttactaggtaccagtattctttaaaagtcccttccttaacatgttttcttaatacagaacaatattcttctgacatgccttacttacattttcttttacatgccataaacttcttgatttggtaccccaattaacagcgtatgcaaatattagagttattgaaatttggaaaaagagagactcttgggagagatgaaacttgagaggggcagtacaaaatcaaaagcatctagaggtgtggtctagtggaagctggtccagatggggagcttcaaagaaagtcccaagaagagagcgagaaggcaagttgccttctcagggcaatgaagttctgctgtgactgctccgccttctttgtgatctcttctgattggtaactgtgtgggtagtttcagatttaaatgaggaacaacaagttcactctgaaagtggttattttaaattaaatttgtggtttcactcattatcattatcaactctctatgaaatgactgctgagtaaggaatactctgctaagcaggcagagggaagattctaacaatgtggagaatacaaatttattgttttgcaaaagattgttaacactatttgtccatcctttctaagtgtagattatatatatctctttaagggttgactttccttcttttcccctttcttatttattcagagacttgacctgccttttactcccgaacagcaaaaaacaaccaaaagctttgcacttggtgtgtgtgtatctgtgtgtatgtgaatctgtgtatgttgaagggacggcaagtgtttgtatgaatttctgtgtatgtatcagaaagaaacagaggctaccaggagtaaggattttacttctctcttcgtacttcatgaagcaggtttttgccccggagttatttttaaagtataacatcatttggcaacttggtaaatatagatattcataattatctataaccatggttacgagagtaaatctagtccaacaaagtcaaatttactctagaatgatatagttatttgctcaaagttattttccaacatgcactcagaataggttaaaatagattttcatctcataaatttctggtcattatttttcatgcattatttattttactgaatgaaatttacttattaaaattaagttttgggtgaaaattattcaatcatatttagaatttcaagatgaaatttaaaatgttctttttttttgtaatgaactttaatatttttcttttttcttaagcctacaaaacatgatcctgtagcagattttttacagctgggttataaacccttggaaaattgtatttataatagaaatgctgccgtaactttaaatctagcaatactaggaggcagccttcaatcttcgtgagttgctgacaacatagaagtttgttttcagatacatctgcagtgtctatcttgagcattccagattgtagggaatgaagtgtcttcctctcttagaggaaaaaaaggaacatattcattttgctgagggcagcatcgttggaaatgggtttagtatgctgtacatatcactttgtgtttcttgaattttgttagatatttttgttgtgacatggggcttcccaaatggtggttgtgcaaacatttgttctgcttcattttcccccagagtatctgggaaaagtagctgagaaatttctaggaatcaagtgacgaagttcatcttgcttccctttcacaaattttggtgcatccaaatctgtggaagatgcctgtagtcactgggagtttattttatgtgaagcaatgcttgtgttgttggtcaacatacacatactcaaagaatgagcataaattaagtgcagcagaaaaaaatggccttggttcatttttagctctgtcatacctatgttcatgagaagttcagagaattcagtcaattcatcgttagatatttgaataccagctgggtgctcaaatatttgcatcacttgaaaatctcaaagggacaggatttcctgtagctgactggattcccaccttccaatccttcctttttgagatttagagccaaggaaagcagccagacatttatgtttccctaatattgtggattcattgtataaatagacaggattttagagaagtcctccttgagtagtgtttttttttttgttttttttttttttttttaatagttgtcttctcaaaaagggatgatatgggactgctttagtacttgctgcctgagagcagtatgagtgtaattgcttcaagcaaactatcttggtggccaaatgattgttgtttgctcttaaaatatttttctcttgtgataccatgaaatgtttgttgtgtaaaaaagattagtgggaattaaaatctgataaatgggggcctagatcatagaatgttttgtagggaactagaagtactttagcttttactttgtttgggacaaggagactttgtagagttctgagccaaggattgacacagctgacttatgttgacattttcacatcataattgagattatttcaccatctttctgaaccccataacaagtttgaaaccttctgtggtgttcaattgctcttcatgtaagatcctccatggcttggcctctgcaaacttttctagcattattcatgtccacacttggccttgatgcctggtctgcagtcatttgtcttgctttcagtgtttttaatgtacatttccctagggcagtttcacctgttgtgtgttcttagccaaatatagctgccattcctatcattgagctacaaggtaagtgtttacaactgatctttaagaaatagaagattttgtaagttcctggaaagaggaatttggtggcctagaagttcaccctatggaaagaacctcagaaatatctaattcaaacattttaccatagcattcaaaaatgaccctatgggttgacagcttcagtgacaggcaggggaagtgccatctgagaaggtaggccagccctttgggcttttctgagaaacagcttctctaagaaaataaattctggtgaagtctattgggtgaagaatattagacttctaagaccagtaaaaaaacaaaactccccgattctccttatcttctaattatcgtttagcagtacagtatttataggaaaagagaatatatcgaactggatctttttttccataaccctttctgatccccatagcttgttaaacctcttacatataatccacttatattagcttatactcacaacactgtaaggcattgttctgttgcccattttaatagaattctgagatgatgtgataaatgacaacttgcctaagtaattctctactagaataaaaacaatctactcaaggctgtatctgccaataaaggtaaccttgcctaaatccacatttttaattaaaaacattatgggattttaagtttttttaatttctaaagaaatacgtgttctttgttttgaaagaaaagcaaacaatacaatattggataaaataaataaaaaattcccactgacttcttcaaaatcactagacaatttgttaagagtacatatgataaaatgtggtttaaaaataaaaaaagaaaattatttaaaatgagtattacatcccctataaaagaaataagtaaataaaatcttctccaagatcccccaatctcatccaaaatatatggtcactatgaacaaatatgtatattactgtgcctcatgtaatatgtttttacttgcatatttcaaatacttatatgcattagtacataatttacttttttacaaaatgagatgacacaatacataccattaaacaatttcttcttttcaactagcaataaattatagacctctttccacatcagtaatgcatatcttttttgactaatttgtaatatatatgtggtaggaggaaagtgtcatgattcatttaatcattttcaccttgaaaatgtatttttaaatgcatagtattattttatttattgcatttataattgagtctatttactgttcttactaagaactatattttaggaggattgctcatccacttgaaggcaaaattggaactgagaagaagagtaaggtagtttcttccctgggtgatccacatctgagacagagagagctggaccaggataggactgaaggaggactgaggctgagagatgcagaaagcgctgtcagggaaggatcccttgagatggcaataggacctctaagtaggcgtgtaacagacaaggggagagcgcccttctccacaatgcagggattttatcattatgagacatggttaggttaactaaatttttaatctcttctaaaatataacacatgtagcacatgtaaaaaaaagttaataaaactctgctttatgttttgcaggtctgtgaacacttattttgtctaacaacattaatagttatattaataatatgaatgataacaaaatagctacagagtattttatgttcccacctgccctttgcttcttatatacacatcatctactccctacagtttcttaagagacaagtattatcatttctgctttatttttactcctgtgactcagagatattaagtaatttcagtttatagggagttattatctttggaacaataccactcctgcaaataaggacaagggagctcctgtttgctgcattaattctcattggttctcaaacaaatgcgaattactgtataatggcaatcacagttgagccgtatctctatttttgaaaaactattattcatctactctgttttgtattgaaggtctaggttcatttttctgtttgtcgaaagagaaaaacagtcacaaatatctatactgtcttaactgtatttccagaagaaacacgtaaaatttttctaaagaaaatgatttcaggaaacacgtttttggaaataaatgatcacccggccaggaactaacaaaaatctgaattctttctttgtttgggtgctttctatacttagaaatgatttacttctattatcttaattttctcattactgttattaattagaggcatattttatatcaatgaaaaccttgaagtatcattccttcttcctcaaaatgattaggaaatatgtctatggggacttaagttaattggataaaacatttctgaaaggagtgagttttatgttcagtaaaatgagactcacatttctattgaatttttttttactatggaatctattaataaatagatgtgaaagaagatagtgatcaagaacactcggcaggctccttatgtgcagttccacagcagaagagactgtagtatatttattggccttgctatcgagggtggcagtgttttatttcctgctttgaaattattttaatctgttatttggtaaattgcctatcgtttttacagttctatgaaaagtaagaaaagaacttaacgatggtatttatcaacttgttgtttagtagaatgtaattagttggcgaaagaggaaacatgccatatgtaaatgatgtctgtcattcctcctaccccaccgctgctgcatccctgcacagaactctccatttgcacactggttttttttgggtatgtccaccagagccaaaaaagaaaggaaaaaaaaaagcaatgtttttatcaacagacgttttcactgtataactaattaagcagtgaggtggttctattccttcaaggaaattataactattttacagattaggaaaccgaggtccacaagctgggcatcttcctcaaggtcatagtttgttgatgacatttctgtctctctttttttccctttgatttaatttaatttgttttgttttgttaatcagagcactccttattctactcttagcatatcgtttttttttgctcttcagactggaatattctttggtatgatataactaaaattttcccagccaagaaaattgagttcatggtttggaatttcaaaacatgattattttaaactttttgtccactcttgggactacctgggaaatagttgtatggggatttttaacttgaaacaacattaaggatagattatcttgtataaagatagattattttgtaaaatgactcatttctcttggacactaatggggtcattaacacctatactgtaaaatattgtaataatgaataaaattagaaattaaacataaagaattagaatgaaaatgttttgcagtgaaaagaggtcaagaaaagacaatggggtatctccttataagacagtgctatgcttaagctagtgtgaaaaataaatacagtctcagctgttaactttattgtgcaaagtgcaaagagaaataagataaattctgagaactttttgtctccttgtgttagtcttatagtgaataagataaattcttaaaaaaatagttactttgcctgaacagcaaacactcggtgatgtggaacattctttattcccaaacaaaaaacttggttgtatagggactcacctagcttcaaaatctgagggtcaatgaaaatcattaaagaggcctactatggaatgagtaggtaactgtatctagaaggcagtttatcataaaatatctttggaaatatgtggagtttaaaatattgagaataatttcgttgctccttgctttttcatctgtcctgctattatggtacttaaaaggaatagtggacagagtggtccattctttacatctgaataacatttaaactaaatgacccctattggtgtgaatcatatagagaataatttttaccactatttctttcatataagctttttatattctcttgttctagttactgtaaaatgctgaaaataatcttttaataaagtagtcaaatggcagcatgcttatttaaagcccacaatataatgagaatttgatttgtatgactcttaattgcttccacaggcattattttacagctaggatattgagatactatgatgttatgaggcatgtctatgtaggacagatatttgttctctgagaagcttccatgatactttacaacatagaattgagccttgggtgaaaagaccaatgggaagttgcatgggctaggtatactatcatgcagaaccatgaaaatggttccttttatgcctcagtcatcctagcgtgccataggttacataggatataaacttcaattagtattttcgtttctttgtatctgtgtttgggatttggtcttacacacccacataaaaatcaccagagacggcgtttcattcccttatctttcgacatttggaaaattgtgaaactttgatgataaaccattcactgcaattgaagatatatactaataggtgtgccagtagattttaatagagatatttacttttcctccatctcccagaaatctggaacttgagatacgatttttttttcacctatgatgaaactcctgttttacgccagttcacttttttttcagtatagttttgttttgttttttaaccaatgaataaataggggaatgcatttgttagattttttttttttatgtagccataaaggtgaaaaacttggctgtgactctgttttgatgttccaggctgaggaagtgtaattgtagctgtgaaatgaagtgggtgtaaaatgagtttgatggttcagtcaacttcaatagacagatgttgattttatcctttaatgggaaaaggttctgcaaaaatcattataaaatgaaaaaaaaaaacccaataaatttgcaggtgtgcaagccttattaaaagaggtatttaaattttaaaataaaatttaagatcatattcttgtaaatattttgtttttattttttaaataaaaacaaaggctccctttcatcacctgctgagcatgtgaggtcaggttgctcaatttctctggtatgtttatttgtcttttgtaaaatgtacgtaccacacaagaattaatgaccaatttgatgagatagtatacaagaattgtaactttaaggcccctttcacataatggattattttaatcagagatggaatctctatgaggggagttctctttattgaaatatcaattttaaaaatatggttcatagtctggttacacagtgtttttcctataagttcattgtgagatgtgtcacagtaattttggaggaaagaattcctttcatgtattaattttcatgtgctaattataggtattaattgtttctgaggtatagaatatcagcatgtagtataggaaggtagtgaataaataaaggagtagtatttatgaaaacagaaaaaaaagagttgaaacttcaagagaagtgattgttctgcctttgtattatgtctggccagttgtgtgctcaacaggaatgctgaaggactggtgagcataggggtgaggaagttgtactgttgggcatgaatctttgatataaaatgcttcacttgttagaattttatttcactatgtttgcttcctcaccctaaatgtgaatggaacaggccattaagaataaaatattcaagcaataaacaattttcctggcctgcatgttctttctggctcagttaaggctgcattctaggggaatgctgccaagcagcaatggaatgaggcagtcatttgggatgtctcagtcttggaggttcaacgagacaggtggctaatttgggtcaatcagtggactgaaggggacagaacttggtctggcagcaagcaagctgttgaggcatctctgaccgctgggagaactgggccagacctcagctgctgggtagcctttcagccttctctggtcttgtgaaaactgatagggataaggttggcatccagtcatagggaatagcactggacaggttcatggttagacatggaggactgttatggggatgtgtttattgaaaatgagatttaagtgcagaaatataattattagaccagttttaagatgatcagaacaagacttagcaattgttttggactagcaatgattctcctgaactactagactagaaatcctgagagtctcccagagaaaagccaagactgatgctggaatatggggcttaatgagttcacaactggaagcccaggatctggttaaggaaatggtttgtcctcagggaatgctgcacattttataatgttcactaagcaattgtctgtctgcctctttccttttcttgtttgtggagtcttcttccttcctttctttcttctcttttttcctccttctccttcctttcttgctctctctttcatctccttccctctctttctgtctcttttcttcttcccatttcttttcccttctttcctccttccatgtttagcttttattgaaagtctaaactgcaatattctaattcattattgaaaaaagcttttaaaatcacctatctacatgttgcttaatatgtcatctttcaaggacaacggggtgcataatataatgatgcataatgtaccaagtatgtaacatataaaggataaattgcaaattatttccaaaactatttctcagtaaaattattcagaggaacagtctgatgatcagatagactctaaagtcagtcatctgaagcctgtattttaatgagggaaattttacattttagaagaaaggtctatatttcttcaaaaatttaatttttggcattttagtattatattcttcttatagaagaataccataaacattctttatattcttcacctaagttcattaattgttagtatttttatacatatcatttatatttatctttttatctatctattgacaacgtttttgaatcattttaaactaacagatagcaggacacttcacaacaaaatacttcaatgcgtatctcttatgaataatgactttcaccgtaaggctattatcatatctaagaaaattaacatttatttaatacaataatctgataacatagagtccatatttaaatttacctaattgacccaagtagtgttttttataacttcggtgtttgaattttccatccaggagttaatcaaaattcatgaaccgtccatttactatgtcttaaattagttgccccacattctaattttttggttttttatgaccctgatgtctttttatggccaagtccaaacgttgcttacaataattcacattctgtatttgtttcattatcttgtcatagttagatcagattaaacactttggcaagaatattacttaggggttgttgcttacttttgttagaaagcaaatcatatcagggctttctattatttatgatactatatatttgaacacttggttaagacagtgcccatcatattttaccatttaaaaagtacatttttctcttcatgattaataatcaaactatggagtgatattttgaagtatttgagatattttaagatagtgtacctcttctgtttcctagtattcttgataatccttgagtgactaaatcattacactagaggatatgaagcaaatttgtaattttctaatccctttgtacttgttattctttctaaaacaccatttaattttgttatagtaaattaattcattattctttcttatactctaatatctaaagttggccccttcaagttccttcacttcagctacttttgatcccattaatatctgggtacttctttttattattattattattttttagatggaatctccttctgtcgcccaggctgcagtgaagtggcacgatctcggctcactgccaagctattctcctgcctcagcttctcaaatagctgggattacaggcgtgtgtgccaccacgcccagctaatttttgtatttttagtagagacagggtttcgccatgttggcccggctggtctcctgacctcaggtgatccacccacctaagcctcccaaagtgctggaattataggcatgagccactgtgcctggcccatatctgggtatttcttaccttgtctcaagctcactttgtactttgttgcctcaaactgaaattaaggcatttcctaagaaactctcatttctttaaatggagtataatattttgaaaacaagatgttaatactaggtttaatctttgttactggggtggcattgacctagattagaagtgggtaggctagagcctgtgaagcaaatccaatctacttcctggttttgtaaataatattttattggaacagctatgctctgttgtttacatattatgtatttctattttcacactacaatggcggagttgattatgtgcaacagagaccatatggctgcaaagtctaaaatatatactatcttaccctttacaagaaaaaaaaagtttgccagtattttatatagatgctttcagtggactgctctctctctctctctctctctctctttctccatatatatatatattttaatgtcatgattttacttctgttctggccaaaatggagtaacagagactggatctacctcttgcctaaagtaaccaaaacacaaaactaaactaaattaaataaattataggaaacaaggagttccaatacaatggatgtcagacaatgaagatgaaagagaacaaatcctgagaaacaaaaaaacaggcaaaatatgccatacaactctcccaatttattgccttgagagttttcagactacactataggaaagacaaacccagatggaatctagccgactctcaggactggggagatgcagtccagccgaccaaagtggctgtgggtggcaacgggggcattggggggtctcccttgagtattaagcaccatgattaaaacatgcatgtgaagaagccatcacagttcagggaaagaatttgccaaaaccattacattgaccaacgtatgatgtgtaaacaaaactagaactgatgcacactgctaaccagctaaactgacaaattaattcatgagacatggggtagtgtactcaggaagttcttgccttggtggaaagtaattaaccctagatctagtgctgccctgtacctacttaacacttcttaaagcaagattcaaaaggctttgcaaactgttgtaatataccttaacagaggctcagctcaaagctcaagaatgtttttagggctgcaaacatatccagcacccaataagataaatttcaaaatgtttggtatccaatcaaaggttgcaaagtatgcaaaaaaagtacttatgtatgaccctttataagtaaaatactaagtcaactgacactgtactagaactgaccaatacgttagaattagcagacaagacattaaaagtcataactgtattaaatatttttaagttaaatataaaatgtgtatatatatacacacatctgaagctaccttctaaacatgaaacctataatatgtaagatgaaaaatacattgaatgtgattagagcagattaacatcacagaagaaaagaagtgaatttgaagacacagcaatagaaactattcaggatgaaacggagaaaagaaaatttagaaaaatagagagagctttggcgacctatctgtggcacaactttaagagacctcatatgtgcataactgaattctctaaagcagagtagagagaaagggttacagaaaatatttgaagacacaattgttgagagaattctaaatgtgatgaaaactatacatctatagatcccagaagttctatgagccccaatcacaagaaacacaaaataaatgacaacatgcacatcataatgaaattgcttgaaaataatggtaataagagcatataaaaatcatctgagaaggaaaatacactaggcatacagaagaagataatagcagcagaattttaatcagaaacaatgtaagtgaaaataagggtgagcaaagtacttcaaagtacagtactttcaaaagcaaaaatcaaaaagctgtcagcagtttgtaccacatttgtacaatggaaacagatgctcattcctcattcactcgattgacatgtaagaatgttagtgtgaaagttactgagctttatttgggcatactggggaaaaaataatcctagtgacctctttatgtttgcaaccaggctaccagagttggggaaacaagactcttactcactgaaagagatagagtctggttatgctgcccaggctggttttgaactcctgggctcaagtgatcctgccacttcagcttcccaaataactgggagtgtgccatcatgtgcactggtacaggtgtgtgccaccacacttgactttctctctattttaattataaaaacatacatcagcggaaccagcaaacaggatgcccaaataaaaggcacacatggaagctgccagtccaccagctgcagatcacctgagccctggggctggtgcttacctactgagaatggcaccaaggaccagccaacaaaggttaacctgggacactcttggacagtgattctgatgtttgttctgagcagcgcgctcaacagtatgacaagagagaggggccaatgtccactgaactaccagttcttcctgctgcaagctttcccaggactgagatcccagggctaaacaaggagccagccccagtcagcaccttggcatctgcctggcctcagtggccctgtcctactggtacctgtatgacatccacggcttacttctgcgaggtgatgctcgctgtgggagtccatgatgaacttgaactggaagttccaggcaagcatgtgggccctcttcatttatgacacctccatccttgtcatgggacgcatgtacctgtgtctgcatggctgctacccactgctactgcgctgcctcatctacacgctttggctctggcctacttgtgagagttcgccccttgctgcatcctgcaccagttcaacacctgcctctggaagtactcccagttccattttgacttcatgggcctatcaccctggagtatgctgtgccctggttctgcgagtccctcatcatggaacaactccagcgcactctgcccctgcttcagtgacacccagcctgggaagcctagtggacccctggccctggccaacatccatgtcaagactgactgagagtagagagggatgagtgggtgttctggagatctcttatggaattcatggacaaagagaccaagctggtgtattgcgccttctgtgcagcacaagccctgccctggccaggcctcagccctgtagggcacacacagccccataccctccaaggtgggcaggtgttgagggggcatggtcaggtggtgggggacagggtgtcaaggcagcagaggaacatagggaaggatacatggattttggcccagctcagaggctggtggtgggaggctgtgggtaagcggtgattggactgtacagttgactttggaagcagcaggccatcctggctaagggacattgagaatggggccacaggtaggaggcaaggcctgacctccctccctctcatctggatttagttggactttggctggttccattaggcaactttcaggttcttgcttgcaaccagtaccttcacagaggtctgctgagctgtcgcttaagagatactgggcagccaggaggcttcttggcagtaatgttgatgtacaaaagctgggagactttcccttgtctcctctcccctccctcacagacatgcatagctcccttggcctttgggggcccccgtagtgctggattcccaccaacattgggcttttggaggtttcagtccccatgacagtgccctcccatctcttgcaggctttcctccactattcccactttatctcttttagcaccactattccttgtgctttgggaattcctgagttatgcttcccaactcttggtctagtgggctgtggcagtgtctcctctccacagtggcccagttgagaatgaatgatgcccttcaatgcacagtcaggccgagatgggccttgtggatccacaatggtaacctagaggaaaattagttccatggggaaaaatcagagttctcagtcacttaggctctaactggtttattttcaaactaattgagcaatctagcattccaggggatggaggaggaggtaatccagtattagagactcatggagaatgagggagaaaaaaagaggtgtccttcagccttggaaagctctttggaacaccctttgtcagaaaggatcggttctttctctgccataatcccagccctgtggcaaagcattctcatggttgccattctcctcggcccccacccagtgaggaagattctttgagcttgctccttaaacagtctgaaccctgccacactcatgggcattgttatcttggttctgccctcccccttttccttgtgacaggcccattgctggcagtggacaggtgaaatcctcactctagccgcttttggctctgccccctattccctgaggagaggggtctgtcagaaagtggtccatcccgtggtatgtggtctcttcttgaccacactcagacacttaggtagaaattagcctttcccttcttatagatcgtttttaaatgacaataataccccctccaaaaaaaaaattatcaatgtggaattctctatacccaacaaaatatattttaatagctacagtgaaattaagaccttttggaggctggaataattaatcaccagtagaaagtaggactaatcgtttcctgctactgaagcaagagcttcctaagtacactaccccatgcctcacgaattaagagttcaccactttctctggttaggaatgtgcattggttatagtcctgtgtgtgtgtcacacactgttcactttaattcttttgaataattttttcctggatgctagaagaaaagatttgaagtgtttccaacacaaaaaataataaatgcttgaggtaatatatatcccagttaatctgattgtatcattacacattgtgtgcaagtatcaaaatatctcatgtgccccataagtatgtacaattattacatatcaataaaaagatgtccactataaaccctaaatcaatgactaaaatatcaaaacaaagagttacacctaataagccaaaaaaggatacaaaatggaattataaaaatgttcaactaatccaaaggtaggcagaaaaatagataaaggggaataaacagatggaacatattgaaaacacataataaaatactgtcaaatttaaccatatcaataatcacattgaaggcaaatgttttaaacatttccatttaaaaggcagagattgtcaagattggataaaaaacaaaattaaaacatttttgctgtctaaaagaaatacattttaatataaaaacacaggttaaaagtaacagaatggaaaataaatgccaggttaacattactcaaaagaaagccagaatggctatgttaatatcagttataccaatttcagaacaaagaatattacttgaattatatgacaaagttcacttcaaaatgataaaggggttaatccatcaagaagacataacaagcctaaatgcttatgcttctaataatagagcttcaaaatacataaatcaaaacctgatcaaacttcaaggagaaacagacaaatacaaaattttaatcagaaattgaaatacccttttttctgtaattgatagaatcagtagacagaagatcaataagaatatagaagatttgagcaatactaataaccaatttgacataattgacatatatataaaacatcccacccaacaggagcaaaatactcattcttttcaagcatgcacagaacttttaccaagataagcaatattctggatcacaaaacaagttgcagtacatttaaatggatccaagtcatgcaaaatgtgttttctgatcttaatggaattgaaatggaaatcaataaaagaaagtctctggaaaattcccaaatatttgaaaaccaaataacacttggatcaaaaataaatcagaataaaaaaatggaaaatattttaaactgaatgaaaatacaatatatcataatttaggaacttcccctaagcagacataaggtaaaatttatatactaaacgcctatattagaaaagaaggaaggtcaaattaaaggcatcagcttcattttatgaaactattatagaagaataggagcaaattctgccaaagccaataacatgaaaatatgaaatacatagggatgaatatgacaaaagttgttaaaggcctgtattctgaaaatagaaaagtattgttgagataaatcaaagaagaccagaataaatggagatagaccttggtctttgaacaaaagaggcactattattaagatatcagttctctcccattaatctatggatttaatgttacaccaataaaaatataatcagccttttttcttaaaaggaaagaaattgacaatctgagtttcaaagtcatatggaagtgcaaagaacctagaatttttaaaacaacactgaaaaagaacaaagtagaattaacactacttgaattccagaaaaaaaaaatgataaactggacaccaccaaaatttaaatcaaatgacttcattaagaggatgaacagatatgctacaaattgagagaaaatattttcaaataatatatctgtaaaggatttatacccaaaatgtataacaaaatctctaaacacaataataagaaaccaaaatacaaaataaaaaccagtcaaaatatttaaacaatgcttcaccaaaggagataagagataagaaataagcacatgctgtgaaatgcaaatgacagcaaaaatgagataccactttacatgtagcaaaataagttaaaaagatgatcataccaagttagtggagggtgtgaggaattccaaactcttgtacacagatgggaatgtaaaatgatacaaccactttggaaaacaactgggtagattcttctttttcttttttctttctttcttttttttttagacaaagtctcactttattgcccaggctggagtgcaggggccctatctcagctcactgcaacctctgcctcctggattcaagccattcttgtgtctcaccttcctgagtagctgagattacaggcatgcaccaccacacccagctaatttttgtatttttagtagagatgggatttcaccacgttggtcaggctggtctcaaattcctgacctcaggtgatccacccaccttggcatcccaaagtgctgggattacaggcatgagccaccacgctcagccctactataagatccaaccatcccactcatcagtatttaaccaagaaaaaagaaagcatgtgtctattaaaaaatttgtgcatgaatgttcatagaacctttatttctattagtatgaaacccaaaacaacctaaatattcatcagcagatgaacagataaattgtgaaataagcataaaatggaatacaactcagtaataagaaggaattaactattgaatattaaaataattatgctgaatgaaagaagtcagattctctccttggcaagagtatatactggataattccattagtataaaactttagaaaatgcaaactatagtaacagaaagaatatgagtggttgctggatgggacactggggaagagagagagggattccaaagaatataagaacactgttgggagtgatagataaggatacaatcttgattgcagtaatagttacatagacatgtaactattacatgttacaagttacattttgtaactattacaagttacatgtctatgtaactattacatatacatgtcatacatatgtcaatacatatgtcaaaacatatcaaattacatattttaaatatgcgcaattttttatgtgtcaattatacctgaacaaagcagttaaaaaatgttgagtccacattgttattttaaattcaaatgaaatgccataagattctttttcaccttcacattccctcctagtgttctccttttctcaccgtgaaaactagttcctaataaagttaaaataggtacttatcgttctatctcacaacacacaggcaactataatcacacacagacctagagagaaagagagagaaagttggttttaggattgtatctatactattactaaaagaatatcataaaagtaaaaattaaaggtttcttgtagttcttttggtccatatgatataaaccattaaagtacacttaaagtgttcaataagaaaactgtgttcaaattacttgagttcttatttaaaaaatatagtttttcaaaataaaactatatgaaaatgtatactcaaatatttctcccataataatcttttcacttaccatttccatttacctcataaaaggatactatattcttaatttctttttgcaaaaaaacctaaatttatattttttatatttgcatatgtatatacgtgtatgtatgcatacttatttcttatttctcatttgttacacaaatagtggcatactgtgcaatatctttatcaactttcttacagtttgattttttttaacttaatacatcttagatgtaacacagaccatgaatatccacttcattcatcttcagctacatacttcctactcatcattattcactcaaattagcttcctatggatggcatcctatgacagttttcactattttgcctttccaaatgatggcacaatgaataaactcttgcatagatatagataaatatgaatgtagatatagatctggaatagatataggaagtttatttttaggggaaattcctagaaagggaactgtttctgttgtggaagataatacagatttcaccacaatggttattgtatagtttacacttgctccagaatctatacctgactcccgcctatgtatgtattgtcaaactttaaagtttgcaaatacaacaggttaggaatggtatcacattgtgcattaaatttgtatctttgtgataatgagtggtgtctatatggtttacttttttattcaccaaaattcttgtttcatttggaacttattgtggtgagtaatgttaggttgtgaaataagtattcagttgtctcaacataatttattacaaatatttatgttttcaacagtgaactgagatgctacctttactatacacgaagttttcatacattcttaagtagatttctggtaatctattttgttcattggagaaacctcatatgcttttaattatggtggttatagagtatgcttttatatttggcaggactgctactgcctcttgttatttttggagggattttctaactccttgcctgtttattttttttttttattatttgtataaatttaaggagtacaagtgcatttttgatacatggataaattgtgtagtgttgaagtctgggcttttaatgtaagcctcacttgaataatatacattgtatccattaagtaattattcatccctcacctgtctcccaccctcctacccctccaagtctccagtatccattattccactctgtatgttcatgtctacacgctgtttagctcccatttctaggtgggaatgggtagtgtttgacttgctgtttctgagttgtttcctcttaagataatgacctctagttctatccatgtatgatttcattctttatatggctgaatagtatcccatatatattcaatatttatgtgttatatatatgtatatataataagttgttatatatatattacttttttattcgctcatctgttgatggacagttaggttgattccatatctttgctattgtgaatagtgttgtgataaacataagagagcagatatttttgatataatgatttcttttccactgggtagatacccagtagtgggattgctggattgaatggtagttctattcttatttctttgagaagtcttcatactgttttccatagaggtcttactaatttacattccccgtagcagtgtatatgtatttctttttctctgcatcctcaccaacatttgttattttttgactttaataatagccattctgactggtataagatgatacctcattgtggttttagtttgcatatctctgatggttagtgatgttgagcatttttttttatgcttgttgaccatttgtatgtcttcttttgaaaaatgtctactcatgttctttgcccattttttttgttttgttttttgagacagagtctgtctgtcacccaggctggagtgcagtggcgtggtcttggctcactgcaacctccaactcctgggttcaagcgattctcctgcctcagcttcctgagtagttgggattacaggcacacaccaccatgcccagctaatttttgtgttttctagtagagatgggatttcaccatgttggccaggccggtttcaaactcctgacatcaagtaatctgcctgcctcagcctcccaatgtgctggcgttacaggtgtgagccaccatgcccggcccctttgcccactttttaattgggttatttggttgttattgttgagtttgagtttcttataaattttggatattagtccactgtcagatacatagtctgcaagtattttgtctgttacataggctgtctgttcactccgttgattatttcttttgctgtgcaggaacttttagtttctctgagtcccatttgtttatttttggttttgttgcttgtgcttttgagatcttagtcatgaatgccttgcctgggaaaatatccagaagaattttccttaggtttttgtctatcattttgatagtttcgggtcttacatttaagtctttattccatcttgagttgatttttgtgttgggtgtgagagaggggtccagtttcattattctacatatggcaattcccagcaccatttgaaaaggctgtcctttccctggtgtacgtttttgtcaatctgttggctatagatatgtagcttaacctctgggatctcaattctgttccgttgatctatttgtctgtttgtataccagtactatgctgttatagttactatagtcttgtagtacaatttgaggtcaggtaatgtgttgcttccagctttgtcctttttgcttagggttgctttggctattcgagctcttttttggttccgtatacattttaggatgttttctctaattctttgaaacatgacattgatattttggttagaaattgcattgaatctgtagattgctttaggcactatggtcattttaacaatattgattcttccaattcatgaatgtgggatatttttgcatttgttggtgtcctctatgatttctttcctcagacttttgtagcttcccttgtagagatctttcacctcttgtttaaatatgctgctaggtattttttaggtagctattataaatgggattaccttcttgattttgttctcggtttcattgttgttagtgtataaaaatgctactgatttttgtatatctattttgtattctgaaacttcactgaatttatttatcaaatctaagaggttcttttgcaaagtcgttagggttttatagatataacatcatatcatcagtaaacagagataatacaacttcctcttttccgatttggatgccttttatttatttctctttcctgattgctctggctaggacttccagtactgtgttgcataggactggtgtaattgtaaaatccttgtcttgttctagttttaaaaggaatgctttcaactatttttattaagtatgacattggctgtgggttagcatatttggcctatattattttgaggtgtatttcttctttgcctagtttgttaagggtcttcatcatgaaggaatgctgaattctattaaatgctttttctgaatttattgagatgatcatatgctttctgtccttaactttgtttatatgatgaattacatttattgacaaaaatgttagccccaactttttagtttaagaaaatgaaaacttcgcatttttataaacattatgttcaatttatatattgatatagttgattacaagatagctataaattatttgctatttatgtattgagacatggaatctgatttcccctccctggagtctgagctggccattatgatttgcttgtctattggagtgtagaagtgacattctgagacttagaggcttgggcagaaaaagcctcacagacactttctaggtctaggaacctcagttttaggaactgaggaagttcctttctagcaacctcttaggacccagacaccatgctgttaggaagtccaagcagctccctgtacaagccacatgaacaggagccaattatccttgtcagcaaccttggctgagtcaatagccactaccaaccggatagccacatgagtgagtcttcttagaggtggatcctctagccctaatagaatcacccagctgatgccatatggaactgagttgagtcatcctcaataagccctactcaaatttcagatttgtttgacaaaaactgaataattattaaagattactgttgttataagccagaaaaattatcttagggagaattaaaactggatggataatttttaaactttccgctttgcactaagttgtcatcaaatactctttataccttcatttttctaccctattctattaaaaataacgtttagaggattgtaatacagtctatttaaataagcattttaccttaaacaccttaataatactagtaatatcttataaaacattaatcctgaatagcataacattatacttgtttagtaaaatgaatagtttctaataattaaaataaattgttactcttatcctgtatacttcaaataagagttcaaggcagttaaaaatctacctatgcatcaggtccctattataagtaaatagaaggagaaacctataaaaagtagggattacattattacattgttttcttggttctaagtttcatccttttaaactaatatttctcaacttggatgcttcttgtgattgatatatatgtttaatgtagtgactctcctaccgtccaaaagctattgctaagtcaaataatatgttaggattgaagaattatgtatacattttgaagcattttccttttttttctaaaataaaatcagcatctatagatagatatctgagaactgcaagaggattcttcaggcaatttgattgaaatggccaatgtagttagacagatatccagtttgcataggaggaaaagaattaatggatggatgatgtatttttctctgcttagcattgcgtttttcagtcatatatgtaagcatagagccagtagtgtatacagtgtggtcacagatactgaagccagactccttggtttcagatctcagctcttccatggtagccatatgaccttgggaaatttttgcttccattatagttttctatgagtattcaataagttaatactcataaagcacaaaggaaagtaatagcatatagtttgcaccttgcagaagtttgttaaataaaattaaaatgcagggaggacctcagaaggggaaaagctaaataagtattttaacggaaagaaaaaaggaaaaaatagagcaggcaacactgtaataggatttatttaagcagctgctgtttctttacataaactcttattcacttatataaagcacctctgtagaaagtatgaaaggtgcttcagagaagttttcgagcctttagaaagttccaaagcctaaatatatatatgaacctttttgtattgcagcaagtcattctgttatgtacacattttagtacagatggctattttgagagagtgtacgtaaaactggttataacaaatgaattttctattcccaagatttgtttttctctcagtatgttatcattttgagctacatttttggaagcatatatgacaggtgtacttaccaactgtgcctgaaagaatgatgttttgaaaaaaaaaatctaccacttcaaacctctagttctctgttctttcttcacgttgaaattatttctggatgaatttgtttatttcttatttctcaggtgtatttatttatactttgtaccctacctacatctcaaatgattttaagatagcttttaaaaattcatgtataataagacagttaaaattaaaaaaaaaaaaatctgacactacatgtatatgactgtatgagagcgtgaggttctcaatggaaaagtgcatatgttaccagtggatggtgtccaggttcttggcaacttgaacaaagaattggacaaaatgcacagacaaagcaaggaaagaatgaagcaacaaaagcagagattcattgaaaatgaaagtacactccacagagtggcagtgggcccaagcataggggctcaagagccctgttaaagaattttttgggggtttaaatatcctcaagaggtttccattggttacttgatgtacaccctatgtaaatgaagaggatgaaggaaagttacaaagtcatttactcggtgtttgtcctatgtaaatggagaggatatttcctgtcatagctgaagtgtttccctttgatttagttttaggaagtccttaggtttcctgcatccagaccccattctcctgcttcacatatgcctaaaactttgtaatatcaaattttgttttgagcttgctggtaggcaagacaaaaaggagcactgattaaaagtattctaagttaattagagctcataactattttcttttccttgtcctgaattctgaaaagcatccattgggtggttcctacctacacagaaataatactctctacagagcttttgcaaaacatacagagatgtctctcatatcccacccacttttgatgaaagtcataggtgtactacgcaaatgtcacttagtgaaaatgtaagttggtgtttggttttggattattttattcatttgtttgttcatttgctgttggtgagacccagctaacgtggtccagatgtgttgccttctcctctggtgacaattagaattcttaatgaagttgttttcagaagatgacccccaccactatctgaattaaaatcacatgaataatttgttaaaatgtacattccaggtcctcagctcagtcttacccaatgagaattttggggactgggttattttttaaaagcttctcaaaggattgttatgaacaccaaagagggcaaattactttcttagacaagtagacctgtaggaaagggatcaaagggcaatctaagctacaagaaagtgaaggtttgaagactttgcatactactctgcaggattttacaactgacaagttgacagcttcttcctcatctcaaagacgaggaaatcattttgtcttacctaccagaaaggattgctgtaaagattacattagacaataaatgtaaaaatgctttgtaaaccattatataaaaaagaagacacagttttcattattatcaagaaaaacatgtagtttttaaaatctaactcttataaggaggttgttaggcatagaactttgggatctcatggtgtgtttaactcccgaatttcactcactacggtatctaaaataaaagccttaaattctgggtctcagggaatctggagatcctctgcttcctaaatagaatttcaagctccttctatctttagatttgccttccccattcttccaactccatgtgctgccaattcctggggcatttggggttctatagtgcaaattgaattggtttttgaccttctttactgctaacctaggaatcaactttcttagctaaggatttgcttcttgtctttctgcagtctagcttctaaaatagtgccattttctctgtccctcctgccccctttgttttgttattgtgagattttttcctctttcagaaattatttgcagtcattttaaggggcactgggcagtggggggaaagctaacccaagatttttgctttgaagttgttcttttaaaatgtgaatgctttctccttaaaatcattagttgcaaacttggttcacactcttgttttatgatgttttaaaatgtgatgcatatattttgccctcagctaaaaaaaataggaatcatcccacccactccaaagccccagatctggttactttattctcagtagcaggatggaagaaagaaggaagagggaaggaaggtaggaaggaagccaaaattaatggatattaattttgaagagtattggtgatgatccttgtcagcaatgtattaatacttcctagattttcttatgactctcctttttttcatataaaatctgatgaatgtgacaagtttatgcctgattgtactggtagagtaataaacttaagtttgtaagtgcatggtgactttcagcaatatccagtaaagggacttgggaaaaaaataggttttaggaaccctatcaataaaacataggtaattaaagaactaaaaatggtgtaactttcgtatggtagttagagaaatttaacaggcatggtgacagtctacattattagtagatgctgtggctatacatatttatactataagtccaaggcaccccatataaaactatgaacaatcaaagagatatcgggtctttgcagatagatgtcctaactacttctcattttccataggtctgttgctaccaggtatgtgattaggaagctgtcataacctaaattactcctttgttgagtctctgttgggtgtaattccattaattgctttacaggagagagaaatagcttgggatagacaagttttgaagagaattaagaacagcagttgtgcttcagagtagaatccaggctagtgacatacaagagcaataatccgaatttgttccattctcaggtagtcctacttctaatctttatattgaagttttatgactactgtaaaattaatttggaaatagcatagaactatccttctccttcagatgacttctgatgagtccattcttagttgtacagtcttacagaaccgggaaaaatgattcagtgaaggcatcacagccttcttgctactttgctttggttcattcaaagcttgctgcttctaaactaagacttccttgggattacccttgctagtctctcccagggtcctgtttcaagggtatgtaggcatggtgttgattccagtgctagagtactgctctacgaagaggccccaaatgatccactgggccaaaatatctttgcatgttctataatgtactttataatctattcatacagcactacatttgtatggtttatacacatgcatggaatggaggttcatcctcaaaatgtttgtaaaactatcccataaaataagaaaattattcgaagagtacagttaaccttatctgatgcttctgtgaagataagcacacaattgttttggtcttctctttaacagagaagtgtaactccagaagcttgaagccttgcattatctcattaggcaggtgagtcccctaacttctattgccactactcatttttaccaaaaaattttgtcttaccattagcattattgagagcaataaccagtgcgagtaataataaaatatccagtgaaaataaaacctaaatgtagaagaattttagagtttaggaaggtgtcaaatttagaggtatgcattctcattcttacattatactcaatggtgatgtataagctattaaaaacaaaccatattaaagaaagggcatttgttttgtaacttttttcaaatgaacaaattggtgatacctaagaccattttatttgctgtctcctctatttgctgaagtgtccaactctttgtgacagctgaaatgacaatcactgcatgacataaccatttacctagtgtgtacagggatatttcagaaatattaaccatgtgggagtcatttaaaaggcaagtaagtatgaccagagtcatttagcacttagaaacttccagagcagcagtttaaaaaatagccttgggccacagagtcttctttgccagctaacatattgggtttattatatatatatgtatattaaaaaaaccattgtgatgccttgatctctgattcacaaatttagagcactgctagcttcaaatcatggtgtgtaccttatggtttcttatttatgattctctgggcttctgtgtgcgtgtgtatgtgtgtgtgtatgtgtgtttagaagggggtggtggtttcttcactgctttcatcatttgcatgcttgtgtttggttttaacgaggaggtgtatgtttttggttctatgttttgttgaaattccttatcacaaaagtccactaccttaataaccatcttgcaggctaaatgtgactcctgaaagtcataggtgttttattctgaatttacatacttgtccttaactggcagatatgcaagtttcctccttctatactttgttgatttgtataggtctcctattctgaggacatagtgagagaaaatgtggtacatgttctagtaaaatgagtggttattcttgctattcgtagagacagcggaggcaggtgaattatgttccactgtgtcagccccaagctaaatagagctttatcttttccacacagtgaaagcatctagagggaatgcaaagtagtttccattgtgcaatgaatcactcattaaagtcaattgacatccaaggaacacttgtttcagttatcacagctattggtagggggaagctggttatcaaagaaagacagaataccacaatggaccaatcatctccttattttattttttttttcaaataaaaaacatacttagaagtcaattcattacattttctaggttcatgcattgaaattcaggttccccaacttccaaattctatgttaaaagtttctgaatatatatacattattttcacctctagaaagttattgaaactattaaattgcttggatggctgaagatcaaaagcattacagtcaattaaggggagaatgccatactaagtgatctttggaatataatactttaaatactaattcagctttacaacctgaaggtaaaaaccaaacaattacatgggacaaaaactgctttaatgtattacttcttatctaaacactgttaaaatgctcaaattctactactagtataaaatgaaaaaaatgagcaccaaaatatatcatgttctccactgtcaagtccttttgactggtgagaaaatactggttcatattttatctaagtgttcccaacccatcctcttcacattatacttggatgcaccatggtgtgctgaaaagaagtttggcttaatttcagactcaaacattacctcttcatgtagtctcaagttaatgaacttccctgggcctgagtttcctcatttataaacaaagggagtgtgagagcactcataaaatattatctgaaaagactgaaaagcaaacgtgaatgagtagtgtccagtgaagggtgtgtgccagtaatccacttgagattgttcatgcctttcattctgtgtgttagcggcagagatggagggaaatgaactaatgaaagaaatatgtagatggataggatcaaaggaattcaaagtagagtagtgagcgagctgaaaaattttgtatagtttctctaggattctaagaaagaaactcatttgatgactgatatttataatgcttcaagtttattaatggcttactgcaatgtgtctcaataaaaggtgactgatgttatccacgtttttcagatggataagttgaggtcaaagaagataaatacctttcctaacattccatggctcataggtgggagcatttggatttgactgtacatctgtctgacttcaaagtccaggttctcagcactgggtgaagaagcctcccaaattgtggtaaaggtacctagttattattacaccacatagtggtaagcgagattatagagcaggaataattccccttaggatactgagtttaccttccaccatttgaaaaaagaatttcttctttgattaggtatttggcctgtgtcttgctaaagctgtttcatcagacataagtttatgttgtgattagagaaatgtgtactattccttatcttaagctatctcttaataaagttacaattcataactataaacaatatggaatcattagtaaatagcataatctggcattttgggccacttagcgaaagtcgttagaataccatttcattgattaaaagataagtttacccatatcgttaatataaatagccatctgtttataccatgagcatggtaacaggcaaatcagagcaggaagcagggtgcatgcaatagcatttggaaccttggcgaatcagaccacagcaggactttattaattaaattgctgtaggctgattgctgaaggcattggtctgttctgttagaactcaaatgacaagagtcacgcaactgtttgtacctagtaaattccttaatcatttgactctccgtgtatggcttataattctcttccccttccactgaaggataaacaagttatctttcactttatccatggctgctgaatacctctttcagctcacaagcattgatgacaaagaacattatcttaagaagaaaagtatgagtgcccaattccattgccaaataggcccttacagagctatttatggaatcctaaagttaatacatacggcagtaataatgaactgagactaaaataatttgcttctagacatagttctgctacatttaaaaagtatgtcagccttgaccaaatcactttatcttagttttctcacctaagaaatgaggaggttgtacaatttaaggtgtctatcagtcatgaaatctcaatatctgttcatctatgtttaatttcatgaagtatattaaaaattattggaataatttgtgcagcttaaagtttattcataatttatccatttgaagtatctgtgtatttcaagatggctctgttgttttctattcttactccttttgaaataatagatgtttgattttctgtgaatctttggaaggattccagatgttttcattcgggtctttcttagccattagcatatgatttcatcaatttcctttaactcatatcagtggttctcaacttaagacattttggcattctcaaaataagacatttttggttgtcacaaattgggagatgctactggtatctctattacataaagactaggaatgctgttttaaatctcacaattcacaaggtaactccataaccccaacacaaaattttcctgcccaaaatgtcaacagtatacttttccataggtatttggagaaatcctaaactaactatgcacattaaagtacagaggaactagcctgggagtcttatttttataccaagtataaagcacactgcagggaagttgtaagtcagtttattatgcattttaaaagcatcatttgatacttaactataaataattattttccatttcaaaattcagtgggatagatggtaaatgcatggactttggagtaggtgaacttgggttcatatcctgactttatcatttaatagttatatgacttcagacaacttctttctcatttctgagtctcagtgctctcatctgaaaaagtgtttagttgtatcttcctttcattgttgtaagacttaaaatggaacattaagtgcttataaggaaaagctgtttaagacagacacataacaatgattatgttaacaatgatagctgatttgctaaaaaaattccatgaatcaaaattttctttgcacaaagttgtttaacttattaaggttttacagcagaaaaggaatactgataaatgcttctgttgaaacaaggaaaaaacaggacaaaaacaacttttcaaaaactttatttaaaaatatatatgggaaaacacattttatgctgtaaaaaagaaagttcttgcatatatagaagctagtgccaaaataataaatagcattggaaaggtattgtaaagaaccgtgctgaacaagagaagctcctaaagatattaaaaccacccacaaatgaatcagaaaaaagctgcagttgagagatgactagaaatgtattggtagctgagctgggaacagttttcaacatgctttatttctaaacattccatcttttctgcactagtatgtccagtaaggtcaatgactatagaaaatgctcaagtatagacagaggattcacagatatctgaaagtcacgcttcttgaagattatcagtttaaaatctgtgaatcactgctacttttttttttttttccattatgagcagtctttttcccaaaggaatcctgcctgatgagtaggagtacattgtttgaaagaactacagaagtacttcttaggtgtttttcccctttagcaaaatgttgggaagatggaggagtattcagcatgaggtatgctgtcattatatttattctgggcctttcagcactgtaatttatttctgtgccaaaacaatatgaattgttaaaaaatgtgcttctccaaaatatgaaacagttggactggatccctattgaattatgcacatatcttagctaaaagaatggtattttctgaataataaaaatcatacttttttgcagaaacaaaaaactcaaaatatttatcagtacattttaagggctattctcccaattggacctaaaatgaactttaaaaaaattcaaatggttctcagaaagcccacaacatttatttagaacagattgtatctaccatctcttatctttttactgagatgattcttcctagtaatgaagaatcctaaatggaattggcatctaaattttagaaatacaaaatcactttattgtgcatgaagatacttctagaataaatatagtcacatcatctgtttatgataaggaaattggtagcttgagtgagggaacaattaaaagtgttaaaaaaatgagcactggacagtgttaacaatttcctgtgctgtgattattgcgcgaagggaaaggaagtttccattcattgaacaccctctgtgggtaaagtactcttctgatgctttcatacatgttctcatggaatcctcagagccacatgcaaagtgtggaaactgtattatgccttatgtgttattatgtatcatgtcagagatgagattactgagtcgcagagaagttaagatcattcaattagtgagtagaagctctgagtttgaatccagatgtaaagtctcaagttcggtgctcttttctctaaatcacactgcttacattatttattattattttatatgtgtttgtatttaaacactccccaaaatgctctgaatttccactgctaggtgagttctttaatgtcaggggtaatgatttgaatgtttctgagctcataatatattccgtattagtgactggcatatggttggtccttataaatatttgttaaatagattccaatattgacaacatacaagaaatacatcttgcttcatttgtcaaaaaaaggtggttgatatggtctggctctgtgtccccaaccaaaatctcatcttgaattgtaattagaattataatccccatgtgttggggaagggacctcatgggaggtaattagattgtgagtgtggttcctccaagttgctctcatgacagtgagttagttctcatgagatctgttggttttataggggacttttctcccctgtgttctgcacttctccttcctgccgccatgtgaagaaggacgtagttgcttccccttccttcatgattataagtttcctgaggcctcccagccatgctgaactgtgagttaattaaacctcttccctttataaattactcagtctcgggtatgtctttattagcagcttgagaatgcactagtacagtggcagaatggcacaactgtcgagccatttagacattttgaagataaatgttatataaatacatcattatatttctgcggaaatgacaaggtttacataattgacattgaggaatctcgcatgtgtaaacagtgctaatcttctgtctactttaaatcttgttatcaaaaaaattctattgggtatgtattcagaaatagttgctaggacaacataaaaaagttaaaaagatatgtatttcaatgggaaacatttaaattttacctatgtggttttatgcatttcttaatgtgcagagaaaagaaataaactgttgttgaaagatctaaaatagtagtgaccaaattctcttggtacattgtttccctaatatgaagtttgtcataattattcatgtttttttggatttgtaattggtattaatttcggccttccattggcattataacttagtgcttccaaaatgcattttctttatatgcctgacacttttcctgaacacatgaaggacagaaaatggctattcatccttgtgtccctgcaggcatctaatgggtgaattcatactttaccatactgttgtatgtgattgaggatataaattgtgatatacttggagaaagcatcatgcctgtcatgaaagctctgaccttacatcttctcttatatgtcaattgactttgagttcctgataagtgatatcataatgttgtagtaaatatatatatatataattttgagttcctgataaaatcactatgacactatcagcttttcccacctctgaccattgatgtagataaatataagcctaagtatcctcctttagaaaatgaaatgtcctattgataggatacaatcgatgtaattctggaccaaaccattagctcagatgtattttccccaaaatgtatgtcattttatatgcaatttatacagtcagagttaaaagctacactatgaagggagttgaaaaaatgcctaatgtattggtgttaaaacaagttattgtttttgaagggaaattgtgttgttagaaattgtgttgatacagtcttgttttaatcagaggatgtcagagtttaaggatgtctccttatagaaatctgattaatggatcaaccattccctaacagggactctcttggtgatgctccttctttgaagatgatcccagttatttttggatgtgttgtacattcattgctgtcctgaaggtgaaaactctgctccagtgaaaagttttttaaaagttcatttgcatgaatactaactaaaatgtcaataaagatgagaagctttattcataatagttttttaatggcactcagcattaagacatcttaaattctaaaaacaacatagtttttaattgcattattagaactacagaaaacacagatcaacaaacagaacactcattatcctaactcacataaaaagaaaatgttaacattttattgtatattgttcaagatcagttcctttgcacatattcagagataggaacttcttggacataaaatataaaaagtaaaaaagaataaacataatcacattgtactttacatatatttcattctgctttttaacatgataatggattacaacaacccatgtatgccaataattctaaagaaatatgataattttcatggcagaatatagctttgtgtgatgtaacattatttgttggatttgttgggcatttaggttatttccattttaatttttcaaacattgccataatgaaacacacgcatatgcacacacacacacacacacacacacacacgtacagcactgtgggatgttctgattattcccttaggatacattttaacagataaaattgtgggaacagtagatatgtatacttcttttttaaaacattttttaaaaaaactaattttggacttgaagaaaaatggtgaaaataagacagagatttacccaacacaccccacccagattccctgaaggtaacatctagcataaccatgttacagtgatgaaaaccaaataattacattggtatgatactattatctaaattgcagactttaattgaatttcaccaattttattctgtaacatctttttctgtaccaggattctatatagattttcacagtttatttggttgctattttttctgaaattcccttttttttgagttcaagtctcactctgttgcccaggccggagtacagtggcttgatcttggctcactgcaacctccgcctcctgggttcaagtgattctcctgcctcagcctcccgattagctgggactacaggtgtgcaccaccacgcctggctcacttttgtatgttttttagtagagtcggggtttcaccatatcggacaggctggtctcgaactcctgacctcatgatccgcttgtcttggtttcccaaagtgctgggattacaagcgtgagccaccatgccagaccccatttttttataatagcaaaacctggaaacatatataacttcttaatttaataatgtattatgtctcattcattcatgcgtgtaattcacaaacatttatttatcttcaattgaaggcacaagggatacaatgtgatttccttaagaagcttacagtctagtaggaagaaacggacctgtgaataatatgatcatttaaatactataattggcatttgtccagattattatgagttcagaaaataggcagtgatcaaaatttccttagggagaatctaactagacttcacagaagaagagacagtcgccaagtcttaaatatgtgaaagtagttatcagtttagttgggtttttaaggcagaagaagaaaatattgccagcagaagtaatgagcagaaaaataccaggctcaactaaaagactcacaaaccaaaatgcgtgcattttagggtaatatagtggtgtagaggctggctagtgaaaaacgaagaaatgatattgaagtacaacacaagtagaagccatatctggaagggatttggaattattgctattttcatgggatagctatctgtgtatgtctttgaggaagacaaccctgtgtgaaaggcttggccattcttcagtgttgtggccatggacaattcactttctcactaagtcttagtttctttttacttttcttttcttttttttttttttttttaagacagagtctcactccgtcacccaggctggatggagtgcagtggcatgatctcagctcactgcaacctctgcctcatgggtcccagcaatgctcatgcctcagcctcctgagtagctgggattacaggcatgagccaccgtgcccagctaatttttgtatttttagtagagacggggtttcaccatgttggtcaggctggtcttgaactcctgacctcaagtgatccgcccgcctcggcctcccaaagtgctgggattacaggcgtgagccactgcaccaggccagtttctttatctttaatatgggaatactaatactttgttcaagggtattctgtgaagatgtaatagatatggcaaacccccatgcatagtccatagtggattatcataagtgtaaagctataatatgattgttatgtttgcatgcagtgtttatttttttcctgtagacactgggaagtcattgccgggttttaatcctatgagtatgttcttactttaagaaaaaacaatgtggtgacaataggtagaatgacttgaagagacagtgagacttgttaggaaggtgttacatttattgggtgtgtagagggcaatgtaatacaatcttgttttatattgtttctattagtttcccagggctattgtaacaaagtaccacaaactgggtggcttagaacaacagaaaattttgtcccttcaggccagaagtctgaagttaaggtgtttggcagggccatgctccctttgaatgcactaagaaaagatctgttcccgtctctccgctaccttctggtagatccttagtttgtggcagcaaaactctaatcctcacataacactctccctgtgtgcatgactgtctctccacttggctttctttttatatggatgtcagtcatattggattagggaccaccctatttcactaagtcctcatcttaattcaactagttacacccacagcaaccttatttccaaataggttgcattctgaagtactggggatcaagacttcaataggtgaatttgtggggacacaatttaccttacaatattgttttttctaacttcagcattaaatggtcctttttgggtgcttcctagtatttttgttataatacaagttttttaacagaactagctaccactgaccattggtgccaatcaaaaaccaaccccaccattcaaatactgggcaaatgtgggatggtgtatagaacttctgtttacctatgcatacattgttagataaagcagtttaaaactattatgtgatgtaaggttttaaaaaataaaaacacaaaatcttgtttacagcataattaaaactttgtaaggaatatgcatgtctgaaatttaatatactaaaaaaagtgttagttttactgtagtggtaatatttttatttcaaaattatctttaagctgattttttcctataaatagggagaaagcagataaactgaaagtgttgaattctagatcttaattttcatggaatttgaaaattgtcatcattatcctgagaacataggtgcctggtgccttgttgtgattattaatatcacatctcaaatgtggcatgaagaaaggatagagcattggactatgttactgcattctttccatttttattttaactattggcccattgcttgatgccaagagagttaactttaacctcacttagtcaccttttaacttatagtaaggacaaaaacagtgatgtgtcattcatttgtttacaggaggattatgaagtatcatgtcaggttttgttctagaaaaacatttttggactcaaaaatgctatgcttttgagtgtgatgagatgagaaatagaagtgtgccatttgctaattataagttattggtggttttttttcagaagttctataagtagctctgtttaaaaatttcaaaatggacaaagggcatgaagctattttgggaacaaaatgtcagtactgaaggtatactttttcatatattgaactaatgcgtggttcagaaagttctttgctaatttatcaaaatgtcatcttcaggtactgggttggaaaattagtaactgctagagtgtgtgaccattgaaaggtgcaggagcctatcaatttttagcttctagcataaaacgatgtttatcattagtgttgagatttaaaatgtcagaagttcttaaagttcttagcataaaaaataaaggctaaaagttaagcatctattatactataaatccagatatacaaaaggaaaacacagtactcaaaaagcattaaatgtactcaaataaattacctaaaaagtgcataggtaacaacttttaaccgtgtaatggcaaatgtcttaattttatccttataaaaatgattcctgttggcttttaattactctaaattgaggaatggtgtattattagtacactcttcacatatatactattcactcttaaatacttatgtggccaatcatatgttgggcaaataatactttttgcttccctggcaaaactctgagcaattagaagaagtagcataaaacctatagcgaaataatatcagaattgaatcccttgcccaggcatggtggctgaggcctgtaatccagcactttgtgaggcccaggaccatggattgcgtgagcccaggagttcgagaccagtctgggcaaaatggcgaaaccccgcctctacatgaaatataaaaaattagtctgtagtcccagctactggggaggctgaggtgggagaatcacctgagcccaggaagttgaggcaacagtgaactgtgattgcgccactgcactccagactgtctcaaacagaagaagaagaaaaaagaattgaatcattttaccttaacatggttaaccacattggaagacagaggatcttgatatgaaataacttcacaattgactatacttttacttgcaacaatacttctcctgccactttacgtttggcactttggtcaatctcccaacacttttgcatataccttactctttttctccacccattatgcaaacaagctagataggaaatcacatttgacaggtgagaaaatggaggcactgatatttcaagtatctgacccaatggcaaacacaaggtaaaacacctggtactacaatttaggctttctagagatcagtgctccaatgagaagctttgtagttaaaatgttatttttaatgcagaatgagtacttcgtgctcataagaattcaaataagaaaggaatagttggccgggcgtggtggctcacacctctaatcccagcactttgggaggccgaggtgggtggatcacgaggtcaggagatcgagaccatcctggctaatatggtgaaaccccgtctctactaaaaatacaaaaaattagccgggcgtggtggcagatgcctgtagtcccagctactcagaaggctgaggcaggagaatggtgtgatcccaggagatagagcttgcagtgagtcaagatcgcgccactgcactccagcctgggcgacagagcgagactccgtctcaaaaataattagaataaaataaaataaaataaagaaaggaatagtttacctgtagtcgtgaagctatacttctcttcaaggtttttgcagagtaacctttgggatttatgtgctatcttgcttccaaagagaatacagaaaatttttcagatgtttttgatccatacctgtgaggcagtagatggttgctatcagggtgaataaagactgggtgaaatgcttacgagatttgcataaggttattgtttacaacagagtctgttctgacacctgatgatatagaaattcctggataggtgaagattaaatcttggatgtattcttaatggctttggacaagttattggtcctctgagagcttttgtgtcttatcagtacaatggggatgctggtgacacctcttggatagagctgacaaaaacttgaatgggagagccatgtagattgcctacaagaaggctgacaccttcaaggagatagtcttcctctttcttctctcctgaccatgtaagacgcttcttcattgtttcaacttaggttacctcattcaagccttaatatcattatgtataacattttataattttattctcaagttgaagtacctataacaatgtaactctttcaactatatttttttcccacttgctgaaaaatagaggtcaatgtcactttacaacagcagaagtggttatacattactcaaaaattagggaatatttcagcagatagacctttaaggagtcactgtaggtttttgctggtttaagccttgtcaataaacaattgctctctcagagtaaagggatttagaatgatggttatatttttaataattgtgatggcatgacaaggagactggtttgtgattaaaggttgatgcttttaagtactaaatggagactttttaggaaattatattggtaaatcaaagatttacattatcagcatcaatttttttccctcatgaaaaatctgataaccatatatgatcagaatggtattttcttgatgctatgaaatgtacccctgggtaaagtagtaaaatactaaaatcatgtgagcataatttatgttaagtcattcctttagcaataagtagctactagtgctagttaatccctgatacaactcttaatatgtaacgatatggttatgtcattcacaaagaagaaaataatgcctttctatttgccatggtagactacttgtgcatttattctgaaatcagtatcagaacattagagtatacattaaaaggagaggcattaaaatatagcctattttactatttttgaaacactggtctggtttgcaaggtctagtttgcttaccatgatttttgtagtaatagaaaatgcaatttttgcaggaatgttgcgggagtatcaagcatggtgcatttagttcctaaaataatgctgtgagctcagtggtattatcccattttgtgcatgaggaaactggggcatagagaagataaatatcttgttaatgttatacaactaaacatcacaatgcaacctccatctaaccacaaagccatgtactttttttgtttttttaagtacatatgttaatggtagaaaggtgtccaggttcttggcatcttgaacaaagaattggacaaaacgcacaaacaaagcaaggaaggaatgaagggatttattgaaaatgaaagtacactccacaatgtgtgagtgggcccaagcataggggctcaaaggctccattacaaattttgggggagttaaatacccttagaggattccattggttacttggagtacgccctgtgtaaatgaagagggtgaagtaaatttacaaagtcatttacttggcctacactctatggagaggatatttcctgtcatagctgaagtgtgaatcggccgtatgttccctgcctccagaccctattttcctgcctcatatatagtcatccaataatcattcatgtctagagatccatattaaggacataaattttgtttaattttctgaagtaatgagaggtaaatgaaaaatacacaaaattgtagacttttgacagatttatgtaaaacatgaaagtaaatatatgaacaatcaatagtaaaatggccttgtctaaaattttgttattttatatgtgcattagccattgtaccaaggatatttattgtgcccttattgtgtacaaagcactatgcattcatgtcattatcccaactttacagatgaggagactgaggcttagggagtttaaatagcttgtccaaaaaaaaaatttagccaacatctgggtgacttcaaaatttgtgcccttgatcagtatgctatatcttgggctgaagtgaaagccctataggaaaaaagaattgtaatgttacgaatatgttatttaaagttacaggaacattttttaaaggaatagaaagctgtcctttccgaaattagattcctctttatacctgtataaagaaatcattactgaggaattaattacatcaatagtatattaaggattgaaggctattaattattacggtagcttttaaaattttgagtggagagacatttcttaaagctgcttattcccacaaattctaagttaaataaaacatggtgagagagcttagagagtcccagttgggatgagacataggtttataaacttggagaaaataattcagcctacactaagttttctatcccccaggattctgtaactgtagtaatagggatttgggatatatttttatcattataaaaaaattatatttttttcatgtttctgtatgataagattattttgactaactaaatttttttttactcaaattatgtcaatcagtgtggtagcattatttttcgtatgttggccggaagttttgattgacagctgtatgcttttaatttataaaacatattaattattaataaattgtgttaatctctaagagcatgaaattttggacatagcataaaggaagagagaagcagcagaaaggaaaaaaatctttgttgattgaatatttggaattgattgcactgatgtctatgtggatcttccttaatgaaatgtttttatttaacatggatgaacatcaataacatattctttttttcccactttttggtcttcagagtagttttcaaaatgccagaatcccatattcatttcattgcgcatatatctctcaattgaccagccagctcaatcttcaaaattcatcattttaatgcatctaggagcttcaggtagcagaagtaaattgaacaatttattaaaacaaacaaacaaagaaagctctgagaagtctttacgtaaaataattcatctgattatcaaaccataggtaaataaggaaaaagtgcttgctaataggaagagatagcacttcactcaaaaattttagccaattattttattcttggtagctgataatattatattaactatcagttatcgatgccaggaaaccatgtaagataattttgtggttgctagaggtgttgggggagtgagtgtgggttgggaagaaaggaggtggatgtggttatagaaatgcaaaacaaggatctttattggtgatggaactgttttgtatcttgactcttgcggtggacacatgagcctgactatgtgataaaagtgcatagaactgctctctttctctgtctctgtctctctctctttctctctctctttgtctctctctctctctctctcacacacacacacacacacacacacacacacacactagagtataagtaaaactgggaaaatcttaataggattagtggattgtattaatgttaatatgctggttatgatattttactatagctttgcaatatgttactattgtaggaaatgggtaaagtgtgcaaaggatctctctgtaatatttcttacaactacatgtgaatatacaagtaatgtcagaataaaaaagttaataataataatagtagtaataataataagatatagcaaaaggaaactagaaagaaaatgcttcattgagctttgaggcatgctgctcttccttgttttctaaacagccagagagctgaggtagtgatgcctttgacagactatagaatcttagcagtctggcaggcagatcaacgggactggaggtcaacagggccagatggaaattggaacaaacaaagccctagtagtggaaccagagctctgctatattccaaatcagttcaagtaccatatgaagaattttagccagtctgcccttttggttccctgacagtggctattcagtatccagaaattgctaatataaagaatatacatgctatgtgtttcagataatataaagtttttgtttgtttttttctctataaaggtaatatggtaaatgaataaaatatttttatgtatatacctttgatgtactttttgtataaattcataaattggaaaatacattttattcacatttaaatttattttaaatatattgtattctaatttttattgggaacatgtagttgctgcacactggaaatattaagtaaatatctatctttagtctgaaaaatgcctaaacttccactgtacatctcagcatacctcaaacaaagcaaaatttcatattttcttacaattatttgtcttcatatgtctcttctgataagacattgagtccttggactgtagaacaattctccttattttgtttgtgtctctcttcttactttgatcaccatccttttactcccggccctgatgtctagcataacaccctgcaaatgtagatgattaattaatatttgttgaattaatttaaaagtgaactgtgggaaaataggttcggtgatagagcatgtataaattcccagagcatattaaatttccagagaaggagaatagagtcagaaatgaaagacctgagacttagggaaagactatttgtgtagccatcagaaaagtgcttcaacaaggaccagggtaagctatacagataccttggcagctgtagagtgaaggttggctattatctggctagaagggtgatctgaagaccaagatttacacccaggaatacaaatcagaactcgattatatgaatcctgtctctcaccagacccaaaggtagtaccgtcttgcacctgcttggaactatgtgctagaatatctttcagacatccaggctagtacagaaaaatttataatatgttagcctttcttgcatgtaactccatcaatcaatcattcctttgtctgcttccattgcttggtttttatttactttaatttttaataaatttgtcatttaaaaccttcaagttgcctataaattattgaggagagaaatagattttaattccttaataataatctatttaaaccaaggcagtttcttcacagatgagcagaaatattgttgtgcaaagactaccatatagatttgataagtttataacctattatctatgaggcttatgcattctaaacatacatttaaaaaacattgtaaatgcagatagatatagatacatacatatttagctccatgggccaaaagaactaccataaataaactgtctataaccaactagtcactgtggctaaggactcacataatttccataacaatccttcctgaattctgtattaatgtctacattaggtaggtacagcaatcaaatcttggaaacattaaattgttgattgaaagtcttacagccaaactaaagatgggattaaactttggggctaacagcagagtcctattcattctttgacaccatgacgtagtgtcatataatttaattttcagttatctatagtttctggtgcaattttcttcagtcctgtccagttctgtgtgtggcattgtgtatgtgcagtttcctcagtttgtcccttatcttgctgtatatggaagcatttatgggatccacttttgaaacagcctctgaattgaaatacaatgtatctagtcaacctgagcgtccacaggcctttaatgtgacaagggcagtttattctcacagtctctaatatagtcatttgacaaatgtatattcagtgcttgctgtttatctggatttgttctatgtactaggaagactaagatgaatatggcatggttcctgcttttaagaaacatacagactgttaagagggctacgttagaaataattactacacagattaaggacatgccgcagtagagggaagagaaaaggccattggatgtacaaaaaagggagagtttaattttgcctagttattataaagccataggaaaactagggcaggcttcacaaaggatgtgattttggatctatgtattgaaggaatcgtaggaattaacaggtggaaagaggatggggttcattccaaacagaaagatccacatcatggaggttgcaagggtgctgcaaatggttcgttatggctatagcgactataaagtaaagaagttgaagaagcagctgaagacaagagatcctctgaggtctgattttaaaggaccttataccctaggggttagtatttttaaattaggagagtgatgtggtcagatatgaatttcaaaatgattaccctgccaacaacatggaaaatagattttaaaaactgaaaacagaatactagttaagaggccacagatctaatctaggtgagaaacattgagagcttccactaagtaagtgatatagaaattgaaaagatggacctattttatagacatttaggagaattccttgctttacaaggtgtttgaattgaagtatctgtaataattggttggttccattaagtgagagaaaaagtatggtaaatggagcagagtttagttgggaattagatgagtttggtttaggtatgttattgagtttgaggacactcaggaaatcacaaattaatactgaaccagtctgtcagtgcaaagatttttcattcatctgtattttgcagccccgatgtgaaaaaaaaaaaaagtaaaaaagtacagggagattttagaaatgatttagagttgatgaacagcaaatagattagttgactgagatttttgataaaagaaaaatgtaaatgattcactagggctagtaaaaaatgaaaaaaaaagatgaagaactgatagatggacagaaaatgcgcagttcaagaaattagaggttccaggatttcagaaaagataaaggaatgaaggagctgaaatagcgtaaagattttacaggcagcactaattctgagtcatgtggtagtctacagattcgggttatatgaatgggttgctgaagtgatttggggataaatgttctacaggggaggggataaaaaagactgagaagctagaaaattggataggttatctccatgtgttggaattgctgaataccatttcatgagttaggttggagaagtagactatacgccaagagctaattttctctatgaatgtaaaatgacctggaggtcagttgaagaaatgatgaaaggatggagtagagggtgttacagcaaaataatattggtctcaggaaggaaagactttttcaagagtgagttaattctattttgaactttgaagtaagatgccaggaacatacctggagtctgatcttagtaatccctgcatctgattttggtaattgttaaccatgataaacctactgtatgtgcttatgactagacaatggccatcaatgaatgagacgtggaaaccccctctatgtcctacagaatatggcatgttttatgataaaagttctttgaaaagttcatgccaaggaaacaattaattatgactgtgaaaagaaatcaggaaatcttctacagaagagaaaatattggaccagtacttgaaaagtgcatatgattttggctggagaaaaagaaataaatgaatggagaaatatgttctggaaaagtgaatatgttaaggctaaagagaaaagaagatgagggtagaaatattttattctgtaaaaaataaaatgaggttttgaaagtttattttgttttgtttcttagcggggtagtggtatggatagtggaaggcattttagttaaaactcatgagatgctgagctttgtgctaatttatgttaatatactgcagccttattaagtatttcacttacttatttttcttgataatgtaatttgtgcaaaggtaacagtaataatttgaagaaggaggtgccatttttaggaatgatcagaaatgtacttttaaattatctatatgcctataaatcaccactgccaagttctagaaaattctaaggtaaaagcaaagactggaagataaaaatgcaattttgaattaatttgaagtgtagccagtcatcagtttttaaaacaatattctctttgttatcaaggtgacaagtttttaaaattctgaaaaaacgaaattcagtttaaattttaattctctgggtgtcaagtagcaagatggaacaaggttatgattcttgtgtttgctcattaataccattttatgacaatgatgatatttctgcatacatttgaaatgtgttaatgacatgtagttaaaggagaggacattggttgacaagttgaacctcagtcactagggaccatggatggaaactgaagtaactttgggaggtatatacaatatttatttgtttcagttcttggtgcagaacagaacgttctgaacaaagaactaatgcaaatgtaccctttctggctccaactgaagcaatgtgatgccttgcaattggaattttgagacatggaaaactgggtcagattttctttctgcttcaggctacattttttttaaaaccctataataattaattttaaagatttcccatttgcttcatgttaaaactatgtccttcaacacgtttaacagtgaattttagctacataattttatttgaaattttttaggctatcaaatgcatgatgattggactgactgttaactttgtatagattgagtctactctcttcaaaagaaatgcagcattttctgaccagtgagataagataagcagaagttgttttatattcagagtactatttttttaatatggtaaagaaatagaaacatgaaatgttttttccaagctaaggtaacaaaatgaccttacggtcagtgtttggatgtgaaagaggaatagaagattgatgttttgatggataataattgactgttagctgttctcactcttctaaaggcaaggatgaatttgcactgatgcttccttgctgtcactctaaataatatatctctgtggctcaagctgttatcagtaattgtaagtaggtatttttgtgacagtcagtcctctggagcctacatgatgaatccatccttggcctctccaaacctccctggctgatgtgcttgaggtttgcaattgtgtactccctacccctcagggagaaatctgcacatcttcctggtactgtttttatggggaactctcagagtaagacatatttttggccctgattaagcacttgggctctagactcagactgctagtaactacttactaggtatacaattgggcaggttacttaagctctctgcaccgtgttccttcactgaccataagaatactgaacagacagtaacccccctcacagggatattatcaaattgaatgtgtagtcatatgatgccatcaatacagtgctaataaatgctcaataatttcttcttattgtacttctgttgatggtttggggaattcatttaactaccctagtcaacctccttatttctaaaacacttaaacataatatttttaaaggattctgagatttgtgaaactaacttactaagaattgacagtgtgagctttatttagtaggaaaataggctgtgaaatgtgttagaactgattcgatcatgagtatgccatttactagtgtttttctgtgggtaatttgtctttactcccttgtcttttttctcatttttaagaaaaggtgagaataatagtagtgcccacatcattgagttttgaaagaattatatgaaagagtttatgtacaacacttcatttagtgactaaattcaagaaataataactattgttattattttcaaatttttcatacaaatattgcctttatgaagttgtctttgcccatctataaagacaataggtggctgggcacggtggctcacgcctgtaatcccagcactttggaaggctgaagagggtggatcacgaggtcaagagatcgagaccatcctggctaacatggtgaaaccccatctgtactaaaaatacaaaaaattagccgggtatggtggcacatgcctgtagtcccaactactcaggaggctgaggcaggagaatcgcttgaacccaggaggtggaggttgcaatgagccgagattgcaccactgcactccagcctgggtgacagagtgagacactgtctcaaaaaaaaaaaaaaaaaaaaaaaaaggtattactacataagccatgattttccatacctaagaacttaaataattgggttaacccattatgcctgaggttggaattttgtgaatttttgcaatcagaccttggcgatgaccttgagcagtaggatataaataactcccacatgcttagtgttccaataatggaacaccaggcataaatgggtcaagtcttttaaattgttacctgaggtgtcaatgaattatatactagcaaatcatggatgttgaaacctgaggttcatatcaaatttagatatctctttagttgaagaaagccaccaaagctattgtaatgtaaggagtttactccagcatgagagactatttagagatttttattaaattgtcatgtaagttgctggttttgcaactgttaaaagttattaaaaccgtgcttttcatcataggacattctgtatacagcgtgcatttttgtggttagttttaaaaaataaatttaaatatttctttctcccatttagtattaaaatgcagctggcatgtatttataaatgatgtataagaatctattttttgctccttataaaatacagagatctaatttgatttgctttgctttcatttttatcccgttgttgtctcagtggaagaaactatcattcctacacatttcaagtcctccttccttcctcttcctcttccccccatggcataaatactgcttcatgcactgtgtgtttgaaaacactgcttttagtgagtgctggtattatctttctgggaaatagagttgaaattcccccagatcccactaagctctcctcagcctgtcactactgaggatatggaactgactacatattgggggatctccaagtgacagaacaacaactattgctgagatgtgtaaattagagaaaagactggatttgaggtagtaactcaaaatatggtttttttaccctctttctctcattccctattcccatggtaatcaaaaacatctaattacttaatttcaagttaagcatttactgtgagaaaattatttattcttactttacttcagaacccatccacataattaaaacacaagtaattcctttcacttagttgatacgatcaaataagataatgtatatgaaacagatgataaactgtgaagtgtggaagggtgggtcaggtatagtgcttcgtgctttgcatatgttttcaaatgtaaacatcatttcaacccaaacagatgcatattgtcaccattttgcagataaaaaaacagagggtgaggccaagtcacatgctgggaaatggctgttggacttgattttagcacagatccagctgattccaaagccaaagctatctttaatcacagtaaacaaatcatatatcattatatgattatgatttacatagtaaacaatttacacagtaaactgtgtaaacagttcacagtaaacaaaagtatattgttattattacttaattgtatataacaagtgtaccttattttatttagtatattgaaattcaaacatgccaaaacagaaaataatttgaagtgattattaacttttcaaaaaaaatcatttgcttttgaagacacagtaagtttttttaaatagaaccctttttttaaattctagtgtcattaaagatatgacttgatttttaaagacttcacttctatatacctttccagcagcatgtgttttaaacagactgatttgcctctacagtgcctttttactttgagctccataaatagatgaaacacatttgtcaaggataaatatgaagtttaaaagtcagaacttaagtagtgtgcatatctttatgatactatgaggctgaagtgtacctgggtaatagacgtaaaagatgtccattgctctaatttacttataggccattagctttctacatatctgggctttgaaaaactagaccaaaggaaaacatgcttgtgatgttcaaagaacccaatttttaaaatgtgttgaagtggtcccactacatctctaagctcatgtgacgtccaatttacatcatattggaaatgtcagtcactgaatcaggttattgttcactttttttgtttgtgttcaaattacatattgagaatttacatgaagtgtttcatgatgaaaatatttgaagcttgaaagttgtactttagttgaattaactgtatattcatcccaatttaatattttcctgaccttagcagttaaaattataactaagctattttaaaaattaatacataacagtggagtgttattacaaaagcctttaaaggtaaataatccttgctctacttctgataattcataaattattgtttttaatagagttcttttgcatgtagataatatattatttcgtactgatagattttaatgtgtgccaccagttgaatcctctatgcccggtatggcaccagatgattcttagcattatgttaagccctccttattagaccatttaatggcctttgtctttaataatggaaactcatttaataatgcatggtttgtgttacgttaacaataattacaggatgccgagtagttgctccagttgaaaatcaatttaaataagttgctcccaatattacaatagacacaaaatgaaacttattggtcattagtaattatgagacaaaatcattagaagccctgtggacaagaaaagaacagattcaaatcattctttatgtatggttaagacatattcccaggttttatgagctatgagggttgaggttactagtatcttatgaaaattaagagctaaacgtgttttaaatgcatcaataatttgaactgtcctaaacactgttataaaaatgctcccatgattcctacttaaacaatattgctgggtgattttcgaggccttaagttaatagttaccactgttgtacctcagcccctgcatagaacaagggctgccaggcagtcatcaaatcccaggaaaagaggttattaaagttcagttatcagagataggctggaagtcaatgatttaagatggtgagctctaagttgttagggcggaaagatagctatgtcatgtaaggactcaaatccaggaagtttggtaaatgatcccaagagtaccaagattgggtgatccagtgtgactctgaagcatgtgctggggctttttgtatgtgctgtgtcaaaaaggtaagcacaatgagagggttgaatgtgaatatggagatatcatttactattcttcaacatcagatgtcctcttacaattaaaataaaattaatacttctttcacttgattgagaagattaaaacctgaatttatgatgtgggagtacgtggactatatcaagctacaagaagggtaaagggaagagggagaagaaaaggcatggcagagtctagcaatcattaaccatgctcatttgggaaggtggctaacaactatttttaaattttaaaacattttaaaggaaatacattgagttaaaacccaaggcaagaacttgttattttggtcacagtacacaattgatttttcatagcataatctcagcaatattgagataactgtgaaagtggagacattttagcttattcttcagttgttgaattcagagttctcttaatattgtactaagatgagaaagcaaacgcaaagcgcttgactaaaaaaaaaaaaaatcaaaacagaaacaaaataaaattaccccaactgtttaataagtaaaaatttcttttacttcctctctttttttcattttcaaaagggggttttaacttcattttgattttattatacttctccttaaattagaattactgtatcaaagtttttgaattctgggactgactctaatgggaagaaaataagggaaatgatgtttcctggtgatctaatcaaactttgctctctgaggatttttaagggtggttaattttattgtcattactatgtaaatgtttcccagcttctaatcataggcatgctattgcttatccatgcttcccccagccatatagacaagatccataacctactccaacatcctgtgtataaatagacactcatggctgggtgcagtggctcacacctataatcccagcactttgggaggccgaggcaggcagatcacgaggttaggagttcaagaccagcctggccaacatggtgaaaccccatctctactaaaaatacaaaaattagcggggtgtggtggcaggcgcctgtaattccagctactcaggaggctgaggcaggagaattgcttgaacccggcaggtggagattgcagtgagccgagatcacgccattgcactccagcccaggtgacagagcaagactccgtcccaaagacaaaaaaaaaaaagatacttgtgaacctcttttgaaatctgaattgtgtgtggtatgggaacaagtatccaggaggagtggttactgtgggttggaaagtgtgtagcactgggacagtagtagtctgcatgttgggttttgctgtgcttgtaaagaaactccaaatggaatccacgatcaggttgtttaccttaaattctggacttaaccctatgtttgtagaaccgagttggattctcctgtaacagtggttctcaataaaatagactcagtaactcctttgtgtaaaatcttttataatgcacattttactaaaatgaagctaatggataatattctctacccacacatgtgatttttaaaagtaattttaaaatgatatagaccttattatgtacatgcgtgggtatggcttcactagaagatggataaaatagtcagatgcttatgcctatacatagaatcactaaatagctaaaaggcagacagatacaggtgtgctttgttggggactcaaatagtaggagcagccctgctgtcagtcacctgattttcctaaatggtaacttactcttgatacaattgtgaaaaataaaataaaaatgtctctggacttataaaacagttgtattttgggagaatttatatttatactaaaaagtgagaaaaataaaatgtttaaatattgatatgtgaaaaggagttgtcgatgtcatcagctcagataactatacatatttatttcacttatatatgtatgtccagcaaggtctttgaaagttgtgtcagatgtaggataattcttcactctacaggaatgtttcttgaatgcagaacagctagcaagtatttccagacaatcaatgaaagagcctcccaaattaaaaagtgaacaaaagacattctaaggaacacagccactgtaggcaagaactgttgctctgtactagaataccacgttttaaaatctcagttaatttcaggaaatactagttctctaagaaaggtctaaaattaaacagaatggtcagaaggtaataataaggcatactagtgtttcaaatgcctgatataatggacattctgcagttcatacacaaaattgtatgtattcagttgagttgtagacctagactatgtctgatgatgagatactgctggtcatgtgccttttcaaaggcattttttcaaatatttaatgctactgcatgttcttcctacttgtgagtcgtatgacatggtgtatgtgaacatgctttgtaaaccgttaagccaattgtgagtgttatcaattctattatggagattttcttaaatagtgacacaaggatttgctaatggctcctgaggatgcaatggaatcctcttatttcatttgctgtcctaagggaagtaagtttcagtaagcttacacaaagttaatgagtcattaggctttgagttttggcctcctaaaacaatgctgtttttcttaggactttgtattcctctgagtgctgtgtgcttgggcagtggagagcgactaaaaaggtcattcacattttctttttaatcatagcaatacactggaatcaaataatatagccattgagagagccctgttactgtctcagtcattaaaataaagctgtttatcaaacactaaacacatggcagacactacgttattaaagataccacaggcaagtcacgtggtctcttacttcaactggatgtataagaaaactaatcttgctttctcctattggataaaaattaactgagcatcccaatatgttttcaagcttaggtataatatgataaaatagttcttgtagtcagcattcaaaattagtcttcaaaatgtcatggacaaaattgctaatttctaaaaaaatacctcctccaattttcttttctttcattaaaatggtgccaaggagtattggggaagggagttacatatgagactgtcaaaaagttgggtttttctgttttggcatcctgttgtcacatttagtgtctgcatttagtcaccttccatttgggtgtactaataatttatggctaacatctgccgctaatgtcatttatgtcctactctggtagacccagatctgctcttactggctgccttggtcccatttggctccataaaagtcagaccttcctttatgtcctgagtcacctccagcctctaaagtattcctctagattatgctggtggactgtactactgccctgcttgttctcaactcaatatcctggacatgtgggactgtgcttgcagcatggcgaaatcaaacccaacatcaccccctctgactacttttgcttctaagggtatgagattgctcttgtcacaagactgtgtgaggtatcttgtaaggaggcttcccctgggaagttacagagacttgggtaatggaggaggcagccccaatctgcttgtagagttcctctgacttccctaatgcccctccctatctgctggacaaatctgaacacacccctgctgaaatggctcttcaacttttctttccacctcccaaaattctctgagatcagaaagagaaaatggcatttgaccccacagtcttttcctgtaggcactattaaatctgacctttgttaccctaaagaaggagccaaaggaattttgacaagattcctcaagataatggcctggtttgcaaggctcccatgcgctgcaaaatcatattttgtgtattacaagctgaattttatcttgaattatttttcattctatctgtaacgaatccagatcctcccactctaccttgccccattcaattaggtaccttggatgaactacaataaaaatcctgttctcaaaaatgcaaagaaggaaagcacttcagtaattttcaaaataaactagaaataggggatgcaatagtggagaggatagacatgatcccttacttctatggagcccatgttctattcatgaggaatgggggtcagataaataaaaaaataagtgggggattagtgttatgaaaaaagtaaacataacattaaggtaacgaatatagggaagtttgaagagattgagtgattctagtcttttgtttatatttgaagaaactgagacttagaattttccgaatattaatcatttacttactgacagtcaaaagtggtagcaggactccagaatccttactgagtgagcccattttataggcgacacttaaaaaagaaaatgaactaatggtcttggcgtggattcaggttagaacggcttgtattaaatattgtgctaaaacattttttaaaagtctctactcaagtgaagaggactgctgaccacaacatcatgacttacatattctatacctttaaactttttgtttctcattcctaggatgccatttactctcacttctaggcattataatttttattcctgcctagacacctccttatttatgattccaactataatgaccacatctagaaataagctgtcagctcttgctattaccttctgtggcatttttcacatactgcctgaattactgtttggtttctcactaagttgaaatctttttgtggggcaaataatatatactataaatatgtatagtgctttgctcacagttatcagtaaatatttggtgaacaaatacatgaattatgtaatgaaagtccatgatgtcagattccgtagaagctcttagtgtatgaatgattcatggaccttggtaatctgtaatcaagttaatgaagaacatagtttctgcttccgtttacagcagcactgactgcatataagaataaatgcacaacgaggcatagattttttaaaaagataaaaagtgcaagatacatagatatgtgactaattatagtttgtatggagagatcagagccaagtgtggttagggaaagaagccaaaggcagaaagacttgagtttaaaccgtttttggagtacaggatgaacaggttgtggtgccttacggaaagtgccttaggagaagctgtaaaaattgcagaagttgtagaagggtgaacacagttctaggtagaatatattaagttgatatacctgacgaaatattaactggggattccgggagatggaggagtggaagctttgaagcttgtgattaggagtctgaattatattcaaggaatgattggtagtcattgttggcttctaagagggggaacttgaaataacatttagggaatactcctactcctgtcctttgctcatgctgttttcccatctggaagatttccttttctccaaacccctctttagcccatttcttcaaggcttaattcatatccctctgtctctgaagcttttccaatgattcaagccaatgcgttctctctctctttctgtctctctgtttctccatcctctgcatttattgcttttactacaaaattaatatccttctgaattctctcttcttaatttataataggctctttaaaagattttctaaaatacagttttgttcagtagctgcagattcttatttacatcataaggaaaataaaatctttgaagccagcgactttatattatgtttttgtgtactccatttagcattcatctaggttcatgtgtgtttaatacgtgtcttaaagtgggataacttataacccaaatatcaactcagagataacgtttaagagttaggagagaccttagaggtcctgcctagagcttgtgttgagatcatatatgaagtcagtaccaagggcttgcatcacgtttttttctgtcagtggtgttatctagttggattctatatgatactgactgtacttgcttctaaatgttactgaacagcttccaaaaccaaagaaaatgaaacaacggcaacaaatattttctttaagtgaaatgtttttactactaaagatttttggaaaaaaaatattggcttatgggtggtgactgagaatacacattaaattcccatctgtggaaggactttagtcatttgaaagctaaaaattgactgcacaatgcatctctttataaaagaatacaaaattaattttattgcactaaggtacacgtggtatcttgaatgttgtggatttaataggtcagaaaataatagaagatttatttttcacgtagcagttaccaggaaataaaattcaatatactaattaaatcaaaatatagcatcattataattctcttttcatttacttgttagacataaggcattctcaactggaaatcaatattttgttaagcccactagtgtttaaaaaggaaattgctctgttattaattattctgctggtagatgttatgacatcgcttacttatgtagtcaccgtctcctcagatataaaagcagtaaactttaaaccttgtttggcagttatcacttttctgtgtgaagaagtttttattcaattaaaaagtcagtgatctattcacatttgtggcatgaggattaactgataagtgtctctatagccctaaatgttatgtgaccgcgatataataaagcaaataatcagttatgtctttgaacatagaaaatactatataaatgcaaaatatgactttttcaactacatttttctaaagtacagaggtaagattggacttatctaatacctgcagtgggtgatgaaaatccttggtaacatactactttagtgtttatattgagtattttagaaatgtgtttgatagctacaatttggaagtacgcagaaggctacagaaccctgaaggcaaaggtgagctgcttgaattaatatgaactaaaatgataatacgttatacttaaaagctaacttttttgcaatatacttagaagtctttagctgcattacctctaatcctcagaatacatcatgagaatagtctctgtgaacagggttaaatgcattggaaagaacactgatggaaataaggaggggtcactttcccattaacaggtactatatagagtcaaaagcgcatgcctgatgtcagatagagctgagcacacaaaccatttctccaccagtgagacgtttcaatcataccaagtatccttgctattttgcatggttcaaattggtggcctaaagagatttgttacttgattacctcaagagtacactacaagtgaaggtaaaaactagagttataataagttggttaaggaatctttgtaaggtaattttgtggaaaaataacagagcaagtgattctgacatctcaaagcagaataagataaaatgctggggatcttctggtattgaaggaagtgttttgatgtgcaccttctataaagttagtccttcatgtatttcggaacaccagaatttttttttaattgtgaagttaaaggagggactgaaataaaatttacttaccaactatggaaagcaaatactattattgcaaattccttcatgaatagggaggtagcataaatatgtaacatgtgagagtagaaaacaatggagaataatggagcatgtgtgaaaaagctaaaactttaccaataccttcaaacataagaagttacttaaagtattaatagagtatttataaattaaaattatctattcattgaagagaattttctttactaagtatcacacttgacaacctgcttatattcttcttgtattagaattttaacttatattggcattcactctcctaaatttagtagcatgaattagagatgtttttattctaatattggctatacagcagactaacaaatagataatgtttgggagaatggtgcagaaaataatgaacaaaaaaacaggaaatggtgttcagaagaatgaaaaataaaaaagaaggttaattttctttaaaaggtaacaatgtaagttttttgtgttattttgggtcgctgaagtatccagaactaacatttttggagaaagttgaggatagtgaattggaaaataatattaaggtgtttataaactattaatacacagatattagtttaattcatgctacaaattaaaattttagggaaagtataaaataacacatttaaggacaatacactgctgagaataggaagaaataaaaggaaagtataagaaaataataggaagaaaacagtccttaaaaagtatgagaacccagaggaaactgaatcccaaagtatcaacaaagagagagcaatgagaccgaccagctctgttagtgattttgtatgatttatattgcttgttgctggtcaaagttgtgaaactctgtttttttctctctctctttgtcttctgaaataaataaggtcaattttgaattatatttcttctgtatgtttaagtcagtgatgcactctgagcagtctggaacaagatatgacaagatgagcacaaataaaacattatgtaatgtagaggtgcaaaactaactgaaaattgtttggacacttgagggccaagtgcggtgttgaaagcttgtgaacaatgataaaggcccatttaatgtttcattatgtttggttcattgggacctactgacgtgtacattatctaggatttcaaatatattgaggtacaaactgattcaacagaacacatttttctctcatattgccttgtgtgataaaaagaagcaaaactgaataagattttgtttgtttgtcagaatgtacagtagggtaaatgaaacatgtttttgtgcatagctcctcatatccagaatgaaaacttgtcattttttcataggtaccattgaaaatattacttacctggtagattccagccttcattgtaaattgaaatatgagattataagcctagggcttacagcacttctatgcaatggtcctgattggaatattactcacatgtgcaattttgtgttgccttttattgactgtgacaagacacatgacatgcagcatgtgcacaaccacagcaaacaatattagcagaaaatgaatttcaaagagggagaagaaaaatatggcccactaccagccctccactgaagtgtggacacatagttgaggtgtgagtaactttcagatttcattaataaattctgcatttatctttatttgctttgacttttccagtaattgtattgagactttcagtatctgaggcttttccagagacttttagctatatatgttgagcctgacagtcaaaggcttccagctgggtgttaaaattagtcatttttttaaaaatcccatattttatggcctaaataaagttgctaataaatacttcatttaaaaaaaatactttttcaagagaaaaagagaagaatagctaccttcagtgtccagaagtactttgaagacatgattctgtactgttaaatattctaacaaccaaacattattaatacagtcagtccccatgtttcaaagtagttgtcttctaaaatccatttgttaataggtagcttgaaaataaaaaacaaaacatttttatgtaggaaaagataattaggtttccagactgatccacaaaattctcctcaaagaatagtgcatccacaaggatatatatgttcatacttaggatttttttttcaatccatttattctgagtcattaataaaattttatttataaaactagaccatatattcaaattttttatcttactatttttcagtgcctcttacactatactagcatgctaactattaaatattttgtttctattttgtttttgtttttaaacatcttatactttaaaaatcttatactgtggacttataaaagtccacagctttttgccaaaccagtaatgtaagaagcatatccacaagcataactcaaccttattacgatcacttcttgaaataaaactttgcacaatttagtttttctatctataaagtgtgaagaataatactcatatcatggaatgtctgtgaacattagagaaagtttgtgaagtgcctggcactgtgcccagcatatattggtgctatcatggctcactgcagcctcgacctcctgggcttaagcagatcctccaatgtcagcctcctgagtagctgagactacaggtgtgagccaccatgtctggctaatttttgtattttttgtagagacagggtttcaccatgtttccccggcttgtctttaactcctgagctcaagcaactctcccacctttgcctctcaaagtgtgaagattacaagtgtgaaccactgagcctggccttatttataattctttatggtacctgtgaagaaactaagttccaactaagttgactaaaaatggaaatctattagaatatacaattcaagaaaagagtgaacaatataaatgtgtgacaggaggattttgccctccgaaggtttaaatactgacaacattctcttttgatttttatttctgcttgtcttggcttcttgactccaatgtctaccttagcactctaacttctccttgtagcatagtgggaaaatggctatgttttagatccctagttttatgttttataggtatagctaccaagagacttttttttctcagctccagttttctaaaccttgaaaagggactatgagtggccctcttgttgaatcaagagatccagcccattgctgagccaatcatctgtggcccaataatgaaatcattctgaacattgaagagttatatggtaagcatcgttgaggaaggagtagactaaaatttctagaaaatggaagagagcactgggaagacaactctgtttacttcatacttcttttctctccttcaccttccttttctttcttttctctaagaagaatatggtcattgacaattgaaagaacattagtcgggcttgtttttgtttgtttcttatgagttttaaccacataaaaatgttgccctacatatacaagaaagtgtaaatttctatgaactagccacactttttcataattacatcacagtcttttgtattcacctacaaggtgttctgcagacattatggagtaaacacctaaacagagtagtatgtttcatagaagtatattgctacagtagattcagatttttatgaagaaaaaatttatgactcttctgaaaatgggcagtctgatagagccatagagcaagccagagagtaataatagctattacctattattaacaatgctatccttctcatcattttaaaaatatgatcagaagtagtattgccacattagctttgatcctagtgaaagttaaatgtttctttccagtttttatgctgccttctactcactaacatatagatacatgttttaattacaggcacattgcatagatactcataaaacaacctgatgagttaatatgacagcatgtcagaaggatatgcttgggagtgtgtcaaagcaggactcaagtttatttatttatttatttattttttacatattttccaagctgtgtttccttaggcaatctgccctacctttacctttctaagtctcagtttctacatctgtttataaagaaaatggatacaataagcacattagtggccagttttatttttcattgtctgattttgtgaaaggatttttaaaaacattaagagagggacatacaaatttctatattgtttgctagagtgacagggacagagagaaagattttcttttttttttagactgagtttcgctcttgttgcccaggctggagtgcaatggtgcgatctcagctcaccgcaacctctgcctcccgggttcaagtgattctcctgcctcagcctcctgagtagctgggattacaagcatgcaccaccaagcccggctaattttgtattgttttttgtagagatggggtgtctctgtgttggtcaggctggtctcgaactcctgacctcaggtgatccacccgcctcggcctcccaaagtactgggattacaggcgtgagccactgcatctggccgagagaaagattttcaatctaatattatttttattactattcccctttataggtcagaccctctctgtgattagagggtaaatgtgcactttttagtaatacattaatttttttagattattggggccattttgtaaatgttttttccattgcagtggatggtaaccagtggcctaaacgcataaggacaaagcttaaaaaatgaaaaaaaaaaaaaacaaacttatttatatatgctttatttcaagatagcttaaaaactttttcccatgttctagttcattaggatcataaatccttaggaaaatcactgttctgttgcagaagatgttgttcactgatttgtgaaggtttgtagtttatttattctgcaactattagacactcaataaatgaatttgatgataatgcttatggtattttttccaagaattagaaatccaggaaagaagggcatcacgttgcaatactgaattatcaaatcgaagattttttttatgccatatgaaaacagaatcagcactcaggtagtcttctttcaaatacccattctttcactgatgagagataacagaccacctaaaccatttcattaaatggcttctggtcgtctgatgcatttatgcgccttctactagtggaacaaccgtattcccttttgatgcataagactttacccactagtggcaaaatgctttaaaatgatagagtacattggccatcatatttgttcagttctcagtatataccttgctctatattatgccccgtggaatatacaaaaaaattggttttcaaagagcaacatgtttgctacataattttttttctattttatggaaaaaaattctgttgtccatacatacacaagagaagctttcccaaatgaataaatgattaatttcaaaaagcctttattttgttttcttttgacattatctgcctatttggagctaagagaatgccagtgatgaaatggtgagaaatgttgtgtattgtgcaattagaaaacaggaattttttttgttgtttgtttgtttgtttgagatggagtttccctcttgttgccgaggctggagtacaatggcgtgatctcagctcaccccaacctccacctcccaggttcaagcgattctcctgcctcagcctcccgagtagctgggattacacgcatgcgccaccttgcccagctaattttgtaattttagtagagacgcgttatctccaggttgttcaggctggtctcaaattcccgaccacaggtgatccatccacctaggcctcccaaaatgctgggattacaagcgtgagccaccgcacctggctcaagaagttttaaaaaacaaaaatctaggacctcatctacccctcaatcatggcaaaaccagttatttcaaaacccaaattttaatatggtttaccaagcctgaacataaaataaaagaacacaaactaaatgttaccaatacaggttaacaatgcacatccatacaatttagggcaaatccaaaatcaacttgacgttaaatatgttagcctattcttgacgttaaatatgtcaagctcttctctcttggtttgttttgacctaaatttctaacctgatattcttattcaaatgtgtcatgagggcagccaaatggcctgatttttccaggacagcagtaaaaactgttctgctttgtcatggattctttgaaataagttgttcttgcagtgaatacaaatgtaagcttcctgtctcagtgaactaagcaacagaatgggagttttaaaagtcacagatccaaatccctctctccagtactgagtcaccatgtagcctttgtggccttgagttcctggttttcactattgaaaatgggaattataaaatccagagagtattttatgttttaaggtttagggggaaggatgtagaaaggtataggagaagcagcaggtaattttttgaggactggtgaatagacacactgtaaaatacctcacaaataatgagctttcccctcccaccagtggggagaaaattgcccaccagtgggaggtaggaggaagatagaaaaagaaaaagaaaagagaacttttctggtcacagaggtactatttagtgcactggagcataatttattaagtggaactttggctgaaaagagctaattcacctaccaaactgagcagatttacattcttcccatcacaaggacaaaactccacatagttagttatttatcttttgggaagtaactggataagatacgggcaatggagtaaatcagcagaatgaaaactattccccaaatgccaaaaaccacaggctcctgggaaatatactaaaatattattgttaattgtatatctacaaaaattattgtaaatgcgttcatattaatcactactgcagaaatgctccattttcttactttttataccattctgtttcttggaaaaatataagataattttgaaagcaatcaaaagagccagattagttcattttaattaaatcttacagaaactgccttgttatctgtgtgaactttggttactaactttctcaaggtgagaaaagatgtattcaggtctctgtattactgtaatgtactttgtactctacaggcagaaacaaataaattccatcattaagactgtatgaagaaagctgaacagtagtggtttatgttttcataatgagttccttgtattgaatgtggaacttctgttacattttcatggagtctgcgtagaatctacacataattaaatgcctgttttctgctctctgatgcatcatctttaggcagaaacctgcatttgtgtttctcatgtccagctattacttgaatctaatttctgtcatattttattttttaatgtgaaacttcttctatcagtgttataactgatatatggtagggcaagacaattatgtagaagccagagtacaatgctaatgtgtatgtttgagagaggctaataggactcttaagctctagacctcataaaagtgccagaaaggccgggcacggtggctcaagcctgtaatcccagcactttgggaggccgaggcgggcggatcacaaggtcaggagatcgagaccatcctggctaacacggtgaaaccctgtctctactaaaaatacaaaaaattagctgggcgtggtggcgggcgcctgtagtcccagctactcgggaggctgaggcaggagaatggcgtgaacccaggaggtggagcttgcagtaagctgagatctcgccacccactgcactccagcctgggtgacacagcgagactccgtcttgaaaaaaaagtgccggaaaatgctgttgaagttggtctaaagtttttctgaagcatacaggcagaataatgttcccctcaccatccaaaaatatccatattctgtgaacatattagcctgcattgcaaaaggaactttacagatgttatagcgtatcttcaagtgggaacattatcctggattatctgggtgcctcagtgtagtcacaggaatccttgtaagagggaggcaagaggttcagaatcagagaaggaaatgtgatgagggaagcaaaactcagagtaatgaggccacaagccaaggcatgtaagcagcatctagatgccacaaatgataagaaactcattcttatagagcctccagaaataatgtagccctgcaatactttgattttaacccaatgaagctgattttggacttctcacatccaggactgtgtgataatacatttctggtattttgaacaactaaatttgtggtgatttgttaacaggaaactaatacacagttattaatctgacttttcaattttaaatacaaaactctgaggtttgaattagaacagagtgattcagacacagccttaagcttatgccttttctaataacagagctagaatataaataatacaagcccattgcccttaagtaactaatgccagtggagataaatgacttgcttaaggtagtacagctagttagtgatagagatgagatgaattgggctacacaaggctctgagaccactgatatttaatttctactgtgctgcctttgtttcatggtataaaaacatttgcatacaaaagtcatgtttaagaagagttttcggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagctgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcaaaaaaaaaaaaaaaaagaagagttttcaagtgtaataagaaatggggtaaaagtgggtgtgcggatgaagggatagagaaagggaagagttacttcacgacaagaatttatgtatgtcctgctaagttacagactaggcgatctgtagtgaatcaatgagacatggcccttgctcatggtgcctgttgggaagacaaacataaacaaatgtaattataattaattaatagaataccttaaaggagcaaagttctgtaaagactttatcatgtgcaaggacttttcctcttaatctgtattgtctttgaataagatgatgatcaaaaagaattttattctattaaaagaacatcatatgattttgagctgttactcttattctgcaaagatataataatcgccttttattatggggaagaatgtatacatgtatttttcaatgtctttggaaacatacttgtgtatattttagaagcccaggtttgtggatgacacttcactgcgatgccatcagtttctatggagacactaactattgtgcagttaggaggaaaaaaagactcctccgcttccctgtagctttaaactgtttttactcatctttctattccacacattcagaaataaaattaaaatggttttctttttgagcaatattacttgaatgccaatagtattatcttttatttcacaaagactataaaacatttatgaattaaatatagtccaacagaaaatgagatcttccctagccatcccatgctaatggcaaagatagtgtttcctctgtgtggtttataaatctagaatttttgttggtattatgttactagagttttttttttttttaaacttatacattaaacactaccaataacttcaaccttggtctttcacacagctgtggtgtagagataacttccatttatattaaccgaagttacatttgcatgctagcaggaaagtaccctttatagaaccaaattagtacaaagctatgtgaaagaacaaatcttttctacttaaaagaggcatggcaattcagtttaataaagaaattctacatcagtgtttgtttcctagatcctgatgggttcattttgtcttcttttgcatcattaattttaaataatttttaaaaattggtaatcaacagataatgctgcctgatttgaacttcctttttacactggctttatttactgctgggaactttttatttattttaacttcttcttaaaataagaatctctgttttactaacgtttgtgtttttaagtcctataaatgctggattacataagtatcagtaaatattacagttggcaaaagcttaaaattgcttccaaaaataattttaagaaacaaaaaataattaaaatgtcactcctgaattcatacattcaagtgtattttaatatcaaagttaaatgttaagtgttaaccgtgaatccatggagatagtgtcatactttgcagtctaagtacttttaagtagcacaaggtctttcaacataattagcacagaatattgaaccacgccagaaatatgggattcgtcattaaatttagaggcttctttatctctctgagtctaatcatgtgtgcagaagactaattgttaatggcatggtctttattgctcatagctttcttttattttaaatggaatggtctgctttgtgagaaataattaggttttataggcctacctgcatggagccttttgttgaatgtcttatggttttgccaattcagatcctgagagcaattagaggctgtggcggaactgttccttaaatcacacacatattgtgttattgcctgccttttattttttttacctgcagtagcagatgcagaagcttcagttacttgcaagtacacagactaattgttagccagtgcaaaaactacttggtttgggaggcataaactgggaagacaaagttgttataagtgtggcacatagaagtgtgtcctaatgtctgacactgtccccaaaataattatgttctcaattatagaacaagtctgtaacgattctcttaagtgacatggtagtttcgttgtttaaaatgatggtcaaaattggtggccaagctgtagtctttcagtatgtatggattttttttcaaccagaataatttatttgcttcccacagtcagttgggaattattgttgctcagtgaggtaaataatagagacacttttcaaaagtgctcataacagttataaaaatcaatgtttcatttctgaaagagttcaattggtatgattagtcagagacccaactggtgagatctgatagaagtattgtctaaaatgtggcaagtttcaatatcattttgagagaactgcatattatagtagaaaaaattggctggattattttggtcactctgcctacttgccttcttcatgacacagaaaagctcagtgagattattcttaatcagttaatgatgataaaaatgattgtcatttatatgttagtacactttcataaattgcattcccttggagctgtttgtcaaattgtggttaggggttggcgttcacttttccaaccttctcacatgaagttacagtaaatcctatttgtctactgttctgtttgacataaatttaacagtgttttatcctctctgtgtcatcaacatgttagccaggtaccattttctgaggcaactatactcctgctaccatgtaatcaataacacagtactttcaatcttgacaattttctttagtggaaaattactttgcataggctttttgccattccagttgataagccatcttcattcagatctacaatgtcaaatattatcactcccaaaaaggcactgacagccttaaacatatgcatgtacaaatcaatatttttttcaactgatctcctttggaaacattttttttttaactgaaatactagaaggtagatgaatttgtgacctacatcctgtggcaaacctgaagatatgtttgaaaaaaatgtcatatgaacttgcaggatccacagagaaatttacttatgggtagtacatcatttttgatataaagaaataggtcattgtaaaacattttcataggaaccaatggtactgagatgtttattttctgagtttctgtctttattttgctaaattcctcctctaaataagggagggccaagaaaacacctttttgttacctggcagattgccttctgggtaatagatgttagacaggtaaaaatacacattgctgctttgaaacacacctgagatttttgaaatcctaagaagcgtttacagttgtgtaagaaattggctaattaaaatgttgttgaaagattatttgagggactattcctttttatggaaaagagatgaggaaaatagaaaatctaagaataaccttagcaggtcgaaagttttgttttaaataatttaacttttttgtcataaaaatgaatggaatacttattcggtcgtcatggagaaagcctagcctacccatccttttttttttcttcctaatatgtggagagcctgatcctttacatttgcttatgctgctttgaacattttggtcacaatttttattttttatattcaaagtatgtagaccttgtgacagtcagttgtagcaataactcttcttgtggtctttgaaagatcaaatacaaaccaggaaaaaattctaaataaggttgagagtatttgaataattttccccttaaatttagtggggtttgggaagaattgtgtgttatgagtttatgacaactaaataataattaaacttcaaatgattaaactttaaataagtaaaagagaaataattttcgtgctccttgcaataagtcaatagtgttagtgttaaatagagcatgagagttccttgtagacctatttatagagacaaaattgtttatgatttggtatatacctttccatacttttcatgctcatgtaagtatattttatctatttaaatggagacatgctgtatttactgttctatcattcccctcttcacttaacaatatggggaggacttatttacacatttaaagctaccactttttagaaatagatgtaattttaaaaataattatgcatgattaagatttagacttttcaaattattttagtataaacactatcataacaaatattcttactcatatgtctttgcgtacttgttcaattatctcattagtatgggttcctagaactagatttgctggcttaaaggtgcttaggtagatattttatacttcatgaaaattttggtttccacatcccacagtagcattgtccttaaccatcttttatgttctgtgtttctctaagtataaaactctaattgattttaaaatctgcaccctttggttattaacaggttggtggtcttttcagccatcagactgagcaggcattaccaagcctatagcatagggtatttacgtacagatatcgatctacagatatgaatatagatcatatagatatagttatcaatatggttacagacatggttatacacatagatatagatttggacaaagacacacatacgcacacacacgcccacgcgtgcacgcacgcacacacacacatcttttcccaaaagcaagttgttgtttatgctgtttcatcaacctagaaaattttatttttcgatattcaactttattcatcctgagaagctgagctctgatttcactctccctaccaagtcacagccattttttattgctcctgtcagaaatctcatattcctttatagaacttatatggtgccttatacactcctataacatttatcctgctctgtctttaatttgacttaggcgtatgtcagcttcaggattcatagataaggtccttggttgcaggaaccacgtctgacctattttttaaatccacagatacttcatgatttgccaatatatgttgatttggtgtaggtactaagccagtgttgtgtacatatggatttccattgttgtctgccacaaaaggagtaattttgagaaatgcagtgttttggaaaagaatatgagacatgcagtcagagaatttgccacttaatttctgtgtggctttaaagatgttcctcatcttctgtgaacctcagtttaattcatctgtgaaactaagggaataacaatatacttcaaaagtagtaagtgtatcgcaagtagtaatgaagaataaacaagatactggcttgacagtgctttgcaaatgttatataaacataaatataataattatatattattacaaataagatttctgaattcttacctcggtagaaagtaaataagaagactgagtctctgtctcccaacgtgtacccaatgatatgaatcttaagtaatcggatggatgacaggattccagatgtaaattttgtgaccatatgcatccatcagaaattatttagtgaaaacagaaagaaaaataagctcacaaatggggttgcactctctttcctgtatgatagaatggttaaattaatggctaaatctaattaagaaactgaaaaattatagcttgcctgctgccaatattaatcccaatggactgtgagatagggatatggtagcactcaaaaattacctcaccattgttgaatattaaggcaattttgctacctatccttagaaataaaacagcccttgcaattaaattttgtaatttgttattggttcaaaaattaatgccttttactatcataaatgtatcaccacaggtgacaaagcacaattttaattaacagtgacaggtaaagctccttacagtcagattgaatttatattagcaattatataaaaattatattttgatcatcacagttttgcattgaggccaagagttctaatcatatatagtcctgcccctaacgttttgtggggcatgggccaatataaaaattataaaatagctacaaactgccaaatatgtccttctaccttgataaataaatatacttttataatgacccagaagcccaggtttgaatttggaatcctctgacccttggactcctgcatccgaccttggctgaagagcagaaggcccctcccttgttgcctgatcagtttccttttcatccccagctcagtgctgcaccacggggaatcctgtgctccacctctaggtagtcatacttctaagccctgtcatcaccacctctcagccccaaaagtctgtgtctgagccaacctgctggtctagggacgcacactagtaatgcatttgactttcagaggaaaagaccaggagagaggcctgcatagactttggactggactcaggaccattagggcaagatatctcagagtttttgatacgtaaggaatagcctagaaaaggtattgtaaactgcgggtgaacacatccactgggccccctagaatccttgtcccctgaggagaaatacaggatggcagagagctatagtgaggctttctgacgtacaggacccaggggcccaccttgcctagatgtaggggtggtaatgatcatacattaagcatttgatgatatttcagagatgtcaattaaataatggctgaaatatatcagtgatactaataagtttaatacattgattttcaattatatatgctttaggaaaaagtaaagctgtattttaaaccaatgcgttattcggtatattaattttgttttaaaagtgaggttctcaaaacgttatttccgtgtgttgtggtattatttccttcttgacatatttatagggaatttagttattgagaaatgtaggttatgtatgtgaaagacacaaagcataccaaataatttagacacagacgtaagtatagccatgagtgtctgtgttagtcaggaaagtctaggttttgttatggcagcaatcacactaatttagtgatttaaaaataccgaggtttatttctcatttgcgctgtatctatcatgagtcagcccagggctctgttctgcaacatggtccttctaacactggagttcagccagacctagcagtcacccttttgttcttagaagttgtagtaaagagggaaaagagaacaatggcaaatcttgcattacccattatgtgctcagtccagaagaaatacttgctcctctgaccataactcattgacaaaaaacagtcaaaacgatcctgtgttctagagggagatagaaccagaatatttgttgatcaaaactaatgattaatcttgtacagtatacacatgtatgtatctaggaaagcataagaaacatcaagaaccagccgggcacagtggctcacgcctgtaatcccagcacttggggaggttgagacaggtggatcacttgaggtcaggagttcgagaccagcctgtccaaaatgatgaaaccccatccctactaaaaatacaaaaaattagccgggcatggtggtgagtgcctgtaatcccagctactcgagaggctgaggcaggagaatcacttgaatctgggaggcggaggttgcagtgagccgagattgtaccattgaattacagcctgggcaacgagagcgaaactctatctcaaaaaaaaaaaaaaaaaaaaaaaatcaagaaccatatgcgccaaattgttcatacagtttccttaagggtggagtgcaggttacagctacattttaaaaacttggtgtatgcttttcagtacttttgtaatatttgttaaattaaggctataaaatagtctttaaaggtataaatactaatgcaatacccatatattgaaaattaaaacctactgttcatctaatattagttgtactttcatatatgacaaaatggtgatggacatatctttaattaagtttgagattcagtagacacaattacttatggatttttcaaaaattcaatgagtgaatatttatatattcagatactgtaagaaaattaaaataagcataccaaaagatacagtagatgatattagacttatatacaatggaaaaggaccagtaaggtattcagtttgtccttccttaattctatgggacattttagattccggaaattcactactgccgtgtttaacatttcatttagtattctattgtaagctgtatttccactcacatttaaaaaaaaatctttacatagatttcccaggatttatgcatttctttataacttgactgtcttgcatagtctaatttttcagcatttaaatatctaaaataagttttaaatgcaacgtttctgaattattttctattgttacgtactaaaagcaagtcatattgtttagaagtaatttaatttcctaggacttggtttatgaatacttggtaagtctatgcctgcaacaaccactgaatgccccacagcacacgagtgcaatgtctttgatagcatgggttttgttaaattaatgaaaccttaataattaaatttttaattgcatcgggaaatttttcattaactgagaatcttttaacaataaagttcctttttacctggcacactttggaggcaatgcatacttttggaggtatctaattcaggctgaggagtctcaaagcataagaagacccagtcaagtaccatgcgagagtaaactgggtaagaaagaagggaaacagtccataagaaaacagatttctgtggtgacctgggagtgcatgcttctcttaaaggtattccagttagaacaattttaaagcattattccagtgaaactaaatactctcattggcaagatttgagtgtctgtctatgagtttgagactctagaactcagattcttgtttattacacatatttatttattattcaatattagtctacacaggcaagaagatccataattggtcatattctaaattgtgcaaacagaaaagacataaaatcaagagatgcaaaattcctaggagaaaaatagtattaattttgtgatgggtacatagttttgttaacctcattttggtcatcttttgggtttaaacaattcacaataatatttcacagatatctcactttagatgctttatggctaaaaaccaacagtgggcttggtaatttgtttctggtgagagtgagagaaaaatcagtgtgtaagttgttttcagttcagggagaagtaggacaataaaccaagtcaaaacatgaagaaacagaagtcaccaatgaaacacagactattaaagctaccacctgttgcaaacttgtttccttaaatccaactaggatttagggtttaaattataatattaaattggttttaatgatggtttataacagtgtcttttgaaaacactcattttttgttgttttgctaatgcataaaagcatcaaagctcattagtttcatattgcttggctccagtcagccaaggggttaaaagaaaaatagaagctgaaaggacttcttttgcccgggaaccttatcatcattcttatctcttacctgttcttatgaggtaagatatgcactgagcatattggctgcttatgcttgttactggaatcgatctactatggtgataatgagtcatcatgaaatagcagcccagttactgaaggaggtaaggttagagaccagaacctgactggcaacaaggctgtctggatgcctcccgacacactcagcaacagctctttacgctttcccagagtacggacagtagtgttccaagtctggagtggcagaggccaaggctgatcactaagtgggtcacaatgagcaataggaaactgagggcatagagcaatacttgtaattttacttttgaacctgatgtttgttaaaatctacagagtattgggtttctgttttcaggaagctttaaaaagcaaactaaatacagatcaggaaattcatggacatacttctatgactgcttcataataatgtatggggtatgtaatatgtgctaaccactgtgttgagtgtttttattctgcagtttttttgttttgcttttagttagttcatgtaattattacactaactcagtgaggtaagtattgtacttggatttccagataaggataccaaaactttgggaaggtaatatgcttgcttaagagcatatagctatgaagtaatagaaaggggatttaaatccatgtctgtttaacttccaaccctaaggtagccagtctttgttagctatggttaagctaattatactcaagattcttaactactaagcttgtctagatatttagctcagtggttaagatttaggatctagtcaaggctgcctggactcagattctggctctgccactgactacctgtgtgctccctaacaagttattctacctttttgaagcttatgtttcttactgtaaaatgaggataatagtagaatttaatttctaggggcctcattaatattaaatgagttaatacacgggaagtgcccagaacaagtagtgcctaggagacattattcctgtcattatcatttctattattagttattgaaaaccaacaattctacaaatgaagattaaacaaaatccttatatataagtgcaactagttgtgtttttttcttgaaacttgaggcgttaaaatttgattttttaaagataaaaaaatatacagtctgctagataacaaattaattgtaaaacttcagaacaggttggttggggtacagaaaaatataaaagagcaagaaaaaattaataaggagaaaggtaggcatggaggaagagacaatgagagatatgtgtagtagcagcaaggtcggaaacaatgatatacttaaagacaaagggacaaatagacattctaagagattatattcatcaagcaatacagttaactcatgatttcaaataaactattactttaaacaaggttgcatttttataattctgggcagacataaaaatatcctctctttgtatttactcagatggaagctgaaattgttttccaaaaaatggctctcacggcatcattggtcaacttgactgtgataatgtgaagtaagaataaagaaaaggagttaggtcccaagtgagcaaaaactaaaaacaaatgagtagtttttcagtgttttctttatgcaatgaaatatttgtattatttgggtttacaaattacaaagatacatggcttcataactcgttcttttgtcttttaaattatcttcatttttttctttatctttgggagcaaagtgctgatgagttagtgtgatgtaagaatagaagagttaagagaaggagaagaatggcaccaaacactagctttatgttctcaaatttggtgcttaggccactgataattgctattcttttgaaaatatatatgtaaattattttcattttttaaattataataagcctatgttctgtacagatattttctagcttatttcactgtttactatatgattgactttggacaattatttaaactttgtatattcttcatttttaagttgaaattaatgatagtacagggtccttgtgggaattaagtaggctaagatatgcaaaatgtttagaatacagccttatacccatctgtactcaacaaaggttaattataagcatagctgttacatgtatgattacattccttagcttactttctataaaacaaatcacatatgtaccctatattgtagggtgcattgttatgcctggaagatatttaaagtgatatatggctttattgctaaagagttatgctttttatggctggttacatcctaacaaagtagagatagctcaaggatactaagaaaaaggagaaagatgaagggaaaagtagattaagaaagaggaaaaataaatgtttgaatgcaaagtgtaatagaaatacatttgcaactagaatttgaggtttaaattataacattaaattggttgtcatgatggtatataacagcgtcttttgaaaacatttattttttattgttgttatattgtcacctcagctgagaaagtcttggaattggaaatgggctctgaaatacatttggtgttcaaaatgtatttccatcattggtagctacgattctggttaacctctctgcttcttgattttctcatctaaagttggggccactactatgtctactgcaaaagtctttggagggttaattgggtaatgcagataaagggcttagaactgtgcttgacaccatatttgccttccttaagtgtaactattattatattggattaattcttaggctaggagaaatggtgatgaaaaaggcactgttcttggtctcatgcagatcagaagtcaattgaagaagacctaaagagtgaacaggctcttatgatacagcttgaaaattgtcctgaagctgctagaggtacatacaggttgctgctagagcagcaagttaaggggaacccatttattttagagaatgaactatgcctttctggagcaagtgatctctaaactggatcctaggagaatgagatttaacttgaaaagggagtggggaagagtacatcaaagcttgagggaactgcaggtgcccagaatgttttgggaaaattcaagtactctatagtattacaggagaaaaatgtatgggtcagatgaagagactgaagcaactggtagaagaaaaggaggtaaatgagcagggtaaaatgagaagggttttgtcctgagtgttagggaggttagactttcagggattcttcagagtaatcgcaggagaataaacacaagagcttagatctttagaagagttctcttctctgccttttgatataacataaagagcagatggaaggaggcaaagtttccaggaaggcaaccgctttggaggtacgtactgaaattgttagaaagtggttgtagcccctcaaaaaaggcatgaaaggtgggggagagagagaagtggatggactctattgtattttggtggaatcagtaagacaatgttttttcacttcttaaaatgggattacaggtcttggcttaaatgattatttcatagtcttttcacttgttttcctgagtaaagatctgaacactgtgccttgtttttgtccagtaagaatatatgttactcatgttccatggcctttaaacactttcatgtccaattctacaattatcatgtggaatatttccacttgaaatgcattgttaagtctgtggcttcaatagtaagagaatagtaagcaacataaatatgccacttcttttttccttgttccataagtgatgggtgattttcttggcgtgattcttctctcttattaagagctttaatgtttaggattcttgttttgcactattacagaatcaaggtagcgaaaagggactagtgagctatttctatgtatcaggaggaaggttctgtatcccttttattacaaacacgtttttcttttattttctcttcattttctgtccattgaatggtgtatagaacttattatgctagctgatatcacaatgctgggaaaattaatttacttaaataaatagcatcaatttttaagctattttccagatagcatcctgtctggtttcgcagatagttcattagttggcaagtataaacagtcacaaactgctttagttgatagtttaaatttaaaaataaaatccttgtcctgtttatactgttttttgtgtcacaacattatgaaaacaggatttcagagttttgaaaaaaaaaatttcattatttagattttgattaatgtatttcaattcttgctgaacaaaaatatttaaataagatagaagagttgtattttaaattatttggatgatattaaaaatacctaatacataaatatgcttacaataaccagaaatattcataagacaattctaccattcatacaaaaaactttgaattatttcacgaaataaaattgagcaaatctgccactttattgctttcctgtcaaagctggctgtatgtaagagctggtagagacagtgaatttgcacgttcaggaaagcgatttgaaggaattaatctttacaagcatttctaatctgtgaatttaaactatttctctatttttggaaagatgggtcacagattttgtagatatattcattttacttagacaaatgagtgcttgtcaatagggtagtgtttgtgtgtgtgtatatatacacataaaatataccacctatacattgtgttagaatttcaatttgaaacaccatgtatataatctttaagaatgtaactctcttaaacttcagtcccttttatagcagactaagtgctgctaatatacaggaagcaagaggcagcagggtcttcacctcaaaaagaccttcggattgcacccctttggagctcatcagagcccattcaggtttatcctgaggggtcagttgatgcactgcctgatactacttcttcccgggggctgaatgcacagcttcagcgagacacccaactcctgctgacttgagaaaagtgttattttaatgatgattataatgagttttagtgttgctgggagccaaatgtatccttaagtctaaaagagaaagctgcataatgtagcttagattattatttgatatgttggccttttaattaggatttttcccttcttgatattcatttattgcctattgttccaaggtgaatatttgtcgtgtatcttgatgaagatatcgtagcaactgaaacacgttgaatgcactgaaggggtggggggtctgcctcataccgtttatcctgacacattaatcaatgaaactatagctttgatcctagcacctgaattcatttctagcatttgatttcctctccagcagtcattacaagttactttttattaagtgactctagctttagaagatggcttttagccacttttaagcccatccttgcactgcattgtcatgagaagttgattaaggaaacatctaataaaagaagcttcagccaatttggtatggtgatgccatagcaatccttagagtcagtggactttgagagtgaacttttttgtctttagtaaaagttgatgtgatctgttctaaaatggttgtgttttatttattctgttgccagattttaatatgattgaaaattttttgaaaaaatgttagtttttatttttaagctgttaagatctcttcaggaaggtacattgacttggtgcatgtccattttttacaaaagaaatgtatatcaaaccagttaatattgggagtgcataaaaggttggaaactaaaggtgttgatccagcttgattgtaacagttcttcagcaatgggagtcaaactgttttagccatgatccatggctaataacctatgttacctgtgcttgtaggttaaaagtagagcaaaaatttcacaaaatgataacctcagtacaggcaatgaattgtattttcttttttattataattgatgacaatttattgaatatctactgtgtatggaatatatataatcttagatgctagcaagataagagtgagtaatgctttcaatctgtatgtggcaatttacagttatgtgagtcctgcaagcatcaggagccacaaagtggtttaagaagtggtttataaactctggccctcaggagacaattaaagatatcaaaatatctcacgtaccccataaatatataaacctactatgtacccccaaaaattaaaaataaaatgaaaataaaatgtgcatgatgtaggtacaagggtaagggtgcttattagtgatgtaggtacaagggtaagagtgttacaaattagaacattttcaaacatttgagaatgttagaacttcactctacatattttttagtgttttttattgacattaaacaactatacatatatacggggcacatgtcatattctgatacttaaatactatgtgtagcgatcaaattagggtatttcgtatatccatcacctcaaacgtttgttatttccttgtgttgggaacattttgcctcttctcttctagctattttgaaatatacaataaattattgttaactataatgactctattgtgttatcaaacactagaacttccttcttctctctaactatatgtttgtacccattaaccaacctttcttcatccactgcccccaacctacccttctggtaaccatcattctactccctacctccatgaaatatcaatctttttagttcccaaatatgagtgagaacatacaacatttttctttttgtttctggcttatttcacttaacataatgacctccagttccatccatgttgctgaaaaaaatgccagtcacaaattagtaaatcgattttataatccataaatgagtttcagtttgtaaaacactgctcacagccacaaattataatccttagaaggtaggtaggcacactataaattttgaaaagtttcactcaactgtaaaaatctatgactgactaaaaaatgcaacagattatgattcttaagtgtcatatgacaaattctggttatgaatatcctgagttaggccaatagatgcatcatctacttgtgtgatcctattcaatatatggctttatctgatgcaaattgtttcaaaataagtggtaacatgtaataactttttaaagaacatttaaaaataattaccaaaaatgtttataaacataccagaaactttcctgtttttaaacaataatgtgtaggttttatgattggtgaactgaatgtgaaaaattttcttgaatcactaaataaaatagtttcttatattgctgagctatagttgaaaggaactaacataatgaaatccacttttcataccactgccattttccttgcccccaaagtaaatcagactgacatggaggctttctgaggacaggcaccattcatgttgttcagccatattgatccattgtttcctcaaagcaaagcactattccaggcccagtcccttgccacttgttagatatgttattgattctatgaatataaatgaatggatggatggatcaatcagttagtgttagtaagacttgctctaggtaactgaaaaatggcaaaaatttattttgatctctgattttcctctctttttgtctttcctggacttagtttccttagtcagtaaatgtgcatagtctgatacttattttccttaaactcctttttgtgagtaccttctttcctgccctaagctctagaccttccttttgtcaattttttttaaacaaaagtgaccgtcccagtatctggtcctcagacatcatttagttacgcacaaactaatctgtgtaaaggaatgaagaaatctctttaatggcttatagtgtaactgcttccaaggggacttacatcacaattagagcctactgggagaaggcgtcgtgttgcatagtggaattaagggcactgttaaaaagatttgggaaatctattggtagatattttgtcagtgtcccacaaaaaacctcgtatagttgatgtttgaacttttctcagaaaatactgacactatgctggagacagaagttattaaggaatcctgaaaatgtcaaagtgtttatgtgtatagtatacatatttttctttctacagtctaggatagggtgttctcaaactggctgtagattttgaggtgtgcctaaaagtgctgatttctgggccagacacagtggctcacgcctgtaatcccagtacttggggagccagaggtggaaggattgcttgaggccaggagtttcagaccagcctggacaacacagtgggacctcgtctctacaaaaatttaaaaattagtcaggcatggtggcacacgtctatagtcccagctactttgaatgttgaggtgggaggatcacttgaatgcaggagtttaaggctgcagtgagctatgatcatgccactgcattccagcctaggcgacagagagagactgtgtctctaaaaaaataaaaaaaagaaaaagaattttttaaaaaatgctgatttctgagtcacgatccaggcctgctaaatcaggatgcctgaatgtggtaaacaaaatctttatttttaaaataaacactcttgagagagtcccaaattttaaatattttgaggcggggggtgccggcggggtgagaattgtctgtgataacttagttgtttgaaacttgtttaaaaataagtttcatttttcccttattcaagtgaccggaaggtcagttattttttgtcctgtattataaatggttattgatactgtgtgacatgaaaacaaagtttaaccaatagaaccttatagagaattctaggcagagcaacttccagtatatcacacattatttgcttaggaaggacaaaatatattaaatgagaaggtgggagtggatatttcaattctgtttcagctctagaaacaacatatctttcattataccataccttattagtaagtgaattccactgaggagaaaacacaacaaaactaaacattttatttgtattgctatgtgaatacattttatatattccagatcttaactctccatttgaatctccctactagcagaagtaaatgagagtttaatatattctttagaccaatattattggatgcctatgaaggcatagtgcaaagatctggggatgaagtaatgaaacaagaacgtgatacctgcacttgcgtgtctgctgataatttttaaggataaacttatttgtaaaattaatttttaaggtatctacgtagagctatgatgaggagaagtaaagagtatggagaggaagactaccgtggtcttgaagaatgaataagaggtagctgatcaggcaaaaagtcaggtagaagcttttaggcagaaagatcagcacaaatgaaggctctgctttttattatttaaagactgcgttttgagtgctcatatgcacacaacgctatgatcctagcctgttttaaaaattattttccttttgaaagaagctgcaagcctcaacaatgaagccattattatgtttacaagttacttaggagaaagaaaaatgatagcaatttaacattttacattatggctccagtcaccaggtgaaaatgagcttggtgttgactgtcctcaccgaggtgaccttgtgtccaatcaaaaagtacatcacaaaatttggcatcacttgtaatttctaatatgcaaaaagatagccaggccaatctgaatgttttttggtatattgactaaggctcatttaagtgtattttctaagtaaacaagtaaacgctatagattttgttgcacatagcacttctttgctttttgctttcaaatttctcaggtttggtcaccacactctaaggtaaaatgtaaacatacgatcatttataataatagtaacactaattataataatgtcttcagagtgcttactctgtactaggtatttatgaattatcactttattttacaacaacccattgggtttttcaaagacaaaatacactatacacattttatgtaattatttatggagattgttaaagaaggactggagatagtagggagttttaaaagaaagaaattttgtttattgctgcttagaaagctataaaataatttttaccatctttgccgcatagtacagccactagcacatgacttattcttcactatgcagaaccatttaatcattttaatgaattgggaaagtggcccccatttggccaggaaaaagaaccaagtatgctttgatgctgagaaggaagttggtgtgacatgatgggcaacatgaatatctgctcgtaaaaaaaaaaagggaccccagtggaacggagttacgtattcaattataagggttttcaagtacttctctatttcatgtgtctgctacaaaattgtaagtgccttagaatggagaaacaccttacatgatgacacctctgaggaattagtaaaataacagaattgattgtaaaagagctccaaagttggtgtccacacaatgggttgatagcctttgctgtctcagtaacaagttcttcagtagccttgtgtaagtcattaacttgtatcacatatttttcttttcttttcttcttcttcttttttttttttttttttttttaacagagtcttgctctgttgctcaggctggagtgcaatggcgtgatcttggctcactgcaacctctgcctcccaggctcaagcgattctccttctcagtctccagagtagctgggattacaagcacctgccaccacgcccgactaatttttgtatttttggtagagacagggtttcaccatgttggccagctggtctcgaactcctcacctcgtgatgtgcccgccttggcttcccagagtactgggattacaggtgtgagccaccgcagctggccaacttttttttctttatcttcataagtgacttcaaatctgcactcatctattaagacatgagaaacaataagggaaggttcattgtgcaggcactgcagccacatcaaatccagagtctgtcacacataatacctgcatgaccatgacaaaattacttaatctcccttttcctcacatttttcatcaatgtttaatggcaatgataatattaccatcattaatgataatgttaatatcataaggttgttgtgaagatccatttattcatttacttattcatcaaaattttaagagcatctactatgtgccaggcactatgatgcatttcaatgaaagacagaaagacaataaatgaaagaaaaataaaaatataaaacgtggaaaaattaatttgagatgggcaagaatattttaataagataggcagagaagatctccttgataaaatgacggttaaacagagacctgaatgaggtaagtgagataagtcctgaagctacaaggggacggggacatatcacatagaatgaactgcagaggcaaaggctgtgtgacacaagggttcatggcattttcaaagcgatacttgaaggccattgcggctagagctatgtgagcaaaggggagaattttcagaaataaatttagaaagatgtcaagagggcaagagaatatatgggccctgtggaacattataaggattggcttttactgcatgttatcaaatttaaaacatttttcattgttagcttcatcattattttatgtgtaactaaggaacaaaaactgccctgaaaatgatggcacaatactttctaatcacatagatttttattttgtatttatctaaaaagtttatttagtcttatttagacaaaaattcttttatatgctatgctggtctgcctctgtttctttttacatacacaataacttctcatttcaatgttgaatcatagtggaaacttactgaagatattaaattcaaatgtgtagtcccaatagtgcctataattcaactgaagtgatgaccaagtttgttcatatacaagcaatgatcactatgttataactgccacctggttcacggtgaatataagacactttttaattttctatataaaaataagtgtgtattatagtcatctaaatgtggaatgtaaatgagatagaaagtcagagaagggtgttgagagaagaagtcatgatttacttaaagaattacttttactgccatgaaaagaatagactgactgaaatgcacaaaggtgcaagcagagagctgcccaggagatttatttgattaatgatgattcagatagatggtagtggtttggctcagaacagtatcttaagaggtgtcatgaaatggtcagattctgatgtcttttgaagatagaaatgacaagattattgataattggatgaaagggataggagaaagaagtcagaataactctcaagtttttagcttgagattgggaagactgcgcacagatgggtagggatccatgggggtcaggagtctgctattggacatgatacatgtgaacttcactattcgacattcaagtggaaatgtggagtaggtgactagaaaatgagtctaaagttcacagaagtagaatctggagataaaactttaacttaaaataactccttccctgtatagatgctgtttaatattatgaaacaggatgacatcacctacaattgtgtttctccatttttcactactattcacactttttttgagacggagtctcgctctgttgcccagactggagtacagtggcgcaatcttagctcactgcaaccaccgcctcctgggttcaagtgattctcctgcctcagcctcctgagtagctgagattacaggcatgcaccaccatgcccagctaatttccatatttgtagtagagacgaggtttcaccatgttacgcaggctggtctggaactcctgaccataggtgatctgcccacctcagcgtccaaaagcgctgggattcaggcatgagccaccatgcccggctactatttgcacttaaaataactagttcaaccattgtggaagacagtgtggtgattcctcaaggatctagagctagaaataccatttgacccagccatcccattattgggcatatacccaaaggattataaatcatgctactataaagacacatgcacacatatgtttattgcggcactattcataacagcaaagacttggaaccaacccaaatgtccatcaatgatagactggattaagaaaatgtggcacatatacaccatggaatactatgcagccataaaaatgcatgagttcatgtcctttgtagggacatggacgaagctgaaaccatcattctcagcaaactatcgcaaggacagaaaaccaaacactgcatgttctcactcataggtgggaattgaacaatgagaacacttggaaacaggaaggggaacatcacatccaggggcctattgtggggtgggggagggatagcattaggagatatacctaatgaatgtaaatgaccagttaatgggtgcagcacaccaacacggcacatggatacatatgtaacaaacctgtacattgtgcacatgtaccctagaacttaaagtataataataaaaaaagaaaaaaataatattttatatcaccatatcactaggtagcatacaaacatacactggaaaaaatatgtattatttaatgtaactttattttataggtatgatacattctgtttttcttgtctcatcttttctctgttcaaaagccaaaagttactacatgttcctaagattaaaaaacactaaaccagaatgggaatgagaatagggaagagattagttccaagaactgagccctgcttcatgcagtatgtccaaagatctgcagcaatgcctagcacatattaaatgctcaacaaatgttagtttgtattattaaagggggatcccttccccccaaaatattactgatttgtttttatcaacttcatagttagagggctcacactacagcatacagaaaaagaaacaggtattgcattagttttctatgctgtatagctaatcactacaagcgtggcttcttaaaaccacatacatttattatgtcagtttctgtgagtcagagctctgggtatagtttagctgggttctctttctcaggattccaccagatgttggcaagggctgcagactcatcagaggcttgacgggggaaagatccacttcaaactgcctcaggttgttggcagcattcatctccttatagttttagagttgagttctccactgtcttactggctgttggctggaagtcactcttacctcctagatgctgccgctgttccttgccatgtgaccctctctataggcagttcagtgcatgctcacctacttcttcaaggacagcagaagaatctcttaagctccagtatgcccagctggagtcttatgtaacataaattataatagggatgacaacccaccacctttgtcatagaacataacttaatcaagggagtaaagtcgccttttccttactctgttggaagtgagtcatttgttatgcccctactcagaaggaaaggattccataaggaccttacttactgggggtcatcttagggcatgttcttctgcttgtctccttcttatccaaggtattcttcctggaacttgtaggaaggagtaaaattttggtcttcatcttggttatgaaataagaaatcatagaacaggggtaagaagacatgagcactattcttaatactttctgttttatcatgggaatacggcaaggtaattaatctatcattacctcagttttcccatctttaaaatggctgtaccagtatctttccatcatcttttctcacaggattctcaagaaaatggtataaaatattttatgaaaaatcaaattttgagctataaagtgttataaaacatgacaataccctttattattattatgctctggttctccaacttttcaccagctgtctagaaggacaaagcaatgttataaatggcttgtggcctgtcacctttctctaaaccttgtcaacagcaagctttcaaatatttattgaaggaataacacatgtttttcttcatttggtttatatctacttttgttcatcaagggagccataaatagttttacctttctttataaagtgtgtttgatttttaaaacagacaacaagtgttgtacagtttgtattaaaggactactttattgcttttttattacctgaaaaatgcaacaaaagtttaaaattaataacagtcagtagtaacagggagtagagataataaaagttatgttctttgcctcagaagcaacttgcgattcactttccatttccttaccaaaaaaaaaaaaagaagaagaagaagaagaaaaaataatcaagaacttctctggtgtttgtttaatcaaagcaggaacagaaaaggagagagaaagaaagaaaaagaaaaacttttaaacataaggcagcgtctatcaattgagaagagagtcagggatttgcttgatttggatagtccctctatcaacagaagtttcatagccactgttgggaggaaaaagcaacagtgaaacatcagagggggaaacagatttactggggcatagcaaatcctagtagggtttaagtatttcatgggatcagttaattagtaagtggcaagcttaaatgaccgttcccagaaatcttacctaacatacagagctgacttcccaggagagaaacatattttcctttggagaccaatatctagttttcaattattaaaaagtagaaaaatatttataaagcacatctttcaatgctactcttgtaaaataatagattcttgcaaatatctttcattatgcctgccactgacgtgctagagttgtatgcccttctagcaccttaaactatctcctggaaataatactgacacaaaacctagacttggctctcaccatttgctgggcatttccaaatgaacattcttttggttggaattcactctagcaaaagccaatttttaacctttcagctcttgcccaacccacacaccttgcaagggctgtagggtcccagtccacaagtatatatatatacaaattctttatcctttattcatggaaggaaacattctggctcctttacaaatcctttatagctcagaatttcggtttaaagtgacttttgaaatgaaggcagaattattctctgtattttttgatgctgctaagaaggaatttcctcttgcaatcaaaaagaagtacaggaaggcaatggagacaataaaccaggattactggagatggtgtttcccactgagttgcagaaggaagtatttgggggtaagtgaatggatcagatcataaaagtctatgcagctgatctgaagaacgtagattctactctaaataaatggtgaatcattgatggcttggggaatatgaactgatatgaaaaaaatatagggaattaatctctcagcagtttgccctatggtgggaaagtctagaggcaagggttagtttgaaggtggttatactcatgttagtgtgaggcactaaggttgggtagaattcgaagtgagagagaagaatggatgtgagagatgtgtagtagagaaaaatgactagacttagtgacaagatgtaagtgacaaatgaataagacgtggcaagactatgaaagtcctaagaaacataaaaacaaactggtagaagatatcttacaggcaaattttggcatatggaaaaataatgtgttcacactaccagtctaggtggactttgcatgtatgtatgggaggacaatatataacagaggtgactacctcctttatactccattgtgttctgacctttcccttgttttggttaaagccacgtgagctttagaatgggctaaatatctatagtgggttgaatagtgccccccctccaacaattcatgtcaaccccacacctcaaaatgtgaccttatttgaaaattgggtcttttaagatgtacttagttcagatgagtcatgcttgattagagtgggccctaaatccaaagactggtatctttgtaagagtagaggtgaaccagatggatgcatacgtatagggaagaacaacatgtgaaaaacagaagcagacatttaaatgaggcagctataagtcaagcaatgctaaggattgctggaagcccccagaagctaggaagacgcaaagaaggatttttttccctagagtcttcagagggagtatggccctgctggcaggttgatttcagacttcaagcatccagaactgtgagaggataaatttctctcattttaagccaccgagtttgtggtaatttgttcctgtagccctaggaaattaataacatatctgaactacagcaaataataaacattgaaccatcagtatgtgctagacattgtactgaatactttattcagattacctgatggaatcttattttgctgagatgattgtcatatacttttaaaatgaaaacactaagactttgaggggttttataaacccaggtcatactggtagtaatttttgaaaccaggattcttaaaatatcagttggacttaagagccaccaagcaagttatctctcagtcattccatccactgctgagcaattcccagaaaatgtattttcagctttaaaattctcgaaaaacaaaacaaaacactttttgttgagttcagattcatcaatggatcaaggattcctaacccagataatacttcttgttcctatgtttagactccttggtcttctgtgagcctctgagtctttgggcattacaataacttcattttgtttccatctatcctaattctttaggctttggtatctaaagatttttgtaatctctaaaattattttacccagggacataagttgcgtggatggtttaaaatacacacacttacacagatttgaagtcttggtgaagcaatatgcaaaattgtaagcttttctaatgattcttcttaatttattataatgcctttgatggaatgcaaatctgcaacgtggaatttctgctgcttgtaaaagaataacattgctaagtttaatttttacggagaaatattgacagcattgataaaagcttaaaaatagctttattgttatagttgtatatattaaaggtgaatgcattgtcaaatgtccaggtcactcacaatataaatgtgtatgtggtgggacccatacattggtggttctgtaatccaatcatagaaaatttttactgattaccaatttccatattctgtcaaatgcttcaaaaattccattttacatttgcatatctatttgtttcagatatttcacctatgggacttaaagtttctgaataggtcagtgaggcagaatttcctctttttgccctctatctctgacttgtgtttggtgctagaaaaatgcattaattcgaaatacagaaaaaaaaactatttattgagtgcctactattgaccaggtattattttagatattgaaaatataacattggaaggagttcagtgcatatatgcttatatattattatatatcaatatacatgattatatataaatttatcaattatattggaaataccaggatacaagagaaagagtaaaacaaaattgtagtaggaaatatcttgtagataatatcagtgatttcagatctaaactttcatgcctcatgttttgaggtctaacacactactgccccaccgctcccccccccccgcaaaaatagaatgaaagctacaaatttgcaccacatatgtaattttaaaattttttagtagccacactaaaagaaaagaaataggtaaaataggtaaatggccatattttatttccaaaatattatcatttcaacaagcgatcattgtgaaaatgagatttttacacctttttcattctaagcattgaaatttcagtggtattttacactcatttcagactaaccacatttcaggttgctcaatagctgcttcaagtagctagtggtcactgtactggacagcacttatctaatgccttgattgtttgccttgtcttttccatatgaaatgagagtattaagtaattcatatctttttttcctcacacgctgcaaataaaaaaatgaggaaataggcaaattgttttctcaactattccaatataaaaacaaaatatagttatttattaaaaggtctttcttttaaatagaacaaaatgtttaaagcttacttacggaacatcagatttgagcacctgtagaagataataaaatctctgatatattctctttgaaaataattgaggaaataatattttctaacttcagaattttaaagagaaagcaaacgtatcaatctgggcaaggcttcaaagaggccatgatatgtgccttgagaaatcccttggccatcaccaaggggctattctgtctcttggagcggctctgcagaataattttaccgtataatctgtgactgttttcattccgatatcattcacatagagtcttagatgacaatttctctttttctagggaaaaatttagtactattttatgcataatgtaagttgtgttattaccagatttttaaaggaaataggtttttgaaacccttagtttcattttattcttgagttctgataagttgtatacatttgttaattaaacatgaccatgaaacatagcaataaaatctgaagaatggaaagaaagatggagttactttataattttgtttctaatattttgtaaaatcatttaaatataagatggactgtattcaatttcaagtttttattttggaaatgcacaaatcgtataaaatattaggactttggatccaggtcccactaatattgtgagtttcctcattatgaaatgggaaatactaccttttctgcagaactattgagaggatgagatgaaataaatatgtgataaatagtattgtgtagctattacagcaggctctcagtaaaggttagttatcctttcttctctaccacaattactgcttccttttgttttaaaaaattcaggttccttcttcaatctgaaaaacagcatgagaaacatttttcattattgcataaggaaaccaaaaaaagaaaaatacaaattctgtttaaaaaataattcacctagaacaatattctgtacctataatttacatagaaatataaatatataaaggagatgtgcaaaatgagatggatttaggttcttgtattatgactgagttcaggaagtggtcaaaaaattaaaaagacattttttgtaaagaacaatactgctctttgctaacagagtaatgaaaagataaactcactgaggaataaaatcataatcattatggtgttaaaatagatgatgtatatttttattaagaaaagtacaaactaaattgttgtttacaattattttcaaacatacctctaatataccagtggttaggatagtattttaaggtagttaagataaaatattatctctcatttaaattgcttaaacccccttcactaggaccttaaatgccccagtaggacatcttagcataactagatgttttccatcttttaattactatgactaattttttacagctgagttacaaaaccttgaaaataatgaatatggtgacacattcttaattataatggtgcaaacagcaccactctgatacagtgtgaggcttacattgaaaaggaatttccctggaattgaagctcctctgattgctttccacatcacgttttaaacaaacactgtgatgctttagccatgacttggttgcctaggatacacagttaatgtagccctaagatgctgctactagttaggctttgaggccgtgtctgtaagtgctgcacatagctgcttttaatacattagaaacatttatgtaacagggacactttgcggctgggttcggggtgggtagttgcagtttcattcatgagataaccagctgtatatttcagtagttacagtgaaaatagttatttttattttagtttaggttagtttttctgtgaaagaggcaaaaagtgacggttttttaaacaaatgcaaaattgattcagtgacctaattctaagacacattctcaaagaattaaattttcattgttgaagaactggaaaaggtaactagctaaattacagtgagtcatttctacaagcctcttcatttgatagtgacttttattagtagatgtttatttagtctgtgtggtaaaacatatcagtttatttttattaagatatttgaaagtttcatgtattataaaattattatgataataaaaataaacattagcaagataatgtttgtaacagtagttaatgagagtattggtgatgaaccacagaaatatatacaaatatggtatgtacagattataccttttatatcaaaaattatctttcaatttttataacagtacatttttaatgtttttggtttaaatacgagatggaaatataaagctggttatacattttagcaaaacaacttaaatctggttttaaaaatcagtagtcttcttgcttcattcctatgaaaacttgaattgtcttcttggctgattggagttgttgagtgagtgggaagatccaatttgaaccagcaggtggtgcttgagttataaatgcatttagaatagatatttttttgaaaatcttgcaaaactttcaggaatggttgttcttattttctattttataggggtaattacattttagaaggaaaatctcatttagagcttctgaattatcactggaattgataagcttaatgccttttcattccttctctctttccctttcccttttctctaatcattgttcccttttctgcagtagctttcagcagctgtactgtcagggaggaaggatacactcttttctccacaacagagggcctgggtggtgaaagtggaagatactgttccaggagagcttcaggcatattgcctgcaagtgtaccactttttctcctgggtaagattcaaggaggttcctaacttcaccttgaaatcttggtgcatgtttatgacaccacttttcaagttcactcttctgtatataaaccatttttgctgtgtattagaatgcagctctcttaatagtgactaatttattcagtcttcaaaaatgcatatggtcccaaaggtaataaaattatggcctttgacatttgtcacgggggaggaacactgtttgtgtaaaaattcctgcaaaaaagcattgtccataccaccaaattcaacaagaaaataaaaacattgtttgatggatagtgcattttcagtttagatgtactaaatctagtgaatgagcataaaacctaaatgactaggttttatgtcatttgacatatcaaatgacaaaagatataatattaccggttatctagtgttacttctttctgtgagcacatcaagtagactttgcggttatattttaattattaaatactaaagctaatgaaagtcctggatgtctgctattcctgcagaaataatcagaaagcatcttataattacattttttcattttaggaaattcctttattggttttgttaataacatttggttttataatattgatggctttagaattatgatcatgttaaggccttagagcctaatttatttggctgatcacatttctgacattttagttcaagataataaacactgtatattcctaaagtgacatgcatgttgtgttttcagtctattgagaattatatcagataattagattctgtggataattctattttttttttttttttttttttttttttttttagaaacagggtttcaccctgtggcccaggctgaagtgcagtggctcaatcatagctcattgtagcctcaaacccctgggctcaagtcgttctcctgcctcagtctctcaagtggctgggactacaggagtgtgccaccacagccacctaattttttattttttattttttgtagagatgaggtttcactatgttgtctaggctagtcttgaactcctggcctcaagcaaatcctcctgcttctgccttccaaagtgctaggattatgggcatgagtcactgcacctggccttattaattcactagtaacaagcaatctgaataaatcacatttttccccttaagaaactctttttcttctatttttcctcagtaggaattttccctgacaaagttaatatcttcaacaaattattgcaattgcttttttctgaactctgactcaaagtgatcaggacaattggtattagcaacggcagaataaagagcatggaataatggatcttttcttagattatgtacaggtctccatctttatgactaatgtggcacaacattcttctctgcaaaggtttttctttttcctttaagaattaaacttaatgcagtatttgtcagttataaatccagctatgcaaataagggtccactaggactctgaagaagggaatgaacttcagttgcccttatgagctctattaatttgcatgtccatagtaatattccagtttccaggttcctgtaactatgtatgggcataagatacaaaaagtaagatgattcactcaaattccaactactgttttaaaaagtaacaaccaaaatgcaaagttctagcaatatttagtccaaaaagtgaatattttgttgttttaatacgtgggagtttattttcattccttttctcccttgcacatggaactactgaaacacttttattttttcccagtacatctttggccacttgaatttatagagaagagaagagcaatgtaaaatactaatgaagcaattctttctcacatttcagactgctgcaaatcaaactcaaaggattaggaaaaagacccttcttacaagtttataagactaaaatttcttactggttcatgaaatacatttaacttctcattcttctgcaacatagaaagctgttgtcagctggctgatttcttgcataccaggccaactcttctgtctcaaatctgcatagagataagtttggagaggagcagagtccctttggggatgaaatttgcttttgctatttttgttattcctttttcacaggaggctgtgtaataattttctgcctagggtcttgaaataacattaaagattgacaatttggttagacttgtcactcttagggccaaagttgactcatattgcacaagggactggtgacattcacataatttttttaaaataccttttgcatataaatattatttttccaattacaggtggcattttgaaatgcttttttgtgttgtgagtcattcaaacatgttataaaaatatatattttatctttgtatcttcatgctttccttgagggtgattttggtttttggagtagctcttagaaacctctttctcaggcagacaccaagcagatggaagcacagaaaagttggaagacttcatgtttgggaggtaggcacagactgaaggaagtggatgccctaggttagagacaagataacagcattgtgagaatagagtaaaaatgaattcagcttgattcgtttctagctttatgttggctacttaatacagtatatagaagtgagaatgctttctacctaccttcttttctttctcctttcttcctttctccacttcttactcacagaagtgaaattgctgattgatttctgtgcgtaagaaaggaggaaatttttcccgtcccccactctccttccaccagtcctacaaatgtgatcactaagtttaggaaaaacatatgcacagtttgtgtgtaatgttctgggaagcatgaagtccaggggaatatgctttacagatggctatgcagaaccaatatcaaaaaaaatggaggggaaatataaacatagaaggggaccagaacatagttgtaagatgagattcagccttctgacttgttttttatttctgaacaaaaattgttcctttgtgacttctgatgaagtcctccatctttttagaagggaggcttggagagggttgcagtatgagaaaagagccattgcagataaaaaaaaaataattttgtcttggaaattcaagtacctacaaaatattaaaggtgctagtaaaccattaaagtgtaaaataaccttaaaatctaaacccaattcacttacaatatgattatgacttcaaagtagaaatatatatttatatttttcatatacctacccactaatgttggccaaaattgatcattattgataaattaaaactatatacatttgcataatacctctgtttaattatgagcaatattggtgcagatagtttcaaaatgtagctgagattttaatggtggcagtaaatcagagatgttctacttattatttcattttacctactctaaaatggctgataatttttacaaagaatctttctaattatagtaatattactaaacagaacccattttatttagtagatcacatgataaatgcaaaagcaaaaatccactggtagtttatttgtaatttaggtcttaactacctagagaaatagagtgaacatgtgtcacttgagtttccacactagacaacgaaagacaacttcctgtatgattgctaatataaagcctcctcactaagaaaaaaaaaaaagttttattgagatttaatttgcttaccagacaatccacctatttaaggtgtatgattcagtggttttaactatattcacagagttgtgcaaccatcaccacaatacattttgaaaccatcaccacaattttcattactcctaaatgaaaccccatacctataagcagtcactacccatttcctctcaacccctcacctctagacaaccattaatctgtgtctctatagattgcctcttcaagacttttcttgtaaacagaatcatatgatatgcaaccttttggcttattgtgttagtgtaatgtttttaagattaactcacatcatagcatgtatcagtacataattcctttttattgcacaataatattacattgtagggatatactacattgtatttatcagtgtcagctgatggactttgagttttttctactttttggttagtataactcatgctcctacgaacattcatgtacaagaatttgcatggacatgtttttatttctctcagattgtctacttagaagtaaaagtgctgcaccatatgataacccaatatttaacactttgaggtaccaacagactattttccaaagtggatgcatcattttacattctcaccagcagtgtatgaggattccaacttctctgcatcctcaccaacacttgcttatctgtctgttttattatgggcacttaatgaatgtgaaatcatatctcattgggttttgatttgtatttccctgaaggctaatgatgttgagaatcttttgtgtgcttgttggccatttctatatcttctttggagcaaagcctatttggattctttgcccatttaaaatttttttttaaatttttattattgaattgtaagaaaactttatgtattctagacacaagtcttttatgagatacatgatttgcaaatattttctttcattttatgtgtagtcttttcattttctttgttgtaatcattgtaatacaaaatttttaaatttttatgaagtccagtttatcatttttttcttgttatttgtgcttttggtgtcatgtttaaaaatgcgttgtctagaccaaggttgtgaaattttactatgttttcttctaagaattttatatgttttgtcttctcatttaggttcataatctatttggagttaattttgtgcatggtgtgaggaaggagtccaaattcatttttttacatgttgatatccagttgactcaggaccatttgttaaacaactattctttccccaatgcattttcttggaacccttgacaaaaatcatttactataaatgtgaaaaggtatttctagtttcttgattctattccattgatttatatgtctacccttcttccaataccacacaatcatgattactgtaactttggggtaagttttgaaatgggaaattgtaattcctccaactctgtttatttttgagatcgttttggcaattttgggtcccttgaatgtccatatgaattttaggatcagattgtcaatttatgcaaagagagtatctggaattttgattaaaatgtgttgaatctgtagatcaatttggagagtactgccatcttaacattcaactgcaagaggcaaaaacatttgatattagaacatggaaaactataatttgaggtagcttaagataagtgacataaaagatgtacagtgaaacccccttgcagattaaaaggagaaggttttatccatggagaaagaaaaagactattcatggaggaggctgttcaagaagtatgacataaaccttgagttgtctaggatttcatcaggctgtattggaagagaggggcattggtgagaatattcaagatggcacaaacaaaagctccccaagcaggaactcatgagtcgtactcatggaacatcaaacagttcagtttagctagagaatgggacgtgtgaaggaaagtggtcaaatattccgctcgaataaaggagaccacattgtgggggccagaaaagccagcttaaggggtttagcatttacttggtaggcattgcagaacctccacaatattttgattgagaatatactgtaatactagcttgtaaaatctgttagatgaaaagcacatgtatctgtaaatattttaacccgaacaaaaggctaccaatgaaaggtccaggctgtgacaactaacctagtagatcctcttctggaaaacaaaaggaaacattgcttatcttgtcaacggaaggggtttgcttatattaattcaggatttaatagcaagctaagccatagggagctgctgtcataatgaaaaactccactagagtcctcctggaaaaggtacttctgatgtaaaagacctcagggaaaggtttctagagaatccataattaaatgtcacatcatggcaagggcagaggaaaaaaaatgactctatttggaaaatggcaaaatataaatgtctggtcaaaatattttcgtgccttatttaaaataaggctgacgttcttcctagtactctagagtttcagttaaccatcctcagtaaataaaccatttgttaacaaaacaaaggttgtaaatgcgcttctactttgcatggcaagataatgcccatggaaattcctaatttctgggtggaattctttcattctgagttgatggactggaaaaagcttaacagattgctgcactactgattcatttcctaacagacagtttaaactatattggggatgagatcattgtaactgttttcccattttccctaatttaggttatttatttaaaaaagaaagagtataggggagaggaaacaaaccttagtttaaattttggttgtgtagcctcagaagagactattaagattcaaaaatagataatccttccagatgggtccaactcattgcaataagaacataaaacataaaggacagtaaattagcacacagtacttatccctggagtctgccatatgagctaaccaatggaaattactggtatatatggaacgagacagttagttagaaggaactcagtgattttgtgctatattaagtcaaatcatacattagggataatagaaaaattatgaattctctgttatttaacactggattcctacattcatcacctgtttaagcaaattaaacagtaaaagaatggaccatattttgcacatagcacattgtaggatagtattttgcacagaaaaaataaggctcttttgatcaagtccagacctgccaatataaaacccatatcttggccaaagttctccctcatgccctcccatacccctgttccaaagaagtactgattagaaagagaagaaaataattatagacaaacagaaagaaaaatttgaagaaaggagtaaaaaaaattacagcgaggtttagaaagttgagaatatgcaaaagaaaagttatggtgacaggcaatgacatctaaaaggaaaatgtgcttgtttttgctcacaccatagtttataggcaaggaagcaatcatgtgtttaattcttggatgatgaaagattttggaattgaaaaataaaaggaaaggataaattgttctcgaaaactagaaaagccatgcgtaaggtggagaaggtaagggcttgctagcactgacaaagaaggaccaaatgaaagtagatgagatgtgaaatcaaggagtcagactatcttctgtgacaatttcaaagcctacagaaaaaacagctttgactttataaaacacgcaaagtattattagcatacaaaattaagcgtttatgaaaactcttagcatataggtatacaattagttatcagaatgcctaaatacatggaagtttgatttagtcaacattttataaactaatagaacctaaagaagatagttaccagtacataagtattacatcttaaatattgttagaatcagtgcagtaataatccattaacttgctgcttggattccattaagtggtatcaattttattctgttgcctagcatggcatctggcacagagcagacaatcaagagccatttcttgagttaacatataatttctagcccagggccatcatagaaaaattgatattatagacttaacgcccaggaaatatttcttatatacctactatgtgccaggtaaaagggacacactgatgttccagggaactgatagtctttgaagtggcatacatgggctccttagcatcttcctactaacttgaggtcttctatatcagctttctgggtttgtttttgtttttgtttttgagacagagtctcactatgtcactcaggttggagtgcagtggcgcgatcttggctcactgcaacctccacctcctaggttcgagtgactctcctgcctcagccttccaagtagctgggattacaggcgtgcaccatcacacccacctaatttttgtatttctaatagagatggggtttcaccatgttggctaggctgatctcgatctcctgacctcaggtgatccaacctccttggcctcccaaagtgctgggattacaggcgtgagccactgtgctcaaccatgctatatcagctttctgactcatggaaacataatcatgatccagctaaggaagtacaagttacaaagactgagaaaacgaagaaaacttctgtccctgaggaaacagaatgtgttcatacactgcgtccccgtaatgtacgctcctttgttggaagctggccttcccaccccctctaggccctctggtgaataagcaaaaccagtctcactctaatttttacatcaactaagttgcagaaatgtcagttcattctgtgatgttctctatttttttctgaaataagatttgtttcttccttccctctgcttttccaggaatccattcttctccttctctccaaggataactatactacaatttcttaagaatgtatagtatatctattttccctttacaaggctgcaggcagttttattttgaaactaaaactcatggaattatcaagaaggacactggggaagaagagagagggatgtgattaggagaactcagattctcttttaatattagggctgatgtcgctgtactaggtaataaatatgtaaattttctgtttgccccaattgattaaatgtaattaacacctgttctaaaatactttgttttccttaatgaaaaaaagtgaaattttttcaagcttctactatattctatacattttatatgcaatgtctcaacctttattatgatctttttaggtagcttgtatattcccatgtcatagatgaagaagctgagtgtcagaaagattaagagatttctttaatttctttcttatgcctagatatattatagctatattctaagcctttatattttccttcataacatgtttttggtcatttaagaaaacaagtatttcatttttatatgacattttgatgcaacaaatttcccctgagagttcagtctacatttcttttttactttcgatttgtgctagacatttttgcaagggagcaaaagttgtaatttgttttccatgaaagtggccctggttttttcatattagttgatgttttagggatgtgtttccattgtttatccctaagaaaagcagaaaatacatttctttcatgctattttgtctaagttattcctccagatttgagggggttgtttgtattatgtctataaaattatttgcatgtacttgtatttaaatacatacacccataatcttcaatatagagattgcctggctagacctatgtcttaataacaactgcattgctacagaaggccagtgtaggcaattattcgctttcctcaatatgctgaggctaccaaaacttgcatggaacagctattgagacctttctcttgatggaagttttctactgttgacccttaaagactcataataaactcacacttcagcaatagatggtaacagttaagttctacgttctaaatttgatttatttttatcattaatgtttgataatggctttaatatttaaaatcatgcaagcatctaacaagttgtaacatgtacggaattctgagtagcttgtcctagagtgtagtctaaattatgttttctgtgagaatgatttcgtagtgactaagcaccagcagctcaagggacaaatacaccatttactctattatattatattatattttcttctttgaacagctgctacttattattcatactacttcagtgtcactgttagtgctttctactatctaatatatcacagcatttgctcacatttttgcctctttcacatagaatttgagaagaaaagaaaaacaggacattttctttttagaatttcctctttttcttcagcctttgaaaatggtattgctaacattctgttttctatgtctaagtggaaaatgtttcatccttgctgaggttacagggatgaaataacagtagcagcaagctactggcctttcattggacagttcgttggggagggagtggggattgttcaactgactctggaactctggatggggttccccatctctccctcagggttaacttcagtccatataattgctttaactgcctgcagagttcaatgttcagagacagacacttggatttcatttattctaagtttaatgttttatacagtaaaacatgtcagaggaggcagttgtcaatactccaatttctgaacactacatatcacaactttttaaatttaaaatgactttataaattcagacaaataactcattataaattcaaaataactagttagaaattcagacaaatttctgttacataaagatataacatgatatagtaagggaaggtaaaaattgcatggattggggccaaactaatcaacatttatatctgtgctttatccactttagttatgaaacctaaaaccattaattttattctctgaaattcaatagaatgggaataagaagattcaacttgaagggttgtcatgagaaatatataacacatcagaacaatggatgctactcaataggtgttcaaaaagtgtttttcttcccttccttttcttcctcttcctttacacaacatttattgaatgcccagacactatgcttaatttaaggaggcaatgataagtaaaagcagatgcactctctgctcactgggagcatatttcctagtgaggaaaactatgataaagaaacaatcaagaaaatagtgagacactctgactggagcaggtgctgcagaaaggagggacagagaacagcatattttagaaggatttgaacctgtcacaaagatctggaaagacttctgtgaaaaggtaacaacgtagctgagatccgagagataagtaggagttaaataggcaatatcttcactaccaccaccgttagaaagcatgattgtgtgaacactaagcttcctttaattgttcagagaagtaaaacctgccaaaaattttgtaaatcattaaattttgctatgtatcacatccttatctttccttctccctttccctatgatctcacctttggtttcttgtggaggccactgattggcagtggtactaaaaaagctgttatttatttattttttttttgacatctttgttgctctgctgggatggatctgatatatcttattctgctaccgtgtataccaacagcagaatcacactgatcactctttgtccgcactgtcaacttcagttgttcccaacattgttaatagaccgcctatctttccttgcacttaactgaaactaagaggtactgttggatccatgatgcacattcttaatggctcatccctaaccagaactgatgagccttctgtatggagcagaccgtggcaaacaagcacaatggcagttgttttcatcatctattgtgaagtgtctatagaacttagtgacttgatgtcagctcttgccatattttctgtgctcagagatgccttgcttgtgactaatgtcctcattacagattgaatgaagaaaaaagggaaacggagagcagatgacagccttccccatccactgaaagaacattcttttcctttcttatctccatgaactcacccccaaaatgttaccagacatcatttttttaaagtagtagatccttggagatcctagtttatgctaattgcatcagcattaagcaatttactaatttaattaaataaattaattagcttatattttttacctaagtacatctaaagcttttttttacgagaaagagttggttatttatttattttaaacagacaaaagttcaagcaaacttacaaacacccgtgtagtatcagtaatgagaatagggaggaaggtagtatacattgtttgagactgaaaggaattttaattgatgatcatcagccccacacctaacattttatagatgagattatatggcttgccctagatcacactgcaggtgtttagggaaatctccaagcatcaggctaggtgtttggatgcaatatgccatggctattggtggcccagttacctagttccagggaacagatactccagaaagaagcggtctgatttctttgtctttattttgacaaaggataatttgaatcatggactattagttcaaaaggaatttcagataaccataagttagaaacattcacttcacagatagggaaactgaggcttacatcattgcaatcacttatccaagtgtgtaactggtttgcaatcaggacactggacttactcaaaactaccttagtgttcactgaatgccctctctaagtgaggcattgtactggacagtagattataaaggtaattataaggattttctctctcaggattgacagcttgttttcctggttcctaggcagcagaaaggaatgaacagtttatacccacctattaatcttaggctgcgcttggtggcatgcacctgtaataccagttatttggcaggctaaggtgggaggagcccttgagccttggagttcaagatcagcctgagcaacctagtgagaccctatctcaaaacaaaaacaaacaagcaaaaaaaagttaaaaaaatttatctcattttatgggtatccccattaaaatatttcattttctgttcttattctcaagataaagtttaaaatgcttagctagactctatatgaccttttacacttggccctttgcttcctaacactcctgactcatctcctaatcctctctcctccacttactgacctccagtcattcaagccttgtcccggtctctagcttgtatcaggacttccttgctgtttcctctaatgagtcagaattcgagtctgagtcttaaagcccttcacgaaaaccattcttgactgtctacactagattaagtctgatttgtcacatgctattatagaacattctgacatgtcctctacagtcacagatataaaaatatagttatttatgtaattatttgttcaagatctgtccttgtcaccagaagataagtaatctccatgaaacaggaatcatctttttattcaatataacacctttaggctgggggtgctaatctcagcactttgggaggctgaggcaagaggatcacttgaggccaggagttcaagaccagcttaggtaacataacaagatcttctccctactaaaagtatatatacataaaaaattagttgggcatggtgtcttgcaccttgcatctgtagtcccagctactagggaggctgaggcaggagaatagcttgaacccaagagtttgaggctgttgcactccagcctagggtctccagagcaagaccctgcctcaaaaagaaaaaattatatatacacacacacacacacacacacacacacacacaaacacacacgtgtgtataccacgtgtatacgtgtgtgtgtatatatatgtatatgtatatatgtgtgtctgtttttgagacagcgtctcaaaacaatatatatataatatatatatctttaagtatatatatttaaatatatatatctttaagtatatatatttaaatatatatatctttaagtatatatatttaaatatatcttatgtatgtatatatttatatatacttatatacattttataatatgtattttaatatatatacttaaagatatatatatacttaaagatatatatatttaaatatatatataatatatttagtacataaaacagagcctggcacatatttagaatatcaaaaagtatttggttaacgtctgcataagtgaatccatctttcttaggatggtttgtccctgcattgttgattggcaagcaaaagtcctgttcgaatctcaagggtatattttttcttcgcaatcttttccacattctttaagagatactttttatgcacttttcacttagtgacacatatttcctttttacctgatgactaagattgagtattcaaaaaggaatgatatactctttgttccaaagcaattgaaagtcttgttcatttagggactagggtatatgcagccattggactatgatgttagagttttaaaacaaaattttctttcttcttcttcttgttcttttttttttttttttttttttttttttttgagacagggtcttactctgtcaccgagtttggagtgcagtggcatgatctcagctcactggaacctccaccacctgggtttaagcaattctcatgcctcagcctcttgagtagctgggattatgggggtgccccaccaccatatttttggttgagatagggttttaccatgttgaccaggctggtctcaaattcctgaccttaagtgatctgcccatctctacctcccaaagtgctgggactataggcatgagccaccacacctggcctgaaaacatatatttaggagcgtaaaatctagtaaatattatttgttgatgtagtacttatccagaaataactgcattgttttacttttgttgtaagactcaagaaagattttatcaagaaggaagcaggtaaaagaaaatttcaagtgtggaagatagataacagttgatcccttagatttactcttgctgctgacttccttgtttgtacaggcagaacattacatctgaacacataggggcagaggaagttgcaatggagaaatactatctactgggtatgtgcagaacaactagacttctgatgacagcttctgggaagaaaatgttgtaatgggaaaggtcttccctagagctgtccacaatgtgtgtaagaagaaactggttggattttaaaatctctgtataaacatacattgtttgccattcagtatctaaataagggaggatgaaaaaggatgaatgcaagaaattggcctcatggtgactgcctaatttacatgttatcacaacatccagatgtaatataaacaaacaaacaaaaggtttctccataacatcacctgtaagttactgaaaactgcttgtctttggtcttggtcttttgacttttcatctggagtattcagctatgtagatatcttcttatctatcagtttggaagatttgcatctcagtagtttatctgaaagctacatttgtagatcaagcctactgtttgagtaaggttgcttatttatttgaagaagtttgggttgcagcaaggtgaaactgattgaaataataaggtggctacaccttgatactacccctggatatagagaattcaggttgttagtggtcttatgatttcaaagtaggtgcgtcattatatgcacatagcatgactgaattcattatgaaggaaaaaaagcagatctgttcaaatgcatgcttatgtctcatttgcattttctgtatgcttgatgccatcatttatcggtgaatacagtgaaaatataaggcagagaaccctataatttgattaagtgtacaaactatcttgaaaaaatgtttatctcactcacgctttttgttttttagcctaaagacctttttgctataacttagaaaggaaacttagcataaagccacagtttaaaataacaagatgatttatggcctgctagatttccaaagtcattttttatgatcaaatagttcagtcaaaggactgaacaggtgtcaggagccctattggccccaggcagatcagtttgtctttctaggcctcagtttcctcatttataaaatgagaagattgttctagcgaaataatcttgaagatactcttctaaatataataagcattttttgtttggttacatgatgtgagcatttggcactttgctgacaaatttaatcaatctagacaaatggcttgaatgccaatcaatcaaaccgtaactgttaatttaattaactagaaagactccccttccaaaataaaaggtcagctttccagtttgaaacaatatcagagatctttattccacatgtagaaatcatttccttaaatagtgcttctaaccaaaaaaaaaataatattaacatatacacatacacattgtaaaatatttctcttctaacaaaaattattataacctattaaacattactgtcactctttagtgatgactaatacatattaattgaaagcagaatgaagtgctcttccattacctgattttctgggaataactccctttgtaacagggtgactatattacattccagtcttcctaaagcacattaatttgggcagttaacgttcctggtaattattggatacttttcacttattcactctcacgtgaaggtaaacagttcccaaactaagtaaaagtgtgatgaagtttgtcccctattcatgcctctgtgcttttcctcttctggtcagaaatttgtccagctggaaatttgcagacctaaacggagttaattctgttatcccatcataggcttccttccctggtggatgctgtcctgccctgattcgccctgtaccaaagcaatcttcctcagctccttatctccttcatataggcagatctaccctctcctatcccttatagccctgctcattattttggactttctactgaagcctttttcatgttgtccaggctatgtgactgtattttacttcgtgttagtgataatttattaccatagcaacactttcctcatggcttacaccatacccttatgattcctgtgtttgttttaaagtcagataatgaagtttctggtgagagtatgtcactgaattacatcacctttgcaaattggaggttactgagctaagatagaaaactcatttcctttgcattgtcagagtattctatttggtatttaacaaaatgtaacaaaacattagcttacagattgaatggatttgccaattttctaagaacttgaacacaggtacaagtagtagtggatatgtatcaaaataattttatgtctattgagaattcagaatgcatttctgtgcctcaaagtaatcattatgcacactaattattgttgtacactgcagaaatagtggttagtagaggtttcttttgatagaaaggcagataaatcaacttctctgtcattaattctttagatgatgaataatccttttatgcaaatgcttgtcttcctgcagtgtacattaaggtctaaactccagctctgttatgatgtgtggaagaaaattcaaagccgaaaaagttctttgtaatgcacttgaccctgggatcattagaacatttcagcacaacttaactgctggtagaaagaacagtgctttagaagagctaagtaaggtagttgtatccaaaaaatttaaaaactcacattaaactattaccctatttctgcagggtataataggaacacatttcaaaaaacaaataaaaggtcaggtgtttagccatgtgacaaatgtgttttttgaaactgtggattccagtcacaaactatagaagtatagcttcaagttttgaattatgattccagggtcacctgagtaggcgcacatctataataggactatactagttaagataatgtttgtgcatagatacactatttgctttttttgaaaagaaaataactgatataatccagtttcaaatatcctaagaattcttcatttccacctgttccttgccatggaggatcatagaaacatatagtatgtttatcaattatttaatatataaagatatatagccgtaacttgttgatttaatctaacattgattaattttctcaaacttaacaaactagttttacttcaatccatttttatttgccatgtgttgtaaaagtaaaaacatgtgagtatagctattatttctccctaaatataagtgtggtggatctatttacccaactcactcaaacaggccttaagtaagttacctttggaagtgaggccttgttatgctaataatcagacagacagagtaagacagagatttccaagcaaggatgaacagtctagataagcaaatcaacaattttgttgtgtacaaggaaagatgagaatatccttaaaacagaataacagcacagcaaaaccatagaatgtgaaggtttaagggggcttgggaataaaatatagtaatagctactaagcactactccagacactatgctaagagctgtacctatattatcttatgctattcccacaatcatccctcaagttaagtttacttttcctattttacagataggaagctaaggattaaggagttaattagcttgactcaattgacacatctagaaaatcacagagctgtgatttgaatctttttctgactctgaggcctgtgcttgttaaaacacaatcttaacatgagtggtttagcacagcttaaggaagaggcctctgagaaacatggcagaattgtgaactctttaccaggctgctgataaaggcctatggacatatgccctgtatttgtatttttctgattctcaaaattgtgttcacaaatgtaagttatttccaggattattgtaatgccaaatacctcttctgccagacttctgaagggcaaataacaaatccttactggtatcttaaaaatatagatttgtattcttgacttcttacaatatgcagaatgtacccagtgtttaatatgccagatattaacctcctgaacataccttctttctttttgccctctgccctatatcagttgtttacacccactggcataccttacacctcgtcataagcagagatccctccctgatcttgctgtcaaggattcccctctctaaccaccagctgcttttttcccagctcaccctcaatgctccaaacctaacatattcttcaatccaacccagcactgtagttgttgaatcaaccaactcttccttatttatcatagcattaatacttctttcctttgtttaaaaagcttaaagtccatctttgttattttcttacctatagctggacttaattcccttactcctctctctttctggaacttgattgtctccttctccacttactacactaaacatggcaggaaaactaaaccacattgaatgggtcaccactttaaatatactctcaacttaagtggttttcagactgcccagtgattctgctactgttcacctgtccattctccttctacttcccagtctacttctccctctcaaatcttcaacagttcttccccagtcctcaacctcagctgtttactttgcttcccaattcagtgaaaacatagaagcaattatagggaatgtccactctcctccgatacctaccatctaccccatcccttcccttatactccaagaaaggccaaacccttgacttgtatattagataccatcctcttttgccaactcatggacattgttcaaaaacattctacccacccgtcttttcagtaccatccacttttcactgtctactcagttgttttcgtcagcatgtgaacatgctacaggtctcaatccttttatttgtctttaaaactacactcattgccttattcatttcatccagactcctggctttaaatactgtctatgaatttataatgcttaaatttagatctctgctgcaggcatctccctcaattaagatctgaatatttcactatctattctccaactctacttggatatccaatagtcatctcaaactcaacatacccaaactcttctttcttctatatttgtttcatggtcttccctgtcttggttaaagcaactccaaacttccagtggctcgggccaaaacacttgaaatcatccatgattttcatcttcctctcatacaccatatctaatttgccagcaagttatgttggctataccttcaaaatatatctggaataggctgtcttcctactaaatccaccctggatgaaaccactgttatgtctcgcctggatgaaagcaacaacccaaacttttttctctttctattcttgtacctctagggctattatcacttcaatatccagagtgattatattcaaacattagtaagtcatatcatattatctcttgccttaagatcttccagtcactctgtgttcatccagaataacagccaaagtctacacagtggcctaccatgcctcaaaaagtctagcccctgttgcttctttgagtcatctatgttctattctctctcttcttcagccacattagtcactgtcttctcattctacctcaaagaagtcaccctctaccctcagaatctttaattgctgttttctctgccaaaaatgctcttcccccagtatctacataatataatataataataatataatataatataatataatataatatctactcagtttcttcaagtactttttttttctttatttctttcttttctttttttttttttgtttttttttttgttgttgttgttgagacagggtctcactctgtcacccagagcggggtagtgcagtggcatgatcacagctctttgtaacctctgcctctcaggctcaggcgatcctcgcacctcagcttcctaagtagctggaactgcaggtacaggccaccatgcctggctaacttttgtagttttttgtagagatggggtttcaccattttgtccaggttggtcttctgaactcaagcaatctacccgccttgggcttccaaagtgctgggattacagagatgagccactgtgcctggacttcaagtgttccttaaaatgtcctcatattggtaaagccttctctaactgtactacatgaaattgcaatgcccatttcacccaatactcctcattcttctttctctgtttcatattttttctgtagtatttattaccatctaaaatattacttaatttacttatttacttagtgtattatcaatatctctactaatagttctattagtgtaaggatttttggctatttgtgctgtatcccctgggcttagaatagtacttaacatatagtagacactccataaatatttgatgaatgaatgaatacattggtaggaaaatgaataagagttctgtcacaaatccgactaatgcagaaaaataaatattcaaatacattgtccaagttttaacctaagatagtactgaatcttcttaaagatctgtacctacactaatgttttccttcttcttcattctttgctttcatatcatgcatttacatgtccagaaagtcactatttttttaccactttttatgtcaacactccattcattacactttatttaatttatacaacaattccagtatttgtcaccttcaatcactcatcacagagtttaccatgaaatgccatctaaaggttaaagataggacttgaaatctgtttctgaaagataaaactatcagatcaaggtagtgcttaattgtttaagagaagataattgtgtaagagagaacatcatttgaaacattccctgacaatatttttcttagaaaagctttaaaaatcaggaaaaattttgggtactgtttggcaattttgttcagttaatatttgcaatatacatattccatttttttacaaaaattagagcaaaactgtactatgtgtattatcaaggtttaccaatattctgatgttatattggtataatattgatgtatctattgcattatttaatgccaaatctaaggtcaggaaacaaattattattgcatcattcttatgattgaatatgatctttcttattaatgagtttacagaaagatatggtgctaaaacttacaaaatactgctgagacatcagtttgcaatatctatattttttaaaggaaagaaatataatttaaaataattgcctatttcacttgacatttgacatgttgtaggttctttgggagcaattttcaaggcaggcccatgtgacttatagatgctgggatgggaaataccacactgacactagggctgcctttggagacagaagcaggcacataaagacagatgagtggcaaggttggagttcattcctcaaacacattgtcccagtctgagtaggtaaatgaaaatggcaagactaattaataattaaggagggagacccaaatcaagaatgcaaacataaagcgcaatgtaaagttgacacattttgtgttcctctagcacactcaagaaccctgatatcaaaggcatagtcaactgtgcccagcaaacatttttggggtgtttagcaaatttaagtgcattaacagttttccttacatatttctactgacttatactttaattaaaatgctgcttctataactaatgatgttatatattgattcaactggaagatcaattgtatcattggtaaaataggttatattacaaatgaaggcattttgcattatatatggtatttttatttttaattatactccttttattcaaaaatatcttcaacaaatagagctacagagaagtcttaaatttcattcagtaattccgttgttaatgatatctacattaatgttttgggattttacacaatcacatttacacattttttttgtatccaataagataaagcaaataagcaattacttttatgtggtaagacccatgaattttagtataagagaaaaatgataaaaacataaaaatcaaagtataaatttttaaaagttaaattttaatagtaaacatcaatataaatttattttatttttctcttcaaatacatatgtatcttaactttgaagagaaaaacaagtcatggattcattagttaatgttgatatgaatcaaaataattagtgtaagagaaagaatatggaagtataaaaaaattaaaccttttcagggtagagagctgcaaaattataaatataatcatgaattcttcagtacatgtgtgtagatatatatatgcaatatgtgtgtgtgtaaatgtatatattccagctgtgtgtactaaaaaaggcttagaaatagtgacaaagcagaagcagtgagcataaaaattgcgtctctaaataccatttcccattaataggaaacagaacttcttacaaaaatggctgattacagatctgtgtcaagaaatgcacaaaatgattcagggacatttattttgttcagaaaacaaagaagatacaaagactaatggataaatgtaaaaaaaaaaaacccagaaacacatagaaatctatataaaacaaaaacctacggtagaaaaaaaaacaaatttacatgaagatccctttgactagtgcttttttgtgtgttaaaaagaaaattgactgatgtttatacaaacacttcaaataataaaaatcaaagagtctataatgatactaagacagagaaagccaaaacaaaagccaaacaacaaataccaatgcttcggtggcaactaggacactgactccattttctaaacattgtcaattagaagaaaataattatctagaggtgatgaaaccaatatcttcgttgtaaaagaattctgtgtgtaaattgtggaagatgctgcaactaagaaaaatggacatttttgcaatatctagtgataccacctataacagataaaatcactgatgaatgaaaccattggatgaaaggttaatgggaaatcagatatcaccatcttgatccattgtctaatctcagaatcacttaaagcaggaaactcagcattatgtgacatactgatcctatcctgatatgttggaagatgaattacacagaaatattaagaaatattcttgtaaaaaaaattaaaagttgtacctgaatctaatcatgcctttagagctaattgatagtttacaagaaacataggtgatggtggagtaaattaaattaaaccatttactatggtttaattaaactatgtaaaaaaaccacatacctttaaaatgtagaacattatagaaacaatctgactcagtttcttaattaaggcaattatagccaaagaaggtggatgggaaaagagggttataattttaaaaacttgatacataacaaccaatggcaatgtgcagatatcgtttatgtcctgattcaaacaaagcagcagaaaaaaaatggcactttggagaaaatcagagaaattttaaaatagtctgattgttagattatatgaaggaattatccttactttctttaggtgtgcaaatggccaagtgattatgtaaataaaagcccacgtacttcaaaattacatactgaagtttataatacgatgtctgaaactcgttttaaaatacattatttcaaacgaagtaataaaatacatgatataacagtgcccaaattttaatatttatctaacatgggaagatggatgctatgggctgaattgtgtcccctccccaaattcagatatgttgaagctctaagcctcaaggtgtctgtattcagagacaggacttttagaaggcagttaagattgtatgaggtcgtaagagtagggtccttatctgaaactattgctggccttataagaagaggaagaaacagagagaaaactccttctctccatgtgcatgtaatgagcaaaggctatgtgaggacacaggaagaagatgcctgtctgcaaggcaggaggagagccctcatcagatatggaatcagcttttgtcttgatcttggatttcccagcctccagaactgtgagaaataaatttctgttgtttaagctaccaagcctatggtattttgttatgagagccctagcaaactgagacaatggacatatggaaatttatatatttgaatctctaatgttatgtattttttaaaaattttcttgaaaatttctgaccatgtcaataaaacagaatgtgattagaatttaaattctctttttactgcttttaactcccagatcccaatccatctgatcttgtagctttcctgctaatatattatctacagtactttatagcttacaagagaaaatccaagctgcttacccagccagtgtttcccataattagctccaaatgaatctttccagacatgtcttgctctgacttttgtaacatatccttattcttcaaccaaaataaactttacatcgccaaaaatgcccccctccatgtatatttgtagcaattctttaagtgattctcaatttttacattaaaacttaaaaaaatagctaagcagttactatacccaattacatgaagctaaataaatgaacgcagtgtaggttctgatatcagttctcaatttttccttcctagggaactggaaataacccttaatcagtgtggctaaaggattgctttagaaagagctgtagattctctcctgtggatctcacactgggagccttgttggtgcatgggtatctcctaattttattgcctttattgataaattcttaattttgcacttaggtacttgcatgacgttcagcctatacatagtaagcattatttttcttctacatcccacattttcttccccctttctcaccaccttctttctcacatgtaccctagaatctcaattttaacttcctaacatgaatttttccttattctttcatgtaattaaatacacacacacacccaattttcatgtctttggtttaaaaataaaatattttatctatttttctatgcatcttcctttcactaattaacaactcatcatggaaatccctgcacatcagctgatagatattaaatgcatttttaaataattttataatattagcaaagataaaccataatttattcaaccattttcctattaagaaacattcacctttttcttatgtagtttcaccaccaacatggttcatcaattaacgtctttgtacatagcagtgatttaatctctatgggagtggagtcactgctatgtatgtttttaatttgaacacgttttcacattgctttcttaaaaatctgtgacagctatttctttgagcaatgtatgagagtactctattacatggagaatattaggcattgcaatgctattggccacgtagccatctactgaggcaaaaagccctattgcgtgattactttcatttatatttcccttacactctggggttgttcatcatacttccatgtaactattgccatttttatttgtagaatagctcgtatattgtttttctttggcccagttttctactaggatgtcagcattcttatcaatttttaaatcttttgtatataatacaaaatatttttattatctgcattatttttatttttaaattatttctattgttatttatctcccaaattgtcctctaagggctttattgttttataattacatctttaatcaactggaattgggtgacacaaggatctaatgtgttttcttttagtgggtagttagttgtaacattcacttactaaattagaccatccttttcaaacgaattgaaatacctccttagtgatccttacattccaaaatatactgtgctctatttctgaaccatgtgtgcttctctgcaagtggctttaaatttttgcattcctataaaatcacctctttcactagttggaaattctgtcgtcttgctctggggtcccatagaactttatttttactttgagcacatcctatctcaaattatagttgcttttatctatatgcctactgaatttcactgtataatctctgaaagaagaatccgcattgaatttgtctttgtatgcttcacagtttcttgagcaatttagaaatttatgacatggttattgaatacatgaatataattattcactaagtaaatatactaataattaaataaatattatgagaatcataatagtttcatacaattttagaaacctgaagtgaaggtgattctgttcaagacgtgagaagtttttattcttgttttactttagaagttcttgcgacagtgaatgaagttaaaccaaaaaattatatttatgtaatctctcaatgtgctattcattagtacataaatccagattacccttttatgcatagtttattgtactatatgaacatttagtaagtagctcagtctaatttagttttatttagtacctctttctaattaaagccatgaatgatatagataaatttatagatctgcaagagccaggaaactttgataatattaaaccaaatgagagaaaagcatataaaagacagcttattcatattctgccctcagtcacaggttttgagatgtagattttgctgtagtacaataaaagcaactaaaatgtctaactcattaatatgacacagcaactaaaatttctagctcattaatatgttagtatcacaaaaatcatcccagttaagtcagcacaatagagcaattagcagatgtttacctagagctacctacaatcatgcagttttaactctgggcctataacaatttttagagaaactgattgtggtagcctctgggtaaaataaaacaggaaattctgcttcatttccagctgtattgtgtagtacaatgagaaatgttgacggccgactcagtcttgccctttttgctataatgtctttgtactcaacatatagactgaatataagttagtgtgcaatgactttcaatacttatattaccatataatgctaaagaacactgagatgcagttcttgtgtcagaaacaacctaatttgcttgttctagtagagagctcaaagcccactggagtgacgtcttattttctcttctattaaagaaagaagctgtctccctggaggttggcaggggtcccaaactcagaagaaaggttgattagataagctgcgtttagtggctatgacagatggacatggagtcgatgggtaagaggtaggggagccagtgtccacaatcaagtgtgattccaaaatacagttcaactgaggtaaaaactgaaagattctgatgaggcgggtagattagcatgatatatagagcatcactaccttttaaatatgattatttagttcattttgggcagattttatgagatttcttattaaatagaccataatatttctgagatcagggggccctccattttaatagacttctttaataacctgcatttcctacagaaatatttcttctagtctggtagcttcaaatatcagtaaaatgaggaaataagaccttagccaccattatatgcgttggatgctctttttgttcttgtagcctttgttctctgatttaaacttatcaattgagacagataatgcagactttttaccagggaaaaatcagtgaatatcaaggcaaatctaataaaatggagctaaggatcgtcagtctgtgaggcttcagttacattttgggaatgaaccgacagaattctagttctcagagagacaaagcaaagaaataatccaagaaagcagttgaagggttacagaatgtttcaggggcaagagtcttcttatagcctactggtaattttagtactattcagcaatattaaggcattattctgcctcaaactgattatttcatttagttcttccaggacaggaataagccaaaggtagcttggatggttctgagcttagagagcagaggaagagaagagactctcttaataagaaaggaaacaaataacagaaggacagtgttgatgatagattccagggactcatgttctccgatatgcaaacacactgagtgtgacttgccttctccaataatgaagtacttttttgttgttttttaatgaaaggaaaagcagtttactataacactaggttgctaaacttgggatctgctataaaagtgacgatgcaaacacatatctgtacctttaaaatgataataaattaaaagaaatggagaacaaaatatttgagtgattaaaatctagatgagatgaaatatactatagctatagaaaacatgcaaatgatgtgatttttttctttactttcttatgtcttaatggtgggggaaataatgtacttccaactgatactaaaaagagactgttttattatgtttactacacaatgagcctacctaaggcattctctagttatggtatacattattaactgttataaaccattactctgaatagtacccaagcggcctgaaagttaatgtttctctttaagtgcttagctcactataagagagtaacttagacatggaaagtgactgcttagtcatcgacgctgattctgccaagattaggataaagttttgggtgagattggagcagattaggaaatataaaaggaggaagagggagaaagggttaaactcattaaaacagaagttccaaatgctaatcgtatgatactttagggcatcaatttcaataagtgttgtggaattctccaggcaatgggattgtgtaaatttgtctctgatacacacacacacacacacacacacacacacacacagaatctttgacagtcatgaggcatatgatttcatgttcctacagactgcaccctttttcttgttacaactactgataattaaatatttggagaaatggacaaagctttgggagcttacttcattctttatcttcttgcagtctgttaaattcattaggtcagaaaatttgtcagtagctcatatactgccaaggacagagatgattaactgtgatttatttaatgaacatcattattccagcacatgatgtaaaggaagtacctgacccctttttttgtcctaacccccactagaatctataaatacatattctcttgtctaattgaatttatttcttcatttaacaaatatttatttacatatctactctgtgctagacaaaatgtaaggggttgtgagaaaaaagacatgtaatttcatgccctgttgaataaaatggaaagcacagcagaaattcatgatttgggtttactttttgtattacaaatataattttggtttgataagacatttatgattttactttatttctcattcatttttaatgtttcctagacctgtgaaactttgttttgatacacaaagcttctcatttaatttgtatatatggtataactaacagagtttgagattcattagctgaatctagaactgtcctatgccttcaactctccagcaaactcctgttttctactacctagagctataagaaaaaggggaggtatgaggaagaaaaatattgaaaagggaacacaaaaaatggaagcaagagggataaagaggaggaaaaaaaagtaagaaaaagaagaaaaaagcattttcaaagtgaggaaacaatatgaggaatgttaatgaaagaagcaacctcacaacccacttaccctttcacacatcaagcatactcattcagtttcctgtgaaataaaagatcattttatattcaaacattttccataaaatctgtactgtgctcagtaagctaacaaatatctgaagcattgcattgaagaagttgtaacatactattcatttatggttttttaaaccttgttttctctgggcatgatcactctttgaagttgcctgtgacattttcatattctcaccaatgaatgtcaaacaaacaacaaaagctctgtacacttcatgatggagagaagttcaacaggagctcaggatgggaaagactagactgcagtagagaaggttttttaaaataggtcaaaactggaatgtggtctccaggaaaactaatggcatcttaactgacctggaagcctaatgtgcagaaagtaggtgataagtatactctgtctgatcagatctaccttaggtttcaccatgaagggccatggacagactaacgctatgttcagaggggtgtgactgaatcactgcttcctgtaaggttcacttgttcattaagcaagatagaagcagaatcaaaaagaacagaatggttgccttcacttatctgaaggtctgccatgtggaagaggtatatttgctcctgtgttccgaaggagttaagaagactctgagaagtatatctcagcttatttttcagatggcattgtcagatgccaataacagattgggctaccacaaaagttttaatgccaaatttccattagtcacaattagcataatctgcataactacctggtaagaatttgttgaaggattcactcattaaatgggtagtagaatgaaaggatttctagttctttttctactcaaaaacacaattttctgaataggaattaagaaacataaatatagagctctccagcctatcaaaaatatatttataaaaaatcatattagtatcatttttctagaataaatgacttattactttgtcagtgtacccatcagacatttgtattatttttataatgctgcaagggtgccatctgatatttcttgttggataatttccatttctaacttattagaaagaaaatatttttatgtccatctttagataggctttgaaaagatggagaagtgaagaaatgtgccagaaattgctaattgctgtgggtgcatgtgtgtgtgtgtgtgtgtgtgtgtgtgtgtgtgtgtgtgtgtgtgtatgtatgcacacatacatttgtatggaggaggttttttattcagagatataattccttcttgctcacagaagtatttctggttcatgaggactaaaaagaacaaaagcgagaaagctggtgtggtataaaaactttaactcactgaagaaaaatatatagaacaatgtgttgccagaatctaaaacaatatagaatgaaaatttcattgggttgataataaaaggtaattgaccagatagacaagaactgtttctgcactgtggcctaagcacattgagagaaaccaatgatactttatctggagaaatggtaaaaggatatgcaaaataaaaaaccaagaggaaatctgccattaggacaagaaggagaaaaaaataactggactcccttgtctttctgttttgaaatttcaatttttcctcttttctcagtaacagcttcctcagtaacctgagacagtgccttgggaggtatggcatcttcccctacagaatgttatacactctcttaaagccatacatcccattgttattgttccaatctctctctataaacttagtccagtttacttcaatttctgggattttggaatgaccattgccaccatgcagagcctcaagcttatattatacggtaagaataccaaaggaaattgtttctcacacttttattgcaggcttcaaaaggaaagaaaaacagaatgactgccatttccattctgctcattttgttctcatacatactcatctgcttcaagatgatatttcatcatctctttctgtcatttaccacttcttccctcattccctaccatctcctctatcccttatatcctttgaatgtaggtcatgctcatggttatagtggcatagtaaaacttgatggaggagaaactcttctattttctagattactgtacacatattattatatggatgcatgcacagatgcacgaaaacacctagaatcttccttattatgttttgtcttttttttttttttttctgagacagagtcttgctctgttactcaggctggagtccaatggcgccatctcggctcactgcaacctctgcctcccaggttcaagcaattctcctgcctcagcctcccgagtaggtgggattacagacacccaccaccatgcccagctaatttttgtatttttagtagagacggggtttcgccatattggccaggctggtctcgaacacctggcctcaagtgatctgcccacctacgcctcccaaagtgctgggattacaggtgtgagccactgcacccagcctcatcttcttttcctcatactttttctcattctttcctattttccctcctccatgttctcctattagtagtagtagtagcagcaatattaattgttatactagtagtagtaggatagtggtattttctacttattgaaccctgactatattaggtatgtgcttgtcatcttacgtacattcttcataatcccaaaatgtccctattatgttatttctctattttataagattggaaacaggacgaggttaagtcataccattagaggagcagcaggacctccgcattgaattatcctaattgttagaatagtactgattctgaaatttcacaatttgtaaagttaggagaactgttctcaatgaatattgaaagaaagaagggaaacttgttttgcctttttcgtttttataagaatacgtttttaaatcaaagccagattggaataaaaagaattttatggctgtcatcttatacagagtatcattaaataacatgagctaatatgcaaaatgattattacaaaatttttatctagataaatgattttgaaaatttgattaaaaccgatctgctgtatttcttcctaaaattatctccttcactgatttgccattctctagttcagtaatgataacataaatagtaattacaatgtatcctgagagggtattttaaagcttcagctataagtagctgtaaatgtttaatgtgtaattataatgcggatataaattaataatctggaaaaacaaaagaagggactggcgtgtttttcttcaataatgagtattttctaatagacagagaaacagaaatgtaaaattggtactgaaaacaatgctttaagtctgaagggatttcttatacttgatgaccaaattatattcatttcttcttccaacaagaagaatctaacacgtatttgacacaaaattggtgtctgacctatgttaggtagatgagtgatggacaaaccatactgatagttggtttgtacttagcattaaaaatattttattatatgtagaggatattggccaaactcttggaaagtacaaagatatttataaggggaataggcattttcaccagacagtaataataataataaatattagaaaataataaatactaaatgatcgtaataacagagaattatccagaaagtttaagatactgactttttaagaccttttcacgacaaatgtattctttggtttaaattgtccagccaattcattgaatagtgcaatttgtttaataaatatgttcattgtttactgtataagtacagggaacatagagtaaacaatgacccattcaatttgaagaaatcttagtaaaacacacatttatttttatcctaattctatatatttaagttttataattttcttcaacataaattatagtttaaggtcttgaaatgcgtctagacaaatcatttgtcaaaattcaacaattaaaagaaaattcgtattttgatgcaattgcacaagtcattttaatctctgcctttgaataattacatttttgtaatttgaattataatttttaacaatttcctttgaacatataaaaatcaatttaatttaaatttttcattttattttaacattaagtaagttgttaataagaaacaagcttctcatattgatttctatttttttctacctgaaattgtctctcaaatatgtatgtgttcatgaaatacttagataatttatccaagttagaaaatggaaattaggtaaccaatatatattataaaataatttcatttccgaatacctgagtttggggggaaaaagttactgttaatgttgaaagaaaagtaattcattgaattttagagaatacctaattcctactatgtgagttcagagacaatcttcatgaagctcttcttctccaatcagaatggacttactcctcagttgtcagttgcttgagatggtaccacaggagctgagagaaaacttggtgagacagttcatacactcagtagcttattaataaatcaatagccctctccccaatcacagtaaataatccagtgtagatttgcctcttaggatcttgagatttttcttctcaagcacacccctttcataaatgcccaaactcttgaaatggtcaccattcattagtttacaccttatgtatcacatatgccaaatatttcctgaggccatcttttaaaattttcccccttggaacttgtgttaaaaaataacctttctatcaaactccatttatgttttaattaattttctttcactcttcaaacgcatataataaccaatcaaaaataagtgtgaagttcctaacgttacaactaaattattatcaaaagtaaaacagccccaaaaccaaactaacattttgttgttgttgctgagacagggtcttgctctgtcgcccaggctggagtgcagtggtgtgatcttgactcacagcaacctctgcctcccaggctcaagtcaagctatcattccaccccagcctcccaagtagctgggactacaggcacgtaccaccacacccagcaattgtttttatagaggcagggtttcgccatgttgcccaggctggtgttgaaatcctggactcaagcgatccaccctatcagcctcccaaactactgggattacaggcccagcctcaaattaacattttaaccgacctagattggtctccattactttgttcaagaatcttcagggcccagaaagtccaaattaagaggcatagttttggaggcattaatagtgaacatcacctcctaccccttacactcatcttttccacagctgtcagaatatcatatttaccatgaaactcctctgccaaaaatttttcagtggttcactgtttcttccaggagaaagaccaagctaattaacatggtttacaaggacagtccatccctcatcttccaccattgtgtgacttctatgctcaaatgactgtaaactacttggccttctgttctacacttcatctcccaacattcccccaaacacacatatgagggccatgtgtttcctgccagtcacactctttctcatagccgatttacctcaggaatctttcgaacttttcagcatgtggtcccctgacaactcatgcatgtgcctggggtaataatacatgctatgcatgaaactgtctgcccttctaggtgcttatctctttgaaaggtgtgtctatgtctcaagaacctttttatttatgccaattcatccaaggcctggcacaaattacagagggcaggattggagatggaatgtgggctgcagatagaggcactgattggaaacacagaagagtataaggttgagtgcatctacttaacaactttctgaattcatatgccagtgaataaatgaacagggagggtcttactggttataatttatttgagctatctaaaaaagagtttagtgtcccttagcttctgctacattcttcccttaccttatccctctggaaatatctaaaaggtagcatttcccctacaggacagtagaaaaatatcaggtgtccctgctttatgatttctgcatacagaatccataactttcaaagctcaaggcaattaatggaggcccctaagcttctgttatattccaaggatacagcaaagtttggaaacggtcctcttcctagagctctggaaaatgtcctatcttaataaagataattctcaagccattaggaacctcagagatctagagcaactctttacaaataaggaaacttttgcttattcatttattctgtggtggaaaatgccagaaaaatgcctggtgctggaataaaaatgagtcagctggctgctcctcaggccttcacagtctagttagaaaaaatgacctataataggataattagacatgtaaaacatttacagaacttgggctacagaggtgagttgattttcccaaggttacctgcacagataacgttggttgatctaaagaggagagtacaaatgatacatcataatttctgcccttggcattttaaaaaattaatagattttaaaagttttataagttaaagagtcatatggatacttaattactttgttgctaccccctgatattttgcttctctcctggtagaatcttaaataaatatttactggaatatatctaaaattttagttcagtgctgctcctcatggattcctaattcctttgaaggagtgtatggtgtaatgataaaaagaatagattttggagtgagaaacaattgattcacagctctggtccttcatttacagaaaatacaatttcagatcaatgtatcgacctttcaaagtctcagtttcctcatctgtgaaatgaaaatggcagtgtgcatcccaaaaaaggcttgaaggggattgaataagatactgcatgtgattcaattaacatataattcgcactcaatagaatgaaaaaaaaaatcctgctattttgccatgaagaggctttcaacctttataggagagcttgtgaatcaaaaagcatactgccaataacatagcctttcaaaactgaacccagggcttattcagcttataaagcagaaatcctgtgctcactctgtttcctcagctggcagcgttctttcacctttcacctctcaaaatccctattgtttttcaaagttcatctcaaatgcacttccacaaagaagtcttcactgagacctcacagagaagtctcattttctctttctctttcttcccatagtattttgcttctattacttctaaatcatttattttaatcaccctgatttaaaaattggctgcatgtccgtcttcccattatatgataacatctgtgagcacatggggaatggttagcacaatttttgtgcatagtaggttctttcaaataacatctgtagaatcaaactaaactgaatagaaaataaggaactgtattatttttgtgactcatctgaattttgcaatcttatgccatcatttaaaatcaaacctataagcagatgtgatgattagggtatttgagcacattgaggaatgttataattcaagaaaaatttagaggaagtaattttattgactgaatagcaagataaactcacttatttttaattgaggggcaaaataaatacttcttgagtgaacaagtactcaggaaaataactaacaccttgaattgtatgaggtttgtatgttaccaccatatttttaaaataatggctagtaaacgcagaaaattagaggtctctagaatttgacaaattaccaagaatgacctccaagaactcaatattattaaaacatgtaatggtaacaacattagacttgttgattagtaagtttatgccaacttttaataaaaactttttatatatatcaaacttattttgtccataccgtattgtagtgtgggagcctttcgggcagaaaatgtagaaacaaattaaaatataattataattataaaaatatacatatacatgcatctatagatcctaagatagctgagaattctaactttaatatgttgtggttaacttgtctttgtcaactttgaatttaaccaaaaaacagaaaagtgtgaccttattttttaaaattatataattctctttgatgaatgtactgatcattgctactgaccagagacggaacaaaacccagggcatatttttattagtcacatgtgtttttcaattatttaaagaggaaagtaaaaagatttaaaagattattggctcatttttactttcccttttgtggatgttaatcaaagatttgactaatttattcttacctttaatagtgtatggtaggtttctttttttatttgaaagagcagtttttattataatgaagttaaaatcaaatttgttcacattttctcatattcagtcatgaagttttagaagctactcagtttaaaaatgaaatatgaagccgggcatggtggctcactcctgcaatcccagcacttcgggaggctgaggcaggaggatcacctgaggtcagaagtttgacaccatcctggccaacatggtgaaaccccacctctactaaaaatacaaaaattagccaggcatggtgtcaggcacccataatcccaggtacttgggaggctgaggcaggagaattacttgaacctgggagacggaggttgcagggagccaagatcacaccattgcactccagcctgggcaacaggagtgagattccgtcccacttagataacaataaaaacatcagcaacaaaaacttgatatgccccacattttgtttaaagttaagcttttcttctccttcaacttgttaatgattaggcagaagcctggaccggagaatgggatgtggtggtcttcttctcttcacattcctgctcctcagtgacacccatcctttttctgtattcactgagtgtattattttgttctttcctaggctgccagactcctcctcctaattgcagcttcctctccttcagccagcaggctataattccacctcgcttttgcatccaaaggcatcaccccaaactctttttgcaaaagcaatcttcccctggcagaagtctgcttgggttagattttcttttcaaattattccagatcaacattcctactatgaattccatatccatctttccagacatattcacttttggttctctatcaatcagtgaaagtgccattatttgtttcaagacaacacccagccccactgccataacccacttcagtcaacatttgtctgccttttccccactgtgctcaaagagcttcaagtcacacatatcaagctatccaagctaactccttaaagcttctcataccagactggaagtgaggtgaagcatttatctccctccctctgtggggaggggaaggaatgtgcttcaacatacagctttctacaaagaaatcctccccaaaaaacatttttttattaatcttttattttcatatcatgagcattggactaagttcacaggcagcttattggtcatctttgcaagatttacaccaatgacctagcagtttcaccttggaattggtttgttcttggctttgagacacaaaatgttgttattcatatgtcgttttaaaaaagtatagtgccattattgattttaacttacctgtttgtaatatgttatcattgaatatgatgtttgttatatattttgggcagataactgttgttaatcaatatgatttttattgaataataattaaattaagtacctatttgtgctagaaattcttttcaatgctggagatataatggtaggaacaaaaggtctcccttctcacacagtagtgggaggaggtgggtaggttcataaatttaaaaatcacacatataactgtatatataaataaaaatagttatttcagaagttaataaatgctatgaagtaaacaaaacatggtaatgtgacagagtgactgaggtatgaaattagatgttggaggagaaaaagcttctctaaagggatggagtttaagctgtactttaaaatggagttaatcatgtgaggagcaggaaagagaacatcccaatcagacaaagtagcacacccgaagtcataaggtggtaatatgtgtgcgtgtctaagaaacagaaaggacagtgttgccagaagacagccaggaaggccgatgcattcaaatagcagggcatatgggccacagtggagtctgtttttttatttataaagcaattgaaagaaatcagaggagtttaagcagaaatgcttatgacttcatatgtgtaaactgaagtggtcacaggcaagcctttgatatatagtcctcttagttatcaggctactgagagagccagagcaagaaatgtcagtggctcatacaggttcttggtagtagagatggaaagaacttatgtaaaatgtaagtgggggaagagaagggcatcctgctagataaaatgcttcaatagttgatcttctggctctggacactcactaatatttctctgagtttttggatacccagtcatcctatcttttccacacaaactcctgtattcaatgtctttttgagagacagtgactcctgttattggtctggccaagaagtgaattggagaatatgcagaggattccacaaccactccctgctatcatactccaaatagctgtgctgtgggctctctggactcacttccacttctagaatgggctgtttatgggcctggtcttttcttggtgttgaatctaccttttgtgttaattttctgtgagcatttttgttaaagatttctttgttcaatttaagatcacttgctctctgtcttcccaacattctttgttgtttctgagtacattggtactctcatttgcatttttttcttgaaatttcaagatatttggggagtgagaggatttgcacctctaatacagcctcccccagccccctcgcacgcacattctagatatggcttgtattctgtcagtttaacatagagtgttttccttcttacaacacatttaaacccgataaaatcttttacctatagttttaatgcagtgtctactagttttgaaaaggtttcagatttgatacattataattgaatcttcttcaagtattgaaaatattctttaaagcctttataagtgcaccaagcttatgcaattatagtcaataaaatagttttttatttcttaaatttctagtttctttctcatcaaaatgcaaattagtacaatcaaatatgcttctgttttctgagtatttataagaaatactggatttactaaatctgcactaaatgtctaataattaaaaggtaaaattgcaagaacttaattttttaaatgcaatccgttattatatattcagattataaaatttaaattattttatgactttatgttttttcattactcttacgtgttttaaaatatatgcatcttcctgtgtgctctttgatcttttggtgggaatgtgccattctcccttaaggctttggtctttggagttgaacagacctgaatttgaacccttgacatgttactctgttatctggggtaaagtattaacctttctgatgcttttttttttcccaccatacgattgggatcatgcctcctgcatgagattcttcaaatttgttatataacatatgtaaagctcctttcacaatacctgattcccaataaacattagttactgttgtctcattactgatgccacattggctttccattttgcgattatcatttattagttgtgtaatcacagataggcaatgttaactttttgaaagcatgtgcttttaggttaattaaatggaagaatggacatggaagtagtttaaaaacaataatgcattaataaatacaaagtgggaaaaacacaactagagtgacactttgttaacttaggtcattataaaaatatatccccattacattgttacagaataaagtgaaggatacagaaaaagagaacaattgtgtgatacaactacacagcactgaggctaaaaagggacaatcattatagacagtccagatatgaaaacatagacttttgtctattccagattttctactggagttctttactgtatattatacacactttctactatcaacattagcttatctgtgcaaactgtttattgctatagattctctttccttcatctttttactaaaccttccaggcaaaaatgcccgactagtatttttcttaactaaagttttcttttcctggctatcagtctcaaatgggtgcaattctaaataagtcaactttctccaaatatcggggtaatgaacaaaaaaactttattagaaattgtaatgttttagtaccacctatcatctgcaaactgtgtccaactggccttagagagcccctaagctctctaaaaatatgaaaataaatggaatctaattaatctggattctatgaagagttgggtgagataggttaaatgaaccatggcttgtttaaaattattgttgcagctttgttcctctctcattttaattatttaacattatcagttacctgattaagatttagtttccctaccattaataaataaaatcagcgggcattgatgttaagtgtcaacttgttgtggtgttgacaacctagtacagctctgattacttcaggaatatgtgtgggaaactcgatttaattacctgtcccttagaattgcctttgcatgtcacatttccatatctttaatttcctcatacctgactacttcctgatgtaaattgggcaggtatggaagtgacatgaatgacttggctattatatgtttattttcctccgtatataaaagtaatgtggttgaccttaccacattaggtgacagatttggttaaactagatggagatacctctctgatcctctgttatgactgactaaaaaataatccttattgtaaaattggaaaagcatgttcaagtagcagtggaatgatctttcataggaaaaagtcaactgaacacacatatcaaacctgtgaccctgatctcattatcatcataatctaaccatacaagacaacgatcagactgtgtataccacacagacaaaatggaataactatataacttgggaaagcagtaagagtgattaaaatctcaagctctataataactgctttaaattcaaatttttcactccttggcttacgcaagttatttcatctttctagaagtttcggtcacctcatctataaaataaggataataacagtacctacctaataggcgtttgaaaagaataaatgaggccatttatgtaaggttgttctctcagtgcctggaatataatgggtaagtgttagctttactagtttatattacaatcatgaaacagtattttgaatgcccaaagtagcaaccatatggatttggtgagtgactcattgtgaataagtagtaggttctgtaagtgaacattgaaatgactacttttttgtttgttttatcttgtttttaattgatatatagtaactgtatacctctacagggtgatgtttcaatacatttatacattatgtaatgatcaaatcaggataattggcatatccatcacctcaaatattttttatttccttgtagtgagaacattcaaaaaccttttagctattttgaaatatgcaatacattattattaacaatagtcaacctactgtgcaatagaagaccagaatgtattctgtctgtctgtctgtctgtctgtctatctatctatctatctatctatctatctatctatctatctatccatcccatttttagaaatccattcatcccttggtggtcacttaggttgatttcatatcttgcttgttgtgaatagtgctagaataaacatgggagtgcagatatatccttgaaatgtcaatttcaggaaatgactgcttttgaaaagttttctattcttttccaaactccatgctggtctgaaaaggctcatacaaatttcccaagtatctattccattcattaaaaaatctagcatgtttataactgataatgataataatcattgtattaaacaatcaatacttcactatataaatgtgattcacttttgttgtagtatattccttaagtactataacccaatgaagcactcatcaaattcacttttcacttgaagtgttaaagttcatccttggtacctgcaaggtcattcctgacaaattgactgaggttgttaaggtacaatttaagataacacacaatttctttagtgtctgtttttttaaaaaaaacctgtttttcattgtgtataattatatacttacattgacaaatatgaatgtcttgttcatggcagctactttatcttttctggctttggagacctcttttttagttgaaatttataaattaaccaaatgaagtacctcagtatttctaccattgttaatttttttaaaggaaaagactagagtctcgaataatttacagcagaatttattaggcgatggttttaggaaatagaaatgaattttttgcatgtgccaatgtttccatcttgttacagatggctcttgctggcacaagataagggtagaggaaaaccaataaacttgccagattttccctaaaaatatatgaagaattttgcatattgctcttaaaaatgaatttttgccattattatatactaatatctgcttctttttgtttttctgctttaaaattgttacacaaagatgatattaaaccttcataatttttatgaaagcaaaatgtagctattgaatggattttggctctcagtcttttctttcttaacaataaagttaatgctccaaaaatgcatgaaaatttatttttaactgacagttgattttttttcagtaagtaaattaaatcatttcatcttcttcaaatatagaaacaaatatagaattctggattacatattgtaaaaaataatatgagtaattaattgatatgacaaaaggttgtgatatcatttaactaacttacagtggtaaaatttttcttacagagcaaatgtaaatacaaagttattcaatttaattgagatatctagtgtattcctggtataataaacaagataagtgatacagaaccatatttaatattttattcattaaaatatgaaatactttaaagaataagaacattcctaaagttagagttcattgtgcttaatgtattttatatacaaatctgtagaaataaatagttgctttgcagaaaaaatggtattttgataagctaaacaaacttgagattggatatctgattaactagatattagctcaaaattttattttaacactttcaaataatatttctaggaaataatatttgatttttcttggcacacagtattgaacatagactgcattttttgttttatatttattttcctcttagatgtcttaaatccctcaggaccaacattttgaatatcaattatttttatatcagatgataactgtgaatatatgagtggaaaatatttggctgaatcattagaaaatatggagattaagtggagggttacttttttattcaagtcatttttcttaatggtttttactctcccttatttatttaacaaaattttacggagtcctgtaatacatcaaatcctgggccacaacctcagatataaagataaagttggcatggtctttttctttggatatttaaagtctgttggagaaattggacaagcatcaaatcaactgaaagcagtgggacagagacctagtgttaatatggtttgaactaactactatggaacataggctaaacctagatattaccaaaaaatgagaaaatcaaactgtgtttcagataagtggattttgaggagagttgtcagctacaaatctgacagtataagtcccatgcactgggtaacaggccttaaagatgagtggcagaatatggtgtaaaataataaaaaatgttttactagtttcccctcatcaactgctatttttgcaagattatgtaaaatgttcataaattgactcttcattttacaacttcctttatcccttttttccaattttgtcagttgtctttgccagaaaatgttatccatttacctacaaggtctgtgagtcagagaattaaaatacatgaataaaatttccaaattgcatgcataaaaagctatacattttctagatggctgcccatggaatatataatttgttctttgaaacgtccatatttaaacttacagttgacactttatccttaattcatgctgcaatgcttctcacttccatacataataatgtgaattaaagattgtattaatctacagttgctactgctgtcacttggttcatatatttaatgatgatgcatatgtttctctctgtatgatatataaatacatgcatacatgtatctgcatatggtcagtgtacatgtatacgctcagtggggtcataaatgtgttaaaaatgttcgttatgttcaaagtatgaatctcaaataagactcaatagtttattggctgaaataattgctatgacaagtgcaaataactggaagactttaaagtttcaaataatgtttcatgcacacacttaaattgaccatctataccttcaatgccacatgtactagcaaccaagacaataacatgcattttgctaatccaaccataatgttattctgagcagttactttattgatgaggtaaaactccaattcatttattccagtagagtattataactagagaaattaaatatttattctaaaagtcagtagagatgtgtgcacaaataaagttgtttgtagagcaagcagtaatctgagagaagcagacatttaaaggtgtgcccagagtatttacttgatttattatatgttaaacagcaagttaaaaattctgatcacatattttaatgatgaaaataatatatgttcatggtttttgaaaacgtaaatattggccgggcacagtggttcatgcctgtaatcccagcactttgggaggccgaggcgggcggatcacgaggtcaggagatcgagaccatcatgcctaacacggtgaaaccccgtctctagtaaaaaatacaaaaaaaattagccaggcgtggtggcgggcgcctgtagtcccagctactcgggaggctgaggcaggagaatggcgtgaacccaggagggtggagcttgccgtgagccaagatcgcgccactgcactccagcctgggctacagagcgagactccgtctcaaaaaaaaaaaagtaaatattgaagagcatgtaagtgaaaaagtaaaaatccaacccatttctccatgtcacatactgtactcataccctagagaaaaagcatttaaaatagtttattggatatccttccaggaaatatctgtgtatatttaaacagaatatggctaatacttttttctgtgcaaataggatgatacttttcagattgttctgtaatttgcctttttctcttaatcctatgtcttagacaactaagtatcagaacatatgcatctacctaattcattttagtaaatataaaaaaattgaatttgttcactgttatggattatctttgatgggcattgtagttagcattttggcttttatcgtacccatttttgacttaatggatacattgttgtcaaagtcagttgttcaatttaagatctgaggataggtttggttgatctccttgaaacgtattgaatagagacatggacactggagttacccccactagttagtgatatcacttcagacaggaggggttaactccccgtgtctcagtaattggatttgtaggacaaatatgttttttaaaaaggcacattagcccttggcatacgaggtggtcagaagaatccactgaagcaatatatgttgatgtgttttgaaaaagatgaaatattttttaaacaaagtatattaggcactggtactcttggtagagtcataaactattagctcaaactggacaatgttatatgcctcagtcacggaaaaccttaaagtaattttttcattaagctttatttgatttaagatttaagggaaggttgagatcccactgaagaacaggcaagatagagtagatcaatttatttctccttgcttttttagttacttttattgaaagtgtccctgtgggtctcaccaaagcaatcctactgttggaagagctttggaagtgtctttttttttagttttctttgtctagggtatattggggatagggaggaatagggcaaattagacacgaaatctaaccatgttgctatggtcaatttgggaaagacagggtgttgaaagagctaagcagggaaagtacataatacatacaacacctcacaacattcctgacaggcacataggcactcagatgttaattcctgcaagcaacatagatcagcaaattaattgaatgcattaaaggcgcgggtaatgtaaatatagtaaaacagaaaaaaaacctctcaagatacttttaccataaaactatagaaatgttataagaaataaacaagcatgtgcatgtatgtgtgtatgttttggtgaactgatagtatgctagttttgagcactgcttattttcaaaaagttcagttcctcaataaaagctccattttatgaatgtttgtagtttatggacttttgctcttgggagaaaatagtaaaataactgtaggtattttatctattcactccatgcctcgggcagcccccaggagagcaggaaagggaacatgtgtggccaggcaaattttattgtgtactcaaagcttacctttttttttttttctttttgcattgttcttaccacccatgattttaaaatggtatgagaatttttcaaactatgtcctcatgtcttatcaccttgcttataatgcccttcattcccctaccccccgctcccagctttaagtatttacagctaattcagtttctttgaaagaaatctgaaatcactcagcaggtataaaaatatatatactaatacatgtactaatacaaagagatctcctgaatatattgttgagttaaaaaaagtaatgtgcaaaacagcaaatatagaaagctgtcttttaagaaagagagggaataaatatatatgtataatttataattgctaatgtctacagaaataatttccttcattttacataaagaatgtggaaaggatacacacgaaaacaaagagtggttaccataggattggggatgagaggtaggaacagggaagctaagggtggatgagggagaagcatgattttttactgtactttggtttttattgtttggatttctcaactttgtgaatgaattacatattaaaaagagaccattacatttgagaaaaacattcaaaaatccatagttgaggcagcaaaatgctgtgaaaacattggctataaacctgaggagcatgaggtttttgtagcagatacgctactgttgcctgtaacttggaacaagttactgagactttcactctccctggcctcagtgtcctcacctgctccagataagaaggttgcagctgattatctcatgccctagatgtcattctgagctatattttaattgatctaagattgtgcataatccagagttattggattagcgccataggccactcactgaaagtatggaaacatgttctagtatattttacatccaaaaaacttgtcataatgtttttcattcatttgtttttttgttttttgagacggaatcttgctctgtcgcctaggctggagtgcagtggcacgattttggctcacggcaatctctgcctcatgggattcagcgattctccagcctcagcctcctgagttgttgagattacaggcatccatgaccatgccaggctaatttttgtatttttagtagagacagagtttcaccatcttggccaggctggtctcgaactcctgacctcaactgatctgcccacctcagcctcccaaagtgctaggattacaggcatgttacaatgtttttttgaagagatctgttttataatattctggtaatgtttcttaaaggtagaaactttgcttaaaataatctgtgtaaaatatttgattatgtagcaggtttccctagaggaatttaacttttcaataaaattttagcactaataaatatgcactgataggagtcataaaatgtatggagcactgattatgtgccaggtaatgtactcagaactttacatctataattttcacaccagttgacaataagttgcttttgtctacattttcacttgaggaaataagccttagagacttttagattatagaatagatattctaggtgtaaaacttgagtttcaacagaatatgttgaaaagtaaggaaggtgaatattaacatctctccatggaaaatggtagttgtattctgtctggaagccacaaaggactaggtaatttcctggagtattttcattgacagactgggtctgagagaggatatagatcatgggagcttcttttatctacctcctctcccacaggcatgctcaacagggacatacagagggaagtggccacactgagatacctaccccatgattcttatataaataggagaaagaaagatgcacacacacagaccgtacctagaggcagagagcgagaggcagagacagagacagaaaggcagacagagagaaagacagagaaatagagtgagaaacagagagaggagagagagacagagagaaagacaccttcagaaacccaaagtcagagacagccactatagactttgtaatatgatcagaaaggaacacaggcacacagagggatcacatggtgtcaaagacattctgaagaagagagactcataaatgaagatttgtaaatatatacaacagatagaaaacattttagaagcacacatctggccagagagataaacaaggcatagcaagtcacgcaaataagcatcagcaagacaaaattaggcagagtatcatacatacacagacatatacacagaaaacaaagtgaatgatatgaatctccacatgggaagaatgaaacatgttaaactagacaaaagaatacacacattaacacaaaacaaatatatagacagaggcagaaatgacatttatgcacacaaacatagacatacacacacataacaagacagacatagatacccatagtctgacaacaagaagaatcagactttatttctggctataataatagttcaaaagccgccccacttccctggcttctgcactcggcagggggccaagaattccttgtttcccaggccacagatggcgccatcacccttggatcatggtgcctcattcttactgtatttttctacttctgtttatttcattatgttctagtgagcacatttctcttactctttagcatttattccccatcaatatatcttgataatttccacatcttccttacaatacattccttaattttcttaaaaatatgttataaatcactgcaggttgggttcgttgttttatctaaaaatgattttcttctcccagccttagttttactaaagtctgatataacattgtacaagatagtagggtgggcattttttggtaatatgtggacctcaaagaatctagaatattgtcagtactagataaattttaaaccaacatggtacaaaatattttgagatagagattatttattgactaaatttctaagtacatagatattttaatggcatacagaggtatatacatatgcatagttgagtttatatatatatatatgtaaaatataaatgtgtttatctataagagtgtatgtataatctctcatctatttacagtattcttacaaaataaagctttgtttgggagtagaccgtactgtttcttcccggcattgtcttctcaaagagaaattaacatttgagttgagcttatagtatcaaacatttccatctgttgtgcctcatagctaagcatgtacacaatgtgataaattttatacatatatgtacaacttttcattttactccccagtgagaggtagaagaggaaagggtcaaaatcctacaaatagaaaaagggtctggacttcaagttttccttaaaatgtggtacatagacctcattcaacattaaattgctgaattctaggctctaccctgaccaacctcagaggataagagggttagtaaatgtcatttttaataagctccctaggtattttttttatgcacattcatgttggagaagcactttctagagaacagaattttattgatttttatacagggattaaatctgaaaggtatgttccaatgcagagggagggccatgagggtaagtattatggctgtgagttttgtacattgaaattgccctgaatatccctatgtgttcagttttctttccttcttttttttaagtaccaaaccattttgatctttctgtgatcttgttctcatatgttttctccctgctcttctgattaacaagaaatatccagaataattaagctgccaacagaaacaaatttctacttcatttcaacaaaatagtattgaaaatcattctttctcaatggaaagttatctttaggtgactcgcaaaggagaagtgaacccatgtatcatatgtgtgtaatacacacacacacacacaaaacccatatacataaatatgtgtagtatttatatttataaatcaaacactactgccgtgcttaatagtatatgaatcattctggcctaattatttgtaactaaaacataggatactatttcttaacctgtatcagaaaaaatgaattttaatactaagtaaatacagatacattcatattcaaaggaaatatatataggaatggtaacttagaaaacagatatggggcagggcatggtggctcacgcctataatcccagcattttgggaggccgaggagggtggatcacctgagatctggagttagagaccacctggccaacatagtgaaacctcgtctctactaaaaatacaaaaaagtagcagggtgtggtggcaggcacctgtaatcccagctacttgggaggctgaggcaggagaatcacttgaacccgtggggcggaggttgcagtgagccgacatcacgccattgccctccagtctgggaaacaagagcaaaactccgtctcaaaaaaaaaaaaaagaagaaagatattggagtgattattcccttataagacttgtttacccaagtaattcaccatcgagtactcaaaattgcagcttctcttagtgtatttaaaatttacaagcattaattcatgtgcaaatttttaaaaacatctcttgcctaaagtcaactgtatatttttattgctttaaattttaatacagctgtttctatctttctatactaaaataaaaagtctgtgatattcaggacatggctgtttatctaaatgtgaaatatttcacaaaatcaaatgtgatttccacatattcttaaaaatacacttttttgtagaaacactggagactaaatggaaatgcatttatattggtaaagatatttttcttcaaaggcaatcttggcttccaatagttaatattagtattaaatatggtatctttgataaatgttattattctggactcttacaaaaagtagcttgatttgagacattttaatagcttaaagggaagaatgaaaatataaggaaggaaaaatccataaagcatgaggcctcttatcccatattgattcttgtaatccagcaaccattagatacttaaataagcctcttttaagatggcatgtttacattttgaagatcaaataccttaatttgctcatgggtttcccaaacacaattagtacacaagatagaaggtaggctttcagtgaccatgtttccgatgtttttgagctgaccacagcaaaggtgcattgtaaatcaaattatgctcaagcaattgcttcttgcagtgttggtgaacataaatgccttttaaacgtgatcacagattatgaaaatagagctagaacattgaagctggtgagtaataaaatgagtaaaaatattttaatagtcaaataattgaaaaatataacttcatccagaatctctttcttattttccataaaaaatattggctttttaactggataaaattttagaaatacagctttgtcccaaacctgcccattttctccttaatgagtattattacaatggaaataaagagttctgtgacattttacctttaaattttctgtattttttttctaatgctataaacccagacttgacattttgcaaaaaaaaaaaaaaaaaaaaagaaaaagtttatttttatctttacttgctggtaatcaatttcaaatatatagtgactaaatattaaatagtaaatggataaaaaatttattaaatacatttagaaccctcactttttaaaatgcaacataaaatatcaattgattttctactgcaactgttccactgtcaattaacctatttttttagtttttaatttactgtgtgatagcaaaaatttttaatatttattgtgtcctcaacatataccagactctattctaagagctatacatatattactgcctttaatttcataaatgatcctatgaaattggtataaattatttctattcccaattaactaatgaaaaaaaatcaagagctagagttgttaagtaactgaccaaaagtctaacagcaggtagagtggtggagtcaggaaacaaaatcaagaaatcttactcctgctggatgcagtggcttgagcttgtagttccagctgctggagaggctgaggcaggaggatcacttgagcccaggagttggaggctgtagtgtgccatgatcacacctgtgaatagccactaccataatccagcctgggttacacagcaagacctcatttaaaaaaaaaaaaaaaaaaaaaaaaaaaaagacctgattccagaacctgtgttcttcatagccagtaagaaagaaaggatgttggccgggcatgatggctcacgcctgtaatcccagcactttgggaggctgaggtaggcagatcacgaggtcaggagttccagaccaacctggccaatatggtgaaactctgtctctactaaaaaagtacagaaaattagccaggaatggtggtgtgcacctgtagtcccagctactcaggaggctgaggaaggagaatcacttgaacctgggaagcagaggttgcagtgagctgagatcgcgccactgcactctagcctggatgacagagtgagagtccatccaaaaaaaaaagaaagagagagagagagaaagaaagaaggaaggaaggaaggaaagaaagttagttttaattaaaaagaagcgtgaagtgtgcatgcacttttttcctgaaaataatacaaatacagccagtcctttgtgttgtaaccaggcttcttttctttagtagtccccactacttccagctcacttaatgcctattacattaaacttccacattacacgtgaaaagcctttgcagagctttcacaaacaccatcatatttgatcctaccacaatctcccaaggtggatagaacacattgtcccttccttttcacagccaaagaaatgaaggctcagagatagaaaatgtcttgaacaatgtcatatagattatcacctaaaatgtaagaggcagagttcaaactagaacccaaggcttctgttaataacttgggctctttgactacagaatttagcacctgtaattcagggatgagccctctcatgctggtgaggcctctgtgtactgtgggagcaactgactcacagcttcacaatctgggcataatgtacggtgttccacactccgcccatccttccttggattaagcaataaactaaagttcaaattcaaactttcatatttgaatagaacacattttctatatttttcccaactgcctcacctccatgcagctaatctagttctgatttctcagcatctctattgaggacaaggcacctgtgagcttcattccttctgcagagcacagtccctacccttgtctttttttaatcctttgttgtcataaccatgcctttctttcctcataccataggaggcacatcttgctctctaccttccaactacatttataattgtttcttttatttttttcttcatcatggtaccttatgccatgtaataaaagagcaacagatttaccctgagtggttaggtagtttcaaatatatatatgtgtgtatatatgtgtgtgtgtatatatatacatatgtgtgtgtgtgtatgtatgtatcccagtgaagcactcctcttggattttaactaccattctattattctccctaaagtagttgcacagaatagtgtgaatggtgtgaattccagaataatacagagctgcgtccatatcctggcttcccatttattagatagaggatattggacaaatttatcatctttctaagccctagattctttctcaaccacccacaattcagtgataattatcattactctcactgtattctctttatagatcaggcattatactaggtatttcacgtttagaatattgaattgttacgaaaattttattatgcaagtattattctgatttacgtttaaagaaactaataatagagaggataagaaagctaccaaggtcatatagctggcaggtaattgagtggggacaacctaattctaaaattcttctttttaaagtgcatatcatactagaaggtacatgtgtgagtatggttgtgtgtgtgtgtgtgtttgtgtattaaggatttagtttgagttaatggatagaagagaggtgaagggcaaaacaaatatttaactaaacttctctatgctaatccctgtaggaggcacttttaattattatcacaatatttttagaagagtatggcattgtctcctgagatgctgtgagattagaaaacatgtcaaaggttacacagctagcatatgaaagagcccaaaatccaaacctgtatatatctgtctctaagccctttatgacacagacaaattatcaattagtattaatgtataatttaggaaataccttttagagtcttacacttctagatttggaaatatctttgagaataattcagaggtgataacaaacatataagttgtctacagtcgttaaaaacggtatctgcatagagtactgtgactgggtgtggtagccccactgatgctaaacattaactctttagtttcttaatcatgctacagtaagggtatcctgggaaattggcccagccaaagcaacttggacgcttgagtagaaggactctggaagttctgggtaatcgttattcaccaacctgtacaagcatttcactctctcattggcctatatgactatccattagccctagctactcttgtccttactttacatctggttaattatttaatttttccaagctttaagtatttattccgcacaccacccaatttaatgatatccactactgagaagttatgcaatttaactgatattacttatttagtttgaactctaggatcttttgtccttccaaatccattggcttgtttttaagtttcttctgtttttttttttttcttttaaaggcacttcaataaatatttttctttattttaatttaaatttcaattgcatctagatgaagtgttgcttggggtagtgctaacggctttccagttgtaatatgattattaaaaaaacaattgatttatggtttgcttaaaacaggtctatgctacacccacacccaatttttccttttctctgcttgtctttattgctatgtgacttattgtataggagctaaccagactgggtgagaggaaaactgagatctagacctagttctgcttctgactagctgtgagtcctaggcaaaatctgttaaacactctatttttgtttcttcacctgtgaaatgaggagttcgatagtcactcagtagggtcatttctagctctagcgtcctatgaatctgggcacatgaccactggattccaagtgtttctgtagtatgtagtatatgcttaacatttattgcatcaggcaagatagacagaggcagagagagaaaggggcagagaattgtgtccccgaaatactccagcctgcatggtaaaagaggatcaactcatgtggaatagcacagaaagtatgaaaacaatgaaattgtgcttcattgagaatcaaagatgtttagcaaggagaggcatgtgtgagaccagaaactgttaagaagtcatttcagggggatagacactgtcagagagctcatccttcactggcttgtttccagtgagacccactcagaaaacaggatcttcataatgactgcttcaatctttttatctcacttatgaagataaaatttaataatgccaaaaagttaaggtatttttatagtcaggtcttgctggtgtgtagagaactatctctctcattcatatcctgaagacagcattttgggccaaaatacaaagtaatactcctttcttttcaatgtgaaatactcttacacattattgtagaggagactctccatgtttgcactaacacctttcctcctctctgaggtgagttgattataataagaactttaaggaatcaaacatatggaataaaatacacaaggtctaaggatgaagtcactgttttgttcaacggcacaagactcacaataaaaaaaagacatattttggaaagcaatggaacttaagagataaaatgtgcagatagtaagagggtcttatgggctggatttgagcatttagtatatgacaataggaataaggaaatagtaaagacttttaaggagagtagtggaacaatgaaagtcatgtttaaattacattaatctgcactgcgtttttaaaaatgtattttaaatgactagcttccatttggaatagaaaatatcttatttttgctcatgaatttcgaaaacatcaaaactagtgttaaaccatatttagttttcatctgtcttgttttagctattttaaaactcacagtacaagattcactatgtctaagtaagcctttaggtttttaagttcctgttagttctcttagagtgcttgcaattttagtctcagaaggagttgaatgtgtgcacattttagctgatgttaatttacaatgattaaatcttttttctctttgggtttgccactattaataactacaacttcaaaaaacccattgaatacaaaatggattgggagagagtctggagtctgcatgatggtagaagcaaccaagagctttctacaataattcaatcgtggtaatggtagccactgactaggctaacagtagagagtatttaatgacaggaatgagatttccctgggaaatctggtgaaatatgatgagagcaaaggaaggaagagggaatagttaaatattatttctagatttagagtttagagacagagggggttatacctctgaaagcaagacctatgctggagggaaaatgggctttgaaggtggagatgatggtcatccctgttgtactgagatgttggtgagacatccaagtagaaattgttgcagaatattgtatctttatgaatataagatcaattaaaatatgttaattctcaggcaaagtgaatttaactttaaatacatatttaatcaaaactttagaaatatttataaaatttcagaagtgctacagtcttgaattttactttttggtgacattaattttacttgcaaacacaaatggaataagacctcagaggctcctttttcatcatctaatttcacttccataaagcaattcttgtctgatgagagcataatgcaggcttctatataaaatattccctgtcatatttctgagaatgattttgcctctttttgattcttgtgtttaagactcagatagggcagagtttatcagtgtgtgcttaaaccctgtaaatggcttccattgcttttaagattaagacaaaaatccttcagctgaaggggctgtgtgttccagttgattcttgtctggctctttgtcctcatcacccacgactctcttttctactccttgtatgccagccacactgacctccaggcttcctctcttttggggcctttctatgtgctattttctttccccgaaatcttctttccaccctacctcctcatacccagccctttgcctgcctggtgtttactcatctttcagccctcaggccacattacacctagtcactgaagacttcccagactcagccaggtcaccttgtataacatcttatagcaccaagactttttccttgacacttatcacaatttataagtgtatgtgtatgtatatttgcttcatgtctctttgctgagatctaattttcatgagtgtagttgtcttgcctgttttgttcctccatgtatccttcatgcctaatgtaccatatatttgttaaacagctggatgacagaatattgcaaccatggcagggaggttggattattgatgccatcccaatcccatcttcattgaaatagctctagacatctagtggcacttgtgttctcaccagactcctgctctaggtgcaactttggataatacttggaaagtcagggcaatggagagtgtgtcttcacaaagtgtgaaagggtttatagagtatacagaagcatttctccagaataaaaggaacatcagtttgagattcttcaggctgtagaaatactgtatctgcatgtaataaaaatcaaacaaatatagtgttaaagaataatgagctttgcaaatttgctgatgctcaggttaggggttagtctatttaatttactttttatctacttaaattctttcttccccagatgctatcatttttttattctagatggaattgcttttgacatcaaagtgttatgtaatcaaggtaatttatggtgaaaaactattttttaaataaatacaaatgagctcttctcagtgtactagagcagagaaaaattctcttttcccctttcctgactttaacataagattctcctttttttgtgtgtgtgtttcaagttgtgctcttacctctgaaaaactgtctgaaggaatatattttgtgtttatgtgtcttcttccaacacaaaactaaacatagggtatgtctgttgctttcagacccttggaaattgtttccttccaaaacatgtgtacataggagccattagcctaaacaggcagctcacctaaatgacactcattgtcatgaatgacagagcaccaccaccaagatttgcactgatatggattctttttttaaataatcaagtgttccaaaattcacttccaatatctcattggagtggcttgcattagatttttagtttagcataatacaaacgtatgacattctcaaaaatgtaattcccctttaactgaaacattttccagaaagaaaattatttttcagctatgctttctttatatctggtcatataatcaatagttttaaaagtgtgataactttttgttgaataaatatagtaatatcaaattagcgagaatgattccaaatcagtcacttttactgatttctgtattctcaaaagttatgtattcattttagttatataaaattaactaaatttcaatgggtaaaattcaataactttgcaatgacaactgtcataatatctagtttcttaaaaccattgtgttttaatgtttgtcaggttgaaaaagtcaaatatagtaacataatcctgtcgttacttaaaatgcattgaattctggcattgttctccggaatacacatattttttcatatccttgattcaagttttataaactaaattttaccccaagagaatacatccttgagaacatttagcctgcttccaattgctccagaacaacaatggcaatatcttaaattctctcattttgtaaaaatggccttagggatgctttacaatcagtttacttcaaagactgctgggtcaagaggacaggggaaaaaaacaaggtcaatagccagggctttccatctatcatggtgggaccactggagccagaagctctaaataatcctaaaaaattcagaggcttcttcccttgagaaggacgcatttctaatggccagcttttctaagtcgggagctaataataccctcaacctacttgccttttgcagatatgtgtgacacaaagtatggataatttctgctgaattgaacccataatgaaggaatttataatcagttctaatgtatttgagacccaaagtatattagcccttcatcaaagggaatgataaaaagcagcattaatatgggtggatagtaattatttcagagctcataattattctcctgttaactacagagaaacgctgatatttttactccctttttaaaaaataaaaggctctggtcggattctgaaatgtaagaatgcatcgcacgtcctttaccagaacccatactttgaattatgctcatgttaatcgaaaagaaactattttggaattaaatgagttcaaagttcatgttaggagttccctttaccttgcttagtcctgttgtttcaccactgaatttatttattgcccataggagatataaagtatagtaattactctcactccctttcaaaatgacaggaggtctactctcctattaactctaatgagagttatgtgtgtgttcctcagggaggacagacccaatagagtttcaaggtagaattaatcacttctacacactggttttagtggtctcatttgctttatattttggtgctttgagatatccatttaaactgcttgtattgaaaatgcagtatttgttgtttaaaagaagcataagctgtggttagaatgttgttaataactgttatttctatttgaaggataaatgtgttaccctttgaggaaatgatgttgctcaatttacaggaatagagtgtctaaaatgtgactgtctacttttcataaaaaattaatgccaattaccttttacaatattttctttccgtttaaaatgttttaacatgagtgattacatcagttctaacagtttagaacaaagggaaagtgagccagagagctggatgccctagcaaagaagggagctctaggcagaggtggtgttttgtttccagcaggggaagagggaatcttgagatcatgtagggatctgctgcggtaatccagaagcatatgtttactccactgaggcttcctcagagaaaccagtgtggagtttctcagtttgcagccctgaactctgtagatatttattctcagtgcctttaggcgtagagataaaggaaatctgtgttctttcttcttataatcagttttgcccaaaactgttaccaaccctcttcttcctagggaaccttcaaaaatcagatatgtaaaaaattcttgatgttaagaacacccagatatactgaaatcactaaaatactgctgtaattcgtactatgggaaaaaacttactgtcatctaataataacgttttatttagtatcaataaatgaagtgtattgggataactggacttaatcctcctccaggataatcatatccccatgatgctgaagcaatatttgtatttgcttctaattcttcagatttattacaataaaagatgtcctatacaatgcatgcatgcaattattatctcacatcaggtaagagaaacacagtttcctaagtaaggaaggtaaaaataactaatgtagcaaaaaacaaaaaataaaacaacaacaacaacaacaaaaaaaaacaagaaacaaacaagcaaaaaaactgatccatcaaccatgcatccatggaaaaactctctgtatatatactgtccatgacttctctacatatgccctcaactagcaactgagagccatgtgccacatgcaaagaagtgggcgatgatgttttgacaacaattctcttactgttgcaactcatgtaggcccaagagctagccagctctaaatacatgtaaagtatatagaaagcactggctcagtggctatataagctgaatgattcctcatagaaatcatgtaaattgacttgggtaccctagaaggggaaagaaagacaattccatctgactaattcaagagagagctcttatagagccccgaacaaaatgaagacagtgatttaattgtgatagattttacacgtgcctccaaatattagcaaactaatgattcaggaaaaaaaatttgagctcacattaatgatttcttaatatagccaagaattaagcaaattaagtaatttaactaaaattggaaagtagatagtggttttggcagcaataaatgccactgcatttaaattgtgttgctaaccagtgaataaaaccataatttctacatagcagcctagaaaatagaaatgtatatttttttgcagtctttaagaaattacagaaaaattaaaagcttgaaaatataatttttgaagtctaatattttgagggatgctttgaaattggaaatattttaaatataatattctgattcagcaattttaaaatttaaatgaaaaaatatgtatagctttcagaaatgtagctatgttgttgcatgaatgtcaaataatcctaagcatgccttttgcatttaaacagggtcatgttaaataaatgtacatttctgtgaacttgcaactgagtgtcaattaatataaattattgctttatctatgttttctgttaatggaataattgcttgcaggtgtgattataaaagtctatcacttaatttattgtttatagtttccctgtctgtgtttgaaatgaccttgaaaccgtgacctttcaattgaggtagtcaatgggttacttcaattacttcatccatttctgcctttccaatcttctgatctttgacaagttattactgtttttcaaggctgtctccctgagctgatgaaacataactgtattatatcttatttttccccctctgttttctgggattgtgtttttcattctttgagagttataatagtaaatttagtttggaattataaatataatgaatagtaatctcggaaaagacttagaaattttgctaaaaatgtttaacaatctttccctatgaagtgtgcttagacttaatgcctgcttctttactatttatattattgaaatcagtacatgactttcagtctctttttccctcccttttctttgactgttattttatgcatgacaaaattctcttgcttactgctatgtgattggctgtcttttaacttgagtgtcgtgtgtttgtaatgattgctttttgcatgaggattattaaatgtcatgcaaattaaatggttgtggaaacaaaaaaagaatgtgagacttcacttgcttttttatgtgctgagtatgtcaattatgtgacacttaaaattactttcatatgccctttgacgtcccctttggtgtgctcctttattcttgcaaattagcattgttaagtataataaaacacttattaagcattcacagtgttttaatacaattattctcctcaaacatgatcctattataaataactatactgagcatgaaactgcactaaggcataattccattatattactaaattgattatgaaatataagccctgactcggtaactaccttaatagctaaacactgacttctactgatcgaacttttgctctgctgagtgatgagactatttagtgatacatttgtgcaggatgcaaatgtcttaaatccacaagtaatatttaaatgaaaacacatggggaaatatttgtgtaatgacaagtaattttaaaaagtcacagttttgaaaaatgtatggattaaaaatatgtgaaaaccaaatgttaatgttcttaaaaaaaagaagaaaatagaaaaagagcaacttaagatattcatatctctgtcttctctaaggttattatattgtctcaaattaaagaatgaatttgacctacttttttaatgttgccaccaatttaaattagaaaagacactgaataaattaagttctttcagctaataaaactgtttacttttttgtatgcaatgggtatttttttttttttttttaaaagtctttgctcatgacttgattttcaagccataatgtattttttatgctggatatatttacaacccaaatcttctatgagatatttttgggaaagggtttttttttcttaaacaaaaataggtagtcaattatgatgtgaccacttccccactctttttggaaatatccttgagaattttagtatttatatttattttttcccctcagtcttgtttattcttgaattgtcttttttttttttcctccatttctccgttctcaatcctaggtccccttacaaagaaacagacagatgatttaggtgataatgacggtgctgaagatgaaggtattttttttcaccaaatctatttgcatgacaagggcctcaatcactttttccacccctttctatttttttacttcttgtctttttttgaagagttgtttttaattcctgtttttgatgtgttttgtcttcttgcttgttgttacatacaaatatagagtattaatttttttaaaaaattaatattaagttttacattttgatgccaaccattaaaatgttttaaaaagaggggcattttttttttgttttcttgaactgacttttgatatgtttcatcccacattttgactgaattttgtccaccttctttgaactaacaatctctcccttgtagtctctctgtgcccattttgcatgttttctaatctatgtaaatattttcccgaatattaaaatgtgcttcatttttacattcgacatttgttttaaaaaaacacacacacccaataaaatgaaggacaagctgaaagctaatataaagtgtttcttgagcaatatattttaatgtaaaaaatactgttttctgtttatttgcttaaatgtcacataaatgcaattaaattgtatacataagaaaaggcattacaactatttagaaaactgtagtaaacattgtacaaccatttaagtattctggactcctgtagtacttttgatagagtctgtagctattttcttagacaagattcaatgaatattcttaatttcaaggagacatgatttccagattgtcaaataaaatattctgattttcaaacattgcaactataagcaatagaatattttctacttcattaatatccaaattgtttctccttacaactttcatttgacatacaattctgatttactctgtaaacctatgaactcactacctagattgacttgacatttctgatttcactgtacctttacatggtgttaaagtgagctcatcttttttggttccaatcaggattaaagtttatgctttttgtttgttcattttgttatgttttgtaatcccaggtttcagagtaagtgccagaaatctagaaattaaatctcataacgaaaataataatgtggttagaaaagttttccaaaataaaataatctacaacaaggacagcaaaagttttgttccatgagttacaagggaactatgggtaaataaatttttactaaaatatttgccttatttgcattgacatatatacatttaataaactccttcacaacagataattaaattacagaggtggagtattgagaacttaaaaattatatttggtgttaatatttttgaaacacttaagaattattttgattaaataaaatgtatgacatttgattaaatatttatttaccacgaacaccagcagtggattaaagattaaacacaaagcagtcattaatatttgaaacaaatcattatcgctgtccaagagttattctgaatgttaaatagctaaaaataaacttatactatcaagatgcaaattctgatattttaaacactatttgaaatttgatgcattcaaacattcaggatattttgtgacattgtagaacattaattactgtttccaaaactataagaagactacttccactttcaggctttgggactttttgaaccccttgaaaatccttaactcctagaatttgttatctaaataatactgaaagcatacaggacttcttcatgtgtatctttgtaaaggccaaattttccccatttaggcaaagggttaaaatacattattttcctattttaaaaatattttgattgcttatttaatgtgattttttttttccttttgttaaaacagcttcaagtaaggcatttacctatttagagtaggtaagtctgagcgatcatagctaggccatgtaaacctgaatctattttatagacatgttttgaagcacatttaacatttttaaatagccatttaaaatatcctaaaaccctattaaaatgtcaggtagtattcaggttaagtactaagccattcagtcacaagagttattgaatcaataaatatttttaaatactcaaaagcgtagaatgtcaaaacagtcaattccagttcggtctcttcctctgtgttgtttcagataattgttttgaatacaagaaagatgaattcagatatcctacaggggaaaagaaaccttttatagaaatttcagagcatttttaactcaattctttttatcattattttgtagatgtgactgtgaataaaaattgtgatcaatattgaatttgttccaaatgttgactcgacatcactggacataaggcaacaaatatgaaggacttgataagtaacttcatttacatcagtcagaagtcaggtcatcagatcacttatgtgaaattccccacccagttcccctccacctatgcttcatttcaggtcccagtctcagccactgaattgcaaggccactggccatattcctgggtatacaaaaagatatacaaaagaatgtatatctttttttttttttttgacagaatttccttttgtcatggagactggagggcagtggcgtgatcttggctcactgcaacctccgccctcgtgttcaagcaagcaattctcctgccacagcctcccaagtagctgggattataggcgcctgccaccatgcccagctaattttttgcttttagtagagacatggttcatcatgttggccaggctggtctcgaactcctgacttcaggtgatccacctgcctcagcctcccacagtgctggggttacaggcgtgagccaccaggcctggcagaattgtatatctttaagacaattccatagttaaaaacaagactaatctgaagtgacaaaaatggttcaaagtaacatcccagatttctaccaacttattttaaaaatttaagaagtattttaaaaatttaagaagtatttttaaaaattttaatggtgctaataatgccttcatattaacatttcaatatttaccctgggtgtggtggctccacaccctgtaatcccagcactctgggaggccgaggtgggcagatcacttgaaatcaggagtaggagacaagactgtccaacgtggtgaaactaaaaataaaaaaatgagcccagcatggtggcgagcacctataatctcaggtactccggaggctgaggcatgagaattgcttaaatctgggaggtggagattgcaatgagcccagattgcaccactgcaccccagcctgggccgcagaatgagattctgtcaaacaaaaaaaattaaatgcaattttatatactatatagttcaagacaattttttgtagattttgaatatttttaagctaaaaaggtgtgtttaattctgttatgtccagtttaacaagcagaaattcagccaacacttctatgttcattcagtggttctgaatgataacttgaggttcataaaaatgactggaggcacaaaagtctgccttgaaatgtgtttttttataatagagaaagatttaattgaggcaatacttcacaattttaaaactgttaattctaaaaactctaaaatatgggcaattaaatacttcatgagtcctttaagacaaaaaaaatcagtaaacatatttaatgattatatcactaataattattcactaagatcattaatggaagttgtaatttcaaactctggttgtcaggtacaaataaatccccattaactgctctagatctattgacacttgctacattggcttaaaattttggtctataagaaagataaaataggtactaaaattttaaatcaaggtgtttactcagactccaatttttttttttaacttgaagaacttgatttaaatgcttgtgtttagtaaggcttaaaaccattgcaaataatggaaattataaacatgcctgacaaacatttgtacttttactggaactgagttagtattttaaaatttctgagtgtgttcttgtgattttagtaaagtcagtagatgctgtttaggcaaagtaaaaaatcttaagtgaaaattcatagttcacaaattccactatatttataggtggttaaatatgtaaaggtttaaagagacaacttggctctaaaaaattaattataaattaataagctgcatttgatatatttgcacagaagataaatgcccccttcaacattattattaaaatgatggaattagcagatggtattcaatggtaggctatctgatatattagttttatttataaagagtctggttctttctaaaaacaaataaatagttgtaattgagagcctttagattgctatttacatcaaaaaaaaaaaaaaaccctataaactaagcataaaagttaagcctaagatagaaatttgtaataaaacattatacaaagtaaagcctggccaggcatggtggctcacacctgtaatcccagcactttgggaggccgaggagggcagatcacctgaggtcaggagttcaagaccagtctggccaacatagtgaaaccccatctccactaaaaatgcaaaattagccagacatggtagtaggcgcctgtaatcccaactactcgggaggctgagacaggagaatagcttgaacactggaggtggaggttgcaatgagttgagatcacgccactgcactccagcctgggtgacgagagtgaaactcagtctcaaaaataaaaattaaattaaaataaagcctaaggtggaccactctgacaatgcactattaaaggcttccatttttttcctgtaacagaaaatatccaaagtttctacagtttctcaaactttgttaacaatattaaggtttgttatgtccaagaattttacctgttttagtaagtatcataattacttttgcaccagcctaataatactttttataacctaaatctcagggttacttaaaatgaaaaatatttttcagaacacagcataagaatactagagaactttatggaaaagaactgctcaatatcttaagttattaggcaaggctgaaatttgaaaagtttgaaaaggcaaattaaaaattaagattaacccagactatcagtaatccttttaagtctaattttcaaagaaaaataaagagataccactcaaaatagctcctagaatctattgtcatattttcagtgttttctgacaatgtccacttaattctgttattaaatataaaacgtggcaggtcttctcaatgtgtgcctgtattgttgtattgttttccaggtgaacagaatggttctaccaagatttcattactgttcacagttggtgctttgtaattctatgtaattttaattaaagaagaattctgaaacagcctccctctgtgctacctccaagcatacaattagccgagtacagtgtctgctgtgaacagtcagttaatgatttcagtttaataatttattattgctttttcagtgccagccacactagaaaaataagaagctgaaactgtatgtagcaaacaggcatttaaggtgcacagtttaacaatctcaaaaggattgctttctctgtgtaagtctaacatctccacaagcccccagatctttataaatgaatgaatactatttttttctcccaaggtttcaaggagaaaataaattcagattttcctcttaaatgtgtctgtgtttagtgaatggttcctatgtcaaagtatccttccctcactacttaaaaacaagatattattctcaaatatacctttggggaattagaggggtactagtaactttatacactggtattaagtcaaatttaaatagtcttttaaaaaagtttgttaagttctgcaatgagccatttccccaactcgaaaatctgggcaaacaagctgagctgcaatccttgacctaaaatgattcttcatttgaagatatcactttattattacgctagagaaatcaaggcatttacattacacattctatttttttacaaaaaatgcaaagcaatctctaagtaatcactagttctttcaataaatttgtattctgttagtccattctgaaaactggcacctcgattataaggatgttggagagttaaaagtgataaaaaattttgaaagcaaaggaacaaaaacatactattaaattatacgttttaatattggcataaaaaaagataatacatttgatgtaattttgtttcaattgtgggtataagagatcatgggctattacataatagtaatgttttctttatgtatatattcagagccatatatatgcatacatatagtagttcaaatatttcaatctatataatacgtagatagaactatgtttgctgatatacacagttaggcttatctacagaaatcagtgcatttttcatactgattaaaattatgttatgtttatttatatattatttctagatccttgttgaaaattacagaattcaggaaaagtatgagaagagcaaatatatttaataaaattcagagctgtagaaatcacttgaaccctaaatcttgacactttacacttgaacttagctctatcccatcccatgtctacatgataaaacatagagccaaagcgtgaagaagaagagtatattagccacacaaagaaagtgaaaaaatatttgtctgttctcttcttccaaagggtaaggagagctggatatagtggatgtcctgaatttcctaaaaaatatcattctaatgacatttccctaaatgcaacaagaggagcacagatgtacatgactttcgtgcctaaacattcatctgacattacttaggtagtaaactgaaacatcttgcataacacaatactgtaattatgttcacaaattggagcataaatgagttgatgtaatcatgttgcatttgacacaaagttttacagtacataagaaaggttaaacagattcttttgttcacaacagcaataataccattgtctttagtttatggctcataatgtcatgtgaagtctatcatatttttaaaaagtagtcctaagaatcattgccattctgtttcttttgcgtttactgtcacttgaggaattaatcaaaatgcactaaaattcacatctaattttaatttgtctaagttttataagtcagtttgcaacttgtaaacaaaattttgatagaaaacaatggatgcctattgctatttccacaatagctattcatatgagttgcttaagaaacactttaataaaaacagcagtttaagaactatattgaaattatgccctcttttcactaagatggaaaatgtattctctgcttcattgtgtgttatttttgaggataagaacgattgccaaccatttgttttccagatattcgggacagtgggggtcccaaaccagtgatggtgtatatccatggtggctcatatatggaaggtactggaaatttatatgatggaagtgtcttggcaagttatggcaatgtgatcgtcatcacagtcaactatcgacttggagtactcggtaagaagagtctctcttttgttttcaccatgaatccatgaagtatgtgatggttttgttttgacttgttttgttctgctttgctttgtttcacccatttttttatgcgtgttgacattctcgagcccaaattttttatagtttcaatgaattctataggttggttttaagatgtgaaactaaaaggtgatgaaattattcacattgtcatggaatgtacttcctggtttataaactatgaaagacaaaatggcagggccttattgaagaagagtacatctttgaacaaatatttccttcttctgcttttctgtttacaatactctaagtttccctgaggtttggcgtgagctaagactaagtttacattctcttctggagtatgtatatggactcgcttttgggaatgattgtttgccattgtgatggaggtttctttggtttgttgttgttattttggttccataataattagtaatatttttctgaatgtattctgattgaattatttaatttgaaaaaacatgcattgattttataaagtaacaaagaattcagttcaatgatgtatactcttgccaaaagaatgataaatacaaagtggagatttttagctttgataaaaagtatagagacatattacttataaaataacttaggtattctgagataggcatgttatcttatacaataaccagtttttaaaagataaacttgctattctagcatatatttgtttgttatagtattaccacaatttgaggagtaaaattactgtatgatttagtaaaacatctttatctgtgatgtatttaattaacagaatttgctaaaagagcacaatgcatccacaaaatacttaactttttaatcttaattgtcctccaagtcttatcccatactatagacttgaagaagcgtaaattataattttgtttatacacaaagaagcgcctcactctttcattctattatctaaaagattctgaaaaaggaatttgtattatattccttccttggtagtatcatatcttttatccacgttgagaatcagaatttttccccttcagtgttattgtaactcctatgtaatcataattctgtgtttatgcttatcacaaaatattttaaaaggtagaataatttttgtgaatcaagtttatagtctgggggaaggagacattttaccaatgtgaaggttaagtctcagtcattttctagtttgcttttttgaaatttggagtgtggtgaatgaccatagatgcactgcgtaagtgtaggtataaaatattctgtagcactgatcgaatacacatgagttcctccatagtgtctaatcatccattgcttcaaacattcatatgatttctgtgggctgggatgagtgtctttccaccagtgaaaactctgtgtatttaagacatataaataattgctcataataattcttgaatcttaaaccttgaattcttaaatcttaatgttgtcatttgtttcctatggaacattttcattggaaggagggtttttaatattttcatgcattgaatcttaatggtagtattgttgagagctcagttgtttttgctgattattattcttatatttttctaatttttaagttgaaaatcctgagcagtggccagtttgccagatgaaactttaaattgaaatgctaaattatggtaacagtgtttttaaggacttgaacatccagttattcatatttatctattttatttaagaaatgctttggccacaagtttttttgcctctttctgttattggttctgtttatataaagcaagatttcataacataaactttgttgttatgttaacaaaaactttacccattctttttctttttatgtgttcagaactgatgaggacttgactttgacctgattttaatcctatattcatgcccataccccattttaaatgccgcactgtgaggattggattgcaaggcaatggattaactcgctaaaatataaagcactcagtcaatcacttggtttagatagtagcagagagcagacagtattgatattatcaaagtatgatttcccagtgttaaatatttgttctggctctactgtaccctagaatataacatttagttgtctcctctcctttatttctcttaaacacattatacactgataacaagccaaaggctgtccttgataggcctcctctcaacgtgacaaaacataaactctgtgaaacattgtttaggtagactttaagacattggttctcgaacagaggtattctggtcacttttttccaaaaatatgtgttgggtattgtgaaaatgtatttaaataaattaattcataaaaaagaaattatcagaacatttgtttcagcatactttgcatgagtgccgcaccacagcaagatcaacagctcatcggacagaactgcaacaataaagactgtagacttttgagattgatgttgtgaatagtttgtctaacagtaaaaaggtaagccaaggtttcttgggtgtgggatccaagactatggctgtctaatttgcacttgagtgattaagtaggaaataagatatgatcccacatccgaggaaatcctgagctgtgttttcactggggtattttggtgtgaaagaaatagatttgggggtccaatggacaaactgggtaattacaagatcattgatttgaggcgactggttggaacaatcaggatgtctggaacaggtagtgcaatctgtgttgatttgaacttgccatgtggaggtggtggggaatcttacaagttttgttttttgctctttgattttagtgatgaatagagatgtgataatgttttaattagaaaattcgtacagctatctagctgccaatttttcagtttaaagatctcatgttaaaaaaaatttgtttattacaaagtaggaatagaatagaagaaaaaaatacctctaccattcctcagaagaagctagtaacaggtcagaattagttcttctaccgacaccctttagtggtttcctttccagtggtaacacagaatatcactcttactgtgtggtgtatgattttcccccaccctggaaatgctattggaagtgataggaaaaactgccaataagattgacaaagagggaagggaatgcaggactctgcctactaacctcactccccagtttcatgttagagctcctggcgacctcctgccatttagtttcacacttcttatacactaaatatttaacttttctttcacttttgactttacacattctttgtcctcagccagttttgacataaactttccatatttgctttcttcagcatctattatttgatatattgttacatagtccttatatatgtttaaaattattgttagtagggtattttttaaacattctattgtatggtttataatcatcttagaaatgtagggagaaatggccaggtgtgatggctcacacctgtaatcccagcaccttgggaggccaaggtgggtggatggcctgaggccaggagttcaagaccagcctggccaacatggtgaaaccctgtctctagtaaaaatgcaaaaatcagcttggcgtggtggtgggtgcctgtaatcacagctactcgggagcctgaggcaggagaagcatcacttgaacctgggaggcagaggttgcagtgagctgagattgcgccattacactctagcctgggtgacaagagtgaactccgtctcaaaaaaaaaaaaaaaaaaaggaagaaaagaagagaaaagaaatgcagggataaatacttgatgtgttcttaaaggggggaaataatcaaacttaaatgttctgattgtaactagggtaaacatgttcttatggacaagaattatagaatatataagataagaattgaaagagaatataaaataagtcactattagatgagatgtccacaaaacattttttaaaatagaaattatttaagtgatattgacaaatgtcaaacatgaaaaacatgttaagtaatttatcattaaaatgttccaaccacttatttaaattcagaataaatctttaaattacttttggagtaaaagaaaaattttaatacccctgtgaggatcttacttgggcaaacgagattttaatctggtggaaatttaatcagttacctttatcttgacataaatatcttggaggcaattatgcaattcataattctagcacatgtgatttattttagaaaaaaagtttaaatattttagaagtactgatatctatctggacatttggcacatttttggaaaaggatctaattaaatattttacttggtaattgaatatttacaccacccgtccatggaaaaaaataatttaaagtgctagctcacctacttatatttaaacaattagatttagcttactttataattctatgtggggctaaattgtttaaaacaagcttttgttaacttcactgcatatacatttaatgaacaccttaatttatttttattctattagatatggttaatgaaattttttgattcttaaaattagactatctatgccataataatgcttcaagtattattagataaatggcaacaataagtataactttaggccaggcgtggtggtgcatgcctgtaatctcagcactttgggaggctgaggcaataggatcacttgagcccaggagttcaagacaagtctgggcaaaatggtgagattgtgtctctacaaaaaattttcaaaaaattagccaggtgtggtggcacatgcttgtattccgggctacccaggaggctgaggcggaaggatcagttgcgtctgtgatcctacaactgcactccagcctgggtgacagagtgagatcttgtcttaaaaaggttgtgtgtatatacacgcacacacatactatatatgtgtgtgcgtgtatatatatatatgtgtgtgtatatatatatgtatttttatatatatatatataaaactttggtgtggtcagtcatcaaatcagtaacacttgttttcagcattatacaccttttctgagggataaaagtgaggacagtatagtttttatctttaaaaaagagctttcactatagttgaggagaaaaacagtagagaataataattgatattctactttatatttataatatattgatttattaattgatctatatgaatagattcacttgatatataaaaggaaaacagaacgagagaaaagtaaggaaaggtagaatatctgatggattagtaaggatatagtaattgatatttatatttgaaactgattggcctaggatcaaggaaatttgctaaagcctgtgcattgatcatgatttaaagagcaaagcatattaattcctcaagtggtacaatgttttgtcattgttactcctgtttattgaattgtttttgtttctgtctgactctttcaaagaacccccaaaaaacaaaagtctcatactccaaaacaaataaacaaaaaacttcaagtgggatcatatatttaagagtaatatttaaacaaatgttaaattttatgcgattgtaatattctacaacacatccaaatgcgttcttgagatgtagaaagaaaaagagtcagtgtgtctatagagtccagactgttttcatggaaatggtggtaccggaggaaggccacaaagagtggagtatccttggtattaattgaaggaaagggagaaagacagtctttatttctattttcatttattcatactaatttgaaaaagtggaagtaatttgtgacaatgcacacaaataaatagattggtaaaatcatatttgaatagtaatacagagaaaaggatacagaaagttaggtcatgaatatgtacaacagttgaacacagatgcatttcctagttttctagaagcacagtaaaatataatggatttaatttcataattatcataatcacaaaaaggaaacaaacatattcaccagaaaaaaatacgcaaataatagtttctcttacattgtactacagaagaatttatcatatgggttgtatttcttctatttgaaacgtgacaatacaggaattgtgtgatagtcttcgtgtcattataagatgcaaaaatattctcagtatatgattatttatagtaaccttctgtaaaaaccaaagacataataaaggcagctggggaacaaaagcggcgaggccgagggctaggcctgtgtcctcccacggacgaccgtgacttcccagcagcccctgagctgggcccgcagggttcgtggggtctgtggctttcacccagggtgcgtgtctcgcccacaggggcaccccatagtgtcataacttcataagtgctcataacttctataatatcattttagcaaagagctaaccaaaggcaatctgggtaagatatttggtgatttcacttataataggatagagctaaaatacaatttagagcaatggatggtttatttgatccatagatttcttctctcaaatatgttatgtcaactgggttttaataagggctagatggtaatcaattttagattgagtactaaaatgagctcctggaatagagaaactatttgtcctgtggcgacaggtgcaggggacaactttagataggtaatgatattttgcaaagttgactgctcattatttttattcccttactccctccaaaatggtttcaagtggcccgcagtaaaagcaactatttatttattcccaaaacagaaacaatctgaaagtaagtgtgtcaattattgtggatgttagttaaaagaagtaaaatggtgtgtgttaggtaattcattcatgtattcgttcagccatttattcccttattctctataaattgagcaatattatgtatgtcattctcttagctattaagtatattgtgaaaaataagatatatgtgaaccttgctatcagtagattgttagctttagggaaggtagaaaataaataattaaacaaatcatatagtttacatagataacgattgaatgcaaagttaattttcttagcaattacctatataaattctagagaaatagtgcaatgagaagggagctactttattttagaaacacagagcagtttccctgaggaggtaacattcaagtttccatttctttttttcttttcttttcttttctcttctcttttcttttctttcctttccctttcttttccctttctttctttttctttctctccttccttctttccttcgttccttctttccttccttccttcctgccttccttcattccttcctttttcttttttttttttaagatggagtctccctctgtcacccaggctggagtgcagtggctcactgcaacctccgcctcccaggttcaagcaattctcctgactcagcctcccaagtaggtactacaggcgcctgccaccacacccggctaattttttgtatttttagtagagatggggcttcaccgtgttagcaaggatggtctcaatctcctgacctcgtgatctgcaggcctcagcctcccaaagtgctgggattacaggcatgagccaccgcacccagccccatttcttatactctactgagaaaacccttgtcaagattcccaaagacctctagattgccaacttcattagtcacttctctgtttttatcttgtatgatcacttcctagcacaggacacagttaaccattccttttttggcctgcttgtttcgtggtatcacccaggattttcctcctacctccctgactgcttcgtctcagtctcctttgctgactcctactctcctaccctgacctctaaatgttgtgcaattaagcataatccttggctctctatccttctctctctatgatacgccttaaagaaccctgtgcattaccaaatgccatctctatggaagtgacttttcaaaaccatgtcttcaagactaacccttcctcagaactccagcctttcatatacttctgtgtaccaacccttccatgtagatgtttaatgaatatcttaaacttaacatggctgaaatatgttgaatttctcaggcctccttttcttattgacttctacaactaagttataatattattatgtcattcttttagttattaaggatattgtgaaaatccttaaattatattataataattaattataatagttaattaaatatatttacaaaattataaatataatatagtcagtaatgaaatactgtaattatatatttaaatttttaataatagttataattaaatctatatctaattataattgtcaaatactataattataattattataagattatagcctagttgtagaagtcaataataacctaataatcattgcaacaagagcaatagtaatggtggccacattcattgaagacttatattccaaaatttgttttaagcaatttacatagattgcattattacattctcacaactctatgaggtagcattgttagtttccagatttcataaatgcagaaacaagtgagtagagaggctaactaatgtatttacagtcacacaggctaaatagcattcagtggtggaaccaggattctaacctctcttaaagcaacactgtactgatgtcattgccttatccatctggatgatcaagtaaaaactctttattttcctaggttttctaaaacgctagatttaaatcagcgaaattatcttttaaaaacctgcattataacagctcacttctctgcttaacccactctagtggctttccattattcatgtagcataaaattcaaacttcatccctgccttgtctggcaaaagccctcatgaagtggtcctggcctgcatttcttagctcatctcaaaacactcttcctctctgttccagtggtcatttatacttcatagacatcaaactttctcccattttaggcattatatgcctggtgtttcctctaccccagatctttgtggggccagttctttatcattctgatttggtttaaatgtcatcttctcagggagatcatccatgttcatccaatctaacaagagccatcacttcgtgccatctcccttttaaaattgtctgcattactgcattacagttatcatccctgattatcttctgtttatattggtattgttcattttgttattgtctagctccacaaagcccaaaatagtttctggcaaaggatattttatcagaaaatatttgttaatgaatttaaactggatctcaagggtcaataggtgttgatcagatgtggtcataaagcggagaaggcagagctgtgggcagaaaagagggtctgggtgaaaaccagaggaaggaaacggttttgcatgctaacagagctcagcaaactcagctggaatgctcagtgttaaataaggttaaaaacataggcagcaggctgtgcagcaccttgttaaagatttaggatttctatgaacaatcagaaacagttataagacactgagcaggtaagtgacatgattagatctgcatttaaaaaatgttttggtaggcctagaccttgatcaaagttgacattctgctgtggatacaaaaagcacggctaatacctcgttaaagtgagacggttggtagtcaatggatgaggcagatattttgctcatagaagattgagggacctgctgaggctggactcactcaggtaagtataagaatctattttttacacaaagagcaacacagattttggcagtttttcttcctttattttgataatggagtcaatcaaaccagcattgtgaagagttcttctgaatgcctgctttgaaggagtgagaatcaatatgagttatatttcagagactggcaaatatgagagattataatatagtaatctataatatagtaatcatgtaatcatgatgcctccttatttcttaatgtttctatggtattaatatggcttcatttaagttttgagttgtcctaaaaaggatatcttattatttttaattattgtcttaatagtctttgggcaaattctgggaggaatttgagaaaatgtggtttgtgattttctcaagttgttaagatcagtgatttggaataagactacagaacatagtatcaaaatttccctcattgctagttaaagcattcttctaggactagaattcaacaaccatttccaggtattgataggactacaactaactaaacaataaacaaaaatatatttagctttctttcagagcagaagtcatccttttaactcattcattcatttattctttcattaattccacaaatatttattaagcagccactatagccttctaattattggtgtttacaatgttaaaaaagtcagcctcaatccttcctctctggacctcagagtgagtgagaaaaaatgacattaaacaaatgaacaaaacattgaatgacattaaacaaataaacaaaacattaatacaaattttgataagttgtatttccaaaagaacgatgtgctacaaaaatgaatttttttgaaatgtagactgagggtttcagcacagttttatgagtttttcctgcatgcatttacaaaattaaatattttgtaagacagataaaatattttgaaataattttaaagctgtaaaataattagaagcagaacaaatcgtttaaaaaagcaactgtggaaaaatgcaaaatccagacaaacaaacagaccacccacaaccaaccaggcaaagttctctatctgaattaaatgagcaaaactggtttgtaaaatagaaaatacacagggaaaatatcccaggagagtgactagcccttaggtagatatttgatctgtggaatggacgggtaaccttggaactttgcagagaaaataaaacgttctcttcttcacctgcctataactctgagaaaagtcatgaagtgtaataaattagctgcattactgactttttaacaacaaagatatgggtcttttcttcagccagggtcagttttttctctctgttacaaaaagacaatgagggcttggattttgctttttaattttgttctgcctttgaatagttcttttttttttttttttccagtaaggaactaagggagtactcccttactttcccatgacctggtgtcatgatctttgatgttctgcccacttttactgatttgcctttaaaatatagtgcaatttcatatgccaagacatcttgtttattctttctaaaatcctttagaaagggatttctaaagtctttccttgaactacttactctgtaaacatatggatactgctccttttcctttgtctttttagttttaatttgcagagttcattttttaaatcagcttatgttagttttcttctttctattcccattgctactacctactcaccttgggttaccaagtgggtttttggctgacccctcatcctctagacctaaattcatatgccaattgcatcccacaccacaaccaggcaaattactttaatccaagagcaccagttttctttagcttttcctctgctccacatctctaaacggttctcactgactctcggatccattccacagttttcctgtcattccagatctgctgaattactttgctcttcttcttgtcaaactttaccttctattggtttctgaggaagccttttcaggcaggccatgctagactcctcactgcctaggacgatcctttccaacagctgacctgccacaaatacccatctttctcaatcgttgtagctctattatctttctcccttcaattctttgggcttcattcatccctctcttctctctgcttccgtggcataagcagcttagtctctactttggtatgcataataccaatcctacttgttatggttatgtatattaactgcttaatatggtagatgactcaccacccaaattaaaaaatatctggttttccaattttattaagacaacagactgctctgcatacgtaatcaaaagtcatcaataaatatagaaatgaattcactgtgtgcccttctcaggatatgcatttctaggaatacagagcaggtagaaagagtggctggtggtatggaatgtgggtaataaattgtattaaccatgtgcttgcacaggcttcctttcaagtcccaaatacatgaggtgaggccttatcctggctaacacggtgaaaccccgtctctactgaaaaattagctgggcgtggtggctgcgcctgtagtcccagctactcggtaggctgaggcaggagaatggcgcgaacccgggaggcggagcttgcagtgagcggagatggcgccactgcactccagcctgggagagagagcgagattcagtctcgaaaaaaaaaaaaaaaaaaaaaaaacgagaaagagtagcaatcctttacctcaataccagtggcaagaaagtctcctggattttctagagaagtattccttgttctgagactataatgcatgaaagctgcaatttattttaaattgaaaatagctatttctacatttcccatattatttgcattcttctggttcctgctcagcatgaggtaagtgaaagcgttggtgctcataagcattagataaacatgaaaatagtgttgaaatgctactttttgaattaaaatgcagtaatccccccttatccacaagggatatgtttcaaaacgctcagtgactctctataactgtggatagtacagaaccttaagtaaactacttctctatgcatatgtacctatgataaagtttaatttataaattaggcacagtactttattaacaaaaataataataaaacagagcaattaaaacaatatactgaaataacagttatgtaaatctagtctttgtctgaaaatatcctactctactgtaagatatttacctattttcggaccatggttgaccagaggtaaccggagagtaaaactgtgagtgagggaagactgctgtacatacgatattgcagaaggataactattcactttatatagataataggctttggaacctgtaactttttgaggctcagcttaatgttgttcatttgtaaagataagaaataaaaggaaattgtttgtagtttaactttgccttttgatacttcatctatcttgaattgaattacaggtgcacaaccattatcacaaatagagatttgggtgcaatcttaaaccaatccctgattaccctcacacccactcatcttttataacagtgtagtcaggaccatagatttaattatattctaaaatttttccccaaatatggaacaaatgacatttctcgactgatttatgtattggtaatttcaccatttacaaacctttttaagaggtgaggcatatccctgagatgaaacatatctaagagaaatactaatttctgttctagtatttgctagcttcttgcatctgagctttgaaaaaagccatctttactggagaagtcagttctctcagagaatatgcaacatgctcaaacagaagtaagttattaaaaacattctttgtggtaatatcaccataattaggagcaattttctgacaggaataagagatgagtttattcctatgttatttaattatgctagaattctttatgtttttgactttgtatgaaaataagctttaagaaatactctttattcttttttaatacaaataaaacaattgcttcagtagatagtgtttttccttaaaatataccacaattttatctgctttaagtaacaagaaattgggattttagtgaatatatttggctcttctgttttagtatcaatctgtactatttactaaagcaatttatagtctacaattcatatttggatttattttttggaagaacatgtttacagagaccacagatcagacatatataactttttccctgattccaagttgatctgcatctatatgagaaaaatctacatagtcccttagcgatattttactataattcatacaatcttgttatttaggaaagtaattaaataaataattcatttacctatttttacccttccttgtgctagaaagtatttgtgagagcatatacaataacattatgttgagatatacataataaatcaggtttagggaaaacagaagacttgaaaaggcaaataattctcaaaatattttccaagttgatgaattgaaactctgccaggttttattcattttttaatatcagaaggttgtgaaacatgacaagtcttcagagaaatcaaagttattctaggcactaagctctgcaaaagaaatttctcctgtgggactttatatgttggggacagttaacaaaaacagaattctatgataaaaatgcttttaaatagaaataagccaaaactgtgtagtttaattttatttacgatccgtacttccatgtactctgtttagttgtaaccatctactccatgcattagcttttctctacctattcagagtcagcatccaagtggaactgctcggggattccaatggccaaaagacccagcaggggtgattaataagtaataatgatttctgtgtatgtgggtattccataggtaaatgttctaattgaatattgttttgcatgagaaaactactgattataggttgaacatttctaatccaaaaatctaatatctgaaatgctcgaaaatctgagtgtttaaaattaccttctggctatgtgtataaggtgtatatgatacaaattttgtctttagaattagatccttattatgtatatgcaaatattccaaaatccaaagaaatctgacatttaaaacaattctgatccccaagcattctggctaactgttactcaagctatatttcacttttctgatccgttaatataggaaatctgaatcaatgggtttgaataaaaaagagcttctctgtggcttgccaagttcatcagctatctttaagaaggagagataattgacttatttttcttttttaaaatgataccatataattaagaaagccaaatttttgttttctcttattctcttaaaaaagatctacttgctatattgtccctttttttctttttttgtacaatgcttctgttacagtctttatataatagtttttaaaaacctgctattttttggaaatagaattaaaattgagtaacttcaatttaataccatgtcagttaattctctaagactgttctatatgactcaagtggcatacagtagatgtcagtggaaattcctagttgcatcaagatcaacaaatcccaattaaagatattcgcatataatttttaagtgtacctatatatacaacttctatagattaaaaattggtctattagtctaaacttgaatctgtcataagttgtgagtctgttcttttaaatgtttcttatataaatctctctatccaccacctactacttttggatcggtgctgtctaacagaaatatactgcaatacacatacataatttgaaattttacagtaaccatgttagagaaaagtaagaaaaaatagataaaattagttttaaatctttatttcgttcaaactaatatatccaaaatattatcatttctaaatgaagtcaacataaatttattaccagggtactctgaattttttattctttgaaatatgctatgtactttatattgtacttacaaaacatctcaattcacatgctaaatcttcaacagcacatgtagtagtcccactaaacaatacagttgtgcataacagaaaacactgtttggcgctgcttcatttaaaaaaaattaaatcaactaaaattaaataaagtaaaaaaatgcagtaacacagtaacatgagccacatttcaagtactcaatagtcacatgtggctattggttaccaggtcagacaacacacagttctacattgttgtaaataaagtttttaattatacacacctgttgggagaaatatttgcaacaagaaccctcaattcatggaagtatttataaattatatacatgtacatgatatgaatatattatgtatgctataaaataatagaaattttgaagattaatgagtattttaaaataatgttattttcttgttaatttaaaaaaaaaaaacaaatcttttttaatgctctgtgttaggaaaacacttcgttatttttaagatattccttttacattttgttttccagaggtttggaagagtgtttctaagatcagtttaatgtttggttttaatggctgttacagctgaaagagatgattcacaaagacacaaaagtacaataacacatttaaggagcagttcattgttaatcacagtatatttaaatccacataatagtcttatggataattctgagagctgaatacttgtaaaataggattaaattgtcatggtttctaccttgtaatgtggttggctaaaagctcattcttacagccaaaaggaaaaaaatgtcagctttgccattttatgtgactcattggtacttgtacaatcttcaatctgtggtttatttgcaaaaatcctttgaaccacttgctccatgcaaatgctagttttattaaaattgaataacatagacactaaattcacttaactaggtgcatgtaatcaattatgcccttgtttattgttgtttttaaaaaattaaataaagcaatgtgctttaaaacaacaaaagtaaacaaaggtgtaaggggctgctagacatctccctgccctcaggggaccgcatgtgctgtgtatgacatgtgtgtattgacatgtgcacttatatgacatgtttgacttacataaccaggaaagggtatgtatattttaaaagttagatttcttttttcttttataaaagatgcatataaatacaggttttgctatttttctccaacactcatatgatcgtgctgtgtctcccttgactaagcacttaaccattgtgaatattactaatctaagttaaaatgctccgtatctataggaatatgatttagtgacgttgtgtactgatttatggtttgaagattttcctcttattaaccgtatgtagccatttcaatatatctaatggaagtaactagaaatatctttcattgactagcgttgaacaccatgattttcctaaagcagattagaaacatgtaggttctttcagttttgtgagtatataaaaatgatatccaacaatctggcagccctaaagtgggcccaaatagccacttagaccttcacaaattgtgcccaagagaaaatcacagaaaactgtgccagccaaagaacaagtgacaaaaatgaaattaagatttctattttaaaaatatttcttattttcattcactttataagaattcaggttatgcttttttaaatttttggctatgacactctgctgaaagggattgagaaagcttttgagcaaaaattatttttgaaatgttgagagcatgattaattttcatttatttttaaaagtaaatttaaagttggaccatttattttcaagtggcatggcaataatgaccaattggaaatacctttttgcatatttaataattcttagtggaaaaaatgataagagaatatgccattttgttcaatttcaacattgattttgatttttatatcctttgctcagcctttgtagtgattaatattagtaagatgtattctgttagttaaggtttttcgttttattctatttttcccacagtatataattattattagaaaataatggatgcttacattgtgttctccaaagctcacatagttcccaacgaaattagtggaagcttacctctatttaacctgatctttatttacatggtagttgataagctgctttccactaatgagaattacatctgaaaggattagatctaagaaatggtaaaattaaaataactatattcatcattttgatcttttatatcagatcctaacatgctggagttttctcaggtgaaaaatcaggcatcttttgctacaagatatgttctctctagatcactaagatagcctaatccttaactgtgattttggtttttttaaataagtcttgtggtagagcaaagtagagttcattctgagtcatggctcagatggaaacaagcaaggttacacccaagactcaattaaaatcgtggctcatattctagtttatacctgcacctatgagacatactaacacaaaaaactaacaaatgtagttttttttaacaactaaaagtgcattagctgtgtgtgtgtgtctgtatgtgtaggaggatgtttctctgtcagccatgataggcaacattctgctgcaggaatagcaaactcaaaatattagtggcttaaaatgacaaaaactacttctggcacactcagtttcctctggaaatatagaaaactcttgatcaactgtcctccatgtgacatttctgtaactcagactgccttgatcttaatcttgtatctctgccatctcaatacctgacctcctcatttcctgaggtagagaaagagtagtcacagggttccacattgccctttcattgcctcaacccaaaggaacccataacattggctagaatgagagatacagctacacttaactgcaacaggactgggaaatagaaggaaacacatagatcgtgtcatgagcgttactgcctcagccatgattccttactcatttgatcataagcagaatacttaaattttcatgtctgatttctcagagatttatcctgaagttccttataaatagtttttcttcaaatgctggtttgcagtgttctgaaactacgggcttctgccgagggtgttaatgatgattcattcggttgaaaaacaactaggtaatttatcataggctagatattggggatacaaagaggagtgagatgcagtgcttctgacctgaaggagcttactgattagttttcaaaaaagatgtgtaaacgtttatattatactggtaaatgcattctcccatctattgaacaagtgtttattcattgcctatgaggtgccaggtcttttaatgggggcttgacttagcagaaaaaggtctctggtttgcagtgattatattttagatgggggttggaggaggtatataggaaacaaataaacaaaacagaaacatatttcatcagcaagtaatatgtactgtgaagaaaataaaacattgtgatctccagagaggaagctggaaaatctacctctgattaggtgattaggaaagaatgctctaaaatgggaccactaatgcaactacctgagcagccatacattccaagatctgatctggggacagaacgttctaggagtaaaggtcagaaaaaaacaagtttcttctcttgtaattagttagactttagaagacaggccagtggcactggagcatagtatatcaggaacagagaggtaagggatgaatttgaagaagtagggaaaatccagattatgtagagtctgtaggttgaggtaaagattctagtgaagagatataaataaacatacgatatttaagggaacaaaattgcttctgttatcttaaggctgggcaggagatcagagaaaactgttctcttcggagagaggatgcctgagctggattttaaatgaggatgagtcagttggccaagaagtgtggagggtcagtacatgcagaaaatatttagcagcacatcaatagcacagctgaaaataagaaagcaatgatcagcatatatttgactgtgccaagaacttggaagcatggaaaacagagacaacaccttaagaccctcatcttaatgagggatcatatatatttatgatatgtgtgtgtgtgtgtgtgtgtgtgtgtgtgtgtgtgaatgagataaataacatttattatggaaattggctaatgcaagtatggaggctgagaagtcccaccattttccatctgcaagctggagaaccagacagagaagctgatgatgtagttcagtgtgagtcttacggccaagaattaagagcactgatgtccaagagcagaaaatagatgttcctgctcaaatagcctttctctgcctttttactctatctgaactctcaaaggactggatgacacctgcccacattggtgagggcagatcttccttactcagtatactgatttcaatgctcatctcttccaaaaacaccctcacagacaacacctggaaataatgtttgaccagctatctgggcatcccttagcccagtcacattgacacatgaaattaaccattactccatattaatattctgctggcttaaagaaaactaaaggatattttataattttcataatttggggtttgctaaaattatttattttattcctgtgatttaaacttgataatatatgtatataatagcataatttgagttgctgtcacatcatgtggacacttgatttaaacatttatcaaatttgaccatgcagatttctttctatattgtgaatccattaatgttttttcatgacttaaacatttttgtggattgttacaaactaggaggtctaaaacactgggaagtatatatccaggaacacgggtccccttccaaatgataaaggcagataagtgggagctgtcccaggatataagagtttttctgtgttcatccaacagatattcacagaatatccttctatgctagatactgatctaggtattggacacagagcagcaaacacaagatacaatctcttttaccttttttacctcatattccagtgagacgatgcaggtaataaataagtaaataaaatacaaagtatgtttgatagtgatagatgctgaggagaaaaataaatcatggaaggtggctgggaaatttggaaaagtggtggtaaattatagtagggtagccagagaaggcttttgagtaaagacgtgattgatgtgagaaaatatatcatgttgatatctgagggaaaagtgtttcaggcagggggaaaagtaagagcaaagaaattaaacagagataggaactaggttggttgtgaaacagaaacttggcctgtaaatgagatcagataaaccatgagagtagggtaatggcaaatgttgtagagatggcattgggaggaatttgttgctttttgggggggattaatttggaaaggcactgaagaactttaagcaataatgccatgacctcagtgacttcctagcagtagtcccttggctttctgtattgagaacagtttggagaagagcaagaatgcaagcagggagaccagatggaaggctactgcaataatccaggcacaatatgatggaggcttggaccaggatggtgagcgtggaagcagtgagaagtagttttatgttctcagtcactgcaagagggagctttcatattctgagcgggagaagatggcatgaggaacaactttttggcaagacagcatccagttagggtagattaaatttgaaatgcctattaagtatcaaactggagttatctatttgataattagatacacaagtttagaggttagaggagaggtcaggctagagagaaaaatccaaaatccaaatatgcatgactttcagatttgatttttttcctttaaaatatttaattgataaataaaaattctatacaatgtgtacaatgtgatgatttgacatgcatatacattgtgtactgattaccatagtcaaattaattaactcatctatcacctttcataattaaaatttcatgtgtggagtgtgtgcgtgtgtgtgtgtgtgtgtttgtgtgtgtgtgtgtgttaagatcacttaaagaaactgctcttatcaaatttcaagtaaacaatacagtattattaattatagtcactatactatacattagatcccaagaacttaattcattttataactgaaagtttgtaccatttgaccaacatctgtgctctggtagaatttacctgatttgttctctcaaattcctttcattcacatttttgctgattcttctgcccccttgccttccaaaagttgatattcagcccatcttaatatgtggccttgagcatagccatgtctaaaaggttttgagtaatcatctgtgatgtttccttcttacctacagtaaatagctaattgatccaaacgtgccctgttgagtggtcataatatttgcccggtgactttgggtaggttatagaattacagtgggtagtgtgggggggggagggagagaataaaaagaagtctttgtgtccaactgatttatcaatatgttttcatccatttaaattatgtttagttgaacttatctgagcatgtgaagagatatctttttaatatagcaatctatgcacacatcccagtatgtattcatcgagatttataattctgtaatttcataggtcagttaatagtattcccattcaacccccaggctgtcataacttatgacattcaagtgtatgtttcgatacggtcttagccaagggaagtcatgtagccagtgaagcagagagaggaaagaagattgccatagttgaatctgtatcatcaaaatgataaaatgggtctataataaacaataggttagtggcttgatatgcctaacagcatccactgcagtgcacaacaggcaagttatttatgaaatgggccttttgaaaatgtatagcttttataatctgaatctcatttctatgtcctttccaacaaaatagattggcattatccatctatttgggacacatggttgctttattattttttaaaatatgacaccttatagtcaggaaatattgaggaaatccaatccatacaataaatgaaactcataaatatatttttaaaaaatctctcttgtggcatttgaatttttataattcaggaaaaaataaaaaatcttctagaattcaaaataatataagctagtgttattcatatattacgtacattgcacccataaataatactaatgatgaattaactgtcatatgtactagccggaaaggttagtcagtcagaaaatgttctggaggaatcatgtgaataactagtccatgtttaccttgtacttctaatatagatttttatttactcttagttccacatgagattgaagttcaggattttcaaggagactaacacagagtaacatcaatgaagaatacacttgacttctagccttcttcaaaaatagggagatcgcttcagatttcatctagttatagctctcaatttggtcaacccaatatccccctttaaaaataatattttcacttaacatcatggtctccaattccatccatgttgttgcaaatgacaggatgtcattctattttatggctgaatggtactccattgtgtatatgtaccacattttctttatccattcatctgttgatggacacttaggttgcttccaaatttaatccctcatagctatcctgaaaaaaaaaattcagtttagtatcatattacctacctgcacatacatttgaaaaaggtatatatcaaccacatctcttatctgcaaaataaaagagaagataaaaggaaaataacttttaaagaaatgtgtgtttcaaagtgcaagttttggatgaggacggtgctacaaggcataataaagtagacaaatgcctgcccatatacacagaaccactgtgaacacaactactacagtggcaagatgacaaacactggtgcattgtactgatggctcagttaccaccagtggcattgccattggatgttgatattttctgagatagtataaacatcttgattaaatttcaaataaaaaagtacaatgtttgtactttctacaaagtgccataaacttctttaaaaatttgttatatgaaaacaggaagatgtttttttcataacaatcacgtgcattttatggctgtctggcccaatttatatcagttaaaaatatacccacaattttttaaaactttttaagtgagaatgcttgatttagaactggatgttacagtcatataccattcattataattcagtagagacacatacataatctgcagagaaatatttagattctctttctcttcgttgttttctttattcactttagagattgagtaaacaggctatctttataattattatttttcatacagctaagtctatattctactttctttttctttttctttttgacatatagtcttactttgttacccaggctgctgtgtgatggtgcaattatggcttactgcagcctcaacctcccaggcttacgcgatctttccacctcaacctctcaagtagctgggccacagttgctcgcctccaagcccagctaaattaaaaaaaaaaaaaaaactgtagagacagggtctcactgtgttgcccagtctggtcttgaactcctgggctcaagcagttctcccaccttgacctcccaaaatgttgggactacaggcatgatccactgcacctggcctttacttcattcttaaaagaaaattatttctcctgaccaatgaatcacaaaatttctcatgtttcttccaatgcgtatctactattctattatcactggaaaactttccttatattaactattgaatttattgtttttggataatacaggattgatattcttttaatttcatgccaatttgtagccatccgaagtcttatactgctgcccttgcaaagagaaatctctttaattgggggaggatgtttgctagaaaagtttatgtaaacattaaaaacaaaaaggtatgtatgaaatacttatcttcctttaaagaacaagaagactattcaagatataaaacactacggttcatcaaagctatttccttgtgttgtcaaattttgttaacttaggaaagtatgaaaattaacttctatctcacgttaaaaacacatcgttatacttaactagtttttatttttaaagtaatacatgtacatgattaaataaataaatatataaagcctagaaaagagatattaagaaaagcaattttctcttcaacctaggtttgatcttctttagtggcaacaattattgtttgcttgtttatttctatccaaaaatttcttacacaaataagtcttgttaatttttctcggtaaaggtatattggcaatcttttctggtcagcactcccagaaactttctatttcactacgggatgcagagtattgcatatgtggatgaaaccatatgtgttcacaggtgataaatatttaggctattacatattattacaatacaataaaaatctttcttgcacattacattttatacaaactactgaatatagaaaaaattgagaagtgggattactggattacagtatatgtgcatttaaaattttcatagagattggcaaagtgcattgcaagagattgaaccaaattacctgctctcaataacatatgcgagtgtgtaacttcaaaaacccttttactgtgtattttcaaaccatgtgcactacaccatttggtttggtttaaaatatatgtcaatttgatgtgcatttatttaattatgaggaaaataatctatatggaatttaatatactttttttccttccatggattgcttatttatacttttgttggtttttaaaattatattttaggtatttttttaaatctgtactaaaaaaaattagttttttttgtcctttgtctatgcatgctgcaagtagtcatagtttatcctctatcttttatttttatttatttatttttttgagatcatttcccactttcttgtccaggctggtgtgcagtggcacaatctcggctcactgcagcctcaacttccaggccacaagtgactctcccacctcagccccccagtggctgggtctgcgggcatgcaccaccacaccctgctaattttgtatcttttgtagagatggagttttgccatgttgtccaggctgttctcaaacttccgggcctcagcctcccaaagtgctgagattacaggcatgagccaccgcacctggccatcttttaatttttcatggcatgttttctcctataggagtttaaaatttgttatatagtcaaatatacattttttttcctatatggcttcaagattctgtgtcttgtttcaaaagaccaagactattgggtgttttcaagtcactcagatttttttaaataatccccttattttttgtggtttacttctcaaacttaaaattgtctaggatttattttagtatgtagaaaataagacttactttggtacatgaaagaaaaaaatcaaactttttctctcaacaccatgtttttcttaattggtaggcccaatgtcattcattaatccatctatttctaattttaagtgttaacttttcatattacacattcatattatagtcacactcttatattccattctgttctatcttttaaattagctgtatattctttgctcctaccaaacttatttaattaataaggcattacaatacattttgatggtgggcatggctaaactctgctctttattactctttattttttggaaaattcttgatctttttcacgttgtatttttactttatatattttaaaatcagctcctctagttttaaaattttactatattttattggaattccattaaatatttaggaagaactgatctttcacaacattgaattattctttagaaaacaggtgttttccatttattcaagtaaagcttattggttaagtgaattttcccatttacaagtgacctaaaattcttctaagttctctaatgataataataataacaatgcttaccacttagggtacattatatctttgccaaacactatgctacaagctttacacatactatctcatttaactcttacaccatgcaatcaaatacgtgaagaaattgaacatcagaaaagttaagcaacttacatatggtcacagagttaggaggagattatcaaactcaagcccacacaaatttaagtctcatgctgtccctcactatgctaaactgtatttatctctatgtaatcactctcattcatcaagggaaaaagggcacttacgaaactcaacaggggatataacagaggagaaatcctgtgaacttcacataagaagaggcgtaatctctacgcttttcatcacgccagcaacaaaccagaataaaggccattgctctgttggcactgaacttatgtgtgctgcctaattctggcaatgaattcttacccaaattttctgataactaataatccctctaaatgtatcacaggagaaaatattttataacaatttgtagagttttcccctatttcttttgtctctttgtacagacacaatctcacttgaagttggtagtgatttttgcagtagactctgagcattatagtttatcagaaatttattattttgctttaaacattgcttgaaaatgttttctggactttgatatatcgtggttgcttcactcttgtatcatataagaaataataattatgcattgatagtgcatagacaagtacaacaagaggaaaggctttttaataaaagatctttttattttactctgcacttgataagagggtaaaaccttgcattttcctggtgtgatcattgaaatttgcaacagaatttaaggctggattgttttctttggatacatatttcattatcaatcatctaagaaaagtaatatttcatgtttaatagagataaagcatatatattgaacaatacatgttagtatatgtaatatatatggataataatatgttcaaacacatacacacacacacacacacacacacacacactttttctctcatctatgcccttgtttatctccaagaagatttaaaataacatttgggtacaacaggtatataaaactcaaagttttaaatattgaattaaagttatgaattgcaatcaaagaatataaatgtttccttaatccaagaatactagatgtttccttctgagagagaaagaagaggcgaacatcagttgaatcttgagaatgagaaatttagaacaatcagaatagacataaatcaatagataagggaatttgaaaaataatatctttatatatacattagcatttgtgaattatttttacaattcctatttcccttgatcctcacaaccgcactgtaaggttgacaaggaaagtattaataaatccattttgtaggtaggatgtcagagactcagtgatgttagcaaggaaagctccactgatagttattgcatgcccagcactggaacttgcagccaggtaacttcatgcctgctaaaaatataacttcaaaatggttaagatgaatctgtaacataaaacaataccgtcatgactataggaaatatgaagacattagaatattttggattacagccctaactttatgatgcctagtatatcaaatatcaagcattgtgataattctataatgacttaggtatcttataacattgttttcattataacattgttataaaacatattggagttttaagattttattcataaaacaattattcattggggttagcaccatattatcacaagtgctgttgcaattattacaactaatactatagtagtaataatcatactactactaataataatagtttattgatttatggaccttaatttacatgcaaatcagaggattttgtaacttttcttttaagagaaaaatgtataaaatcctcataatatgctctcaccaataaaacaatataattgtggaaaataaattatagttttgtcagattttcttcaacggcttcttccaggctacatgaatttgttgatgttgttagtttcacacttaaatgtggtattatgattcctgaaaaacttccttgatttttgaaactcaacttccatctcccccattactgagaaaggatatttttcagatgcccatcaccatccatgtggcataatctttctatattcacaaagtctggtacaatcttatcagtggaatcaaaagttagaagagtgtggcatttcacgtaacttcaaattaaaatgagcatttcttgtttggatttttctaaggccatcaacaaaatgataatgctcacatgggtaaagggatgctgaatatgtaattgcttcctaaattgatctaaaggcttgatattgatctactgggtaacatgatattcatctttgaaaaacactataatatgtgttatgaaaatcatctaagtatatttacataatagatgttaatacctgttttggaactttcagatcccttttacatatttacatgatggactgataatagtaaaattgtaggttgaagaaacaattttcttctttttccccaaactaaacataaaaatgagaagaaacaggaaattaagagtatgcgattttcattcttaattcatctccttgctggctcagactacagctactttattttttaataaagacaaaagatgtttttaaagtttttaatacatataaaattaagtaaaatcaggcatatactttagagtaacattttcattaatttaaaagtgtatctatatttaaatgcactcatcataattattatagaataaaggaaaatatgctttgggacagtaaacatagacaaggctttgttctttatgaggcaatctgaattttaatagcatgtctattataaaagtatctgaagactctgaaaagccttttgtttcataatgatattcattaatgtacaatatgttgagtaaaagaaatggctgtcacctaaagtagactctctggtttctgaatcttagcagggaaaaataaaaccagggaactgagcattccaatcctaattccactgtacgagatggcctacatttgtatacatatattaaatttctaattaattctttctactgcagaggatttttccaagcatacttacatatacatttaagttatttttctttttaactatggcaaagcatgagaatataaaagaataactagccaaaatgtttgcatgtggccatggggaatgtcagtgcagttggagggaagtgggactgtatgcagttctggtgggaacaggtggagactgtatgcagttctagagaatcagtattactgatttgaaatttttttgtagcttcaaaaattggtatataaacttgtatgtttgaagttttacaaatggcacacttaaagctgaaaaatatttaattagtctaattttgattttgtagaataggaaacagtgtttcacaggtaagagatattacgtgatgacaggattgagtgtagaatgagatttttttgattcccagctcaaggtttgttccttatacagtgtctgattaacttgagcatttgtttagtgtaaacactaaattgattgtaacctggtcaactttctacactgaccagggaaaattaaaaaaaaaaaggttttataatctactgtataaaaagaacattttatcctttttttaacatcaagtttggccaagaggatagccttataaaatagatatgataaccaaatttttgataatttacatttactcgtattgctttttgtttgaccagcttcaggttcattgcaatatttatctaggaaattaacattgaacctctacataatggtttgtttagttactgatttaggttaccattttatcaagaaaaaatttgtttagtaattttgtgtacctgtaaaaatgtttgccaaccctagtcttaaattcattctcctagaacatacgcttaataagaactggggatttatctgcctgcttccatgctggactcccagcctctaaatccctgcctgtcaaaagagagactttaaaaaaaaaatgtcgaatgaatgaatgaatcactgctgcttttgtatgaaacttgtgagaaaaagtgggtaatgattttggtagagtttcagaatatttccaagaacttctgaattgcttagagaaagagaaaaatgggacttatgattgctgaggcaacggattctatactcatagagtgaaattgtctctatgtttggatcctgagaatgtgtgaataaaaatatgatgagcaagcagtctacgtttgactgatgcttcacatgaaaagtcttactgatatagaagtgtatttttttggtatacattaatccagttcaagatgctggaatgtataaattattttttattcagaaagccatttttcgtgtcttaattttatatcatcaggaaccaaattttgcagataaatgttgaccctcacagtattctttttttttaacttcttgaattggatgactttttttttttttttttacagattaggattcaagcaagcaggtaacttcacctttggttaatatgaatagtaaacaaaaatccatcacccttttcttaatttgttaaatttatgtaagacaatactcataatattcattgctctagcattttcctactttttcttttattttgaagtaaatttggaaaacagaatgtttatgtgcctataaaattgtcatattcttaaacaatgagttttcacacagtcatgaactaggccatgttctcagcaagataagatcctgaacatcctcagagaagttttttgtttgtttttttgtttgttttgtttttttgtttttttttttgagacgaagtcttgctctgtcaccaggctggagtgcagtggcgtgacctcagctcactgcaacctctgcctcccggattcaagcgattcttctgcctcagcctcccgagtagctgggactacaggcatgcgccatcacgcccggctaatttttgtgtttttagtagagatggggttttaccatgttggccaggatggtctcaatctcttgaccttgtgatccacctgcctctgcctcccaaagtgctgggattacaggcgtgagccgctgcgcccagccgagaagtttttaaagctagtgtgcactttaaactttcattaaagggctatgcctataatgcttaaagcactcaaacattagcagcaattaaggagtaggaaattcaaatcatctggaaaaattagtgcattgcattaggaaatgtggtattatagatatagctaaaagccctattcttattttcccaacttataaagcaactgaggcacagaaatatgtaagtaacttgaaatattcatgcggctagtgtggtagatgtggacatttaaacctagagacaacttaagctagagattccagcttaaccactgtgctattttacaaatcgcaacatcgacatattcaaggaacacatatggcaatatatgtgactctaaatgccattattgcattttattggacagagtcctgatttcatctacctcaggtgctaaattcaagactccagagttgccttaattgacaaataaatatactatcattcaagaaaaaggggacaaagtcttcccagatcatctgaatttggggagaatgtataaaatagaaataataacttacaacaagcagttctatggactaccataaaattatcatatttggtatttgatttgggttatatagatgtagctagtgatataaatataaagataactaatttgatagagttttcaagtatttccaagaactttagaattgcttaaaagcatgtaaaagtggagagtaatcactgtgaagttagtagtttctatgctcacagtgtgaatttgtcagtatgtttgtaattcttagagtgggttgacatctgtaattttaacaaggatgctagaagaaatgaggttgtacaggtaagctgaagtcaagttgtaagggtagtaaaacctgggttaaggcttcaaacaacatatttttatctttgactcctccttccttcatcgaatcattaggtatgctttaatgtctttgtcacaaacaatgaaatattcctctcttctcatactcacatttttattgcagtcacagatgctgtgtatcctctttccagtctcccatcattatgtacctagttattatctaccactattttcttaaccacagtgcagctacaactttttgcctcaaaagcttttactagatttccaatcttaatttgctggtgaaattaaatataagaaataccctaacccacacgttaacatcctcacaacttaacttcagcttacctgtacaacctcatttcttccagaatccctgtaaatactgtagatgtcaactacaaacatatagacaatttcacactgtgaccatagaagctcctaactttgtaatgattattccccactttttctcagtgtctaagtaatcctaaacttcttagaaatactttaaaactctaccaaataaattatcattgtatctatatctatagttatatatatatatatcccaaatcaaatactagtcaaatgtgacaatttcatggtggtctgtaaaactatttgtagcaatattacaagtggattgttacttctagtttatacattttccccaaatacagatgatctggtaaaacttcgtctcatttttcttgaatgagaatatatttatttctctattaggcatctttgaaaagccttgaatcttgcatctgaagtagaattcaaaattgagaggactgtcttggcattcataaaatatgtggaacaggaggaggttgttaagggggaacagaggatgaattcagctatttgtgtttgttgatttaaggctgtggtgagatagtgaggtgataatattccctccatgagcaaggacaaatcctgttgtgaagttctggaggaagccattgattggagaggtacattcggatggcatgcatggagggagggcacagctgaagtctcagtagcaaatgaaattgctaaaaaggaagactggagaacaaaatgtataaaggtagaaactttgagaaaactgtagaagtagaggagtcatggcaaagaaaatggatcagcctaagaagcactggagtgataagaaatagcacaggagagccaaaggatgaaatatgatgaaaaggagtggttagttccttagagaggcaatggaaaaatgctagttattttgacagtcatgggtgacagttcagaacctcatttttatagaatagtagggacagtatctcaaaaggttaagaaatatatgcttaatgggaggaaaaaagcagcctgtattagtccattttcacactgctgataaatacatacccaagactggggaatttacaaaggaaagtggtttaattggactcacagttccacatggctggggaggcctcacaatcatagcagaaagcaaggaggagcaagtcacagcttacgtggatggcagcaggcaaaaagaagagctagtgcaggggaactcccatttttaaaactatcagatttcatgagactcattcactttcacaagaacagtgcagaaaagacgagcccacataattcaatcacctcccaccaggtttctcccatgacatgtgggaagtgtgagagctacaattcaagatgacattttggtggggacacagacacaatcataacattccacccctagcctctgcctaatctcacgtcctcccatttcaaaaccttcccaacagtcccccaatgtcttaattcatttcaccattaactcagaagtccacagtccaaagtctcatcccagacaaggcaagtcccttctgcctatgagcctgtaaaatcaaaaccaagttagttacttcctagatacaatgggggtacaggcattagataaatacagccattccaaagtggagaaattggccaaaacaaaggaactacaggcttcatgcaagtctgaaatccaacatggcagacaaatcttaaagctccaaaaatgatctcctttgactccaggtctcacatccaggtcacgctgatgcaagaggtgggttcccatggtcttgggcagctccgcccctgtgactttacagggtacagcctgccttccagctgctttcacaggctgacattgagtgtctgtggcttttccaggtgcatggtgcaagctgtcagtggatctactattctggagtctggaggatggtggccgccttctcacagctccactaggcagtgccctaggatggactctgtgtaggggttccaaccccacatttcccttccacactgccctagcagaggttctccatgagagccgtgcccctgcagcaaacttttgcctgggcatccaggcgtttccatacatcttctgaaatctaggtggaagttcccaaaccccaaatcttgacttctgtgaactcacaggctcaacaccatgttgaagctgccaaggcttgaggcttgcactttctgaagccatggcccaagctctactccacatttgcccctttcagacacagcttgagtggttggcacacagagcaccaagtccttaggctgcacacagcacagggaccctgggcccagcacacaaaaccactttttcctcctaggcctacggccctgtgatgggaggggctgccatgaagacctctgacgtgccccgaagacatttttcctattgtcttggggattagcattcagctcctggttacttatgcaaatttctgcagcaggcatgaatttctcctcagaaaatgggattttcttttctattgcattgtcaggctgcaaattttccaaacttctatgctctgcttcccttaaaaaactgaatgcctttaatagcacctaagtcacctcttgaatgctttggtgcttagaaatttcatctgccagataccctaaatcatctctctcaagttcaaagtttcacaaatctgtaggacaggggcaaaatgctgccagcctctttgttaaaacataacaagagtcacctttgctccagttgcaacaagttcctcatttccatctgagaccatctcagcctggactttattgaccatattactatcagcattgtgggcaaagccattcaacaagtctctaggaagttccaaacttttgcacattttcctgtcttcttctgagctctccaaactgttccaacctctgcctattacccaattccaaagtcacttccccatttttgggtatcttctcagcaacaccccactctacaagtatcacattactgtattagtccattttcatgctgctgataaagacatacccaaaactggataatttacaaaagaaaaaggtttaataggactcatagttccacatggctggggaggcctcacaatcatggtggaaggcaaggagaaataagtcacatcttacatggatgacagcaggcaaggaagataagcttgtgcaggaaaactcctgtttttaaaaccatgagatctcatgagcctcattcactatcacaagaacagcacaggaaaaacccacccccataattcaataacctcccacggggtccctcccacaccacatggggattatgggagttacagttcaagatgaaatttgggtggagacacagccaaactatatcacagcccttgttgtttgttctgtcaagaagtttggtagtagagtaagacagagggggtgtttcgaggagaaacagagttgagaaaaagtgccttacttattttgtttttatttattggtagaatgtgtgggtttgtttatatggtcaggtctatctgtaggattgatcttgcatatttttatgaaaatttttgaaataaaaacaaaaatagttgagaatgagagtttgataagggaatgcataattaatagaacacatttctgaaacacaaggaagaagctgaggtacctgagcatggaatcagaagaccttttcctcaaacttcacagcagaggcagaaaaaacaattcatctggtttcatctcctctgcatttagagttcttgatttaggctgtgagtattttaaggaaggaagggacaatgaataatgtttgtgattgtttcactgtagacatttcttgaacgaagtaagcatagttctagacttttgctgcatgatcattcattgactttctcattcatttgacaaattttattgagcctgtagtgtgagttacacagtgtactagaaagaaaacatgttgtcactacatttaaggcggttcatagtcttctattttaaaataaccagccattataatagaaagaaaattctgacatgtgaatgaagacattatgttatgatctgtggaagttctttgtactcataaaatgccatgcatttaagacagtatctctagggaggaaattggtttgatgggtttggaggaagaccactggattaggtgaaaagttttatcaatgaccttaaaagatagtggttttcataaaatagcatctcacttttcatcttgttagttctgtgttaccaccattcctgctgatattgttgaataaattctaatacattagcaagctcataaagctaattatagtggaacaaatatgtttttgaggtagttccataatgtgtaaggtgagtctaactcagtagtcgaatcctggagttttattacacaattaatacatactggggcctgtcttattggaccatcaatatatggcttgtatgtactgggagacagtaagccaaatgccatctactttctattatagagcatctgagtgaatgatcctctgttgaagcaaaaacaaagacacaacataaacaaacagaaaaacacactcagaagtatcttaatgcaatgagaaatctctgttgtggcgaaataatttaatattttcagatatttctctaggactcaataatttttacttaagatagatggatagatagataggtagatgggtagatggatagacagataggtaggtggatggatagatagatagatagatagatagatagatagatagatagataaatagacgaattattccaggagtaactcaataggaaacataaaatgttaaagctggtaggttcttaaacagaaatctgtctagtttcttcatttataggtgaaaaactgaggcaaggtattggtagaagaaatgagctggattccctttatcttgactcttagatttttttcaataatacttagttcttagtttttcttaagtgttttttaattaaaatttttttcgatatcatagtattcagtcatataaccacctttgtacttatttatgtgttactcatctctaggatggtaatttccattctttttgtttttaaagatggggtcttgctatgttgcccaggctggtcagctcctggactcaagcaatcctcctgcctcagccttctgagcagctgagattataggcatgtaccaccactcctggctaggatggtgattttcttcataaataggagcttcactttgcttcttgtgtccccagtacaagtataattcctaaaacatggtagattaattttaaatattaatataaatgaatgaatgaaccatcttttctaaattctccagttaaaattccatccagtcttactgagtgaagacttattggaaagaaaaggctctttctattctgttagattctcaggcctacaaggtctcagtagataatgggtgacccagggctcagtgcttttgtatatggtaagctatccctagtatttctgggacatttctgagggacatactcccatgtggggtacaatggaagttaacagtagacattcagattactcagagtgggagaggtgagagaacacgtgtggagtatggaatggacctaagcctagattaaaatcccaccaaaataagctgcatgtttcttaattatgctacatctaggactctgacctgaagaaatggggaatgtgatttcatgatgtgccatctgctccctttcccacccccatttctacaaatgtcttgaattgaactgcaggtcgtccttttaggaagagacagataatgacattttactctactgaggagaaaatcgagatatggaaagattaaatcatttgctcaagggtaaaatgaattatgcatgcatgcttacagtattcactccagtgtgtctgcttctctgccttccctgtgtgtcactgaattcacaccaaagtattactcagccctctatgtgttactaaattaaatggaagtatttcctttaattgccatgtgaatagtggacaagcattgtgtttatatctaaataaatcaaggaatcatggtagtaaatatctccttgatgtatcaatagttaaaacatttttaaagccttgttttagtgaataccttttttttaattgtgttatgaatgcacaagaaaataaaatgttaaactgcccatgatgcttaataatagtccaaggtggttgtcttgaaaagtatataaaagatgcctctcctaaatgtattcctttatctgattaaatgattaaagagccactgtttgaaatgatgaactttccagacagttaaatatattcttgccttaaaaaaatactgcaatgagaagcttgtttaaaagatattttgggattgtattctaagatgacaactgatgaatagctttgttttgctatttttttggtcagaaagattgtttatacattacttagatctctcaatgcatttttctcacatcttaaagatgatatggttttttatattatttaccaaatgcaaattagacacaaagggaaaccagacattttgatcaagtgctcaattcttcagataaatgtttccaacaatgatggctaccagctatattaaaaatgtagctttaaagactggcttattacaatgagaagtttttaaaaagctgtattctattattttacacacttaaaaatttgttttcattatcagaagataaaaatatattatattttaaaatgtattgtattattattttggaaggctgaggcaggcagatcacctgagggcaggagtttgagaccagcctggccaacatggcaaaaccctgtctctactaaaaatacaaaaattagccaggtgtggtggcatgcgcctgtagtcccacctactcaggaagctgagtggggagaatcacttgaaccggggaggcagaggttgcagtgaaccaagatcacatcactgcactctagcctgggcgacagagtgaaactccatttcaaaaaataaataaattaattaaattaaattaaaatagaatgtactatattttgaaattcatctactttcaccttttcctcacagtccaatgaatggagatcagtaagaaacaaatatattcgttttccctcttctgagcatttactcttgccacctattttgttaatggtagggtatgatttctgcagctgtattacctgggttcagattatagagtctccaattactagctgtgagacttggagcatgttacttaacccctgcttccttttcctgaaaaatagtgataattacagtatctaatgtagtatgacaatttagttagctcacaagggtaaagaccctagaggaatagttggcacacagtaagcatgaactcaatagtagccattaacaacccaaatcctcatttcacacttatgtggtaggtgttataatctctgacagacagtgaaccttacagaagtcaaatcactttcccaaaagttgcaccttaaagagagcagagatatgattcagtcccacttcagataaacagactcccctttccactcatttcaaactggtcttcaaataaatgttaacgtttagacatcttcaagttatttatttcataaggagtaataatatacagcaatattattttttctttctactgcatatgtcatctttctgaatgctaaattgtcttacttccccattgctttttgcattaaataataacaacaatgtaatgccattttcccctgaacttctaagagagggaacatttgaagtaagtaatagtccttttggaatgttggcctgcatttactgaagtatgaacaattaccttccaatttggaatgcttgttgattttcctagctaatttttcttctatttttgatgaatattttattcaatctttatgtgaattgatttacctcctattgagtttaatgagatgtgaactattttattttctgactattacaaaattaaataggatataccaacattaaaaataaactataattacctgcgatagatttctttttaaacaaaactcataaggtgttgcaaagcaattttctagacataaggtatgtagagggtgaagggttgcatatgagctgagaaaccaactggagactccataaccttctaaaatccatcagatatgtaggatatagccaatggttttatgtacagctcattgtcaattttccttggactatagataattttttgatctattgtataagctttgcgataactaccatataatgaaaaaagaaaaaaattcttttgcgtagggggtagtgttatatcttttcttttaaattaatgacggtattttttttctttgaattactctctgtattactccatatagtagtagtagtagataggtttgcacctaattttaattcatattggttagtcacctttctgtctctactgaactttatacacatcctgggataaaatgtttgacaaatttaatcccatattgactctttgagaaaccaggcttccatgtgtgtctgtcagtcatgtaaaaatcatgggacaagttaggcaaaacaagagactgcagagtaacagtgtgtccttcatctgaatataaacattagcagaggtcacgttactagaaacttgtttgaaaatgtattatattttactaatacaaaatcagcggtatgcaaaatgttaggcatcatttaggtatgagtatcatcctatcttaaagtactgcttatgccaatgctaactacttgtccctggtcaaggactattgtgtagtggtgggaacatagtgtattatgatgaacagggaactctgttgtggctttagcctctcgtataaatttacataactcatttaaactatctgaggctcttcataaataaaattatgacagagcagatgacttcatgttcctcctgcgatgcaattctctgatactgtgactatgaaaaatctaaccatttaatagataaatgtgttctttcataagtgtgattcatagttcattgataccactgtgagctcaaatgtaatacagtaatatactataataaaatatatttatctgaggtaatgttttctctgtattgtattttctttaattatatttattacatatatacacatgatttcatatgaaagtaatatttgctgtagaaaattcaaataatacagaaaaatatagagagaagagtgtgaaatatcctcaagaagtctcaccattcataggcagccatcagaaatagtttggtggacatccttccaagcatcaattctttcattaatacatactaagtgacataaaattttacataaacttccatttattcatatatatcttactatatatgtgtgtatgtatgtgtgtgattatgggtatatacggatgttggatttaacaaaacaggacatctctttatggtaatgactatatgtattgatgctgacattcaataacatacaataactacccatagtgattctgaaaggtccctggggcacaagttctctctcttcttaaaaatcactgtgttgtgatttctgggttatgcttatatcttcctaaccatacaattagaaacatgtttacatttagcttcttctagtacttgccttgtgggtttcttttggggagggtagtattttatttttactctatctgcaatttagtgtaaagaatgagagacattcattccaagtgattagtgaattacctctatccttttcgttgaaacaaaaatttttcttgctgattttaaatgtttttgtgaagtccacatttaactaattttttatttttacttgggttatttctaaattattttttccaactatatccttcaattttgttttgttgttgtttttgttttttgagacactttctcactctgtcacccaggctagagtgcagtggcacaatcatgatccactgcagcttcaacctcccagggctcaagtatcctcccacctcagcctcctgcgtagctgggaccacagacatgataccacatctggctaatttttttttttaattttactttctgtagagatgaagtcttgccatgttgcccaggctgttctcaaacccctgagctcaagcaatcctcctgcttcagcctcccaaagtgctgggattacagaaatgagccacacacctgacttacttatctttcaaacttttatgtattttataccatcgtgttttatttagtttcataatatggttttatatccgattgatcaagaccactgtccacatgcccattactttttttgtccattttcctcgaagtttgcacaagctgatttttctgacaaattttagaacatttcatcaaatctaacctcccaagaatcatgacaggattcttctgtaatgaaagtataaattaaattaatgaagataaacaattatttcaataataaatcattcatctacatgaataaagtttcttttattgtttaagtctttgatgtgtatttcaataggcatacataactaggtcatattgatttatgattatgtttattccttgattttgatacttttttgaggaacatttgacacaatttttaactcatattttacaaatgcttacttttctgaagacattcatagccaaacagtttaaagagtgatcttatactttcaaaatcttgaattttccaggtaaacaactaagacagttgaaactattaataatgttatccccttctttctatatttatgttaacttatgaggaccagaccccggtttcttttgataatattatccccttgaccttcttgggtcagatacctagaagatgcttgataaatatctggggatatattaaaattttgatctagtaatactggcttaggatttaaaccaaagagggagcacccttctattgcatctgctttcataggtttgaagaatttttctgtttgagtcgaagtcataacatattcatgttaaatgttaagaaactataaattcatttcttatattctaagagtcttattataaaacatttaaaatgttgtcaaatacagtcttgatgtcacttgttttttttttctttttcattagtagtatggaaaatcagagtgtttcctgtttatgtggggcttaaaacatacaatttgaggaacctctttaagcaaagaatataaaattatgaatctaaagttgagactaaaagtaagtggttggcgcggtggctcacgcctgtaatcccagcactttgggaggccgaggcgggcggatcacgaggtcaggagatcgagaccatcctggctaacacggtgaaaccctgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcaacagagcgagactccgtctcaaaaaaaaaaaaaaaaaaaaaaaaaaaaaaaaagtaagtggttatttagattggaaaataaaagctgccatggaatgccccaataggagtaaaatattctgaatctaaggcttcatcagtttcagaataagtccacatcttgtgttgaattataaaaatttctaatattgaactaatcttgtatttcagaggcaaatcctatttggtcatggcatactattcattaaatatcttgttgacccctaattgttagtaatacgtttatatttgttgtatcacaattaatgttaaattattttataacatattgttcaccaattataaagctttaaaaccactgacatgttggttttgtaaaagcaaattggaaatttccttttctttctatacattttctatattctagtggagctttaatattcttgcttacatttgtaaaaatcttctatattcttaaaatgatcaataacaatctagctagatctgctaagggatgttcataaatacagtatcattttgctttgaaagaagtcatgcttttagctcatcaggctgatactgatagagcgtagataaagatgtttccaggtactctcaagtgggtttatttgtagccttcaaatccacctatgttattgctatttgaatatgattgctaatcacagatttacaagaaatggacccaattctctacacatttatacccgtctccttcactttgcacactactctgtctttaagacatcaacataatcacttgtgacctgcttcattagtcacctctttagacttctcaggttttaggtgtatcttgtcagcatagtggtgccagcacagacaggataatgacaaatgctacttttataaggttggcaggtagcaaactacttgtagcatatggaaaacatacttttatttttcatgcacttgtgatgttcccattgctgatgcttatggggcataattaaagagaagaattagtatgaacttatcataaactagcttcagtgcatctgaaagtcagagaactgatttttattcaatgctccattttataataatagatttgtctttctccgaaattgagtcatcttttcagatgaagaacttatgaatttaaagcattaaactcaatataaaaataagtgtaacaaatacattacaaagtacccaaagtgtctggtaacactaaggaaattgtatatttataatgtagtattatgggtggctgaaattcataaatggattgaattaaactggtatactatttcttatgtgtgcttactaagtgcatttttcttactgtatttgactttgtaatatgtcttttgaaaaactaacacaatcttagaagtttgctttatttaaaaatattgactatgtataagcttcacattttctgcagattttgctcatgattttaggaatatcatgatttaaataccaagataagtcaatgatgagaggttctcatggtcagcagtaataaaaacagtatcttttttgagttaaaattaaaattaatatgattcattttataaattatttattaaatttatatacatttgatagtgatcagtcttgttttatgcaattgatatattcccccaaatatttttgttcattatatgtaaaaatactatacctttaacatataacactctgatcaaacattaagaaatcttaaaaatcgtaactaaactcttaaaattcaaacatcaatccctcattttatcagttttatgcttatagaatttcatgttaagtttttttaagcaagatacacttttaatatggcaacaacaacaaaactttatccataattcaaatacccattttcctttgcagagtacttcagtatagctttttaaaatagccacttaggaactcattttaattaaagtaatcatatttgctacctaaatttgttgtcctattgctactctgccatttcagtgtattaaaaggaaaacagtacaatgatgccaactgtaagtctgattttttttttactttgcccaggaaaatcatttcctttgaagcctatataaaaattataaagaaaaaagggtgggttatgtaagtatgaatctattctcagctttctgtggctgtgtctacaataataatcgtttacagcataaccaggggaggaatgactaacttctcttcttatctacaagataatgaatagcctatttaactttttttaaaaaaaatcaatgtttgcgttgatttttgtatggttacaatagcagccaaagagaaaagttgcatggtaaatttgaaattgctgactgatttttataaatattgaagttcaaggagtgctttaccattaatggtcatatttattggggaaaacagtattggggattgacatctgaactgagctcatagaacatgtagcatagaaatagaaggagacaaggaaaatgacattattcccatggtgcaaggtgatgtttagcagggtgaacttacatctctcattacatctagcgggtagaagagttgaacaaaaagtgccagtccttggcaggctttttgaaaaatcatactacaagatacaaaaattagaacaaaaactagtaaatgttttgttcaaaatcacaaagaattattttttacagagcagtgtgtctctcctggtcttttatattattaatgtaccatgccacatttttaactgttagaaagaaggaataaaagaaaatgtcccatagtctgtcactttagacgctttaacagtgtttgacaaaatgtaggtaaattcttctaagaacattatcattaacagttgattatggtgttcataagagtggtgatattaagaatttatattttaaaatttagtcatatctgtatgtaatcccaagttgctgactgaacttaaatcttttaaaggataattacaattaaagtgaaaatattttctgcactcatgcttttttctagatgtttatatgttgttaaatattctttaaaatattttaacttttagaaattaccaactctaaatattctcttataaatatctattttggtcaattaactagaaatcaactaataacaaaatggtcttgattttttaaatacaagagatgtacttggcaaaaaagttttattgcaccgagccctacatatttgaaacattaattttagatgcctctatggcaacataatgtattcttgtagtcttccaagatgtgccacactttggaatctttgctaaatgtcacaaactgagagacatatcataaacaaaataaagaatgaccacaacggttcaaaaagttgccaatactaacagttccaccaaacgtctattattcaacatacatgatttgaatttcaaatagttctgtaactaattttgacatgaaattctaaacaattctgagtattgccagttgcctccagtagaggcaaggcgatatcacaattcaactctataaataaatattgcaagtcttttataatttataatattatggtggccaggtggcaagttggggatcatacactaccacatcactaccataattttaaacaaccacttggtttcaggtttacccatcactctagctgctttgtgatgaaagaatggtatgtttagaatcttccctctttctggattctcatcctcaggacttatttctctcctaaaagcaagaagcaaaggaactatttctggaccctctagcaacaacattttaatttactcagctgtgtatcaggatcttgaggcattccttttggggtacttcgtcaagtgtacagcttcttctttaagcatggataaataccaaagccactttctgaatgctgcagagacttcacctctagggactgttgttgcaacatgttcaggcttttgcagtggtagtaatagaaatattgctaataaaatagtagtagctcgttttactatatattaactactatgctgtgcaccttgctcagattatctcatttaatccttaaaacaacctatgctgtaggtggtattacatctatttggcaactgggcataaactgaatgttaaaaatctgtaagtcacaagtttggaaacagtcaaattgagaatataaggcaggtctctcccaggtaaaaactgactatagatcataaacttcatatttagtaactgtgtttgtcagaggttgaaaagttctttattaagaacttccttcctaattaggagctatcgtccagcaaaagcatcaggggtaatatatgttgcagtgtaacagtgtggcccaagctgaaattcaaaaccaaatctgggaaaacggaaaggttgatgatctttcctagggtctgtgtgcataaatgtaaatgtatggataatattccaaggagatttctaaagaaaatgagaactgttttacacagaggcctaaaatactagagagaaaagtgaacagcacaaggcttaaaatattatcataaagccagaagttgacaggtaaattttataataggttttatgagactcagtacagaataaactttaggattcaggttcacagggaagtaaaattgcagggaataatatcaccattcttccatacagaacccaacagtgccctggctcctggaatgccaggaaattgaagaagctggaaaggcacctttggtatttgcaaaaggcgttagataaaaaaaaaaaaaagaggcatgaataaaattaagaaacaaaatttcttatgtagctcatcttattcaatactcacgcttgagcacaaaaggaatgccacctggacacatgaaggagtaaccgacaaaggctttgaagtaggtgggggttggggtagcatgtccttaagtcaagcagatagaaggtaagggttagtaattcaataatttggacacaagtgttactgttgatagaatttgaatccactgataactgacccctgacatgctgggacttgcacaccacttgtgttcaaaccctgaaagactagactacctgaaattccctctatgctgtaaatatccccagcttcatggtttgtacagagccttctcaacctgaaactccctcccaggtctacctttgaggtgttatcactttcttttttcaaaacccaatacgttttccaatttatttaactgtttgactgtttttctgcttctcccacctctgtacccaacacaatggacaatattgttattgataataacaatattgaacaaactttgaaaatcaacccactaatacaaaaaaaaatcacagaaagtcatgttgcctcctggattgcgaaaagagggctagaagaaggtggcctctaaaatcagtgccacttattgggctacattgagcatcttcagggtgttactctttccttattttactatccaagagctccagaatccctttattccccatcccaaggccacttaaaaaattactaagtgaacaattactaaaaattgctactagaatgaatatatttaaaaatatgcttaaatttcagtattgtcctatacaaaaccatttctcttcgtaggaagagaactatttcattgggctacattgagcatcttcagggtgttactctttccttattttactatccaagagctccagaatccctttattccccatcccaaggccacttaaaaaattactaagtgaacaattactaaaaattgctactagaatgaatatatttaaaaatatgcttaaatttcagtattgtcctatacaaaaccatttctcttcgtaggaagagaactatttcaagaacctcactatttcaagaaccttattttgccattacttctttgttagcatcttcacatgcacagtgagtctggaaagatttccagcctcttttcttccattttgaattctcagagggcaatattttgcttgattttaaaagatacatgagtgaagaaaaatgagttctgtcagattcctctgccttggactgagtcatatattttccctaaatccatacaccagacaaaacagaaggatagactgatttgtcattttctcttctaggatgtttaatttcagacagtttttttcaaggtctgaaaaacagttaccttctgttttaaaattataatccagtaatcaagcctatgtaggttctgggtaaaatgctaagatttgaattatattagggtgccttgccatttggataggtttccaatttctgaattctcttgttcctcacagttgttgattaaaatgggtcatgatttctatccttgcttatcccattgtaaacacacaactttaatatcaaaaggagtctgtgtggatggtttctatgataatttctaattcacacattgtttgatttcattttatttggaatgtcagttttaaacctttaagttctgagcctaaatgaaatttttatatgagatgccttattcatctttgacctaaatcgcatagatagtttatataagtagcaccggatttttcattaccatcacattcctgcaaaatacttctcctaggtctgaaaatgatcttcaaatcatttactcgtctcttcacaaccatggaaaccacattgataatgtcagcagtcttagtttgaaatgcctgtacagcttttgtctaaaataaaactttctaagcttttgtattagagaaaatcataatgtaaattaatgatgtttctctctgtattaaaatatctgcgtttaataccctacttcaatatagtttaacttcacttttttttggcctccctttgcacgtcaataaaacctgaaatgcttcagggaaagaaaaaataaaaagaaacaaacaaagattgaaaataaaggaagtcttcccaacacaagggatttggtatttttcatgcagtttgacagtaaaagaatgaagtattttgaacatcttttaataactaactatgaaaactatatcatggtctcaaagagtttacaatctgttttatttttagttactgacttcctgtttccattcaaaggagtttgcatttgggccaccattattttttctgcctctcagacatacgtaaatgtgacctagcaaagttgttttgatatattagttattctgtttgtccataccattagcaggctacacccaatgtattcagagagaaccccgatgcctgtaagaatctaggaaaatatttgtaagggccctatttcactctttagaaaattatactgttgtgtgatatgaactaaagaaataacagcaaaagagtcattttgataaggttctttgaaaccattgttatagtaaatacaatcagttaattaaaacagtgttttctcctcactgaaaaattgaatttttctttctaggcctcagttttctcatctatatattggggtagtagtggaaccaaataatttttagaggtggtctaaacaatttgttttataaatttgaaattattattcaagattgttgtttttttcaagatgttttcttgttcaagggtacacgactaaacatcatccattttgtctaaattttaaaagtttgggtataaagtaaattttaaaatctccattctgtctgttgctctagtacgctttcattttatttctaactttaaaaaatgtgtgctctcttattttcttgatcaaatcctgccagatgtttatctattatataaatctttttaaaagtcaacttttaatattattaatcctcactattttgtttctttgttttccttgtcattatcattatttacatttttatctttcttattcttcctttgtattgttttgggtttactttgtcatatttgaaatttattttaagaacccttaactcactatttctagtttctttttttcattaagtaattaacattatatacctttccaaaaatactgttttacatgtgtcccaaatatttttataggtagtatttgattgttgttcagttctaggcatttagaaatttcaattattgtgtcttatttgacccatatattatttaaaagtgtgttttggggtttccaaatttctgaacattgttggcaattttttacatttctaattttactgattttttttctaattgtagactgtagactatcaattattttatcttttctcaaattttctttggtgttccattatagttattaactaattacctcttttgttctagaaagtcaaaaatactttctaagattaataaatcaagatgcaggtgtaaatgttacagtaggaagaaaaatgagtgtcatcagtaaattagttaaaatacgtttaaaagagcgaagaaattgcccttgttaacagtgtgatcaggttgagtcattagggaatccagcaggtagggaagtttggatccaaccctctagtctgtaataaagagaactgagaactgctctctagagaatgaaatgtgaataatgttaattcatcataaccttattcttaaagaagaaccttccacagtgtctgcctctaactgcctacctgctttctctatgtcaaaatatgaagggggggttacctgctcatgtgacctgggaaagtatgcacacctcagtcagagacagcattcaaggaataggcctgtgggggacagatgtatgagaccatcaaggaactcatgccaattgcctatactagtcaacataaatatggacaaacaagaaatcttttagtgagaaaagtttttatattataggttttctttttccttctctatcacagtgcatgattaatactctaaattttggttatctgttttcactttgtcaaaaattagcctgttataaattcagagaagactttatcatatttcaaaatttaaatacacactttaaaacttgatgacataaaaacaataataattataaagctaacaaattaaatggtagaaaatagatgagagtttgaaaaaaatatttagttttctcttatctttcatactgtaaatttaatgtgtaattttaataaaatcaagaaaaatggatgaaagtataagccttaaaatccttatggcaaccactagaaattaaaaaaaaatgataataaagcaaaagaaataacagaatctagagctgggagatggaaagaaggatgaaacagtgtttagtctcccaaattacttacttttcatactgataagttaatagatattgttaagaattgccaattccagtagctggcacgtgtgtgtgtgtgtgtgtgtgtgtgtgtgtgtgtgtgtgtgtatatacacacacacatatatatacacacacatatatgtgtgtatgtatatatacatataattacaactgtaatatttacaaataataataaaaataaaaatgattaccaatagaacaatttaaaatagaaacttttgaagtgtgaagatgtggggatagtatgtgtgtgtgtttgtgtgtgtttctaaatttttcattttatttatttatttatttattgagacagagtcttggtgtgttgcccaggctggagtgcagtggtgtgatctcggctcactgcagcctccacctcctgggttcaagtgattctcatgcctcagcctcccgagtagctgggattacagatgcacaccaccacacccaactaatttttgtgtgtgtgtgtatttttagtagagacgaggttttaccatgttggccaggctggtcttgaactcctgacctcaggtgatccgcctgcctcagcctcccaaagtgctggaattacaggcgtgagccaccacacccggccaatttttcattttataccactctaggtagttaaaaatattaaatcatacacataacttccaataattttaaaatgaatctatatacagacagaggattactgttcaaatcaataactaactacatctacatgtgctgatatggaaagaggactacaatatattaataaagaaaatggcctgtaatcccagcactttgggaggccgaggcgggcggatcacgaggtcgggagatcgagaccatcccggctaaaacggtgaaaccccgtctttactaaaaatacaaaaaattagccgggcgtagtggcgggcgcctgtagtcccagctacttgggaggctgaggcaggagaatggcgtgaacccgggagacggagcttgcagtgagccgagatcccgccactgcactccagcctgggcgacagagcgagactccgtctcaaaaaaaaaaaaaaaaaaaaaaaaagaaaatgaaaacataatacatataattatgtatattatagattccaaatatgtaaaaatagagggtacgcatatatgtttgtattaatcaatgcctaaaaatatccagaaagggaaacaccaagcgaataactgtgactatttagacagcattttattttgtatttctttgtattgtttatataaatttttcactacttcaatgcattgataatataataaaattttattagtaaaaaccattgatatcctagatgatttggttggcaagatatcttacttaatttaatttactctgaactcccaatattcaggtaagaagctacgtgggtacaggaattctctgtgccttgctcacttctctaatctctgcctccaggccaggttaacccctatacccattataaaatctctgcaaatagttctgtagtgagttaatgaatgtcagaaatcaccttaatataataggtggtatatagtagttgtgctaaaatatgttaaagctttgttttgttaaatagtctatgtgaaccagtaagaattaatagcattgaataataacatttgaaaactgttcagagatagcaatgtgagcgatggctgataaaaaaaaaaaaactttcttctattttatgttaaaaattacctatttgtatatatgttccttttttaagttaaaaagctataaaaaattaatgtgattgttctggtttaaccagaacattctcatttatgacttttatatttttctccatgacatatacctgctgtctttgtggttcatatacttaaatcagagttctctaaaatggatatacgtttcctaaagcttcttcattatcatctttcatatcagtaaagcagcagcagaaatctttgcttactttaggtttctgaatgctaatatgtagaatgatgtttcttttctataagtcttattacaacaatttttttagtgtgcgtatataatggcatttacttcctcaatttcattgtaaatgcactaaaagttgtgtcaatgaagtcattctgaatatctttaatagacaataagcctcagtcatgatcagaatgaggaaaaaggaggatgtgcacatggactaacttgatggttatggcttccaatgagtttctatttcccttcagggtttggactaaagctgaaagcaaaagaatattcaagatgcttaagtttctcccttgctctgatgtggctgtatgcaaatcagctgcgttactggcaggactagcattccacagaatgatggtgaccataatacagaaccctatagagtgaggtctggaagtcttcaggcagaagagagcttgattggccatcattgagctttcatattgtattaatgtagaaaaagtgatcaatctattgcagcagacatagttaacgcctccttcagatcccaagtacaacgtaacagagctgccttccatatttggatgatggtgatgagaggaaaattggaagaataatgatctgtctcaaatgagaaagctatgataaaaaaggaaacatttaaacatttttgctttgttataaatacaactgtcaacccaataatggactgttgaatggcttgtttaaatgcaagaatttagtgaagtattcatgaaatatgataatatgccccttagtttcacaagcataatatgacaggaaaaataaccttttgtctccattttagaaatgagatataagtaacatattataaatttgtcctagttcaagggtgtgacacttaatagatgtacatattggcaatttgcttatagattatcatttactgtcacttttttaattagaatgtgatcttccattgtctttaatctatttacatcatggatgacaaatttctttcccgtaaagcaaagtctttatttatcataagacaatttttaccaaaattattacacgttgaagggggaaatcataagtgggatcatttagcttttgaattttcagactacctggcatctttaacacagtaataaaacatattttaagtgactgatatttgcacatttgccttctcaaaaacattcttaattttgctatttaccataaatctgttatgattttaccattaattttggaaccatgccatgaaaagtttgattaaatttacgttctgtttatgtatgcaactgaaacttacacgcaggctgtaattcaatgtttctagtcagctctgaaggcaggagtcccctccatagttttcacattggcatatgcatctccttacccacagaaagattgttaaagcaaatagttctactggtaagcagggatatttgtagaggtactctgggaattggaatggtggaggagagagatggaaaacctagaatgagaacatctaaactgccttttagggggaaaaatacggttttgatgggatatatgattccttgccatcaatttctgctgggaatataacaaaaagtatatttagatggtgtttaagtagtgaaactttgtttaaatatttctgattggactgtcaacttaatggtgtggtggtctggtactaatgccagggtaagattgtgaattcagcatgatatttgtcaaagtgaatgctactcactgttaggtggcatctttagctttattttagaggtttagtgtgaagtaaatgtaaccacagtttgtattaatcctttctttaggtgttttatgtttatttcactgagtttctttttttttaatctcaattttgaaccaaacttcaaccctttaatctcctaagaccttaaaatcatggtatattatttgattacatatgtactgtcattttagtatctttaggaaagatacatcctcatccccaaaatgctccatcatttctagtagtttgcttagttcttacatgtacataataataaccaacattgattggacatagtatgtgttagaaaccattctaagtgttttatgtgtactaagtaatttattcctcaataaatccctatgatttcaaaatgattatattcacaatcttacggataaaaacttgcagcactgatagatttttaaaaaaacaacaaagaaacttgatcaagattacccagctgggaagcagagaaactgaggtttaaatccaggtagcttgattccagagacattgccctgaaacttaatcatagagctttgatatttaaaagtaaactgcttcttggaaaggtgaccttaaatgtagttatttgacattatttatgcttcaaaatgaatgatccgaaagaaggctttgatgtgcataaacctgacactggaagagagatcgctctttggggaggaaatatgatgaagaactgagatgctggaatcttataaacataagccccttccttcaaaattttcattagaaaattgtaaacactttattctgctattaaccacatgggcctggagactgagaagtggaaggcactaggcaggcttcctctttaactaaactctacctcggcagggttagatctgcatagttgaatcagccccctaaaggaaacagacacctgtgaccacatctgcttctttcccttgagcctgacacctgttctttcatcaggatacttctgtagtttgggaggatgtggttgaaagaatgtatttgtgaattgcaagcaggtaattaaggtagctcagtaccttgaacatttctgatgttaggagcaggcatttgaaaacagtaatgacagtaattagataggtagtgattctcgcttgaacccgggaggcggaggttgcagtgagttgagattgcgtcattgcattccagcctgggcaacaagagtgaaactccatctcaaaagaaacaaacaaacaaacaaaaaaaggcagggattcttttcctgcgttatttattatttacctgttagaaactaatgtatgtctctctgtaaatgcatgagttaaaaaataaacgaataaatgaatgagagagactagtgatattttgttgagaaattgggcgtatgtttgctataatctattatgagcaaaactattttagaattgaatttttcaaattgacttatatacagttgattttatattctcaactaagtttacatcgatatcaaatttgaaacctcagcggcattcaattgatttgttggttttatataaaaagaaatctcatggaagatgttgtgcctgtgttaatacatagccactgaagggaccaatttttcaataaagccatgttttctgatttatatattcattaggttggcagtggacatttatgtagttgtggggttagttatacagcacccttttgggaatggtcatccttttgtcattagaagcgatagggttgaaattgttccacaaagataaagatgtttctaatgtatttatggggaagaaggggcaaagatggaaaagagttacaaatgtaagaattataccattcagaattgtaagtctgaatctgtatctttgaatgtgtatggcttaaaacagccataaacggcatagtactattttccaacagcacagtctgtctgtctgtactcctaggaagatctagcagcacattaaggataattttcctcatcaactaagcattcttaaaactaatttagataaaaactatcaaataaaatttaaaatgtaaccccctcctaaccaaaatatgcagagatgatatcagattacagtgcagcagttaattttctctccaaaatttagtttcaaccgagcaagaaatgtgttccctgtattgatacagaaagtagaggcaatctttgcctatagcttgattttatactcgttatattaaataaagagaaatgtgcatttttctgtattggctaatttagaatgatttgcataaggttaaaatacagagttactataactggcaatttgtgttacttataatacggttctgacttttattatctttgataaataaattgagctttagagtagttactttatgaataattctttttcaaatataaagaatctgttttccataagtcaaataactataccagtttttaaagaaacatataatgttggtatgttctctaacctcatggcatgttagtaaattaaaatattatttaattaatattaattatcagccaatatctgataatgaataaaaagatgatttatcattattatatgatagtggtgatgaagggtacattccaattactctttcaattgtaataatacaggcacatttgtcccctacaaaaatcacctgaagaggcaaagtaagaggagcatgtgataggttgggaagtttaaaatctacctactaaaaataaatgaatgtataaatattttcagagtgaggtaggccattgctttttgttgttgtttgaattgaatattggacttgctctagatataacagctacagccccataggagaatgttctcatgtggcttattgcctttaaaataatttacttgaaaatcttaatctccactaagaaaatagcccagatcctctacatatcttaaatatattacaaacctgtaacttttaaatatttcccagttacattagtcagtgccacccaatttatatctatggctttcattcacatgaaggaaaagggtaactgttggggagttctgaactttccagcatttacagaatcctagtgggctgattacttagtggagggagaagcaaggtgaataggtgagtatgggcatgagagaaagtgaatatgagcagttatgggaattggatgaccaagatgttagggaagctattgaaggcagtactattttaattgttttatctatatgtgttcaatcaacaattatgactatatcgatataattcagagactgaaaaatattgtggtttagccacccagatagtctggcaaatatggatataacagggtttgtgtggtagataattgttttgaaaaattagtatgcggtaagtctcagaataaagttacactgactactattcattcattggtgaataaaaatgcacttagacaacttgtgttcctcctggtccaggtttctccaccttggggagagagtaaaatagttccacttatagtgaaaggagggattcaactggaaatctggcagggcctgactgcttagaagttctaggtaaagaaagtctacaccagtggctcccaagcttcactgggcatattaatctttgataaaaatgtagactttactggggccctatctccaaagaatctgattcagtaggtcataggatgcaacatctgtaattttaacaagcatctcaggtggtctaaggctaatgtttcatgtctctagttgagcttaaacccacaatatttacatgaggtacttaaaaagtagggagagagcaacagagagagagacagacagaaagagagaacaaagagagaaataaaaggaaaaccttgaaaacaccctgaattggactctaaggcaaaagttgtcagtaagttttcaaaaagtataaggtactgtctcttctctacttcagtgctatttttcatattttgagtatattttactaaatgatattccatacttttaaggagcatagtaatagatcagaaaaagttaattccaactgcagaagatattattcagccacatcataatttgtaagtacagataaatggcaaatagcattaaatcctaactttgtagtttaaatggcagaatcatgcactgctagaaataaaaataatacctttcaattaggaattgttcctgtttgacaaaaatgatctatttttcttaacatagaaattaatatatgcctttaaaacaagttctacatgtaaaatattagtaaagagatccatcaacttaatgaaaatgatcaataatctttagctttgtgagaggatagtattttggattgtatatgcatgcaaactaatggccaatggcaaaggttgtttggttttactccctgggcatcagaaactagtagtctttcattttaagaaaaactgaagatctctttaaatctataccccaaatctaccattaagaggacagtttttctgtattttaagtaagaaatgggtgaaaatatctgtctgtagtaagccacgtttgctggtgttcagtaagctaacctcagcacatcaatgtaaacccagtcttcttggtgtagaaaaagaaattatcacaggtattgggagacacatagcacaaaagaaagtatttccttcaacttctactccccaatatttttttagtggcttttactggaattaaaatacgtatcctacaaacgaggctttaattcattgtctctttgactgaaatttttttttgctgtttgcatcagatgttcaacagaggacaaattacagtttcagactgtatcaagtattccagcaggcagaggcatctgattcagataaattgagcacacatttgaaagaaagtcttttattctagacacggctgacttcattgctagctctgatgttcagcaatagatctagaggctggaagacaggaaatgctgaccagtacaaatgcatttcagtgtgtgaagtatgctagattatcagaaagtatatttagagaaagccttcctaggttttaatagacatccttacttttgtgtcaaataatgtaattattatacatgtaatgaatatacatgttaccattatctcttctaatctgttattaagttgcatgtatttatattgtttaaaatctctgttttaaaataaattcatttacatatatttcctcttgctttcaaatccaataactatgaattccatgaaattcagagctatatcttcacaaaaacctaataaagtacatcttccctagatggtgcttaatgactaagtgttgaaagaataaatacttgctcagtttgaggcagcctgggaaattaaaaagaactagaaaagcaaacagggcctggaagctggttttagataacaaatttatcgccaaatttatctcagttttccgacagtttcaacaaaaagggggctgttttggttttggttttgactgttcagtaaaaggagcatccaggatgagaaatttatctggctctgaatttaagaatgtatcaatagaatggttaaaaagagaggtaaacataatagactatcattctccttctgagtttcttaatttatatttggtgattgatttcatggttgatgcaaaaattagaacattcattgtggtgcttaatacatgcagagaaagtacactgtgatcgaatgaaaaatacctgtttggtctctgcctccagttcctggcacagagctactaaaactattgtgaagtcctggtgcacttagcatcttaaactccaatatttggtctttgaacccatttcttgacacagaactcctaataccttagaatttcctaggtgatatgagggtcctttgttctaatgaggcagctcttggtagactcctggatggaggctggtgaccagaaagaccaagccataattaagagcttgaaactttcagccccactatccgattctccaggaagggtagggaagcttgagttaataataggtcatgtctacacgatgaagcttctattaaaaattcctaaactacagggttcagagagtttctgggctgctgaacatgtggtgatgcagggaagatgacgtgtcccgaagaggctagaagcaccacaccccttaccacagatttcaccctatgtgcctctttatctggctgttgatctgtattctttcttatatactttataatgaaccagtagatgtggaaaaaaagatgtattaagctggaatagagttgcaaatgtatgatttttttcaaaaaagacaaatacaatctttatatttttgtattagccctcagtgataacaggaagtatgaaattaaatgtttactcagtgaagattttacattgaggagccactagacgtagacagatcttgatctttcttttcctagggcttggcaaaattcctggcacctaagagcatctcagtaaatgttacttgaatggaaatatttcaagctcaattaaaaatcaagttgaagatatttcactggttttaatcctctgaaagatagcatagctctactggtggctaaatttatgtataatctctgaaacccagaaactgtacaacaaggccatgcctggaacacagtcttgatgatacatcaagagtgactcccagctggctggagcctgcatattcctgtttcggttctttttcctccagtagaatggtctagacagaggccatgggaacaggcctggataccggagttaaggtgtgatatgtccagtcactatcttgagcctggagtgtttaggacactgtttaggatacaaaaatttttaagatttgggtgacattcaagaaaacatgaaatatttgttatcataggacctttcaatttcaaccgttcctaagagttagctggaattcacaagaataacatcttggtttgtaatttaaataatgaagactggttggatggcccaccgtgagggggggagtcagggctagctgcagtgaaggtgggtaggtcacgagggatgcactggaaagcacgcgcctcatgggcaagagtgtaggaagttgcctccctctcgtggactgagagaggacagggtagccaacgaaattccgtggtaaatggcaggcacatgtctaagccaaacaggcaggaggacgatttgatttgactgactgactgactagctatttagtctaaattgagcacgtggacaataaaaggttttctaatgcgtccccagtgtgggcctatgctagtgattgaacaaatgtgatttagactgcagtgtagtctgaactaaaatgggtcaaagaaatatggaatggcaaatagcttcttggccatgttccctgtttttcttcaggcactagaaaaatgcaaaaacatgaccactggatttttccaatgatcttgacaaaacaaagttttgtgttaaacagaaaatttattcttctgcttttactatagaaaagactttggtgtgagtttgtgtgtctttgtgcatgcaaatgcccctgaagcatcttagttccctcaggctaaacagaggccccacatcacaggattttttagtgtttaaagtaagttaaagtttcttcagggctataagaatgacagattttctttcccactgaggtcctgccgacttgcttcaaggattttagtgttcaatttctatctagcttttctaaatgtagttttgaagtggattataaagcttttaatctactaagtatccatagtttatttttcaacacaaagggctttcatttgaataatatctggaacctctccccacccccattttgacagctttgttttttgttctttattacataaggagacacagaggggatataggacaagcagatgaaaaaggatgtgaaacgatcttagagtttgatgatacaatgtcacatacacagtaattactgtggaatgtccccaatgcccaaggtcaattggggctggcacgtgaaggaactcagtaactacttgctaaatgcagggatgcatgtatgatggattttttttttttttttgagaccgaatctcactctgctgcccaggctggagtgcagtggcgctatgtcagctcactgcaacctctgcctcccagattgaagtgattctcatgcctcagcctcccaagtagctgggattacaggtgcatgccaccacattgggctaatttttgtatttttagtagaggtcgggtttcaccatgttacccaggctggtctcaacttcctgacctgaagtgatccgtccatctcagcctcccaaagtgctgggattatagacgtgagccaccacacctggcctgatgaatttttaaatattgtatttttaagctaagaagatgatttttgaaaaatattctctgtcagtataagaaaaactaacataactatttgaagttataaatagaaagcatttaaaagacagaagcatgtgtaattgtagattttgggggttattaacataaaacaagaaattatttaaaaattttattgtatttcaatgtggatttattattattttttagtagtagaagatggtttatgcattttgcatacatttttgtagtagtctttcaatcaagttagaatggcctgatcatctgtaaaagcttcttctcttaattgtcatcatctcatttcggatatggtattccttcagctgcacagcctgtctcttggaccagagatcttggacagtgatggttatgggctgaactgtttcccaaaaaagtcatatgttgcgtacctaacatccagtaccccagaatgtgactctatttagagacaggacctctaaagatataattaaggtaaaatgaggtcatatgtgtaggctctaatcccatatgactggtgccattataagaaaatgagagtaaaatatagacaacacacagaccaaggggcagccatgtgaggacacagtgggacgatggccatctgtaagccaaagaaagaggcctcagaagaaatctaacctgccaacacctgatcttggacttcccagcctccagaactgtgagaaaataaatttcacttgtttaagccacccagtttgtggcattttgttatggcagcactatcagactaatacagtgactctcttttcatattgggcagtcaagagactttccagtctcatcctggaggatgactgggctgtcagctattcccctttagctggattctaactgctttttgttccacagacctgttaggcggtctgatgaatcctatggatcccttctcaaagtgatgtttaaatgtgtaaaataaaatacataaacttagaaaaggaaccaaccttatgtaaatacagttttcaaaatattttttacatgtaaggcttaaaattatatgggcatccttattagccagtgaataataacatctagcaagggaatataattttaataatatttggggctataattataatgtgaaaatatctgtggtttctattaaggacaaagtcacaagtacgatttatcctcctgtggtttatttccaacattcaaaatggaagacaatgaaaattttcaattagaggttagtgatgataaacatgtaattttccccctcatccaagttccacagactaaagttaagaatccttgtcttagagaaataataacagcatgatctccactgtataaaaagcttaggattagagaccactaagtaaaatgtacattttgggtgataaatttgcacagatctattctatctcttaatcatttctctttgtgactagtggtatgtatttgcaaggaagtgaaaagaaggaagtaatctgacattaggggtagagaaaacctagcctgagccctaggactattgccgtttatgactagtggatttttgaagtgcttaggtgaagatgtgggctacaggctttgcaactacttatgtttagtaacctcagaaagtctttaggcttttggttttcaaagtaatatactattgggggtataaatcacatcccctttgttactcctgtacctgagcaaggaatttttcacaagcctcttcacttcctgtcagactttgccattcatgacataccatggataggaacagcgtagaaggtgtttgaccactgcggacattgaatgtgtctttggtgagtcagtataaaaactgaagccatggcagttattatttctacatatgacagtgaccctctgccatctgaactttacttgccaggtagaatctgtgtctggagccttaatttgtaagatctgtactcaagtcctgactctaccactggacactgaatatctttcacttttagtctattcatttgtaaaagggatataataaaaatacctgttctgctttctaaaaatatttgtttaaagcataaaatgtagtgacacatgcaaaagccattaaatgtaagtgatgaagtacaatgctaatgtaaggcaataatacatttaaaataaacatagtgaacattatactagaaacttcaagttaatgtagcaagacttattatttattccaaataattttgaacaaaaaagtaccattatttttaaatgagaaaatattatgattttaaacctttattaataaaaacagaatcctcataatgccctgcttttttaaacagttgtgctttcaattaggcttataatattaacaggatagagaccctagatataaggaagcttcttcctctctgaagttctagcaagaattcagcacttcagttcaacattttatctaatctaatgacagtttttattttcacaagattaggaagcaacctcagatatgactttgtaaatgaaatataactactcagaaagaagttaggagatgcttacaaagagtttagtgctggtcaggctggggtagataagagttttaaaagcttaacatgtgccttaaaagcctctcaaaaaaaaatccctgagaaaattttaaaactgaagataatgattgatgaatgtgataagattctaagtatagcagtagtgataaagagttgaaaaatcaaactgattctcctggaaggcagtaacatatttaaaaatgtcaagttggtaggggttcttaaaggaaacaagatgtataatttttgaacagtaggttatgatggctgtggaagtggtaattttgacagtgcatttgtggtggttgagtcggaacaggtcaattagcttttacaaaatgcgttttgccttagtaacttaaccaccgaatatttatatatcacagtttaaaagatttgggtatgcttcattttactttaaaaatttagcaagatttaattaattctaattaattaaaataatgttcagggtttgtttgtttgcattcatcaaattgaaacacttcttgcaattcagaataattaatgaggagactaaattcaacaataattacagatttttaaagggaaattgttggtttacattgctgtgtgaaaaatatggagcactgctaaaaatagtgtggttttaaaagctattctatgattccagagctggggcaggaaaacataagatgagcctggggcatcttttgttgccagaaaataaaaatgtgctaaaagagaaaaatggggcatttcaaaaaggcttagacactaatgggaaagagctcccagtggccaaagttggaacaacttaaacaacattataaatagcataaacaaaaacataaaataagcaaatagaaaattttggattaaactcaaaaactaaaataaatatctatgaatacatactgacaaaaatatataggtgaataaatgcataaatgtcatggaagtgagaactcttcattaccaaggaattgcaaagaattaatacagaaagaatgagggaaatagaaaatcagcatttggacaccaaagtaataattgctttagccaagtggatattcaaattggtgagtaaaactttaaataagaataggatatttgcctagtccccaagtatctcgctcccaaataataacaaaggaacaaataaccgtacaatgttgaatcttggcagacactacattaaccaagtgatcgattttaattactagtactgtgtgatcaaatttaattactagtacataaagtgatcaaatttaattactagtacataatatctgtggatatcatgtaccttctcatatgatacacagaaaagggcacaggacctctctgatatccttgccaacaataactaaactcattctaataatgagaaaacattagatagaccaaattgtgggacggtccatgaaatttctggccattattattcaaaaccttcagagacataaaggacaaggacagactgagaaactgtcagagactggaagagacaaaggagacatcacaactaaatgaaatgcagggtcccagattaaatcctaaaacagagaaaaaaaaaaagtgaaaaaaaccctgcagaaacttgagtaagttctgtactctagttaataccagtagtattgtatcagcgctaacttcttagttgtgataaataggctatggttatgtaaggtgctatcataaagggaacctgggtgaagggcatgtgggaactttctgtactatttttgccactcttctattaagtctaaaattatctcaaccttaaatttttttaaaataaaagctcttataataaaatgtacatatccaattttaagataacagctaacatttgtgtagcagtatgtaccaggcattgttacaaatgctttacatatattgacttatataatttctgcaatagtagctgccattaacatcaccattttatagatgagaaaactgaggcaaacagagagtttacagtagagctgggacttcaacctggaattttacttctggaatatgtactcttaactactgttatatggtcttcaaattaactgacttacctctagggaatacagttaccataataatgctactttaaacaccttgagaattattttttttttaatctttttgagacagagtctcgctctgtcacccaggctggagtgcaatggtgcaatctcagctcactgcaacctctgcctcccgggttcaagcgattctcctgcctcagcctcccaagtagctaggactacaggtgcatgccaccacgcctggctaatttttgtatttttagtagaaacagggtttcaccaggttggtcaggctggtctcgaacttctgaccttgtaatccccctgcttgggcctctcagagtgcagggattacaggcgtgagccactgcgccaagccaaaatgcataacatataatattgttttgcagcaggctttttcattaaacactatatcataaatacctttctgtatctataaaaatgttctgcattatttttaatatgaaaaaatttaattccttgaatatataagacttcgtataatcaagtatctttttgaaaaattggctcgattatctcagaaaaaatactgctatgaagatcattgtgtacaaattcttgtgtcattttccattcacacattcatgcatttatctgtcttttatttgttcatataaatgaatataaatatatatacttatatatgtgtatatatatatatacacatacatatataagtgtgtgtatatatatacacatacatatataagtgtgtatatatatatttaacctactgtgcttcaggctctgtgtaggtaatagggatatagcagagaagaaaacaattatcccttgcactaaggatctcatatttcgtaggataaattcctggaaatggaattgctgaatcaagagttatgtggatatttacaccttttgactcactcagcatattgttgcctaagaaagtggggaaattgacagttccgtcagaaatgtcttattgaggctgggcatggtgacttaacgcctgtaatcccagcactttgggaggccatagcatgtggatcacctgaggtcaggagttcgagaccagcctggccaacacgttgaagccctgtctctactaaaaatacaaaagttagctgggcatggtggcacatgtctgtagtccctgagtacaggcagctgagataggagaattgcttgaacctgggaggtggaggttgcagtgagccgagaacacaccactacactccagcctgggtgacaaagtgacactttgtctcagacaaaaaaaaaaagaaagaaagaaaaaaatgttttattgagttcaggtaaactgattcctcaatactttttctctctgttcttcagactgaacaatttctattgatctgtcttcaagttcactgggtctaatgccatcttcaatctgctattaatctcatccactgaaattttaattcagatattgtatttttcagttctaaaagattcatttttaaaatagtttctatatcgcagctgacatatcattgtattaatgctgagcatggttttcctcacatccttgagcatagttataatagctgtttaaaatccttgtctacgaaagttcaacatgtgggtcactttagaatcaattttcattagttgcctcttctattgaatattgatgacttttttctgtgtgtttttttttttatctaatttggattatattctgggcatcatgaatgatacactgtggagactctggattcagttatgttcttccaaatgtgtggagtcttgaatcctctggaatctgcccatttgtagtttttgttcaatgtcttcagatagttttgcatgttttctagaatttctagttgtcatctttgagacagttgttccaataggagccacttagccatgatgagaaacaaaatttcatgtaaatgaattcttaaaagcatttctcaagtgtattttaaaatactttgagcatcagagtattattttgcagacggaaaattatttggacatataagttctttaaactttgtttaaattttatttctttgtagctatatcctataagcaagcatagtttttctttctcatcttaaaaatatattgtgtgtgaaaatccaaaaagattttcttctttgcaaaagtagatcaaccttaaaaatataaatttaggtaaatacctaatttaaagtgagctacagaagtttttaggtaactttaactgaatgatacataactgaagaaatatattgctcacatgtagattgtgtggttgtacaagatagaatgtaaaaagaaataaaatcaaatgtagaccttttctagacttgatcttaaccaaaaggccaaaaaatgatgaaggtagatgttttctaacaattttcttagctgtaccattgccgttttctttttactaatttattttaattaataaataaaaataatatacaggcatagctcagatatattgtgtttcagttccagactactgcaataaagcaagtattgcaatcaagtgattcacacaaattttttttttattttctagtgcttttaaaagctacgtttaccctatactgttgtccattaggtgtacaatataagtatgtttaaaaatatatatatattaatttaaaaatattttattgctaaaaatcattaacaatcatatgaaccttgagagacttgtaaacttttttgttcttgcctaaactaaggctcttgcctcagtgtttatggctgctgactgatcagagtggcagctgccaaagcttgggttgctgttgcaatttcttaaagtaagacaacaaggaagtttgccacttcaattaactcttcttctcataacagacttttctgtagcattcagtgatgtttgatagcattttactcaccgtagaacttctttccaaattgaagtcaatgctttcaaaatgtaccacagctaagtttatgcaaaattctaaatcttttattgtcatttcaactatatgcacagcatctataccgggagtggattgcatctcaaaaaaaaccactttctttgctcattcataataagcaacttctcatcacttgaagttttatcatgagattgcagcaatttagtcacatcttcaggctccctcctttttttttttttttttttttttttgagacagagcttttgctcttgtcacccaggctggagtgcagtggtgcgatctcagctcactgcaactgccgcctcctgggttcaggcgattctcctgcctcagcccccagagtagctgggacaataggcgcacaacaccacccctggctaatttttgtatttttgctagagacgagggttcaccatgttggccaagatgttctcaatctcctgaccttgtgatccacctgcctcggcctcccaaattgctgggattacaggcctgagccactgcgcccagccaggctccacttctgctccactcctttttttttttttttttttttttgagacagagtctcgctctgttgcccaggctggagtgcagtggcgcaatctcggctcactgcaagctctacctcccgggttcacgccattctcctgcctcagcctcccgagtagctgggactacaggcacccgccaccacgcctggctaattttttgtgtgtttttagtagagacggggtttcactattgtagccaggatggtctcgatctcctgacctcgtgatccacccacctcggcctcccaaagtgccaggctccacttctaattctagttcttgttctatttccatcacatctgcagttgcttcttccactggagtcttgacctctcagagttatccatgaggattggaatcaactttttctgcacttctgttaatattgatgttttgacctcctcccatgaatcacagatgttttaatggcatatagaatggtaaatcctttctagaaggtttttaatttactttgcccagattcgtcagaagaatcactctctatgacatctataacctttttaaatgtatttcttaaataataagacttgaaagcaaaaattactcctgatccatgggctgcagaatgagtattgtgttagcaggcataaaaacaataatctccttgggcatctccatcagagttcctaggtgacagatgctttgacaataagcagtaatattttgaaatatctttttttctgagaagtaggtctcaacaatggcttttaaatattcaataagccatgctataaacagatattctatcatccaggctttgctgttccattttttgagcacaggcagagtagatttttcatgattcttaagggccctagaatttttggagtgggaattggcttcatcttaaatcaccagctgcattagatcttactgagagtcagcctgttctttgaagctttgaaactggtcattgacttctatttagatatgaaatcctagatggcatcttcttctaatataggactctttcatatacactgaaaatctgttgtttagcatagccaccctcattcacaatgttagctagatcttctggataacttgctacagcatctgcaccagcatttcctgcttcacattgcacttttatgttatggaggtgacttctttctttcaacctcatgaatcagtctttgccagcttccaacttttcttttgcagcttcgtcttctctctcagccttcatagaattgaagagagttaagggcttactgtagattaggctttggcttaagggaatattgttgaaaccttctccatatcatcaataaagctgtttcacttactgataatttgtgtgcttactatagtagcactttcaatttccttcaagaacattttatttgtattcacaactgggctgtttagtgcaagagatctaactttcaccctatcttgacttttaacatgtctttctcactatgtttaatcatttctaggttttgattaaagtgagacatgtgtgactcttcattccacttgaacgcttagcagccattgaggagttattaattggcctgattttaatattgctgtttcacttactgatatttgtgtgcttactatagtagcacttccaatttccttcaagaacattttctttgtattcacaactgggctgtttagtgcaagagatctagctttcaccctatcttgacttttaacatgtctttctcactatgtttaatcatttctaggttttgattaaagtgagacatgtgtgactcttcattccacttgaacgcttagcagccattgaggagttattaattggcctgattttaatattgctgtgtctaagggaataggaaagtctcaaaaggaggcgagagataagggaatggccagtcggtggaacagtcagaacatacataacatttattggtatagtttgcattcttatatgggtgtggtttgtggcacctcaaaacaattacaatagtaaaatcacagatcatcataacaaataataataatgaaaaagcttgaagtattgcactgattaccaatatgtgacacagagaggtgagcacacatgaagtgagcatatgttgttgaaaaaccggtgctgatatacttgattgatgcaatgttgccacaaatcttcagtttatataaaaaaataaaactgcaatatctacaaagtgcaatagtgtgcaataaagtatgcctgtatatttatggtgcacaatgtgtttgaaacatatatacattatgtcattaccagtttctgatttaaatccctgtactatatatattgatttgtaattgcccatgttgacatggcagtatcatgggccatgatactttcaaaataattgttttattagttttgattaaagggaaactttctttttttttttttttttttttagaattccatgacctttaaaggtaaaaattaattctctcagcttagtaataggaatagagacacaatcacactgatatttcacatgagaaattgtcgttctagcatttttactctttccttgaatagtactgttcaaccataataaattatcctcccctttgaatacgtatttacctttgcatttagggtagggtaaactaaagatttcttactgactttttttttttaatcgaaagaatcattagcaactaaatcatcttaggatgttgtttggcctttatcgtgctgacccaaaatttttgtttgcaatgtcttactaacttacattgtctttgaaaggagttctctgctcagtaattgacaagaattctctgggggagataaaaccataaactgatgtttaaaaaaataaaaagtaagccagaaatgttagagataagggatcaactgcaatttctgatttggtttcctagcacctaatttctatttctaggcatgcgcaaacatcccgtcctagtcttacagtgttatccttatgtgctatttgtaatgaggcacagtaagaatttaggtggtctttgatttatgatgtgtgctatatatgttcgtaatgatctttaagtaagtagcataaatataacactttctgtagtgtctggtaatacagtgttgacaattagtgatgggagatactgatttagattacttaaaaagaacctacatactttgagattagttgaaatttttacatccacacatactgatagtatatggaggaaactaaaagtttcctacatgtgcatgtacataggactctagactttatttattttcttatttttatctcatgaattaaaatcagatgaacacatctgtaatctaccaatttcttagtccatttatactgctataaaaaaaacgcagactggataattgataaacaattgaaatttatttctcacgtttctgaaggctggaaagtccaaggttaaggtgccgacaggttcatgtctgttgaaggctgctccctgtttccaagatagccccttgttgagatagcctctgaagaggccaaatgctgcgtcctcacatggccacagagaggtaaagaagggacttaccctctcaagcccttttataggttgctgatctcatacatacaagcccactcttatgacttaatcacctgctaaagtccccacctttgaatagtataaagttggtgattatttttcaacataatgaattttagaggacacattcaaaccacagaaaccaaaatggtaagattcagttgaaatttcactatctccatagatctgagggtctttaatctagcaaatattgatatttcatttagaaattttgttgtatacttttttacccttaattttattatttaacgcatttttataatcaaatctgcacagtttagaacatattcatatacagtgtgctgttatttttttcaaacatatgatatctgcctagttcatttgaagcaccttatataattgaaactcaaagtagctgtgctagtatacagtaggtggttgaaaagtgaaaagaatctcttttaagttatttattttcactactatattaaagtgtaaaggcaagggaaacactttaatacatattgtaaaactaaactacttaacagagtaagtgccatatagttaggccagaaatagatccacttacagataaaaatttgatatattgctatattaaatatatagtaaataggaattatgtatctataataaaaagcatattcaataaatggctaagggataagtgtccaaaggaaataatatttatgtcaccataatcaattcactaaatagttaaacacttgaatatttttatactgctggatgtcaaaatttaggaagcagagaaaacacaaagaagaaataaacttcagggaagaaagatataaaaaattgagacatcattttcagcaaatatgaaaaactgtataaatattcattacttaatggattcataaatactggaatatgttaaaacccagaagataaatggacaaagacatgaagtgatcattatgaaaaacacaactatgtaactcctcttgtatttcacattttctttacagaacctattagtaagaataaatctaaaacatgaagaaagttatagggatgtttgtttcaacattatttaaaaccgtcatatcccaaacacctaggggcccatcagtagataaatacttaggtaaattatgtgtgtacacacagactcttatgcaaccactaccaatattagtcattaggaccatgtaagatcgtggcaacatgtgtactgttcaatgaaaattcatcatttaaaacagggaaaacagtataattatagcaaggcaaaagaagaacactcatgaaaaaacaatgaaagtaagtacttcaaaattataaggtgatttgcattatgaagaagagactgtgagtatttttttctcatttttctagtcctcaaatttactgttacatgaacactgcctttcaaatgtgaaaaaacgtttaaggtataaaaagaagaagaagcaaatgtgcttctttagctagaaatactctaaagtacattttacattttttcagcagtagtttcatccattttactagttattatttttcttttattaagacaaagaatattcaacagggggcaaatgcaagcatctgtttggttctcaggattcctacagctcttaaattataaactgagaacttatactatatataaggcaaaatagtttaaaaggaaaattaattctaacaatgcattttaccagtaaaatataaaatagggatgagtgtaaaaatcgaaataaatgaagaaatatgtcagtcataaaatttcaccttggtgtttcaactcaggcaattcctagagggaagagtggcctcctgactccataggaggtataataagtgcatgaccagagactgctgaaaccaataaaaataaccgtcaacccaccacttgtctttgtaatcactccatatcttgatttcccttgcactataaaatagactaaatataggcgagttcaagaaaaaattgatttaaaaaatatggctctttttttctgattagatttcataatttatcagagacaaaatatctctacacttctttgtcatacgaatcaaccttgagatattcacctttcagcatgtaggtgaaattttaaatagtcagtattcatcattgccattagttattgtaaggtatagcttattcctctcattggaaacaaagtgcatttcttacctgacctctgtgattcttaaacaatattcatttgaaaagcttgtagacaccactgaagagtgaaaatatctacctttcttattttcaggatttgatcacagtaaaaatgctttcatttggggagattctacctatatttcttggatcacaatgattctggaatcctaaagagttcagagtttagattgcatatgtcttttcttttttgacttctttcacttttgtagctaacaacttgatcgtaatgactcagtccaaaagaaatatgaacctattagttttagtgatcatgaaaacaaatgcttggtgaatttttttctaaaacatcaaaaaaatttaaattttagaattggaagaggtcttggaaaatgttatctaattctcactcttcacctcactaaaattttgaaaactttaagtgatttcctaaagggacacagctaattagaggcagagttctaacagaaaacccaagtctcttgattcatttccagtgctttaaccaatatattatgttgctatgtaggatagtttaaattctaattttccatggttagttttaaaatacaatcatttttaaaatatactagtaaaacagtttttgctttctaaaaataaccagctctaaaagggatcttttcaagcattatcattattttaataactggtttttaaaactatcaatctgtattagtaaaattttcactcagaaaatttgactacaacaaaaataacactaaaaaaaacccacttctaccactactgtcatcacttaatatggatccttttcaagaaataaaattataaactttaattgaaactttctaaattacttctaactgatcttctaattatatcccattccttaaaataagcagatatttagcaccaataggaaatgcctgtagtgacagtgaaacatggtgtatatgaatcacccatataatgcacataataaaatctttgtgaatcacaatgttccctttattctattcccaagtctctcaattataggcatatctggagctactagtccaaatataattgatttaataatagatagcttaaagcacagtgagatacagtcatccctcagtatctgtggggaatgggttccaggaccccagagataccaaaatcctcagatgctcaaatccgttatacaaaatggtatagtatttgcatataacctaagcatatcctcccctatactttaaatcatccctagattacttataatacctagtataatataaatgctatatcaagagttgttatactgtaattttaaaaatatttttattgttttattgttattttttattcttctttgttcccagtaaatttgattggccattggttgaattgtggatgcagaacctatgggtatggaacttgcagatacagaggccagctattctgaagtgcttttaaaacatcataaactaaatagcagtgagcatattttttgtgttatgttcatattaatacatgctaattttttgaatatataataaacttatgacattttattaatacgaatatttgatgtcccaaaacttctatataaaccagggaaagtttatcgtgacgtatttttttcctaacattatgtatttacattttttttgagtgttgaagaagacattaagatgtttaggagtatttaaactctgcaataacccagttaaaatgaaagctcagaggttttcattttgttacctttattgtcacttgaatatggactattgacagctcaccatttacaagacatgcacaaagacagatttattataatttaggtgttgatcactttggctggagattttctgttattagagtagaatactacatttcaaaccagctatacaagttttttgtttgtattcactgtctccatgaagaataatttgaaacgaaaattgaaggcttctaattttatgcagagtgacagctatgtatttccataaatgtatgagcattttgacatgaaactgttatttctcatccgaagtcataattgttcagcatgaaagtgggccatgagaatgaatgataataataatttgcctttttgagatcatggcattaataagcataattttcagagctgcatataagcaaaaggagtttgcctgtagacagtatgacaagacggttattgggaggagggtatgtgaattgcccacctttgcagccatcttgcctttctgacctttctttctgcgtaactgtagcctctagccagctaccttccactgttttactacaaacagtgacaaagagagcaaaaaagaggtcagtgtaggaattccaaggagttaataccttttactacatagctcaatggcatgaccatttagttgtgacatgtcgtttttaaagtagtctgtttccttttaaaagaatcccgttgtcaagaagtaaaaaggggttttgttgttgttaaatgatgttttaaaatcctgtccaatttatgttaaagaaagtacctatggaggttgagactgaaagacagtgatacatgaaaaggaataaaagaacacagcaaacataaggtctggcaacgaccatgatagttgtttgcctgccaacagcagtaataaggactagttgtaccggttgagaaagctgtttaattcagatgcatccaaaaaatatgcatccttcaaaagagatacggtgcatacatttatactttaagaaacaccactgtgaacttcaatcttgaatgactcaaagaaaacgtttaaattcttcaagcttacagacataagaaagaatgcaataaattgtgggaactggtagagattttgccaaaaataaagggccttctcttttgtgtatgtatgagggtgtgtgtgtgtgtgtgtgtgtgtttaattaggtaaaattatgtaagttcatttaggctctgcagcattttctgatgacccagtaatcattttctgttatcccatttagctgttaagagcaatgaatagaaatctgaaaccaaaagccattccctttaaaattctacatgcattaacttgggttgcaggaggaaattcccttataaaagtgaaggtattaccattaacacagagaactctttcagtcgttcagataataattctgactctcatttctaggacctgtcccttcagttgttttgcagctaatggtcagaggtttgttcagaaccacccacacacacttgtttagtccctgggtgaccaacagaatgcatttatgagaaggttgggccggagaccgcagtgtgtgcctttggtacagagattctctttggtgcaaaatctatctggcctttatagatattgcattagcatcgagcacaaaatgttcaactgcctgactcttgaacccttttccctgacctcaaatgaatgttttctgaagatataaatgtgtgaaaggtggtcatttatataaacctggagaaatacaaggagatagcattgaaagaaaattgttattgcactctgatcttgcaggaaaattgatttattattatgaaataacaaagtactcttaaggctaaaaccttttttgccctacttcaacctgacgaaaaggtttacctcctagttataaacccatccatagcgtggtctctaatggaaaaatccgagagctccttcacacatggcaataggagccagtgctctaataaaagccttcattaaaatatggttggaatctatgtggcatggcaattctcagctacaaattgaaaaagaattggttgcacctgtaatgagagttcaattaagtgatcttggaaaaaagctagaaggaaattaaatattgaatccttcatcattgagtgtttatcttgaagggaataatgtatggactgaagacaagtggagatcagcagacataacctctcctgtgtttattctttatggtgaaggagcttgcccttattcaagcaaggcacttctctatccacatttaattctgtggtaaaataggataatacaaaccacatgtttactacaacatagagatgtcatacaggttgacaggtaatgacagcaaagcactctggacacaatgctaatattgtgcactgttcattatttgaattattgatcatgtgcaacggcctaaataatcaaaatagcaaatatatagcctgatctctcagttcccaagtggaaggattatgggctgataatcatatccccttagattctctttaacctaatgtgatattttgtaagactttcaagctatctgcatagtcagaaaatcattttagatatttaggcagcaaaagcctcttcacagtactgcatttggcaaggtgccatcctaaaatagttcctcttttccatatgtgttatgccctttgcccagtctacctcccttccctttttgcctagtttggcctttattccttcttctaaagtttccaaacccatgttttcctagctgagccatccacaaaccttaaactgtgaggatgatttactcctggccaatgtccaggcccatttgccaacctccctagcacaactctaaaacttaccaaggcagtggatatgagcggccactgctgagggatccttgggacacttctcaaatccaacataatcagatttagaaaggttgggtctttctcatacccggtgttcaaaagaaacctaatgatacaagaaactctccagctctgtcctaatcaagtcacaacaatgcccatcatgcagaaaagacaaaattgcttctaacacactgcctcacaccttgcggtgagtaataaatacttgatgaatgaatatgcaagaaagtgcactaaatggcagaaagtatattccacagccaaggtcacagcaattatgtttctagaagcaggagtcacaggaaaaataacaatcacctgaattactgttctacttaagcacatcattgaaatggttttgtgtatcatggaatcctgatgcgtgagagaagtcatctatctttacaagcatttactcctgttaagtacctattatgtcattaaaacagaaactttgtcacgtatatttaaggttttttttttttttgcatttcccttatttttatgtatttgtatgttaaatcctttgttctgcttgggcctgtgaaaacttattactttataagtctctgtgtgtcatatcctccaatagatcctgccatctctgttctctgtttttattttatgcaactgctttttcagatatgttgtgaccttcgtaaatgtaggttgggaggaacaaaacattattaagattttcctatgtatgttttatatacatcatttccttttaactttcacaatagccctgtaaggtaaggatcagtagccccagtttacagatgagaaaactgagtctcagaaagtagatcacttcttgcaggctaatatgtgtcagcatcatattcagaaccaggaaaagaaggcaaactaaaaaaaaaaaaaaaatgacagttaagaaatgaggaataagagattatattaaactaacatttttagcactacctactggaacactgccatgatatccaattgccagacactcgtggggtttccatccagctctacatccgagttatgattcaggagccactgggcaggaaaatgtgaggacacagaggaagctgactgaagcaggtagacgagaagaggaagtgaggcatgccagagaggcaccgtcataaccccacagttaggttttaacctgacttggaagctatgttgtccctgacagccattgtagtaggtaacaatattgtactatcttggagacttggggaagccttttttccccttttctaatatctaaaattaatctgtattataactatgcatcttctgagcccttgcctcttgtatacctgctaattacattaatatttgagccagcatgagaatcagacagaaaacaggtatctcctatccacacttttgtgagaaatcaggcgcagaaaatcaggggccctctcataggcacctcaaacccagcatatctcaaattgaacatgtttccaacttctagctagttatccctctttttatgaccttcctaactaaagacactcatccatctagtcacccaagccagaaacctggatgtcagccatgggaagacaaagaattgtggtggttaagagcatagcttttgaagtatgtgtattctgagttcagtcaccgaggtttagatttcagctctgatactaacaatgtgacttcgagaaagttactttaccttttgaagtctcagttttttcatcaataaaatggttgtatcaatcatacctttctcatagcactattgtacgggccatatgatataatccaagtaaagagtttaataaaatagcacacacgtattaagacacaggaaaaattagctacactgatgaccatgatgattaatgatgatgcttgactttttcctcaaccatccttcaccctaaaggtcatcaaatcctgtacattctaactaaatactttcagatcttcaccttgtgtctatcactttgtcttaggccctaaataattttttgcataattattattgcatgggctcctaacctgtttttattttttttaacctcttacttaactcacctccctttgtccttcgtgttgccccagaagcataaatacaattttgttttcctctgcttaaaattctgtgatagcttgcctatcatttgtaaatcccaacctcctttttatgtcatcgcaagtcttgcatgtctgcaccctgaatacttatgttacaacatctttggcctcgtgctactcacatcctttattcccattcacctcttcatgccttttttgtgacattaattctaactgaaatgtcctgccagtttgtccaactttcacactttcccttactcactatttcaaatcccatgaagcaccttcacttcctctttcctgccatcccttggggtgagcttgttgctttctcttttatacaacttgggcttggtattgacttccattatagcacttatcacagggtgttacaattattattataatagcacttatcacagggtgttacaattattattatcatcatcaacatcatatagttagtgtagtcctactagaggccaacatcaaacacactacctagcaaaaacctaggtcgaaccaatgaagcaccgtgacttaccaagaggtaaaaggaaggcaaccaagctaattgccaggcataactcatctccagagactcaagttgataggaaaagaatactcattggaagcttgcaagttttcaacctcctgggttggagaaaggagtttctaagtcattcattctcctgtatgatttacataaattgaatcttgcttttctttgatatttattaaagatacagtctcatagatacttcagggtcatatagtatatgagtgttccattgtttccataccaattacctcaaacttaaacatttttaaatgtttaaaataataaatttcttttcttttttttctttttctttttttttttttttgagatagagatttgctctttttgcccaggttggagtgcaatggcaatggcacattattggttcactgcaacctatgcctccagggttcaagtgattctcctgtctaagcttcccaattagctaggattataggtgtgggccaccacgcctggctaattttgtaattttagtagagacagggtttcaccatgttggccaggctggtgtcgaactcctgacctcaagtgatccacccgcctcggcctcccaaagtgctgggattacaggcatgagccccctcactcggccaataaatttattttcttatagttaaataggtaaaaagtctgacacaggtatcactgggctaaaatcagcgtattacaaagactggatttcttactgcaaggtctagggagaatctgtttccttgcttttttggtgccgggagggggggagttgttgatctaataattcagtttcttgtagttgtactactgaggagagtccccagcttctagaggcctcccacattcactttgtatccttccagcctcctctttcctcttgcatctctctgaacacagtccttttaaggactgatatgattagacttgatccatctgagtaccacatctgtaaagtccctttttctatgcaaggtaatatagtcacaggttcttgggagatacttcatgattttattacaaaggcatcaagatgctagcaggtgatgatctctaccaggattgcccggaaaggaaagcaatgaaactaaaacttggggaatcttactgtgaggcaaagagaagccaaaatatggtaaagatttttaaaatatttcctttcagacaccatataacagggtactcagagaactcaacctgaatggagacactcgacttcccagtgtcagagacttttattctatgttaccaggagcctcctagcttccagaaagaccagagaccagtaatcatttggtcctttgaatgatagacagaataattttccccaaagaagatctcacagagaaggaaaacttggcagcttccaaggacccttttttttttcttttttgagacaagagtctcactctgttgcccaggctggagtgtagtggcatgatctcggctcactacaacctctccctcctgggttcaagcgattctcctgtctcagcctcccaagtagctgtgattgtaggcatgtgcccccacacatggctaatttttgtatttttagtagagatgggttttgccgtgttggtcaggctggtctcgaactcctgacctcaggtgatctgcccaccttggcctcccaaagtgctgagattacaggcatgaggcaccgcacctggcctccccacacctggcctcaatgactatacttttcctatcaacttgagtctctggagatgaattatgcctggcaattagcatggttgccttccttttacctcttggtaagtcaccatgctccattggttccactcagatttctgctaggtagtgtgcttgattttggcctctagtaggaatacactagctatgtgatgatgataatgatgcttataattgcaacatcctatgataagtgcttcttaatctgtttccagtttcccaaaagatctgctttgtgaagtcctcatgggggaatcattctgcccatcatacataggaccaaataattaccgtccagctgatccttctgtgagctaggagaatcctgatagtgtagaataaaagtctctctggttctgggaagtagagtctctcctttcaaattgagttctctgagcaccctgttgtgcagtgtctgtgaaaaggctaggaatagacttacatttctcctgtagcagttttagaattgcttgggtgagttcttcatgccctgggaaggcattttactttcatagtgtttatgaacttatttgacatttgttagtttgatcctacaaaatatgagcatctggagcaaagttggtgtatgctttattagcatatattctctgacagtacctttactttttcattctcttctccatcccagtctctggtcacagttctcattcataccatagatgctgacatgcttcattttaaagtgccagccagccctgaaatctccagctgtctcaatgccacctccttatctagcaccactcccatccgctcttctcacccaatcacctttccctcagctagagacctggactctcaattatcatttcattcaaataaattgtctcttccttgccacactcattgttccttttccttgaacttgactgtcaattagtgatcacaaactgccctgattaccacacttactactaaacacatccctcaacacctcactataaactactcttgtttcttattcaacctgtttccggggtcccaaaaggtgttctttgtcagaaccagtgttctttcatccagaagtaagtatctttcttccctttcaaatttagctactttcttcttcaaactctctattccactgatcccatgattgtttacatatgattaaaatcttcaccacatttttcactcttttgctgggcaattaagattccccaagattcactttcactgattttctttccaggcaatcccgctagagatcatcacctgactagcatcttgatgcctctgcaataaaatcataaaatatctactatcttcccaaatatccatcccattaaattaagatagtaaaatttggtatcttcccttgaagaggacattgacatattgctattgccttgtttagttcctataaatatatcattcaacaaacagcctgcactgatgtcctctgcagttttgtagaaccagaaattgagatccaaatatgaatagctaaggttagatgagttgttgagctactaagtgtagtctcagtcagcagtaggcctagcttatcccaatataagcaattttacttttggagtaaaatccaatgacaatttacattttgatctcattatgtctaggttaggtaaaatgttatactgataccctcatttggatgtaaaacaaataaggcattcttgttctaactagtgaaggcaagataaacaatagatatcttataagaggaaagtcctgttcactgaaccagataagctttagggactcagttctacaagtaagccatagatttcttctctccttgtcatgaacatctaccactcatgttacaaatcaatactaatagaatagcatggtgttcttgccccctttagactacatgaatcattgcaaacaatcagatttgcatttgtaaaagccatggtgtactgtaaaagttaacactggaaaaattaaagaattcaaaagccacatgtaaaagaaatgcttttctagattatacttgaattatcatgattcaatagcaaaaaaaaatcctaataaaagtttctgtcttgaaaattagctttcactgacatttataaatggtaatttctttacttaggcatctccctattacttgtaacaattctaaattttgctagtgttaagaccttgaattgtaagttgtcctgaagatgtgctttaaattcaatgtttttgcaatctttcaatcattgagataatttcattttattgtggaaatatacaattttacagaaagtaaacataggaaagagttttgatgttcagtttctcttttagatatcaggaaaaaaatactgcaatttcttagtaccaggcagtgaggtgctgaagccagctcattttggctttaaaaggcaaatcgtgtgcatctcttcccattgtgcattcagagatgtcactgtggttgctagaaatagaccatgtcaaggtattcacaccatagaaatgagtaaatgctccaaatcagggcttttcatcccagagacctggtattaagcattaaccagcatactactggtatggcatgttaacatacacacaacttctataacaatgtagtagcttctagctctggggagccaaatggactgattgttgttgctgttgttgggtgtgtatgttttacagttaactagggacttattcatttctgtagtaaaactgtcactattaactgtgaatccatttttagtagtaggattgtatgctactttgacaaggtaccagctacaaatattccctgtaataaatggagtatcagccacaggatcaacacactttcaaagagacctcataaactacattggattaaagctgtcccaatgactttagacaaactttaaaggaaaaaatgaaattgttttgcggaccattcagatacagctttaagagaacaccaaaacaatagcaataataaaaatgaagtttgatctggggtaaggagttagagttctttccaagaataataaaattatttgaaaatgttaagtgttaaagtaattaagttcagagacaaaatgataaacatgtacatctctggatcttttagaaaaataatacaagcaagaagccagttttattccttcaacttttcctccagtgtaccattcccacctccatcaaactgtgggttctattattttagcaaaggcagaaagctttagaggttttggggtaaatacattttaaaaacctaaaatgggatcttagatagcataaatttgttgaacttgatatagagtcagagcaattaacacattgaaagtttttcaaattagtaaaaaatttttcagactgacttgcattagtcgactatactaaatgtttttaagaaaaatttggaataagcgtagaacattttttaatgaaactttatcattgagaacatagataaaccttggcaattttttaaaccaattctcgttaaatgagtctagctagattaaacaagggcttggcaaactatgaccaataggccaaacctggcctcctagctgatttatacagcccctgagttaagaatgatttttatacatttttaaatggttgagaaaaatcaaaagaatagtatttttgtcatgtgaaagttacaggaaatccaaattttccattaataaagttttattggaacacagtttcacccattcttttacgtgtcatctatgctgccttcaggccacaaaagctgtgttgagtagttatcaaacattatatggcctatgaagcctgaaatatttgctatctgctgctttacagtgtaagtttgcttgcccatggactgaatgacacttatttttaatttggatgttttaattccttttctttaacttgaatcaaattcgagatcaacaattttcttaaggatattaaatagctacatgttaattatgaaacatgtaaacaaagaaataaatgatgcatatgcaatcaactgagttcataagagataatgtgttcagattttcctttttcctttcaatcatctccagccagaggctgttgagcagctggtgaatcttctgcttctcctcaccagaacagagaggacaaaagggcaaaactttggagctattaaaaagagggtagcaaagataatgctcaaaacagagaaaataaaaagaacttataattatattgtgttctatttttgagtgctaaaaacattaatttgtcaaatgtatgctttaaaatgtgccaagttttataaactctgttttgttactacttcattttttaaatactaacaacttccaatgattggaattaactggaccttctcagggcctgaccatagctttgggtgcatctgttacagtagagatgtgaatataccctaatatcattgccctgctgatatgcaaattcaggtaactaaccagaggaaaagaaagtaattatttccagatgaagactggccaaacgtagacagaaattgattttgaaaactcatggatttttttccatgaatccctttaattacttttcttatacagtattactaaatatggttttgaataactctatctccatctctgttctttttagtttttcataagaatgggagcagagaaaaagggaatttaacttccaatttttaataggcaagatttacttaagattatctattcaaaaatcaaatggctttgagttcttcagagtttcaggggaagacggtcatgcaaagtacaaagatccagagagaaacctattaacactgggatggggcaaaatttattttcaccagtagagtaatcctagaatgacagtaaaacaattaaggcttaattatcatttgttcaacattttaccctgatagaacctctggtaggggagcatgtgttatactgacatggcgggaaagaaaactagcaattatgaaatgacgttttcaaggtcacaaaagtgataactaatatagccatgtttaaggccaggtcctctgactggaaactcgtgtcttttggaactgctgtttaagaaaacatcatagagttcaagaaaagcacctaagaatactcttaagacttttttgatcatctaatttaaataatctttacttaatgttatttggcctataaaaagctagaatatagatttattttttctcaccttccaaaaaaatccctttactagtgtttgtcatggaattgagattaataatgcattaggagttcacatatatatgcactccttaatatgtgcatgtgcgtgtaatcctgtaactgcaggaaggagatgaggagtacaattaatacatagacaagtttctgaaaccagtaaataaaacaatagaaatataaatagaatatttgaaaaactagtattttttttgggggggtgtgtgtgtgtgtgtttaaaaacagtggcttggcatttctctatggcatattagatttggataatataaaattacacttaaatctgtttacaatctcattttggagtttattccatttgttagctgccactaaagagtatttcttattttgcttattcagggtatgcatattctgtatgtaagacttcggtatgtatgatccttatttctaagattgcatacaaaatgataaaggattatattttgcaaaactgaagtataaaatagtaatatctctctttgtggtactcaagacatcctgatttgataatttcattttggaaactttattgggaaatgatctgaatttacacagaacacttaatttctttttcgagaacaggccttaaaatgctgttgaattttattgatttgctctgagaatcactgcactgcccttcaagaaatctgagctgaattgaaaggacgtactgcagttgctgtgtcagagtcagagccatttgtctcacaacattacactgtatatattgagacttcagacacattttgcttgtctaaaatacagcttttatatttaagccattttaatggcaagttagtattaaaactgactattggatcttctgatgtggattttattattagtactttgcttggcatccaaaatttggttccctacacagatagcccttgacggaatgttatttgattatccaaatcagtactcacactttttcaagaaaccttgaagaaaatttagtttcccgcactctgccacatcccatactcctaacttcttttagcttgaatactttttctttactttttccagacctcatagtttttccactcctcctggataggatccattaaaaggaggtgagttcacttagaggtcacagcttctgtctgttgtcttgacctttccataggaatacacacatgactggcccatgtcttacttcctcaactggtgaggatttcagaattgacatagaaatagcttatgtttgaaacagaaaatatgatttttaagagagtttatgtaaggattttaaaaatgtgatatcccagagttacaggtcaacctgatttcatatagcaacatttcatgatagttattcttacgtagagtttctctccacaatatggaataatttaaggttacatttatcattacacatgacctttgagtaacctgtggctactcaaaccagtttttaagttggcaagcctctggcaactatatgctaatatttgattgtggttatttcaacagactttatagccttattcttttttattacttagagagaatcatagagtaggcatggaatagtgaattttggtttatttctgggccaagagagaacatgattataattagatgagactataactattctgtgagcccacagcattaagtctagagatcataccaggagcattcatttagcaaaaatgcattttgtgaactactgtgtgccaggcactgttttgatgctagaaacagcatcaaagcgaggcttagtacttgtattaaagaggtctcatggggtgaaacagataaacacaataaaagtaccatgtgtttactgctataatcaaaatgctataggaatttgagggcttaccacccaacttagctttggtgtgtcacagcattctatgcagatgaatagcactgtaaagttctggaaaagtttagcatgaggaagggacttgtgaagtaaacagcagacaggtcagaaaaggcattgagtgttctgttaggaattcatactggggaaaaagggatagcattgatgggctttttggagggtaatggcctcattagatcagatcggcagtaatccaggaggaagactggtgattggatctaaggaaaagggattagcatggggaggagaggatgatcaggagagagaacagaccagactcagctactgactgaatgaagggattgatggaagtggagtactcagggtcaagaatggtgtggacagatgacaagccttttacctttagtcatatatgtgttatgttgaagagtttttgcatggtaaagataatttaatctttgtactttgattatctgaaatatatttatgtaaaacataaacatgtttctctcaattatttaacaagtaatgctctatactactgcattttcctatttgttactagaggtgacagatggaagctgcagattgggaagaagtgattaaacagtgagaataatctattggtgaggccaggcctacatatcaaggtagctgtgctcaaggtacagaatatagaagagagggtaggaaggtatacctgcgggcaaggagctatggagggcctcctgaaacaatgaagcgattgctgaaagctgggacagttagtcttctattttaaagtctcaaatgagagttggtgtcagtctcagccaaattccttgaaatactgtcatatatttcagggagctgtaaggagatcttttattacatcctttcaaatcctgatgtgccctctagaagttggctttaaaatacttgtagtcttttttccccagcacagactcagaaggctcttcttttttttttccatttccaagcagctacaaagtttactgttgaagtagaggtttacttttctaagaaatttttgaaggacttttatattacagtacaatttaaacttttaagaactttgtaatagattcaacttacacgactgtgggctgtcaatttattttattatttgaaaagtcaaactatcaatggcttttggtttgcatataaattcttttgggttccttttgtttcattattgcatgggctttttaaaataaaagaggtatgatgtaaatatctccctttctcattttttaatctctccttttatctctcctttctcctttccaatttcagtttagcaaaaaattactcttgggctagttacatttaaggcattgtgctagctctggaaagacaaacaacataggaagatatctctaggatcaaggggttagaatctctttgtcctggcttctctcttcttaactttcacctctttctattttgcttaatttttcttccttttttttctcctaaatggagtatacttttgcttatatgtgaagataaagggttttttttttttcatttagtttcaagtgcataaccacaaatatgtgataaataggcctattgaatgttcccatttcggtatggcagctggaggaggatatggaataatatcttgagagaaatatccatcctaatgtcttcagaatttcaggggaagagacactcatattcttttctgggtcacttctgtttctaagagggaatgccttagaccagctctgaccatacaaagatatgtttgcatttatgattctgcttgctggtcaacaaagcggtggtgataagatttgacagaaaatgccaacagatacagaacaagaacaagttattttcaggcaggtaaaggaaaagcttacaatagcacacgctgattatacaagactgatgatattgcagtgttccaagggagagggccaacctgccctggctatccaggcccataaagagccttatattgctgcttctgtcctcttcttgaggtgagaatcttatcaaaattttggaaaagctcctttttctagtttcatgggttttaaacctccgtggctcctcctgacaaaattctggctacccgcctgatgcaaagaactggtaacaatttcactatttccctgtctgtttgcctgagttctctttcccatgtggactatcgccatagcagggtagggccttggacctgccagaggtctagtcccacagattccaacttctgttagtttttacagatgaatggcactgcaaactcttgttatttgtttattcttgttttacacactttaaatttgcaacttcagctgaattgttaaaaagactctagagtgaggagagccaaagggtccatattagcttccaaccccaatttgtactgtccacttaaagcaatacgttaagaaagatttcaaggcttcatgctggttcactgagaaagagctctggtccatcatgtattccacagacaagggaagggaataatggcatgcattcctgacatttccttttcctggtctagcaccatcctaaatctttaagagagaagagagacctctcatgtggccctcccttgagcatacactggcctgttggatctggctgtgagttatattcagagacctgccagggacaatggatgtgataagaaatacatcacttggggcatttcaagcaagcacagaaatgtttggtaaaaataacagaagacatggatccagcagcactttccctagcaggtttgcctctataactgcaaaagaagtctcaggacatagcctttccttgaagcaaaatgtctgtcactgaatggtaggatttgtggggttctgacaactcttatctaacagaaataaaaatctatttcatcagcttgtaggtagtccctgaaatttaatcacgggggatgtattcctgtagtatactaggagattgaggtctactgcataaacagaatgtagaattaaagaactcttggaccaagaacagacacaagggcgatggattttaatactattgttttctagttgaggaaacaaaggcaacttaaccaataaattctctttaatttcaaggggaaagagaaccactatttattcactgtagttactgtagattgttttatagattaggaaactgtagagagtttaagtattgtgtttaacatcatgcagctaagttagtgccacagtcagaatttgaatccaactttatctggggcctaagcctgtgtgccctttgcactggatcgtattgctcttttttattagcattttttccatcctttctcctccctgtcccactgacttgctgtatgtatatcttactctactgaaatctgatctcttctactttggatcttagtaagattctgataaactaattgataatttatattaatagttgataaaactcaatgccttatggcctttattgtgtacctactttgggatagtctctaaggatataaaagagatatcacccctgccctgaaaaattccagagtagcactgtgctgccgtctatctaatcaacccatcacatttttgtaaacaaatttgtgataaaattattactatatttttcgcctttcccacgatggaggcaaaacagtgggtgattctttgggctatttcaaatctactttttctataacactatatttctttcccttctgtgtccttttttaaattaaatattaaaaatgttagccaggcatagtaggtgcacccgtaattccagctactcaagaggctgacacaggaggatcacttgagcctgagttccaggctgcagtgtgctatgatcgtgcctatgattagctactgcactccagcatggctaacatagtgagacctcatctttaaacaaacaaacaaaaacaaaaaaaaaaaaaaaaaaagaaagggaagtccacgttactgaggctctctttaattaataaatgcttgaaaaggtctttgtaagcctcaaatacttacaaaataaatggtaaagtatcttcttctatgggtttgggcattttcctgcaagaaacagttgaagatcttcccaatctcccaggcctggtagtcattttaaaacttaaagaagtataattggtgacatgaaatatccacatcttattgttgctggtcaagcttagaaggcaggaaagagtcaaaactcaggaagcctaaagctctgcttcgttataaagaaacgccaccaccagcacttctcacatttcttttggaaagaatatttaagtgtaaggatattttcctcagcaactccttgttattcatatcaaaatgttatgtcaagttgatttcctcttaccgtgaggcatcacttaaaatacctacctatagctatgtccagttagtggagaatacttcatttgttgtatttccaagagtccaggattctacagagaattttttcagagttaagaacaagcactctacttccctatttccctacatttctgtagtagagctgagtcctcttctctcttcttatcacatgtagagagttgttagggactataaagaaatgaggatccaggagaaggcgtatcttagatggctttatctctctctctcttttttttttttttttttttgagttggagtgttgctctgtcgcccagtctgtagtgcaatgacatgatctcagctcactgaaacctctgcctcccaggttcaagcgattctcctgcctcagcctcctgagtagctgggattacaggcatgcttcaccacccccggctaatttttgtattcttagtagagacggggtttcaccatgttggccaggctggtctcgaactcctgacctcaggtgatccacccgcctcagactcccaaagtgctgggattacaggtgtgagccaccacccccggctaatttttgtattcttagtagagacggggtttcaccatgttggccaggctggtctcgaactcctgacctcaggtgatccacatgcctcggcctcccaaagtgctggcattacaggcgtgagccaccacgcccagcagattgctttatctcttttacctttcaatctactgtagagctcaaagagaaaacaggacaacttttataaaaatattgattactgcatgttagttaaaactctaaaaataaggcacaaataagggaccatttataccaaataaactggaaaaaatatgtatttaaatggtaatacctaggctagtttgattgcagtaaaaacatcacacgtatctagtggttcttagcccagaatggtgcattagaaccacctggggagtttttgcaacttaccaataccaaccttccacctctgcctcaaattcttagtgatggagtaaaacaaaggatgctttttgaaagtaatttttataatatctttaaatagccacacaaaaatgtttgcattttcaaacctcacaatctcacttgtggtaagatatctttataaaactggaaattgggaaaaagctgcatgagagaagctcagagttgtttattatatttaaaattttaaacagccaaaatcttgaatgtgcaatatagtaatttctatccccatcaccccacactcactaatataacagcacctagttttaaagtctgtctagtgcagagctgactatgaaatcaggcatggtacagcctacgtgtagcaacatctataactctagtggggctggcaaactcaggggcaattaatactgatgtaattgtggaaattacattaaaaaatagacactgcttataaacaactagaaggaaatagagaaaaataaaaataatttggcttgttgagatgatggcattgcgttatttttctttcattttgaattctgttaacataattttgatgtctataaaaacatttttaatggggactattggcaggctaaagatgtttttagctttattaatttatctaaagattgaaatgtaataacatcaactggccagactcaagtagcttaaacccagtgtcttaagaatcattagtctttccctatcacaaagtatccctctctaccagtgaggtggaaaaatggatcatttttccattactggcaaacatttgtattagaacattgtctcccaagattaacattattcattttaaggaaataactagtatgaattgtattctattagctagtcactaagtcaggaagtccttgcagaacgatgcaaggaaagtaagatttggtttcgggggaggttcagttaagataaaaaaaaagcccagacaatggcatttggcacctagaagagaaaagcaacctgaacttcaatttaaccctgggcttagccatcttttttatgataaattttccccggggacctacactgcagatcattctttatcataggactttcccaaacagaagcatctcatcctttggggctttccctgaaaaaagtttaattcaaatagggatttgtgtgtatcctatgccaggcacagtcacagtccctggtgtcctagaccttacaatttgaaatgaagactcacttgttcaatttccactattgagcaatcagcttgcctggagaagctaatggttgctggtagattatattattttctcacctttcagtggttacatttaagtatggacttctcaagggaagcttcattgcaaccaccctccccacagcatttatttatttatttatttattcatttacttatgtattttttgagatggagtcttgctcttgttgcccaggctggagtgcaatggcatgatctcggctaccgcaacctccacctcccaggttcaagtaattctcctgcctcagcctcctgagtagctgggaatacgggcatgtgccaccacgcccagctaattttgtattttcagtagagacggggtttctccacgttggtcaggctggtctcaaactcctgaccttaggtgttccaccctacttggcctcccaaagtgctggcattacaggcgtgagccatcacacccagcctccacaacatttcttatagtgaaggcatgttaggtcaatgggggagagatttgctaacccaagagtctctaatattaaaccctaaactctcctcagactttattccaggcacttgacactactgggttgttcatgctcagtttctttcttctccttcctgatcgttggtagaagtttcagaggatgcagtgcttctcaatactaatgtgcacacaaatcacctgggatcctgctaaaaatgcagattctgcttcatcagaactgggatggggcttcagattctgcaattataacaagccttttgatgctgctgcttgtgttgtttatctctgtagtatctgttgaatagcttgggaagtaagcttaaccttgaaggacaaggacaggaaaaaaatgaaacttttcctacaacagactggatatcagtgttcattgcccattccagtaatacatatgatcattctaagcctgaaatttgaagttttgctaccattttattttgctttacagtgattctctctttcttcttttctaatttcacacaggataaaataggaataattaagtaatccctttatatagcttgtattttctagtatcctttgatttagatctatacaaggtatgcagatttttcaactatattctactaaagttcttacgattctaaaatcactaaattttaataagtaatatataatgctcacagcaaatgtgtgcttccttgaggaaaagagaaacaaaattattttggtaataatgtagcataaaaatctccatttggagtgagagacttgattttaagattgagctgttttgatctcattgtaactgtggccattttcttatcttctccaagtgttcttcgtcatccataaaatgggtatgataactatatcagagggtatcggaaagtaaaaaggaaaacaaattatttgaaatgctttgggaactgaagacactttaaatagctgctaattattaattattcattacattttcgtgtaccttgcctgaaatcacaatgttttattgcatttcacacacaaatatttatgaatattactaaatgtaggtataagagactaaatttgtgaaaaatctcctaaactcactgtacttgcagaaagaaaacaaactgttataatatccaaagagaatttattaagaaagcaatcccccaaacaataaaaatgtactaatttttgaaaaataattgtttaagctgttacaagcgccagtgctttttatagctaatattcttttctctagctttgctaaatttagtagtttatctcaattattaagtgacagtaatatgtaagtatctaagaggtgaaataaatctacgttaaccttgtatagaacggtttctaaaacaatgatcaaactttatgagaatgcaaaaatactccttaaatattgtaatcatccagaaacactgacacacatgtctaatgagtcaaaaatattaatttcctttttctctccttcaatatatgtaaatgttagcaagcctgatgaaaggttgaatcagagattagctcaaaactgtcaaggagaatatcaaaacgacaccttctggggcatgtaggcaaaccaaatgcttagtggagacaggctaatttatcatagtgcagttgcgatggcaacaatagttcttggtgccatgtgacccaaagcagtttctgttgactggctctaactgactgtcagttcagcaaaggttccactgtttgcagtgaaaaggaagagagagcattgatacttgttgaaaaggcataataataatagtgtatctcaaaccatgaaagcatccctttgtttcctcgaagtttatttttatgctggctaaaaggatccctctaatttttgttacacaaagaccccttatttattcacagattaaatatgtgtccctctgtttactaagaattctatctatgccgatagagttgcaaacaacaagaatttaaatctttcaggataataataatgttgtatttacaatgtgctaaattttttacagaactttttctagtatatttcataagatcacaagaaatctggttgtatgaaatataagccagtaactaaattctcctgcatataattttttcaaatgcaaaacatagagcctgacagtgttcccctctgatccgaagagagcatgagatctttaagaaaggtagacaataagtattcactttattcttcttgtctccttttcactgttattttcattgatgagcaagtaacaagggccatggagatagtcacactctttgattcaacaattccactcccgggattttatcttggggaaacctcactaaagaaatagttctatgacatagaggagaaagaatgagatttggagtcagatatgaatttcaaatcctggttctgccactcgctcactgactgcccttggggaagtatttttcctctatgagcttcgagttttctcatttgtaaaacagacttcagagtatccaccctgaacagtgttcaggggccttataaatcatatgtgctaagtgtctggtatatgccccatgtatctaccagagctctcagtatgtggcgtttctcaatgcagtatcatctctaaaaacattggaaaaacaatccgcattcctagaattagaaaaatgagttagtaaactgtataaatgaggtgtatcaacagaattaagcatgatctaataatcatttaaaattttgatgaaaaaacgtgactatgggagaaattttatgatataataaaaataatactattacaaaaagcacaagtaaaattatggactttataatattctatcactgtataaaatacacatgtctgaagattgtaactggctagacgaaaatactatagaaagtatgattacaagtgattactgtgttaatattgatccctcctttaaggtacttcactgtcctttccattaaaaatataaggaaagaaaacagtatagaggttggagtggtgagaggaatgccttcaatggctcacaccaccaacaacagcgactagaatgcatttaaaatccctctttctcttccacttaagaatacccattcaccccaagtccatgggaggcagaggcaaagttaactaaatatggctctgcaaacacttttgtgcatgttcttggtattccctgaccagtactgcctcaaggaaaaaacagaaaaacatttataagaaagaatccatgtgtggaaggattctaaattacacaccaaagaaagagtaagtggaagaaaagtgggaggttgagagcagtttgcaagattgattaaaaggtgtggttcgcctttggaatgcatttgtgttcaaatttgagatttagatgtttgataccctggcatgtgggaatagcagctataagtcttttccataggattagaagttcattataacctggaactaatggccacaggaactaagagccaaaggattttctagctgagtctttttaagtggcagttgagcagttcactgagggccatgttcagtgctgacagcccaggaacgagtgaagaaggcagataacaaggcattgacaggggcagctgggtaagtctctcagtgaatgctgacatgctttcctctctcaacatcccagctaaactggctagtgtccaggtactattatctactctggcaaggacaggccacatttcacttcatgcaaaaagtatgtcgagcagaagaactcaggaacagccaaagaaaagtgcttgattctttattacactcttcttacctcaactgctctgctcctaactataaggtgttcttaatttaccagtctctgttaaagagtattgctgttttaaagcagaaaaacatacactaaaaaagatagaaaatatagactgaaaatccatcttgttggtcttcatggaaattctgttagtcattattagggttccctacccaagtcaaaatcacactgcaccgcaggaaacttgtatagcatactcaaaacaaggaaatgacatctaaactccagtctagtgtgctcgcaactggcatcttcattagcaagtcaaagtgatctcatgaaattgaaatttggttgctctgtgcttccttacaatacacagttgatatatttgggctgtggttctgcctccctaggtactccaacagccatctctctttgaggtctcaccattctctagcatgtggctgagttcccattgttgttttagtgacagaagtatcccctcccccacatccttaaagaaatcattattgaatctgaaggaagcctctgccccactacaacctctcacattcactttgcctcttcttcaaagggtttaggcttttgtttcacaaaagccagcaagacttacaggctctgcctggtttgtggtcagccttatacttccctggagaaaatgaagcatgtgaagcatggaggctacttgaatggccaaaaggaaaaggagaaaatagaggagaaacacacacacacacatatataatgagccttaatgaatatatgtatgtgtgtatatatacacatacatctatacatacacacacacacacacacacatatgtatatatttgatgaagacttacatcgtcaagctctgggaccaagtacaaggtagagaattcgtagagtatgtgtgtggtggcaggggatggggttactatgtaaaagtgaaagccccaaggcacagggacactgaaacaggaagagactaaaaccaacatgaatcaataaagacaaaatcaccaggttgagcggagtaacgatttgagtttcctgatataggctcttcacactaacactaggtcagctctaaacatcactgattgctaaatcaataactgttacaagatttttgttttactttgttttaagttaaaagagtgtcatactttgtgtggtggtgttccttagaagatgtgcctgtacttgaatggagcacaagattttattttcaacggcgaataatccttgcggtttttaaaacaattgctgcaattacaaatagcattaattatgacaatgttttctttttaatcatttacaccttcagttagacttgggctcttaagattagctggttggagcaacatattaacaggaccaagatcacaggcgtggatatcttggggccagctacgctgactctatttcatgattatggattgtacttctaacctcagcctgccagtttttaaatgcattcttctggtctcaaggggtattttgtaagaacacatgaacaaatcgatgaaaatcgatttcctattggaaaaaactcagattttatgacctacatctcatgagtaaccagcccctttgcatatgagaaacaattaattaattcattttcaaatggagctgtctacaaggatgtcagggcaaaacaaatttacattaaaaacattgtttactcttgacagatcagtagactgaagtctatatctgcaggaagaaaatgtattgctcttgaataatatccaattaagcttttcagcattttccaagagcattcaagaaggaaaacatatcccttatcaaggattctttgccttataactaaccaggtaacttctagaatcattctcactattgctgatacaatctattcaaaataatatcgtgaagaacgccgattttatctgtaatctatacggatactgttgtgagttaaagtaagtttgctagaaatagtcgtgggaacccacagttttagaggctcacattctataatcgttcttgtcatgggctagtcccttattcagacattgaatagcctttttctttccagaaaaccatggtacttatatttttgtcttcttttattttcaaggaccatgtagcttttttttcatatttatgctcatatgcaaagcctatactagtctttcttattattttctaatttttatttttttagattatagtagcattttaggctgaatcaggattgtgtgagaaaagtagcagggtttagatcgtgaactttaatgtggcgctccaaacaggccttgcctttactgcagtgggttaacatgagcatgttttactcctctgagcctcagtttttacatttgtgaaatataggtactgatcccctatatcttaggtttcttgtgagaatgagattagataagcatgttatataaactagcacagtgttagcatgtagcacatagtaaaagttagtatgattatgatatcttacgatgatcatcaaataatgaggagtttaagttcagttgcctttcagctaccctactattgctgagtttaatgagtgacctctaatggagtacagagcccaaaacacaattggtaaaacattatctatggcatactacaaatattttgctcattcattcactcattcatttattgatcaccctaagtggaaggactggaaacaagaatataagctctagcttaaggaaatagataggagaggcacattattgcaatatagcctaattataatattttatatcaaataatttagatacaggtaaaagttctttgtaaatgttgtcataataataattaggactacatgaaagccattagatatggtgcccttccagatagcaatttcagtagaatgactcttctaatgctatttttatttattataatacctaaagagatacatattccagtgaggcttatacaaacaacatgaaaatttcagatgaggccacctttttataaaagtgcttaaatttgatcagactggaatataggatgcgtgttctagtttatccataaagataccctaatctgaagttaaggattccttgagtcttgctgaatactgagagcaaatctaaaatgccttaattagtaaaatttttaaaaagtaagaacaaattgaaattttctggatggtttcctgtgattggaccaaactgttgaaggaagcagaaagtagaaaagcagacttgttttgtgtaaatgtgggtgttttgttttgttttccaacttcagactacaattgctgaataagctagtttccagcctactattcaatcaagtgagaataacatagaaagggaagaaggcacacattgcttaaaaactacttctagcaagaaaatctgaatcagtgcattccaaagtcaagttgataaactatataatggaaattagtgacaaatttagattaaagatctaatttgcagaatctgattttgcttcactgtatgagaagggatttcatggattttataataaaggaagattacaaagagacaataatctcttggattactttatactttctctggattgatactttatcacgggtattggaatcagacacataagaaactaaattgactataattttagacaaaccttgtaagtcttagttacttcttttgtaaaaatgggaacattaatatgtataaaatatttgatagtgattggcataacaccaggaacataatcaatattcattacatatgagtttaattttgcctaaatttttaatacagatactgatacttttcttaagaaaatagcaaaaccagaacttagattgaatacaaaagtagattttactaaaacaagagaaaagtaaacatatccttctttgcctctatatttttctaagccctgacctagaatagctagtccttagtcccctagtgatagttatatcaattactccctagtcaggaagatgtctaagccaaaggtaaggcagaaattctggagaaattagccatcagcagacacgatgtctaactgcctccacctgattgagaattctcatatccatgacacgatgaaatattatcagctgaacttaggaagggcgctctgaaattcttacaaagcaacattgtgtgtgtgtgtgtgtgtgtgtgtgtgttggcctttatctggatttattgttgatgaatggcttgattttaaatcaacaggctatggttcaaaccatttcacttcctttcagtttgtccatttgtaagttaaacttttaaattcagtcccttttctgtaaaactgcagtaagaacacgtacctctaaggctgttttatgaattaaataagataatgtatgtaagatggttatcatattggcacatattaagtattcagtcaattatagtacttgttcttattatttattaatagaagtaatgcattcgttacttattaatatcttccaaagcttgaactttgtagttctttaaacgtatttatgtgaaatcttaactgtgcttacttaatgcttcattaagtgttgcaacatgaaatgacctcactattattaagtatcattacagttctctgtagcttgctacacatctacaaaaggtatcaaacaccggaattttaaaatgcatagaatgggccgggcgcggtggctcacacctgtaatcccagcactttggggggccgaggcaggcagatcacgaggtcaggagtttgagaccaacctgaccaacatagtgaaactctatctactaaaaatacaaagattagcgccatgcggcagcgtgtgcctgtagtcccagctactcgggaggctgaggcaggagaatcacttgaacctgggaggtggaggttgcagtgagctgaaaccacaccattgcactccagcctgggtgacagtgagactccatctcaaaaaaaaaaaaaaaaaaaagaaatacatatgtgtgtgtgtgtgtgtgtgtgtgtgtgtgtgtgtgtgtgtgtatatatatatattgcatagaatggtaacgtcttctagtccatttattgcctttattgagtgtatcagtttcccattgctgttgtaacaaattaccacatatttagtgttataaaacaacataaatttattattttatagtcctaaaatcagtgtgtctacaggattgcattacatttggtggctctagtagagaatctattttcttgccttttctatcttctaggggctacctgcattccttggctagttcctctgctggttttgaataaactagcagtccagcatgttcagatttcaatttctgtctctgattttgcttcagtcaccacatcttttatcctgattctcactctcctacctctctccttttcttacaaggactcctgtgattatattgagtccacttggataatccaggataatctctatatctcaagatccttaacttaatcatatctgcaaaatctgacaaatgtatttgtaacgtaacatattcaagattctggagattaagactcagacatctttgggaggccattttgtatctgctacagagaatatgaaggaaaaagctgtttatccccttgaggacataaaggacatattaaggaaaagattcaagtttactgttgttcatattttactttacaagcatatttcaaagaggacagagcagaaaaaaattttcttgggtttttaccatatgacagaatccatgtgagataatttacacaatttcattaaattgtctaagccacactcactttattaggaaggttccattagccacatttcacagaagaggaaacaggactcctagaaaaatttgtccaaaatcatccagctaatggtagagttaagaatttgaaataagcctggccaattccaaaatccacactcttaactaggtcatgctctgtctataactcattgtatcttagctagaacagtttaaaagaattcctaaaatatggataaaatatttaaggatttctatattatattaaatggctaattgtacattttactcatgtttttatcttctgttgaactaaaaatgaaaaacatgcaaacaaaaaatgttctagtagatatatagctattaaatatgcacagttttgctatagagaagactcatttttctttcttaataaataatagacatttttctaaaagttttataaatcttaacatatatgcaatcaatatttaaaatattaacatggatactgaagagctttgtacttaatttaatcaaaggagaatgctgggatgctattttttaaaaaaatattttagtcataggactttagattgcaaactgcccagagcagggttgagagagacattgagaaaaaaggagcaaacctagtatcttgagaaactgaaaattctaatgttgatcttcaggctgaaagggcagactagatacagatactctgaggccacttatttgagatagaaataaaaaaggcttggattatctcttatggttatcaagtgttctagcctactactagactagattactgcatatgaagtaccaaataagtggccctttggattgaatgattcattgactcctaaagcaggtgtgttagaaagaaagcacaaatgtaaacgttatattgccattgactgtgctcataaaataatgaaaactatgataatataatttgttttcttcagatttgggccatatcttgtatcacatcatataagaaaaatagaagacacagtctggcacaaagtttactcaaatgtcacaggtgcagattgttcttggttgaagggacagatgctaccataacacctaccaacctgctagttcggctattttcatcttcagccaccttcaagcatgtgagaatgcatatgagtcatcagacttgctgttaacttcctctgaagctcaaagtttaagagtcagtagctcataacactctatttaaggttcacaacccctggttcaacctctaggttttaaacattggagccacctgctgaaggagaaaagattggtgaataatagaagacttaagtgctccaggtctttcaacctgtcaatcagaacttttcagttcttagcttgtttaggtagagagagatagaaacagagagagagagagaaagggagagagaatgtttgaaaatcactgttctagaaccttgtagctggctgataaatgtatacatatgtttaaaatgagaagcttatagtttcaaattttgaatcataaattcaaggaacacaatataaacaacgaattggaattcagcatatgtgtttcaatttcaagatcttttgttgacttacttatccaacttactttttaagatgcctttatgttttggggatttaaatgagttaaacctcaaaaatcctccaaagcaatttggaatttacaggaagttcatagcaatagatttcactcgaatttggtccttaatatatatatgtaatatatattacatattatatatacaatatatatgtagtatatataatatatatactatgcatgtataatatatggtatatatatgtagtatatataatatatagcattattatacatttaatatatattatatatttctactatatattatatatagtggaaaataattcaattgattttagtaatctattgtttcatttgtagtaatttattttttctgtgttcaagttcagttcatacaaggaatgcatttacacgtaaaaaaatggttttctttcctttctctaaaggcttcatttatactgttttaattgtgatcaaatctcatttattttaccctaggaaaatattatttctcagcaactcaaatttaattaaatttattaatttaactttttatttcagttaagagattatcaagatatttttccaacaagattattttaccctcattgaaggaaacagttaacatgtgtatgagttctttgacttctcccaagtcgtacagctaatgagtgttaaaacttgaaatgagctgaaccctcctagcaacgagtatgtattctcatcaggatgttccttcttctacgtataaaacctttgaaaatacggttatcagaaattgacatcatgaagaattaagtggtgttgatcattgctaattgtagtagttggggctatttgaatcactggctgactgaaacagacccttagggcatgcttattctaacttgccactcattttctaagcagaaggtttttctttgtgccactctgaatacattataccaacagctacagcagagcccaattcagggccttagcaacccagggtggtgctacataattcctaagctttacctaatgtcttttggtggtggtggtgtttcttagttatttgctactttaatcagtttctaaataatgttttaaggaaacagcctcattgatccaggctaatacaactgcacatattaacgaataatatagaaatctatatttttttatgacttggaattttaaaatttgtataaagaactaaatatttatgtttttatgtgtttgatcaatttttattaataaatgtttcttgaactttaaatagaaagaataaggctaatataagttatttgccaagcactgtggaagaaaaagacacaaatatagtttagacagtataccggtagctgcatgtatactacaaaaatgtgaagagaattatatataatgttaactttgctaagaaatatagctcaaatttttaaaaagctgtttctcatcatgcatctgaacatatttgttcacattctgtttttcctaggaaataaaaacattaaatattatgtttcataaaactattatactttcataaaattatttaaaatttcatcccaaatgagttttgggtacattttttcaagctggttatttatattaattttacacacttcaagaactgcagatttatcttctcagaatggaggagatggaagatttttggtaaggattattgataaaaagaagcttaagctctttattagaaacagttaactactttggcttctattctaatgccatgtgtcgtctctggaaagcaatttccccaactgatagaataatattttaatggagtagtgtttgttaggtgaactgacatagcaggtagactgcttggggttaaattccacgagcaattccattaaactctttattcttcagtttcttcacctgaaaatgggaagagaaattgagtccacttcataagcctgttctgagatttgaataagttaatgcatgaaaagcttttgtaataatgactggcacatacatactatataattattatcatcatcgtcattattgtaacttcatatcacatttcatcaacattttttcagcaatcttacctacaaagccaaaaggtaagatacctaatctaatagtttcgaactttatttgactatatttcatatttttaagtctatgagtcttaaaagtgaagaggaaataggaagctaagaggtggaaaaaagtcagtttactaccatggttgctagggtctgtgggaaaggcagcagagataggagcctgagtagagggtctgttttgtggtaattgttttcttcgtaaacttctggaacttcaaaaggactttccaaaagtttcagaatcagcatttctaaaggaattgagatctgcatcttgaatggtcatacataccccaccctaaaatgaattggccagaatgaattgcctgccacagagagctattacactgtattccttttcttcttccctctttagaagggcacttcataaagaatggtgtacatctctctcttcctatagtttactgatcctgtgatttaaaaattgctggtgtgggttaaacatcttccaagacaaagaaattttgagaaaatattcttagagttacctgaatgatgtatgacataatctccctctcacatctcattaaattttcagtataaatctgataaataaattgaaacaaaaaatccttagatcattaagtaaagaaaatatttaaaatattggtgattgtatttagaaaaagaatggctgagtaaaaactccttttacaagtcagttaattttcatttctttcttttcaacaaaattgaaggtgatgataattgagttgtcagctgagagatcattaacagtaatttttatcatagatatctacatgatttttggcatataacttggaaaaagttcaaataattgaatggcattttttagaataaaacttcttccattctcatttactttatgtgaattttctcaaaactgacatctataaaaataaaactaagcataaaatctatgtttaatattaccttatagcaatacaaaaaattcagccatgactacaaaaactgattggagaaacagagatcatccatctcattaaggactgaattcccaatacatttaaaaacatttgtttagtaatcatcaaatgtatttatttatttggatcaagtgcatatcaataataattttacaaaaacctgaaagagatatattaacaattttgccatcacaggaatttttttaaatttaaatttctatttatatacatattttcattgcacaaaattttaagacctgataaaggtctctcaaacgtgaaaaatgtatttcattaaaatacagtattatggagaaggtgaaataaaagtccaaagacagaaagaaacaatgcaaaatcttttaactgtgcagggctttttgatgcattctattttgtaatgtatgatagtaggtcttaaattgatgtggccttcagagtcaattaggtatgcctgtagtccagcactttcagaggccaaagtatgagaatcccttgagcccaggatgtcaaggctgcagtgagccatagtcaccccactgcaattcagcctaggcaacagagtataaccctgtctcaaaaaaaaaaataaaaataaaaataaaaattcaattagatacaaataaaagagtcaaaacaatttttataacatgccaatatttactgtatgttgggaattatatatttttaaatgttaaacttatgagaagccatttaagtgacatagttcttaaaatattcttttagaaggtatatgggtaaaaatatatataaaccactaacttgaaccctttcaaagatcatctggttctaagatggcatgattattttgaaaatgaaatatttacttggtatatttactaacattttacttaaattttaatctagaattccttagaaatatttacagtattacctttaaaaaccaattttgagttttttggttttgcctatggatattttctttggcatcttgatattctttctaaaagttaataaaagaaataataacacagaaacattgaaacacaaaatggatcaaacctatttttttcttttggtgggggaagaagatgagaagataaaatgcaggaatattaattaaaacaccacttagtgtactagaaattcacatttgtagatgttagtaatgttatccatttttaagtacttaattaaaaagtgacattttagaaagctgtacctggataatgaaaataagccactgaggatcttttggggatgttggtattttgattcaagttttggactaataacagtttgaggaaaaaaaatagttcatttaaagaattcagagagtaggaaccttctgacaaatgagctcaatccatgggagaaataagagaagaatataccactgcagctgctgtttttatttcaccaattcagaataattagaatgtcatctacctggacccagtatagagtagtaacaattactattgcccagatgttttctttacctgcctccctcacagaaccattgtgccactttctgctaacctgggagctggaagaatacaatccaattgctgggtgtggaaccaggacagaaaggaagagcctgctcccagagcaaaggccagggagcctgtctgcagagtaggggaagataagattggatatcttttcccaaaaagtggatctgttgacaaacatatatgtaagtgtattctaagaagattaattatttaaaagtagaccagagataaaaattataaatatatatattcatagcttaaagaataataatgaatcagcacccagattaagaaatagaacattacagtacctttaaaaagttgattattttaaaaataaaatctatgtcattgttctgatttctctcactccaattagaaagcaaagattttcaaaaagcatacatgccattcaaaacttctttagctgtcattcattcttatttttagtgctgtcattttcattagaatcttggtatactaaaaattctaagatcttactataatctaattctatttttaaaaaaattcagtgactaaaaaatgaaatacatttagattttcaggtctaaagattttttttaaaatacttttttattaactttaaatagtatttttttttctgttttcatgttatctaaggacaaagataactgtatcaaaaaagactaccactcttaacaatttaaaataactcttaaggactattaaaagaactatctctattctggaaaagataattttactaattatgatttaagtatactatgaaatctcaaaaacgtctaagtctccaactctagtttctctaaataatacttttttatttcatcattttccctaaccacaaaagtcaagtataactcgcagcttgccatagagaatcaagttcacctaagtggtttgctgagtcccatggtctaatcccaatcttacttcccactaaattctgagaataatctgcttccaacaaacctaccggtgtatacatccatgtatttatcattctctactatttattcaaattctctccactttacaatgttctttatctaggcaagagcacagtgaatctcgtttcttttacctcacgagattttcattacctgtagctatcttatatcgcaccttgtaatgttccatgtttacgtggcatcatgctccatgaaggcaggaaatgcatccatccaagttagaaacttttagaaactctgtttgcgagtgggtggggaaagtgcagggaagtattttcagtcctgatgttaacataaaccttaacccacccattgttaaccatacctttaggcaattcagtaccaccttcaaagttataggactattaactgctttattgcctgtaatgatcttggtagagtgtaactggaaagccaattgagtctttcttaccactttctcttttatccagatgtggcaaatgatttttttctccccatgatcagcaaacttctcattccttttctgaacaccttctgagttatgaattgcctttttttcctttctttttctttcttttgaaatggagtttcactcttgtcacccaggctggagtgcagtggcatgatctcggctcactgcaacctacacctcccgggttcaagggattctcctgcctcagcctcctgagtagctgggattacaggtgcatgtctccacgcctggctaatttttgtatttttagtagagatggggtttcaccatgttggtcaggctggtctcaaactcctgacctcgtgatccatccaccttggcctcccaaaatgctggattacaggcatgagccgccatgcccagccaaattgcctcattttttagtatttaaaagtgtagagtttagcctaatatctaagccaaagtctctcatctagtgtgaatcctccccttctaactcagtcatgacataggctcagaaacttaagggagggatggggacacaattagtctctcctcctgctcttcctggctactatacacttcttcccattcactgctcaggctacttctggctgtttccaaagtgtaagaggaagatggggagtaaagttagaaagacctccctggaaagttagcatttgcacatttttcaagagtggcctcattttaggattggaggagacaagggggacattgttctcccactctcaactgccgctccagaaaacacacacacacacacgtacacacagatacagaaacacacatacatacatacatgtacattcacaaacaggtatgctggtgtgtcacagaaacaggctttcttccttctgaacccgagagcagctgcagagggccctgtgatccctgtagcatgcttcttcagtgatagggagaggggctccaagagtccttacttctctgaagacctggttgtgtccggcacagtgctttttatgtaggaattgtagaacacccctctgagtagttgaaattccctaacattcagggttgcacacacattttctgaaatacaagtgtagctagatctccattatttgtttttattaccatgaccaaaaagagttattgtgattattcttaacaactttaatattaaacttctgattttacaacctaagttgtgagttacctattgttaatcttataaattggctagtgttatttatatatggaaacccagactcggaaaattaatttgtccagggtcacacacttttaagtgacagagtcttctgatcctctgttcttggggatcaccacatagcctctttggtaactttcctttttgcctcgtgagtgacaggagcctcaactgtgtggtacattatcttctgtgatcatgacaaagcacttgaacttttcgagtcttaagtatcttatctcttaaacaaaataatcttaaaaatacttgcctcaaagatttattgggataactaagatctgtaatacttggagataggaactatgtcacatagtgcatgacacatgaaaggcacttaatattcattgaattgaattaaatctcacagatttaaataaaaggcctttgccttaatgttcaactttgtatttggtatgaggtctctctgtctcccttcaattaaatgatatttagaggtatgctcacaatagattagacatagttaatttttttttttttttttttgagatagagtctctctgttgcccaggctggagtacaatggcacgatctcggctccctgcaacctctgcctcctgggttcaagagattctcctgcctcagcctccccagtaatggattacaggcatgtgccaccatgtctggctaattttttgtatttttagtagagatggggtttcaccatgttgactaggctggtgttgaactgctgacctcaagtgattcacctgcctaggccttccaaagtgctggattacaggcatgagccaccatgcctggcctgacatagttaatttttgagaggatgaaaatttaaaaaggaaaggtcgattattataaatcctattcttgtagaatgctgtatttaagaacctctaaattttttagtgaaataggttctatgtatccaatccaaaggtcttatatcaactggaaaaattagatatattccatttaatatgtgttcaatatacaaaacttacatgaagttcttacttttccctgatttgaaaggagcaaagcgctccttgcctaattcaattgctcaggatggcttcagatggaagaaaaacttgtaaccattgcaggatgatcagctatcttcttgtcatcaggggcttacaatctgagcacgatatggttggtgtcatttattttgcattcttgcatcttttttctttcttgaaaataaccagctaagttgtatgttcaccttaaagaaattcaaaggatattgcaggttgtcagatttgcccacacaatatctgaagtcagaccacacacagagagttttaattggagttaccttttgctgagtggataggtgttatgtgactttagattctgtagttacaatggaatattttataaatgatcactgtcatttccaaaaaaaaaaaaaaaggaggaaagaaaccaacttaaaatttcccaaatattttctgagagaaacaaatctccttattaaagtgtatgtctacccaataagcttttttttttctttttttctttttttctttttttttttctttttgagacagagttttgctcttgttgcccaggctggagtgcaatggcacgatcttggctcaccgcaacttctgcctctcgggttcaaatgattcttctgcctcagcctcccgagtagctgggattatgggcatgtgccaccacgcccagctaattttgtgtttttagtagagatagggtttctccatgttggtcaggctggtctcgaactcccaacctcaggtggatccgcctgcctcagcctcccaagttctgggattataggcataagccaccacgcctggccaagcttcttcaaataaattccttcctacaacttttttctgatgacacctgatggcaaaaaaacaaaaacaaaacaaaaaactagtaggtgctagtcacggtgagaagagaatatttatctcagcatctccacttgatgcttttataaatgatgaatgttttagcttggaaattccgtacctactgggagatttatactttaatatcatttatcaaaaatgtaaatcgcatattattccaggttggggatgattattctaattattgttatttattattttttagcaccatcagtgctgcaccaggtaactctggcaaaaaatgttcaagttagaggaggaactgttattttcatatttcctaagcaacatcaatttgtatggctaacattttagcaataaaaagcaaaatgtaaaactgcagcccgctgtgaagggaagtctacacattgaatgaacactgcagggacatactcataaatattcattaaacagggtttcattgaaaatgaaatttaagtacttaaggtaatgtaatacaagtaggtgaaaagctatttcaccctagctaagaaaccaggatagactgagataatctaagaaagaaggatagagtttagaggatgtcttttgtaccccaaaatacgaattaagaaaatgaagtgttaattcaattgtcatattcatcctggtgcttcggaagtccagtcttcataataaaagagaacacagtgtcttttaaacaccctataattatgtgaattagggaggagatttgaaggtctagagagttctcttggagtaggtaatgaaatacagtctccaggagatagaattgttcaagaagtcagggtggcctgtttaaaatctgtgtggcctccagtaagtcactaagctctctgatgttgtttcttacctataaagagaaaatagtactacctcctcactcacagtctttttaagaaaagagagtgtgtgtatatttagaagtattttgtaaactataaagcaccatgaaactatccattattgtaatttgctagtattcatttcagtacatttatggagcctaatctcaatctctatgattgcttagttatattgacatttttacattcattgcttctattagaaactcagtcaataaattttgaatgaaaacctatgattttccaagcatcactctaggggctctggaggaaccaataaacaaaacaaaatgagaggctccaccttcatggagcctatgtcctattcaggggaagtcaataagaagctaacatcataaatatataaaaattaaaatgttagtgggtgagaagtgctttgaagaaaaaacaaagcatagaggtggcatagtagcataaggaacatggagggttacagggtggagggggcttgggtccctattttcaaatagattggtcatggaaggcttcaatgaggaaagatcatttaaagacaggttttgaagtaagctagaaagttaagtcttgtggctatctaggaaagagcattccaggcagaagaaatcgtaattgcaaaggccctgtggcagaagtgtgtcctggatattgaaggaacagcaataactgagggattgaaaagtgaatgagagaaagagtgagtagaaatagagtcagagagtaggaagccaaattctgttagatcattgaagaattttaccttgcctgggtagaaggaaggaaatcactagagagttttgagaggaaatgtgaaaagatttgacctatatttaactgcatcattctggcttctgtgtggagttaggtgaccagttaagagactattgtaataatccaagtgagagaaaatggtgaattgggaaggggtagtagcattaagagtagtaagaagcactgagagtataaattatcttggaaggtacagccaaaataatcttttcacagtttggatgagagatgcgtcagaaaaaagcagaattaagatgactttaaggtgtttttctgttttgttttgttttaattttttttctgttttgttttgttttgttttgttttgttttccagagcaaatggaaggattgggtttccattactgaaagataagagttattttatttgttctgttttcttctttcaatgcatttgtgtctaggtgagcatgtgggtacacaggatcaatcttaaatgagctatttggttatttttttcagttatttgtaatcagttgtcctgtttccactgtgatcaagttaaaaatggtactgtttcaaattgtcttgtgtcattgtggcaatagtttagttttcagttttttccttaagttgcttcataagaaataaattaatctataactcctctttcatatcgtgttatcactaagcttgagttatatagggaaatgttctgatatgattaattcaaggatgctgaagagcaatgagttgtgtgtaagcagaaaacaaaccagtacttaactaggacatctgtctatgagagagaaaggaggtgcacattatttaaaaaaaaaaaaaaagtgtggtaggatttgtctgcaaattaaatctggagaatagaaagaaagaaattagctttaatactattgctcaggagaattgttcagatagtaacagcacctacagtgactgagaagttagggtgtgtaaccagattctttgtggaatgactaaaatgttctttctttgctaatcttgatgagagtgatggtttcatcaaatttcttagaggctaaagagaattaaagtgttcagccctcttgaaggctgtttggctgggtgacttgctgagtgccagggaatagctgatttgcatatatgaagagtcagttagatgtgactcatcccagacactggctgccccaggaggtgctgtattatagcttagctcatgtgtaagtgtaagaatatctgccacagttcttttggcataagccatctgaaattaagaaatattaatttatgtataaaggtaatggggtggtgggtaaggatgggatttattggaagatactcaaagaatcacaagaagtcctaaacaagcaaactctgagacaggcaacagaaaagctcagaaaaccttaagagaaagtaggagaggcctcagtgaagtgtgaaaaatgttattttgagagtcattaagtaattgaatgggaaaaataggtgtcaatatgaaagagataagaaggcaaacaaactattcagaagggcacctccggtgaaacactagaagctcagagaatggcaggagagaggaggtagaaaagtaatgattacaaagcctcattgtggagagaagggctgattcccaccactagatcttcaaaagataaatatgagcctccactagtgggagactttacaataagaaccatttcagtcaaggccagaacttcaaaggatctgtggattaagggagtttgatgactacagatggggattctagagagagtgtaataaaagtgtaagaaaaatggccagaggggtatctatcttggttgacaattaaagatagcaggtatctgagacacagtttatttagcttgccgcaaatggcaagttattcagatccctggtacttgggaagaccccaaggattttgagaggagtcagatttgacatagttcttccttctggtcttttctatttcctctttcagaaacatatgatgaaatgataatgactatcagataaatcaactgagctttcttctgatattttatttactttcccctaatttagacacaaatcccattaggcagtgactaggttatttctttgttctgaataacatcaagcaaattctcaatgtacttcataaatgttaatctcacatgtatctctcaacctcaaaggttcagtttggtttgggtaatttttttcttaagatatctgtcagatcacagtcctttgtattaatatatattataagtgaataaggatgttctattaaataataataaagaaatattcctctcattgaaggagaaatgtttcaacacctaaatgatacacagtgctattagtattaggagaggtgcaaaagacactgtattgctttgcaaaactgtataatatcattagagaaaaaccatatgtgcaataaaataactacatgtaaatgaactttaaataacatctaacaattttccagaatcattaaaaaagttggggtgttttgcattctgtggcaggtaaaaaaacacgaatatctaagttacaataataataataatgtactattatagtatataatactatatagtattaatattagtagtagttttaatattatactaatattatttaataataaaccattattatgttataataataaaataattgatatctaacttgtttatttcattttgttttatgaagcggttgcaagaaaaagtgaataatgacgtcaatagtaaacatttgcatttgaattatcagcaaatatttttattgactgcatgcaaaccacaggttacattaatattaggataaaactcaaatggtgactttttatatggaggataagaattactttgagtaaatatacacttatcattgggcttcttagctttctggccttttctcaagacagaggtcacatttcacactttatcttcccctgatcttttacaccctgaaaaaccgtattctgtaaataagaagcagtttgttattttcttttatgagtattctcaaagtattttctcagaaaacctcttgatgaatccatctttatcacaaaattagcctttaggtaagaattaaatcacaaggcaagttgaggccatacctttgtcactcacatgtcactatttaaatatctgatgcagctgatttaaaaacccgataatatctctttaaagacataatatattatgtatgcctgtggcaaatttcttaataaaagagtctctatcctagtattttgtttcaaaaatttattgcaaccttgtgaggtaggtattattatttccattatacagatgaggaaagtaagtcttaatggttacaatgtctgtcccagaccactccattatttacaagcaaagctgctttttcagaccaatcattgctcttaaattctgtgctatgttcccatcttctgggagttctggaatctttctcttccttattattcccactgccttagttcaggccctcatcattttgcatcaaatccaacctggttttttagcaagcaaagcctatcacaattttgcccacgtcagttaatttacagttaaactatctgggggttataaaggttaagggacctgcctaaggttatacagctaaaaatatcagagatgaagtttagcggcagcttagtgaatgaaaggtacaattcttggttaaaatcttgtaatgagaattaataaagtctaatctaaaactttccttttatgtagtccagcatgaaaatatggacttttttttactgccctgcatgtcagtagatactggttttattggagcccaggagaaacaaaaaatccagtaatgacactcttccacaaagttagccaacttctagaatcttgaagttcaaagtgacaggttccatttgtcatgagaatatacagtctacacacacacacacacacacacacacacactctctctctctctctctctctctctctctgtctctctctgccttactgttaaattgattcagaccaataaaaatccactaaaaccagaaattagattttggatagactagtgtgttttggttttattttgtgtgtatgtatttttgaatcttttaaaccaattgttagtgaaagaaacaatgtttagcaaccaaggattaaaaattactagaatttgtaaactaagagaaaatattgaattatatcatgagggaagttgatagctaatacagattttgagacaccaaagacctactgctccccatggacagtgtgaagcctacagcaaaagctgttctgagcaagttaaaagttcttaagcacattttcaaggataatacctcatggagaatattgaattagttcccaaaattttcataggcatggattctgttgtgcaaagttgtcattcttttataaagacctttggatttgcacattaagtctttttttttttcatagatcttatgtaatggttctcacaaaattgacataaaataagtggttggtttctgtattgtgtttatatgtttcaaacatttattctagttttgtagtttataaattcagtctctacatctgctttctccttaagggcaccatttttcatcttaagcatggccatgtagatgcctacctcctacacttcttcataagtaccatgcattttatgtttattacagtgtgtttaatttgcattattccagatccttacaccacgggtttagaaatttcaggtcaataaacactacaagaagtatttctctcatgtattctagcattataagggtaatttacatctaagcagtgtgacaccattgtgaatttgcttggatggctaggattacaatggcagatggcaacccttggacgttattactgcagtttactgcagtattttcacaagtttttacattaaaattctcaactgaaagggtgccacaagattgaagataggacctttagaatgaactaacttgcataagcattcattaattactgtattgattctatcattttttaggtcctcaaggtatatgtcttatttagttgtaacacactgttacaacattatagccggaaacggcagacttccttgcatcagtttttcacctgaaaattggtgcttttgcttcagcattcatcattatgtgttaggcagtaagtatatttaaaaattagagaattttgaattgacagtggttttattgtatctgtattgggttaacatttttattttcactatttagaaatacaagaaaataaaacaggcttcttccttaactaaagtagcatgtaaaaagcatataaaactcatttgaacacagggatatatgtatacacagaaacacaatgaaagttttctaaattaactaaaatgtcaaattatggaactaataactttccttcttccatccccctcagcttcctctgatcccacactataggtcccagagcattcagtgagcaaccagaccaaaaagatgtttagaaatgtgaccaaaattaggattcactggctctgagtaagaatatgagctattaattatgcgtacataaacttcagctaatgaactctgtgatgatattagctgcataggtacttttttttcttcattataaactggatttcagattactgagcttatgaaataattcacccatcaatgagaggtgttgagatatatacaaatagaacaaagattatagctcagagaacaaattaatatactttatgaacttcactagtggctcaaattgggagattagatttatcattgagtccaggaaatgatgatacttcaaagaataggtgtaacttgatcaaatctttatattgcaagttatttattactactgagaattaaaaatctgaactttgtgaatttttaaaattaattgcaatggaaaacattagacaggacttgtatgcaggagaaaacatataatctgcagcttatctatgccatatcccttagtaagtgatggttagagataaattactaatagctactaatcacttgacaagtgattttatttatgtcatctgtaacatctttgcattatatctctgcaaaatgttggggttttgtaaaaatgtgattaacgcaaaataagatagtagaagcaaatgtctttcatcaaaaaatgcaaggcaatttctctggtcaattatgtatgaagatatacattagtgtttacattttcaaagttaaccctagatgctccattaacatttcaaaatttaaaatgtaatatttgtaaatgtgacccaataatgtagttgttctgatgttaaaaacaatccatctgggtttatattaagtacatataacacttataacaataaacataaataggccattatgttatcaaatacttatggagcacctattaattgtcaaacactgggaatacaaagatgattaaaagagggtccttttcttcaaggagctcactttctagcatggaaaacagaaattgcatcatattttgagtgtggttgagtagtcactaatgctattcacaagaattgcagttctcctcttttcaggctcggagtagaatgatactttccagtgcctcaaagttaggtatggccattcgaattgttttagaggataaaacgtgagcaagtgcccctccatagcagaaaatgtaagagccagagcatgactcagcatgtttatttttccctttactgttgatgctgagtactgaagcatttatttgccatggaaacatagtcttggtggctgagttactagaatgagcagaggcctttcagtgatctgcagtgaacatgcataatgaccaataaatgtatatttgttgtattaaaccactgagattttggagttctttgctactgcagtgtgacttagcccgtgttgacatatactgctatcacatacaaaatgtcaaggaggtgcaaaggaaaaacttctaagcatactgctcaagcttgtaatagataggatcaaatgagtaattaatcattaatttggcttctctaatactatagcttgacaagaggactagaacaaacaccctccagattagaggaggcccttagcccccctcttttctactctgcttcttatctgatcagctcctacagtatgaagtaccgagaaaaggcatcaactcagtggctcccagcatcagtgatttatgacagatgtccttagtggcaagagcaggatttagggatggtgatctatagcccacacaacattctaccagctaactgagtcagagatataatttggggtgaaataagtaaatcaatgctttccaaaccgagcttgtcaacacaatgaccagaggaacctattttaaaaaattgaaaaaaatattttaaagtatgactgaacacatgagaaaaaatgcaagccatagcaaaaggttacatgatataaagcacacatctctttctttagctagcctgtaacacttactccaaaaatcaattaatgtacgtagttttcgcatgcttccagaaatatgtaatatgtgtgtatatatgtatagccctaaaatttcagctagaaatgtttatctaacggagttctcctgagtagagctcaactgtgctggactcaaccatcaacattgattttccatgttcttatcccttcaactgaaaagaatcaagttaaatctgtagggaatgaaaactaaacagctctttacatgaagttccatgtcctattgcatttatctcgtgggttaaaatcattcattgatcgctaatcacctgtggttgtttacacacaacaggttccctggacagcacaaaaccacaaggaggattatacataccacaggaaacaatcaataaaaaaggcacataatgatcttcctgagaggaaactgaaagattttccctttgtgacagtctgtatatgtgtgataggattgtcaaaacagacataagggtttccagctggcaggaaaatgtttttaacatttggttttcatatccacttttcttgtctcactataataatattaaaaatgaaaaaaatcatttcaaaatttcttttaatagagaattcaatgcttgttttgcttttctgcccaaataataatgaaacaagccttttatctcctttggaatattactgggttttgtttttgtttttgttttgcctcgctgatgcctaaaatatctaatcaagagtccatttttgttatccaaaagaagttgaatgacattagtttaggattctaaaaattgatttaatgcacttttaattcaaaaatgatcactcggtcttaaacaaaaatcacattgtgtataatccactaaaaatactaaaacttatgtttcaggcactggactagaaacaaactaaaaccttgaatgaaattaaaactattctttttaaattttacactcaaatagttatagctttttttttttttttttttttttttgagatggagtctcgctcttgttgccgaggctggagtgcagtggcacgatctctgctcactgcaacctccgcctcctgggttcaagcgattctcctgcctcagcctcctgaatagctgggattacaggcatgcaccaccacgcccagctaatttttgtatttttaggagaggcagggtttctccatgttggtcaggctggtctcgaacccctgacctcaggtgatctgcctgcctcggcctcccaaagcactgggattacaggcatgagctaccatgcccggcctcaaatagttatatcttgtaggttcctggtctacaatatatacctagttctcatttgaggaaataatggaactctttaactcaatcaacaccagtttatctttcctcattttctttcaaagcctttaatatttatataaaactacagatttgatatgtgtcattcggaaaaactgtcctgaacaaattcaatttagaaataaatctttccctccaagtgccaaaacaagaatgaaggagtctgacccatctgagaacatttgcacatagggggacagaatatcaaaaatcctttgagatcttctaataatcctatcctgttatatcctgatttcataaatttgccttacaatttctcccccagtgatatttgatagttttatatttctcataagtagttaaagatgactgaatatctacgtgcatttgcctatgacgtattcttagaactagccaactgcttattgttataaatttcatactagtaaatacttttactatattttataaatactaactgtgcattatttagtggtcaccatttactttccccacttctgaaacttcatgattcttaccccattttccataattaaagaaagaaaagttttaaatgttacgcttggtacagttttataaagggacttctgtgtagctttcgtggattagttatgaagagaaaacaggtgagagttctctaattgtgtaaatgtgtaaactctttgagagtgaatgtcaatatctacatgccagatagttttgcttgctgctccaattatccgaagatcatagtacagaatcataatttgctcttcaaaccattcaggccttccagaacaccacctgaaattaaatcttctgcttgtgcatggcttataaaaattgaatggcagttcattttcacaacacgtgacaaacacaaaggaaattatgaattaattttaaaccttgcttagcagagtcttatcaaactgatggcaccctttgtcttactgaagtcaggcatcagagctgatatgcttaattagaatcaggcatcactaaatgttttagagtgactgttcagatcatcctattggactcccaggccttccagtggttggaagcctaaaacaaggcaattgactcaaaaggttgactggatttgactttcacttccatgcattaccttaacctcatcaaaacgcattattatgctggatgttcaaataaacaaaagcaaagacttttgagggcttttttagataggtggatggagactgagatagatagataatagatcaattaaaaatatgtatatatatagtgtgtatatatatataaatactatatatttgtagaaaaactgtgttataggaaaacaaactgaagttacaactaactgtccttctgcaattattcaggaactaactatgcatttgatgaattatttagattttagcctttcccattttggccatttccctattcatcacatgccatcatgagcttctaattaacaccaaaccataaatacatgtccattatccatcttaaaaacatcctgcttatgaagaagtgacatccacagatgctatggggcactggctgtttactcctagttacaatgctgacaccgagagatgtccactattgatgctcccttcttatttactgctaagttcttgtgtttggaatatttttccagggaaacatcatggtcaggaatattggtggttgggggtgtgtgtgtgtgtgtgtgtgtgtgtgtgtgtatgtgtgtgtgtgtgtatgtgtatatataatatgtgtatatatatatacacatgtgcatatatacatacatagtgaagcactgcctatattctgggcatcttataataattgctgtactgttttagaaccaagcactatctatggtaggtcaggtataggtcacatctacttaattaatttataaaagtaaccagaagagcaccccattctaatagtgttggcttgaagcaggatcataagtgtaaacttgcagtgtatcattcagtgacgactgacctagtagccattataggatgaaaacgaggtacctcagcctagttcaggtcattgtgacatggttcagattttaccagcatgtatcctgagctcagaatagcgccaaaaagagttgaaaatgtggcatcaacttcatagttcaaggtttagtttcaacgttttctttttgctttggaggaaaaaacagtttttattccctaagaccaaaatgcaaccaaaaaagaacaaaatacagtgaaaaggtatgtgaaactttctgatgcctatgagaaaagttgtatttgttatcccttttttcatagttaatgacagcttcaaatattaccttccatgactgactaaatcttccactgaaataataatattcatgacaaccagggaagtgaaagatacagacctgtatgttaatggtaaaactgcattttcacatattaatttaattaaacatacaatttatttactctttattctctttttggactgacagtgtaacatattggtagtcctaaaagtaatgaaggacagatcagatgcagtggttcacacctgtaatcccagcactttgcgaggctgagataggtgtattgcttgagaccaggagtctgagaccctcctgagaaacatggcaaaaccccatctttacaaaaaatataaaaaattagttgggcatggtggcacatgcttgtgatcccagctactcaggaggctgaagttggagggtcatctgagccctgggaggtagaggctgtagtgaactgtaatggcaccactgcactccagcctgggggacagaagaccctgtctcaaaaacaaaaaaaaataatgaagggtataaaaatatatttttcctttgtgagcactttaatattaattactttttaaataggaccttatatatttctctaattattgcaaccccaacattgtccttgtgggggcaagtattctttctttggatttcagaaccaaacagctcttaaggcttcagggcagcccctacaactctcacctagaaaacaagtgagttcaggaaagcacctaagtctataactcagcttcaatgaaagtacatgcacagtgaattacctctgagctgtttcctctttgttaggtaatggcgagtctggtccccttgaattgggtaacatattgtgtcatctactttgttagagtgctctaagacttgataatgaatcaatgattgaagcttttggaggaattcggcttcttggttcgtgggaggaggggtaggtctgtgtttttgtgttttacaggcaaattttcttccctgccattttattttgcacatctcttagcattattgctgaaatgtgagaacagcatttaggaagcctaacaaagcttcccaagtgtgaagctgtgacattttgttattctagaaccacttcagaaagcaacgttgtatttctacttaacatttaatgttttgcagctgctaaagaattatttacaaagtagtaaaacagagaaaaagcaatcatttcccaacatcattagtaacaaatatgtttgcttatattttctaaagaagtgacaagaaatgcagataatgagtgactatttgacagacatgtacaaatgtgccagccaatattagacaaagaaaaatacaaaaacaaggaactgaaacgttttataatctttttgttataaatgtcattttaaatgtccagttaatattatgggtgtgtgtgtgtgtgtgtgtgtgtgtgtgtgtgtgtgttttgtccctatgcaaggaggattagaaagcttcccgaaaggaggcattgtatcaccttcctcattttataatataaggtgtactcgtattttagtttatggtaattcccaattgagcctatttaagaatgaatcacaaacatacatgtggagaaaaaaatgccatattaaaaaaggagagaaattaaatttctctctgaagctttgtttacatgggcaacatgaagtcaatagaaaccatctctgcagcatttacttgatgctctatgttagaaataaatagagaaactgggaggggcaaccttctctggccctggaaaagttgactggatgaaatgttaccagtcagttatccctctcctaaacctaggatgtttgccaccaagggtatagtctgactggcaaggctaagaaggaatggaaatatgattcaagctagaaaaaaggatgattccaatcaagtctcttaataacttctcctatcatcaactcaggttcaactggaaagtgtgaaactcctctctaaggcttttactttttcccatcatgcctagctttttgagtacatctttgctcctttctggtctgataatttaatgctgggtatattaactatgtaatttgtagactgttagctccttgaaggaaatggtcatgccaaattcacatggggtgtacagagttggtattcagtaatcatgatttgtataaatggatgtgtaataaagagaagagttttaaccaaaaattgtatttgttctgtctggctaggattctttgggtaactttatatttgacaaactttgatggtgaagagaaaatgagatggaggtcacttactgaataatttggacctttaagccccctttacctggacttaaatggaaatttgattggattgctttcttccaatctgggcttcatttgacctgatttgaaagtcaataacatggtttgatagaaggactttaatctatgcctcatctgcttgatttcagaagtctttggaaaatctgaaaaaggtgggtgttttccgtcatgcctggtctccctttagagggggtggtgggaacaggaaccaaaaactctgctctctggtgatgttggttacatctgtgcagctatcagtgtttcctcctacacctctatcctaacaaatacattttttgatgtgggtgtaaacctaatttccctgtgcataatgctagtgcctctggagtgtgcagagctggctggaatgtgctctaagtggtttgggaataaaggcttttcttgtcattatttgcagtctgtagtattcagctgccaacccatgccatattatttgtgtgatgcttggtgacagtctgtgttgagttttagctatgatttttgacataatttaatgagctggaatgccattttcccctgtaagaaatatgtacatattttcaatgccagtgaaaagttgtttattttatacatgtattatttttctgaatccagaatgtctactcttaacaaatattaacattatatgttcagtatgtaaaatgtacttttttccccactcgcatttatgagaggtttagtcttcagtataattgaaggaagaaaatgtacctacctggttgcacaagggtttgcttctttcctactcttcctaattagcttttaacaagctgtcaatcttccactctatatgttgcatttgtaaagaaaggacaaggatgagttgcaatctccctgtgaaaatagactgtgcttcttaaggcaggtatctccaggctgtcagggtagggcttagccctacaactttgagtcaaatacaatatgatttttgcctggtgccataaactgatgctgagcatatgtttatgtgtctgtgccatctgcccttttccttagagatgtcatcagctttttcctcacagactcactttaacacaacaggaaaaggcccacctaatacttttccttttgttaaattagagtttagaaatgcaaattatttttttctaataaaagaagtaatacacgttcagtgtgaaggatgtaattcacaaaaatttacccaataaaccaaaatcacttcttaatcaatcatgcagagataaccaatttaatattttaatgcatttctttgggcatttagataatgatttgtgtttggttgtgtgtgtgtgtatgtgtgtgtgtacaaatatttgttttcttcataggaaggttgcattttacatattatttttgtagcatgtatttttatttagcaatagtttatgaacatttcctttgtcaatagtattgtttacagcactatttttaatatcactctagcatgaggcaatacagtaatttacttaaccctctattaatggatgtttaggttatttttcagtttttgctgttcataaattatctctgtgcggttcacctcatgtttttagtatagatacctagccatgatattattggatcaaacactatgtacatgttggatcttttatatcgattgcaaactgccctaccgaaagattaactcatcttgtacttccgctagcagagaatgaaagtctcttcctattcactgtcctctactcagtgggactctcattatctttaaccattgccaatatgtccattgaaatatggaatcttgtttctttaatttacactggcgagaataaatgcttgtcatatgtttaatggtcatttcattgagacaagaaaacgcaacttcagtagcatcatagtatcatgtttaagtgagggctctagggcatcagaaaacctggtcctccacaatgcttcacccaattcatgtggactgggaattgccttcacttgtctgtgtaatgtagtgagcagtggaaacaaaatcacagattgttatgattaactatctagcagttgttaggatttttttttttttttttttgagacagagtttcactcttgttgcccaggctggggtgcaatggcgtgatctcggctcaccgcaacctctgcctcccgggttcaaacgattcttgccaccacgcctggctaattttgcatttttagtagagacagggtttctccatgttgatcaggctggtctcaaactccttacctccggtgatctgcccgcttcagcctcccaaagtgctgggattacaggtgttagccaccacgactggctcagttgttaggattaatcaagtcttaacatacaatagtgataagaacaataataatggcctgaacatctccatagtacttactgtatgccaggcactgtccttagcactttgtatattttaactcttttactgtattatgaagctatatataaagctcttagcataatgcttgtcaggtagtgaactctcaatacatattaaccgttattttttaaataattacgcttttctcataacgtgctgccaaacatgcacatggattaattttatggatgaaaaataattttatcaaaacatcttcaaatcatcaacattaaattcctttaaaatatacaatacaggcatgaaatatcatgaacattcacttagaatttatttttagcttaataaaattaaagataaaattataagaatggatgtttaagaataggtttttaagtagtataattattattgaactatcaaatgccaatatcccttttcatactaatagccatacttggaatatacaaattaagtatagagttaagcaaatatctagtcaattggagtaatagagggactttatttgataattaaaaaataaatgatttcttcatctcactcaatggtagtacctgttgctgtaagaggtcaagcaactgaatggtaaaatagctaaccatgttcatttgcttcttaatggcctgatatttggcttcaagtgaagatgagtgtctgttttctaaagttagcatcaacatacagggttctgtgatacaatgtgggagacagcacagaggtgtagctatgaacacatattttattgttagaaaacctatcttcaaaccacaggtttcctttttagagttggttggcactgggtatgttagttaaattctccaaattttaatttctttatttatataatgagattatttacctcagagcctaatgtgagaattaaatgaaataagaaatgtcaagcacatagcacagggtcaagaacacaaggcatgtaactaagctgttagctgttgattttatcattacggcagagacaatgccagattatccaacatgtgttttgttgatttgcaagacctgactttgaagtatctgcaggacaaaaaaagttgagacggccaaaagacacataggttgtttggtctgaaactcagaggaaagaccagagtttgagaaataatttgtcctctgtagaagggtgagtaaatggacagggatagaagttttaggagaaagattgcccctgaaaaggtgagaggcaacagagtctaggacaaaggaagaggacacattccatagacagggagaagaacatctatgccatagtaacaggaagatagacacaagatgggtacacacagttgcatgaatatttacgtgatatttgtctcaaactgttctgaaactccagtacctgtgcttatgactgttaaacattaatgctttccttcctgattattcctaaagttttattttcgaatgattccatgattggacattatacttgattatgataaactcaaatttagtggcaacccagacagactttagataaagtgaagagaattggggaaattaataatatattttaaataattattttaacatgcagaagataaaatttagtaaatttaaaaaaataatattttatatcctcaaaaaagtttgccctatttgcagacacctctcttcactaaatttttttttaactatggtcaacctatgtaaaaatatattaactcataaatagaaacagctaaacaagataatcagagtaaatgagaatttagaaaaatagctctcagcacattctttctgaacacacagttctctttatataaaaatagcatgttttagatgccttttattatacttgcaaatctcaaggtgtaaatatatttttctgaatatattccttaatatttcaataattggctgcaaaaaggggctttatgtatgatgcagcctttagtcatttttctctcctagcagcagtgatacatttaagaaagataaaacttcttaatctacagagtggaaaagagcaaaactgtaaataagacataattagaaagatgtatcttcttacgtgatttggggcattttgcaagtccttcctctgcttatttatattttcagaaaaattcccctaatagccaatgcataattgtcaatttatagactctggggtaaaagaggcatctggattgtgcttttgagaccttgtctttactactttcagactgaatgtgatgaattgttaaataatcttcagttagtaaaaccaagccttaaaaaatgaaggcatcctataaacattcagtttgaaaatactaaaaagtatctgtataatattatgtcagaaagtgaaacatgacactgtcgtaattctaaaatgaaaattaaatagaaccagaatttatacaaatttattaccgtgagtttaccagtgttgctggagtttaagatgtcagaggaggaaatcattatgtctggcattgctggatcaattacctttatggcttctaataaattttgtcttctgattttgatggatatttaatcatctgcttctggagagatttccatttatatacctggaaaatgcttcaactgagtacttattaactgttagcaatagatatagttctgaaagatagatatagttctgtggttactgtgacttaaacaaacattgggaccacacgatcactttataatgagatttagtatccttttgtagttaagaaaaataaaaaatttggtaaaattattgtttttctttattatctataaatgcttcaaagtagttaataagagtaatttatactaaaactttaaactattgaacaaatggaactgttggtaaatactttgaaattttgtttctgtgaatgtaaaactttcattcagccaagtttgttttagctcatgtataaatattatgtaagtatttgctgacataaaaatatatttactaggaactataaaatttattttcacatttacaaaaaatatggtatcagatgcttatgtgtatgctggaactttattgttattactaggttggtgcaaaagtcatggcagttttgccattactttcaatggcaagcgctgaactaacaaatacgtatgtttatgtgcaaaggagagtttaagaaaatatactgatgttcaaacttgttctaaaaaggtcctaaacaactgggtgtggtggctcatgcctgtaatccgagcactttgggaggcctaggtgggtggatcacctgaggtcaggagttcaagaacagcctggccaatgtggcgaaaccctgtctctactaaaaatacaaaaattagccgggtgtggtggtgcacacctataatcccagctactcgggaggctgaagcagaattgctccaacccaggagcagatgtcgcggtgagccaagattgcgccattacactccagccttggcgacagagtaagacttcgtctcaaaaaaaaaaaaaaggtcctaaataatacaaaataaatatgttattaattttatttatttatttgtttatttatttgagatggactcttgctctgttgcccaggctagagtgcagtggcgtgatcttggctcactacaacctccgtctcccgggttcaagcgtttctcctgactcagcctctcgaataggtgggactacaggagtgcgccaccatgcctggctaattttagtatttttagcagagatggggtttcaccatgttggccaggctggtctcgaactcctgaccttagatgatccatctgcctcggcctcccagagtgctgggattacaggccagagccaccatgtctggcctgttattaattatacaaatagagttttagcacaactctttttccacctaactggaaaaaatgaaaatgaagaaaattttctttggaaaattatttggtagtctttcagtttgttcaaatttgtctaatccatgcatatgtcatctgataaaatcagactccggttaagacctgtgttcaacctttttagcaattttgattagtatattaataactctgaagccacaaattggtctaccttatatcttctttttcctattagatgtaacctttctaagagcaggtatcattcttttttttttttttctttgttttgagacggagtcttgctctgtcgcccaggctggagtgcagtggtgcgatcttggctcactgcaacctcttccttccaggttcaagtgattctcctgcctcagcctcctgagtagctgggattacaggcatggatcaccatgcccagctaatttttgtatttttagtagagatggagtttcaccatgttggtcaggctggtctcgaactcctgacctcgtgttctgcacacctcgacctcccaaagtgctgggattacagccatgagccactgcgccaggccgagaccaggtatcattcttatctctgtatcctatataatacgtcttagtgtcctccaaatagtaaaatcaacatttcatgtatgtatatcccataccattcttgcaaattttaatgtgtgccttgcatattcacataattttattatggcttagtgttaaaccattttggttagatttttcacaacataacttatgcatagtgcaataaaagtacatgtctatgaacaaaggcatactgttgagaacatttaatattgcacctgatattgtagccagcattatttccctttcttttcataaggacaccatttttatgtgaggggtgggatgcaggtaggaaaaacactttgttccattcatcagtctatatacttccgacatagcaaacttcctgcaggtctgtagatgagcatgtggcacaggtctgttcaatcagtccagtcaatcccataaagataggtttaaagatgggcatatttcccgataagagccaacaagtctggaatcccagacttcagtctctccggagtcactgagatgaagaatgtgtgcctggagctgctagcagtcttgttgccctccagaagagagctgttgcctaagaatgtacacaagaggtgagacaaggaatagtcttcgtgacattttttttattcctgaatcttgtcagattttactctagtgctatcctggatttttcagttatagaagctaacaaatggccttatttttgcttaagcttgcttgaattgtatctataacccttgcaacttaaagaagtctgattaatagagtcgtctgtactttggttatttcatctacgaagcaagggactggaatagatagctgtttcatgatttccctttcagaaatcagtctatatgtacaacagcatgaacttaattacagagatcccatatgtttattacatcaggataaactgaaaatgtttattattttccttcattttatttttttatcttactactagtttttttaagtggttaaaatttaccttttttttttttttttgagacagagttttcactcttgtcacccagggtggagtgcagtggcacaatctcagctcactgcaacctccacctcccaagttcaagcgattctcctgcctcagccttccaagtagctgggattacaggcacacaacacccacaccaggctaatttttgtatctttagtagagacggggtttcaccatgctgtccaggctggtcttgaactcctgacctcaagtgatccacccaccttggcctcccaaagtgctggtattacaggcgtgagccaccgtgctcagccctaaaatttacttttaacctctatatctttccatgattactctgctgtttatcagcagtcagagtagcttagaattatctatttaaaaattactaataaaaggcaagtaattgtatttaaacatgtaagtgactgtcagagaaaagaattcacatttataaatcaggttattatattaggttctcttatctaattcttaccaaatcttgttatcattacataagttgtttttcaaaaagatgaactttgtttaaacaaaaaataatacttattgattttcttgcagaaaaagcttcatgaaaaagaaaaaaaggtattgttatgtttctgagttaagctctgttcaattttagagctgcttgttatccaactgggcactaaactaaggtgaccatttatcctgattaatggtagacagtcctggactgcctgaggccattttatttatttatttatatacttacttacttatttatttacttatttatttattgagaccagagtctcactttgtcacccaggctagagtgcagtggcactatcatggctcactgcagcctcaacctcctgggcttaagtgatcctcccacctcagcctcccaagtagctgggactacaggcatgcaccacgtctggctaattttttatagataaaaggactcaatatgttgtccaggctggtcttgaactcctggactcaagctatcctcccaccttggcctcccaggtgctggggttacaggtttgagccactgtacctgactcatttctatttatatctgctttcctgatgtaattgctaatggtcccccattttactatcaaaagtattccaattatgagaaaaattatgtgctcatcccaggtatggccaccaaagatgttctaaagttaaatgataaaggaaaatgatatagtgatgaacttgtaacactttgacaataaatgaggtatctgagagacattttaccactacaaatggtaaatatggaaataatttgtaaaatcagtaaaaatgtaaaatattatcatcagtctactgtaacttatcgacaagaaaaaatgaaaaaaaaatgcgtatgtttattgctgaatttatctgtaccactaaccctcaatgaactattcttcagaaatagcaatcaagcctgacccaggaatagtaaatggcttatgtatatctatgcattctatagcaaaactctgtgctaaatgaagcacagatgtaatcatctacatcagtagtcaccactaagaaaatctttctaaattttaaatcttgagggaagtgtaaaaggttattattattattatcattatcattgaagtgcgtagaagtgtaactgctgtcattgggaaacctgcatttgaaatttatagaaaatttgctttgcaagataaatttcatttctagcttcctgaataaactgttaggttgaagtggaatcagcatttcacaatgtctgccaaccatttcaaatgtcacttcttgagttgcttcttcccatatcccaccttcttcttgcatattctttcagtagaaccaatgtacttctgaggcaataagagaagtaatcactgattaggtagaactgactattgctcacacggtcactaaactaaggtttagacacagaggacaaactgaaaccaaggttgctctttccaaactctcctttttagtttattttcatcattttatgtagagtatcttaaatagcaacataaacatacatatatatgcacacatacaggaatagtgcattagctcataaatatgagaattagtcattgaatatggaaataatactgagtacttgcaaaatgcatgaaatctccattaggtatcaacaggtcgtagagagggaattggcaattttttttttcagtctagggccaggtagtaaaagtttttggctttgtggatcatatgattttggctacaactatttgactctgccattgtagcacaaaagctgccacagacaaaacattaacaaatgagtgtggctgtgtttccataaaaacctttattcatgaacacagaaatttgatattcatagaattatcataagtcagaaataaaattctttttttgaaatgtttcagccacttataatataaaaatcattcatccttggctcataggccgtgcaaaaataagtcaatgggcaaaatttggtatgtgaaccatcttttgctgatgccgctcatagagcattaatactgttctctctcagggagaaaaaaataaagaattgtgtgtggcatttagcaaaggttcccaaatgtgctttaagatgcatgtaatgttgttaaaatgaggtgccatatttttccccttacaaaatacagattattagagtgctaggaaagtgctatgaaaacaacagtttctaattttacataaagagtccatggtaaatacacctccagaacaatgctttgttatacagagatatgatgtcagtttcatgtatagccagcttccttgccaatcaaataatactatagataggtgtgacattatgtctgggcataatcagttttgactgataggttggaatctaaacaagaatataaacaagaaactggagaataattgcttgacttaaacttcagataaaaatagttgaagaagactaatattactaacatatgaatgtattagaaattatctaaaaattgtttcttctttaactgccaagatgtaatctaatgatgagagaaaggaccttggaaatttctattattatttaatttattgtttagtcaaatgggtcattttaaatagatcactattgcaaatataagtatttttggtacaattagaggtcattccgaatacacaagaatacatatagtttaacgtgaaaaaataaattataatctgatgccaattattagcaaaaaatataattaatgttatattcctactagagaatacattttttaaaatacaaaactttatacaataagctttcgtagagcttatatagatcttcaattatgttaatattcaagtacccaaatttgataaggcagagtttaaatgtttcattgcatcatgtggtttgtccaagcctgtctttttaaaataaataaatcaagcagagagatgcaaagggacttatttaaggttacacagcaaattagcagtgaatcaagacaagaatacagccttttcctattacaatattatataaccaaaggaagcaagagaagtctagcttgtgaacagaggaaataagaatgtttgaaattgaccaaaaggtttttctttattgttgtaatctccttcctcctctttcccttcctcttcctccttcttcccttatctcttcttcctttataagctagttatatgttattctgggaaaaaatattatttgtagttattgctatcatgaaaaataaaattttatgtgtcctaaatttaattatattttatgaaacattaactctgacatgatgtggtaaccatcatgtaggcaggacttcactggggactcttcccctttctgccctggtgcctgtttgcttcctgccactgtatggttgagtatttctgaagtcctaaatacacttaaagttgtggcttttatgtatggatatgatagttttctttaaagagttgtcagtgtaaacgttctaaatagaacaaagcataatgatactggtcatgattgaaactttttgttgataaatagcattaaatataatcttcccactcatgattcctaagaaagattagtaaaatcctacatagtaaacagctcacagacttctatagagatgggaaaatttatttttcccactgatgagaacatatggaggattttcttttcttcagagaactcacagtttccaactgagttggattttttttaaaaatgagttaataacattgtgaacattataaaatggtgattttaggcatgtatgaaaagctatcaataacaaaaatagagatatatctacagaattatgatgcatattataatatagcaaaaaaatttggagggtaaagtgatttaatgagaattagatactatttaagataaattttaaatatcttagtggtaaaagtatatgtctttctgagaaaatcaaatgtgtttatttgcctggataagttgtttatccagacaaatattaatcaacactaattaattactatctatattagggcaaaagggcaatattatgaacattttcttccccaaacagctgctcaaattctgcagatcataatgcagatataaatagcatagctcattatattttagatagctggagtctattaggcacttttgaaaattattattttgctctgcctatttttctctcatgggttacaactaaatactgacatgtaaaagaaacattatttaaagctagttttcccccaatatccattctccccttcttgaagaacctgagatttttagcccagaataacagctatattatttagactcctaaacaataatttttaggcagctaaacaatcatttcgagagatatcagcattatttagacctactgggtcatggcagaaaatgctatgtgctccttacgggttggactcttaagagaaggaatacaccttactaatagtttctgctccctcctatggtcctgaatgtagatttggtagtgtcatgagattcttggggtgttgcttcaccagccagaaacctccgtagccagtgacgcctttgcctcggttttgcttgggcctgctgggctccttctgcccactcagcctggcaggctgtgctcagcttgtgctactggcctggatcccacacctgccaagatgagttaagtgtggaacagcaaggggtgtgtgagtgagtgagtgttgggtccagccactgcacacagccaggcacaccagatgctggctccctgtgaggctgcagctggaccagatatactgcaagcagcttccacagttggcaccagaagcttggagacaccaagaactgcagagccccaaacaaggtgtcacagccctggcttggggagctcctaggtctgggatccccaaagggctgtagcttttctctcctttccttcttgtcacccgcaacatagcgagcaaggggcatgtttcagccctgttacttacagctcttttagccccaccatttggcagattccaagttcctgtctgacatcccggaaaaacgaagtacatggacaagtggaggttgagcaaggtaaagaggagctttactgcgtgacagaatagctcaggagggagacccgcagtgggtagctcatctccactggcagggtatcctgatgagtgttcagctttcaacaactggagaccctggagtgggtagctcctctccgtggctgattgtccactcatttactcagctctcagcagggaggagaccctggagtgggtagctcctctccacagtgaggtcatcccattttctccttgaatctgacagtctggggtttttatgggcttcagaggggaggaagggtgagctgattgctccaagggcagccatgggttggaaaaagcactgtaagttcccactctggtctgtgagactggcagcctggcccccaagattcaggccttccccagcttgaaggtagggcttcactagggactctcccctttctgccctggtgcctgtttgcctcctgccattgttcatggcacccaggctgttcatgctgagagatgcctgcaggccagtgttgagctgccctcagcacccccttggcctctctcccatgctcattggtgcccaaagtctggagggggcctaggcagcagggggttgtcacgtcagtactgccctgagcatgcacgcacctggccgggttgtgacagtgccctagctcagcctcgactttgctctgagatcaaagcaagtgtcaggagcagggagaggccaggcagtggaagcaggcactttggaccctgcaagggaagggggcaccttcccaggccctcgagagtgcagagatgcctgggtctgcagctgtggcttgggtggctgcagctgtgcccaggagggcaggacacctgcctacttccagcctccaagagcacagggatgcccgggtccacagtcacagcttcagtggttgcagctgcacttggaagggctgggctcctacctgctctgtggagcccacagccccaactgctccttcccactgcagccagtgtttttgcagtggctgctccagaagggctgctgctgctatcagtagtgagacatatttatcaaaccagaagcaggaaacacctagggatggcagagtaacaagagaaaaggagtctatgtctcccatgcctggagtcaccataggaatcctggactaacaatgcttatgttgatacatgagaaagaaataaacctttggcttcttgtaccctaactttcaaattttgttacttatcaagagaaccatatagttttttcccattatctaataatatgaggaattacataaacattgaataaaatattcaaagcatgaatcttttgcattcttgataaaagctctgcttggtcaactttgcaatagattcaatttgttactatgtcatttaatttaagttatttacatcatatgcaaaagtgctattagtctgaaatttttaatttattttttaaatgttttggtatcacagttttgctagatttataaaataattttcagaatcttccatattttctatgctcctacataatttatatgtcaggtaaatattggtttttggaaaactttaaggaaattgcttttaaaccactatggcctaaatattttcacccacttttccgttgttatataattgttgatattcctaggcttccttcttttttgtttaatcaaccatatatttttagaaaatcattatactgagatttgtatatcagattacacagatttgtatatgacattcgaaaacattttctcagattttggatcttctttctcattcttaatatagtgctcttcagttttgtgtattactttttccttggcattacataagacagaagtttatctatttaattgtctttgtcaaataatctccactgacttttcttctttacagtgtattcattacttcctacaatacgggctctctttttgcttttcttgttttgtgtttttcttttcttgaattgattggttagttcacttatttgtagggtttttttgcttaacaagaaaaatatttgcagataaaaattttagtttctgattaaacctttgatcgtgctaaaaatgtttgatatatattattcccactgttatttttctactaatatctaagtggaatttttgtttctcctttgctccaatgtaactttggggagttctttttcttttaaattttagagatttgtagagggttacaattatattactaatttcaattgttaaattattggattcagaatatgtggcttaagacgtatctaccattgaagatttattcgggttatttggtgcctaacactataattttaaaaaattttgcataaaattttaaaacagatataggataatcatttaaatataaactatacaaagaaaaatatgtttcctatatctattaatcttatttttcagattcttgaaatccttgtctgttaaatatttaagttaaaatagataggaagacaacttattttttttttcagtcctctaatatttctgtccatctacactggaagttctaaagggtttatctttatatagttaaatataagattattcattttgcaagtgtttatgtctgatctacctttaatatatactttacagattatcaatgatgcaactttaatatctgaaatactacttaaatttatactattgagatccctgttttcacattgaatttgagtaacatatctttatctgtctttttgcatttaattttcttgttagtcattctttaggtgtggttttatgaatagcatttagatttggttttctagaccaatgtgataatctaccttccaattttttgtgttattttgctatttcctatgtatactttactttcctcggaaacatgaagtatagaatataaaatatacagtatatgttttttccagcccatctcttgacctcctgccccattccttcttgcttttttctcctcttagacctattggctctgtatgaaggtaggtaaataaaacggtagaaacaattgtaggaggaccttaaaaaatcaatacccagaacatacgctgaggacatctagcagagcttggttttggggacatgttgaatttacttccaattttactaattacaatgtattataatttgattcttctttcatcccagggatgatttaagagtgctgtgaaaatattgtttatgcatatggattattttttgaaaagattataaagaagtcatatattcattggaatatatggatatgtaactagttcatttttgtaaactacttaagatgaaattagtgaaggacatgaggcataggtgttaagtataaagtgggtataactctgtgtaatcttaaagaaaaaccatatgagaagacagaagactcagggtacctcaaaaatgtggatgggtgcccttatgcaaatgaggaaggttagaccttgaatgtcagatatgaggattcaagcttctaatgattcttcctctttttttcttattataatcaattaataacattacctcacataagctaccctgagttagagaagcttttatcaaccacttctaccttaaactttaacagggaggtctctcctgcctactcagctctccccacaaaaataactctggactaatttgtcccccatgggtgtcttcttcctcaagctatcttttctgcttcctgcttcttaactttgtgctggtctctaagtagaaagtggaaaggagatgaaaaaaaacaataagccaagttttgaaaagtcttctttttacttcatggacctttgttactgagaagagagttaaaaaaattaatttggtttttgaaaatcaaacacaagacaaggagtatacaacaaagtgaaatttgaaatatatatatttttagtctgccttcatcaaaagttggcaggatttccttccacagtctggcaatttgtgagttaagcttagcctgcatattaggtgagttttattattttctattgtcttcagacgcattttgaaagtcatattaggaagaggttaaataggaagtgtctttgtcaaacatcaccttaagttggaagccccattaagagggaattttactctctcttttataatataatgcattaggtcaaacatctttttcaagctgggcttagttaccccaaatgtgtgtttggtagatactctaccatggactgtcacattttattcaaagctttcaacatgaacattttatttttgccttttaccagaaaacacttgaacatagttgtgaattctaaaacaagtgttacattgagtcaaatatttcctaacttagtcatttgttattttgaattggagatttagttcccaaaattaaagttctgaaaggataaagaatttacgatgtaataagctaggaaattctctattaatataaaggcatgttatttccattaactaacaaatatgttcttggatttgacccaataactacaaagttatccttctgatacagaatagcctaagggtgctttctaattaaaattttgaaagttgatgctcaatataccttatctgtctgcaattctaaattaagctgggatctattatattgagttagtctataatcttttctttcactggtatgtagcagttgaagaaatgctaatttagtaaatcagatcaagttcaatcctaaactattattacgatagcaaataaagttagttgtagttatggtcgagttgcaatttatggaacctcataatcttactagtaataaaaataataattccaacaataataatatgctaccatttattacactcttgctgtgttccaggcctttaaaatgcattatctcatctgacttatgctacaactataagaaggaattatcacatcaattccatagtaaaagcagctgaggtgagaaaataggatggttttcaataacaaagcaatgggcgccagggggtgttgagtaattggatggaaggtgcaatccaaaaagaggattcattaaagagcttctaaaatcttataataacatttattttaggttttaaaattgccttagtagcagacatgtgcctcagatgacatggaaagatggagcaaaacgcataagaaaataaaaatcataaatttcacttcacaggttacattttacatgagtgggaaatttccagaatctgcctacccgttctatgtacggatctggaattcaggagggaggtctgactgagttataattttggaaatcatcagtatgtgatagaagttgaagtctgaggtatggataagacattttaaaagctttgtggactgagaagaaaaaaggacaaaggatatgatttgtggaatttggatattcaaaaagcaataaaaatgagaaataatagtataattaggacaggatgttatcatcaaaactaataaagattatatgaggtaaagaatagctgaaaatgttgaattatgttgtcaagcaatacaaagttcaaaaggtgtctaattggcttgccaattagtcagctacagacacccattcctggtgaacagaggtgggcagacttggaattcagttttctagtgcattcaggagtaaatggtaggtgggtaggtgaggaagtgaatgaaaattctataaaagcatgggtgtgcagagattaagaggtcggtagctagaaatcaagaaaacagttttatcagagagactacaacacatttatctctgcacaggagtgaatggtaggtaggtaggtgaggaagtgaatggaaagtgtaaaagccaggatgtgccagagattaaaagatcagtagctagaatcaagagaagacttttattaaggaaacttaaacacatcctatgtgtggagagagagagaagattgagacgtagggcagacagatgatatgacagtgatgcttgaaggaagtccattgcataaatctcaacaagatgtcctggaagggctgccacagatgatagtgcagggcagtgagtggaggggtgaaagacaacacaaagtcgtgcagttcatcttgttaccatactgaaattacacattgtccgtgatagaaaggtccttagggttatctactgcaacatgcagctgttatatttgtgcatattcaggaaagtgaaggacttgcctagggtcagataataactacatagggacagaggcaagaccgggattttgttctgatttgtaattcaatgttctttctggtacaccaggaaacacagactcaagcttatactttctggtgatagaatatcaaagcagttcttaacagcatcctgagtattgaattcaccttttattgaggtgaaggctagaaaaactaatttttcttgctttctaaacttgccctactcctgaaatctgtatgaatcaaatgtaattttgacttctaatttttaataatggttcttccaaaatggattaaaaatggtagatgtatggcagtttgattttgcatgatagatttatatatttatgttctcaaatctaagtaactatcatatttttgaaactatataccaatattcttgaaaaacaagcacggaaaataaacattttcaggtacgagtacatgaggatgggattggaaatcacatggatcagtaaggagatctgggattttgtggtagctgttcagatatgagatcttcaaagctgttttgagtaaaaatattcacagttataagtagctatgcagcacaattctgaatagtggtattctgaaattttgatttatatttcagtcattgttttccaaattttggttcccgagttgcttataggtatttttttaataaagaagtctgtggccaaattttgccatgctttcactgtatcctttcctacccctacttgaaaattataatgcagagttaaagatctaaataatcctacagagtagaagatccaaagaaatctaagaactccagttaccttgttgaatccatgttttccaaacttgtttaaccacaaagcagggttttgttttgttttcctttttttcccctagaacatttattattagtaatattattattattatttgagacagagtctcaccccatcacccagactagagtgtagtagtgtgatcttggctcactgcaggctccacctcccgggttcaagagattctcatgcttcagcctctgtagtagctgggattacaggcgtgtgccaccaggcccggcttttttttttttttttaagtagagacagaatttcaccatgctggccagaatggtctcgaactactgacctccctgatccacccgcctcagcttcccaaagtgataggattacagacgtgagccacccaacgcgctggcccattcctaaaacatttattatcatctcaaaggtaaaagtgtcccacaattgggagagaattttctcgactggattttctctttttcaggatcttttattcagtatccaaatttttaagacacctgttgaacacaagtacttatctttctctgaaataaaggtgcatttgccacactaaaggagctaagagctaaacagctaaagagaaaaaagggcatgttttgctatagtacctatacattctatcaatactaacattgtaaaacataatttttcagtatataaatatacatattttatattatatacatctgtttgtgtgtacattttgtgggacaggtgttagcagtacaaatatctatcttttaaccaggcttgttggtattttgggaacgtctaaattttgtatagctcattggtatttaccttgccttctttataagaatgaaagattttaactttggttagcaccaactgatattcaaaataagtattatttccgtaataatttggtttattgtccctttctgtaacaatagagccaatgaccagttgcctaaaatctctccttcccatgcttaatattaaacatttggtccagtaaaaagtccacagctctgcctttcaaagcttacttcagcacactcctcttacaggtggtggtatgttttcctaagtccaaaaagaatctgacatgtgactaatctaaagatgccaagagagattttcttttgttttgatttgaaatactattgtgaagtagaaggtcaatcttgaaggggctagcattagaaacatgttactgtgtcatctaacaaaggacataaagataattgaacaataaactaagaaagtacatgaattatttgtgccacctattttttaattgcataaaacaatatggaaaactgtagatatcggtttaagaatattcagatgccccggctagtcactgaaagcacatacacatttcttacactgactccatccgccttggattgccagacttagtgataagtggacttgataagttgtgatgcctgcttaatcagcagtatccaccttgatagtctgacatatttagaaataccaaagttgaataaagcataatataaaaatagacaaaattttttcttaaaatagcatcattgtagttcattgcactcttggtaatagaccttgggaaaatccccaaactgaaagtggtttgctgaaccaggatgtattttgcaaggtaagtgtacaccctatgacatgaaccaagtttttaggtttattcaaagagaaaggtctataaatgatgacaatgttcaaatatctttagtagttgaattggagactaaaatctggaaaaaattcatatagtttgtggaacagtttcaccaactttgcctgtgagtcatacttaacatctaacgataagacaaggtcagcaacagcaggatcccaggacatcggcatggaagtcaagctcactgaaattcagatttactgggctagacatgtatggaagatggatatcagcagggtggcgaagcagctgacagactagctgaaatggagtgattgtaagcacagtgggcaaaagaagtactctaaggcctttaagcagtgtggcataacttccgactggtggacagtgatagcagcaaacagaccatgctggtgcacagcaatcggaatttgtgtggctcccttcaagtgactgtgctacgcaaactctaggactcttgcttgaactgtaataaggtagctgtatagagatgtgtaatggtatgctttccttttgaaatagatgtagctaggtctttattgcattgatttgaacacaactaatatttctactaaaaaagaattcttgtcaaaatctatcccttagtgtcctcacaggtgatttttcactcctaagttacgccaaactatcctgtaacctctctttatattttcacattactatataatttagcttctcagaaatgtttatttagtttctgttttctttggcatgttctctataatttttacttcttattttcaaggtctactatgattctcaatccttctgaaatgcatttcatcccgtttccttctgctttattctgtctctgaacttatcagttcaatgagcctttactttcacaggagctaagaaacaaataagaagagatccaatgaatacatattatgtgatttatcctcattgctatttctttatatatttcatttttcttttttagaaatttgacataaagcttagccctagcatgaagtcttcccaaaccagtgaagtcaattagaacatattcaagtttaattttatcccattaagcaaactggatttcagggcctttgagctttgatggtagctgacgcgtgttccagtaacttacaattcaaatgcgactgtagagtttgctgtagttttgaactttatctctgaaaggttgtgtggttcagacttgtgtgtttttcttttctaaattataataaagtgtaaaatttcattttaagagtcctacaatccttgaaaacatcgtggggtttttcaattgtagagatttagaatagatcttatgatttatgtatttctcaagtccataacacctgatcttgtttagttactatcaagaacatcttttcaccctgtagaaaaggaatattttaaagaatgacttaattttgaactgttattttatcttccatacaagctatttgattactggagttttgcctttcagaaataattaaacctaattttaaaaacaactgattatgggatatatctgtatctatatttatttctatatctatatctatccctcaaccaattatagtcctatagaatatttagcagttctaaaaaatgagtcaatgaccatttttgcttttttgacaaaaatactggatgaggcttataattaagtgtgttaatcagaaaaaaaatactttatagcaagaatatatataatgaatgccttattgagtcctaagctttctggaaaattatcacagaataaattttgatgtgtccaccttctctaacaccccacaattactgaaaataatctttttttttttttttttttttttttttttgagatggagccttcctctgtcgcccaggctggagtgcaatggcgcaatctcagctcactgcaacctctgcctcccaggttcatgtaattcttctgcctcagcttcctgagcagctgagattacagatgcatgtgccaccatgcctagctaatttttgtatttttagtagagacggggttttaccatgttggccaggctggtctcaaactcctgacctcaaatgatccgcccacctcaacctcccaaagtgctgagattacagagatgagccactgcgcccagcctaaaaaccatctttaacattaccagattgttacttggatgagaaaagaatatgcaagaagatttaaaaaaaaaaatttgttactgttaacttgttgattattttattttgtttatttttatattttacttattgtctaaaaaaagacttaaggatgagttcaacatcaaaatgtgacccaaacaaagggaaccagaaataaattataaggtgttttgattttccttcagttaaggccataaggacaatatgccacatgatatgattttacttatttgataaaggagtgaatgccagttcatttggagaaacagattatttcctagtactaaattctaaataaaatctatcatataaatttctacaaagggtattaaagtaacataattagctaggtattttataggaaaaagaaaaattattttaatattcatatattacccattcataaacactaaaaattaaatatcgctagtaaatatagtgggcactatccagaatttagataatttagatactaaattaatacattgacaacatatataaaactagagcaaggtttggcctgcccattgagaagtctatctcaaatatccttgacttacgtgagcttgtttcaggattaaggtatagtcagttcagggctggattctatgatgactatctggaatgccaatattctatgctgttgaaagcaatccatattctttaaatctaatataagtctatggcagaacttacatttattatgaaaatctggaaacttgatttttattgtcactactttcatacagaagggtgcctctgcgtagaatcaaaattgctaccaaaaaagagttttgactcattccaagtaattgcccactaatttatttgaaattgcagatttctgcatggagaagatatttgggcttaaaaaaaaaaaagatctaaccacaaaataaaacatttaattgcctatttttattatataactgtaatatttttaagtgaactctatactagttcacttatatgcacttgatatgcattaagtatgtgcatatcaagtgttgcatttctgatagttacagtttcttttttaacttctttcatatattttaacatctaaaagagtaaaattaagattggcattttcccaatgcaaaaccatttaaacaagtcctttagtctattgtgcacttacgatgtgataaccacagtccttgttgctaaagactaacaaagcatttgtttagtggagggtgaaacaagtaaacattagtgaagactagtaatattttgtggtaaatgcagtgagagaaaatgtacagggtgcgttgtgaaaacaggacaatcgcctcattggcctgagtcccgaaggccatttagttgttaatcaggtgaagggcattttagctagaaggaatggcaatttaaggagtattgaatccaaatgccggaagttcagtgtggctgcagtccagatgttttatgggtaggtaggagtagattaagtaggaagggatgtggaagccagatgatgaagggctttgcttacaataaaaaaaaaagttggattttatccagagtgttaaggcatgaattaaagcttgaggatttatagaaggggtagattccagagctattagaagaacacagtatagcatagtggctaaaaggagctgcctaaatctgagcttaaatctaggccttgtcaactaagagttgtgtgacttgtgcatgttatttaacctataaacctaagtgtccttatctgcaaaatacttgcctggtacatcgttactgtgcagtaaagagtagctggtgctgctgattctggttgctacttgcacttcttaaaaagtggacttgaagactgaatactggcagtaatggaggagtagggtgctactggagaattcactagaaatataggaagaagaatgggtttggattttggtgttttagacgtgttaaatttgaaacagaaagtggaaatccaatggaatccatactagtttgtgagctgtcagcaatgttgtatggaaagatgaaaccgtgagttaatgacaaaactgcctacatggaggagatagacaagaagatgtcaagggtgaaaaactgcgtgcattcactattatttgaaaattatgtggaaaaataaaataaaatccctgaacgagaaagagggaatcataaagggatataagagaaaatggtgttacaaaagtcaaagaaagatttccaggaaataaattgtttataatactgattgccaatgagatgtcggttgtgataatgctagaaaatattcacaagaaggagccactggaagtcactgtcaatgttcagagaggaaaagggaaaatcaagtttcagtggaataggaagtgattgagacaaaaagaaatggagagtctagagatttgtctgaaaaggagagacagaggatgatgatgatgatgatgctgagaggagagctcaaggactttttagttttaatctgagcatattatcacattgcatgcaggaaaagagctgattaaggagaatatgtacacaagaaaatggggaataactttgtaatagaaattttagttaaaaatttccccccaaacactgagaaacagtatatatgaaatgctaaagtaaggcatcaaaccactaagatgactgaattgttgatttaggtttcttgggcttcctcgggaccattacgtgggttccttgcagtcacaaggcatgaaggactggttcctaactcataccaaaaagccaatacttgtgtacatataaaaagtgactttctagaatgtgtcagggccaaggatatgtaaggattacctttgaaccagatagggactacaactgagaactgttatacagtcattctgactctggccttaggctactggcctaagcagcaagtggactgcttaggccagtaatgagataaagaagactatggggagtggactccaggaaaccaggagtcacacaagtgcaactcacagcatgggaggtcaatggaaagtacccagctgaggagcagcttctgaagagcccacagaaggccccaagaaagagccagttttaagcatataacaggactacggggcataaagcctcttaaaaagaacattaacaaagtaagaatatcccacatttcttttcctaatgggagaggagagagtaagaaattaagactaccacattccccttcctgaaggcaggaaacctgcctgcctgcagcgggagaagcttcagcttggagaagagtttagagttttgattattctttagggctggcttactactttatgatttattatatgtaatttaaagtgattaggtttttctactacctgcaaatgaccagaaaagtcatgagactgcttagagctctacaatggtggtagaatgaatgcaaaggcgcagaagaacatagaaataaataatgtacaaatcacacttatttggcattctggcacatttggttcagtaagttcccaaagaagtgtgagtggatagaatccacatttaggaaaattgaccttgaatagcacactttcacaaatgtggaagagaaagagataaaaatgagaaaagataatgataaaatttagttggaggaaagagctaaaagaacagaaataaatgaggagaaatttgacttgatgagccttttctgtgggaattgatgagcttccattctgtgagttaagagtcctggtgaggcagtgattagattggaagattaaaaattgagagaggtttggaatgaaacagagtagttgttctcaaagtgtggtccccaggctagtagcatcaacatctcctgcaaaattgttatacatccaactccttaagtctcaaccagacttcctgaatcagaaactctaggggtggagcccaacaatctgtattttaacaaaccctcctgatgattctcctgcacactgtagagtctaagaaccactgttaagagtttagtgatttaaagcacacgttctgtgtttaaatcacagcactgccgcttattgtcttttgcaaattactaatatttaacctctccttgtctcagtttcttcatctgtaaaatgaggataactagcaataacatactcatagtattcttgtaaagtctatatgacccaatgcactggaagtctttagaacaatctctagcatattgaaataataattaacaaatgtgtattatcattgtgggaaaatggaataaatttctaagtatacatataagaaaattgtagttctgattagtctagtgggctgtactttgtgacaattgcccgcttagtagccaagactctttgttttagtcccttgccacaagcctgtccgcccaggagtcctgttgtcttttctttttctgcaccatcttcagcagcataaggctattttgatgaatgaaatggaggaaaggaggaagaataaaccaagaagcaaagtaatgtgtgcagggaaatccatgttgaattagtcaagctctgaaggagtttcgaataaatatatgataacaaatttttgaggaataaaattatgtggttttttttttggaaacactttaaatgtttctttgagaaataatgctaggaagccacatcaaatatagtagcctggtaaaagacaaattctgtgttatctagagaatttggtttccagtgcatttgaaagaaatgtctaattaaattgattatattttcatttacttagatctatatggcttcattatcaagtatttaatgatattttccaagacccaaataatttgatagtaataatgttggctacacagacgagccatggtagttttatgcttattattagtgataaaaccacattcaaaagtatactatttgtgtttttctggttacaccctaataggctgaaaatatgtaataaaataccctaatgactacaccttgagaactaaaccctattctaattgctttgatgcatgggctagcaggataattgattgacactaagaccactcagtaaacagccagctaacagaattagattaatgaaaacatatggtaattacaactgtgcagaacaacttgaaatctacaacgtagcctcaggataaataatcaaaagtctgatcaaagagcaattaaagttaataaaagtctcattgtgcatttaggattaagaagggctgaaagatgaaactgtaaagttttagaagggtatttgatgaaagatttacttcattccaaaaaaaaaaaaaggttttgttattctggagtaataattgaatttttgaaaaaggaaattctcatatgttttttcaacattgcttaagaaacatttattttaggactcttcatactacattggtatttttataacacacatttacttttacttaaataagtaagtccttgaactttgactcattcattcttctaacaaataattattaatcacttactatatataagtctccaaagagaacatcattgagaaaaggtaaaacagtcacaaatcctgacctttactattttagtctagtggagaactaaaatatgttttttaaaaatttgtgatttgaggtgggaagaggtagaaaagatttttagaaacatatgaataaaatatttgaacaattaaaaggaagaagtgattacttttgggggggtgcttcaaagaaagctttaagattccttcctgagtcttttaagtttgaagaatttgttacatatgttggcaaagataggaatgttttgctttacagtacttcctacagcaggccctattttctgttttgtcagtcctagcatatagtctttataattgaaagcatatatttgattttatagtcttattgtcttatttcctagatggatgaaactagaagtaaagccatgggtcataaatcataaatattaggctttcaagtcttactttgattcaagagccaataacccttttctcacatgccaccctgaatatttattattacattcaatgagttcaaaatacagtagtgacccaaggacacaccagtctagagacagagagaagattggcttaattgtgttcacatgtttctagggctggggtctgtggcagtgtcagcatcgtggaaatggattgtaaccacttttgtaagatgtgcacgtttacacttacagttgtctttaggtaaagtaattgtctcttcttggatgccttgggctaagtacaatctagtttatgtatcaccaatttggggcttcagggaaaatagggagtgagttcacctggatatttttgagtagtctcaacactggggatctcttccaaatctctcctctttgcccttcactcctatctgccacctccctttctaatcaatgaagagtggttgattggggaagggagctctgggaaggagagaatgacaagacaagaattattatatcagaaaaagttgacagtttggtgctgtgcaaaccgagggataatattgatcacagaacaaaaatgcaattgattttcaaggaaggtgaataccttaatactaaaacttcaaagtgtaatcgttctttgaagtatataaagatgagtatagaatctcttttaaaagatgagaaaattgagattcagacagggtatgtgacattacccaagattgcatggcatgggtgagaaattatcttgagataatactttccaattccttttttagtgcattttttactcagaccaagaatgcccagatcttcactgagcaccctatcaactccctcccacactatcattttcttgccccactcattgccctttatcatatttttggtggcatttttatgttcctgttattatatgattgattttctcatgtgtgagattatttagtttctttccactagaaacgaagtttcttgagggcagtcatatgtcttgttcactaatgtttctaaatctgattaccactgctgtaccttcagcacctaatatagcattggtagatctgcaatatatatttactaactgactatttatctactatacaaagtgggctaggtggttataaatcagagtaatcccaactgagtgatatgcactgtgtacaattggagttgtggagataacataaatattctacaactctacattcagggtttttattacgttattcaactatgttgcaaaatgtattgctctcctcctttcctgaaaaatgtccatttaaactacaccacaaaattttgcatatatttttgtaagacatttattgatccaaggtattcttaagtattggctataggataaactattctacaggcttaacaacacagactagctaagtacaagattccattctataccctggggagtacaacaatgaatgtactatggtccctggctttgggtagctaatagcctaattgcgtgtaaaactcattgggagtaacaggatcagaattttggagctattacagacaatgtactgatgaagatgtgggtcagcatattttagtgatttaaccaatcaagctggaggtaatagtagagctggaactgaaacccagattctctggttctcagtcagcatttttcccctaagtgtttatgagttctagttattatttttgctgattaactaccatgaataaatgtgtcttaccatgagcttgtttctctgattgtcttcatttcattttgtttttctgggctatgttgaagagcatgattctacaagccaatgattctttccctggcatctgcccttaaggagtctatgacctttcatgtttcttagctgtcatttcctcatgcacacattggcagttctatccatctttcctcacagatactttctaacctcttaataatttgatatttttagcctcttgccaatttactcagtgtgtatattttcacttcactgacttgtatctaggttcaaactcaaccttttaagcactacagaaaaaaatggactcagtcattcatttttcattcattatttcattttacaaatatgaatgcctaccatgtgccaggcacaatgctaagtgcagcagatagaattgtgagcaaatagtcaaagtacttcttttataaagactactgaagtggaggaaaaagatacacacacacacacgcacacacacacacacgcacacacacacacaccatttcaactgtgacaaatgctgcaatagaaagatattcatcctatgtgaacctatgataggaatatttgacattgccaagtaggtcagaaaagacttctctgagaaaataactttcagttgaaatctgtagtatgaccagatggcagttaagcaaataggagggggaaacatgtcttaaatgggagtggggatgggggaagggcacgtgcataaacactgtaatgtgagggatcatggcgaaggacagacaaaagacaagtgtaattgtaggtagagtacaaaaagtgaagggcaactttatctgagttgacaaggcgggtagaagttggaatctgcaggatcatgtacaatacgttaaggagtttcttaagccccaaagaaaaggtagtcactgaagattttaagcaggaattaacaatttttatactagaagacagaggttccaaggatgacttcaacaagccggcttgtgatcctggaagtctagtggtgctatttattgacctagaaaaaaaaatggacaaagcacaaactctgggagagtgagggaaggaaaatcgtgcattcattttggaccatgttaagttggagatgcctttaagatacccaagatgagatgtaaagtaggcagttcattaaactaatttggaactcaaaagagtattatggcctagagatataactgtatgactcagttgtgactagatgataattgaatctgtgagcttggatgagatcacttcgggagaaaacatcaagtgagaaaaggagagagagctgaggagcaaccttagaggaatgtcaacattttgtggcttgagggtaatgagaatggcaatagagtagtagggagaggcaaggtaacaacaggaaaacgaggagagaattgtcttgaagccaaggggagagaaaatatcaatgatgtcagtgtttatgagagataaggaaaagataataggtcatgactaccttgtttcacaaggaacaaataaatggttttattgattcagggaatagtaatgtctagcatcagtctgacttcatttaagccttcatcatcagacagtgccactaaggaccaaatgtctcttcctttctgcctcctttggcattggctctgtctttacttgtgacaaattggataggagataagtaattatgtaattatatattggtgtaaccactaagatgaataataaagagaaagagcagttttggagggaaatttttagtttagttatgggcatgctaagtttgcaagatatgcgaagatccaagtgcagatgttgagtacgtagataaaattaaagaaactggtaaatgaagtcatgaatgttcatggaagtacctatgaaaacaaagaaggataagggggcttagcatctggaattgagagacttcagtatttaaggagtgggtccacatggaatagtcaattaataaggaccaaaagtagcagtcaagaagaagaaaaatcaaaagaatgtgatgtcattaaagccaagggaagaaaagcattcaagaaagcagtggtcaacctttgtcaaatattcctgagaatcgagtaaaatgaggccgggcatggtggctcatacctgtaatcccagcattttgagaggcctaggtgggtggatcacttgaggtcagaagttcgagaccagcctggctaacatggtgaaaccccttctctaattaaaaaaaaaaaaaaaaaaaaaaaattagccacttgtggcagacatctgtaatcccacctaatcaggaggctgaggcacaagaatcacttgaaccctggaggcagagattgcagcgagccaagatcatgctaccacactccagcctggatgacagagtaagattctgtctcaaaaaaaaaaaattgaatcaagaatgagtaaaatatctattttaatgagcaactgagtacattggtgatcttgtctggagctgtttcactgatacactaaggacaaaggaggtaagtagtgggaagggggattaagtcagattagagtaaattgaggagtgaatggggaagcaagaactgtggagggcttggttagcaaagtagataactctcccacaagaacagattgtaaagagaaatagatagagcaatagctaaaggaaaaagtgggataccaagaggtgactttgtttgatgagaaacacctgggcatgttaaaggatgataggaataatccaaggaatagggaaatattaaagatacataaaatgaagtattaataagtgggaaagaatgaaatttagagtacatgttttacaaggtgagcacaaggtgaaagttgattattaagtgtaagagcttattaaaataatggctaatgggctctagattgaagagaaaaggtgtgaggataagaagggaaaatgggtaagaggtaaaaagaagtgacaatgtgaagacaccaatgagactgacaacagctatggttagtgtaattgagcaccagtgtgtaaagtatgatctggtataacattaatagcatatgctaagcctggtatgcagtgcagaatttttcaagattaccagtcttctgaaggttactggatggatacattattttcctgtatatccatagtatttttgtgtcattattctagtcctatcaccatatcgtgttattgactgcttgtgcatgtatccagatgagtagattgtgagcccctagagcatgtctttgagcctaccaaagtgttttatatataagaatactcaacatgttcaatggattgtggtaaaattttccatctggcaccttatcaataactgtatttatatctctgtggttaatcttcagctcccaaatggtaacagtagcatgcacttgcttccattctcatcttctggattgaaacatgacgtattaagaacctgaaggttttgaagtagcatggtgtttcccttgtttaaatctacttactcaatacaaatacactgggttgtaccagccacttatgcctcttggacaaaattaagtcactgaaaaacaaatttgaaaaattattctaaagcattaacatataaactccccattaaaaatattatgtattaaataaagagcaaaaaatgtatacactgaacaaaagtaacattatcttaatgtatgttctttttaagtttacttcatgttattttcagtttccattcatattttccgttatttaatcatagtatatataaaatattatagcttatttcactcttcattaaatcgtaaaattattccatgttgctatatagtcttttatgtctatcatttttaatgactgcagaaaatgtcactgggttgatgcatgataatatacatggccattccccttttgtttgacatttagtttatttctattttttcctcattataatagtttaacgaacatctttgggaatatagttctttcttgttggattgtttccttaggatacatacctatgagtgggattactgatcaaaatataaagacacacatgaaagttgatatgttttcaaaaaaaacattgtataatgacacggtatcagtgcttcaaactcatctcatctttgccagcatcaggtataaaaatttttactttaatatatatagaacagcacctctattttaatgtacttgggcaggggtgggaattatttcaaactcatgtgactaatcctccaaaatttgagtactatgattgacccatttatattttgaggaatattagttatatcttatccatttgaattttcttttggagaaattaatactttgtaatttgatcctttgatccatattttttcagtccagactttcccaattattttagttcagttatttttattacatacaattctacataaaatattttcttacataaatttataccaaatcctaataatagctatatgtcagaataaattagtagctgaggctgtgggcactggagtcacaagaaacttgatttgaagcccaactctgcctctctaattgtcctcctggtgacataatcctctgggcttcctcatgtgggaataagaataacaacagcatgacagttgtgtgaggactacatataaagtatttaaacattgtgcttaacaatattcagctatttgttgatttagattatcagccaacccaggataactgattttattttatttttctcatcctcctgtagattcaccaaattttcaaattgatagtatttgggtggtttcacagcagacataaaacacagaatggtaaaatgtttagtaagaatattgaccaaataaatttccgtatgaagttggtttagctggaagtgctggaagagttgaggtcatggctcacaggtatcactgatgtaacacgtaactccaactatttctatattacattaaagcagggatcccattttatctggtacattacatttgttgtttaatagcattggctgaatatgtcttctatttcttgtattgctatgtaaggccatgttgtgatacgctgtttaattttgctggggttgtatttttatatttgtatatagagaaatatcttatacctatataatagtgtttcctctttgtgtagtataattcttcatattcatcatgataccaagtatattttcttacatataatcatattctaacaataacacacatatttatactttaccatttaaaaattcattttactaattttcattttctctttaatatatgttgcctaacttaagtaatatgtgtatgagtgttataatctagcaatcaacttccaagctgctttcttttttcttcaagtgaaatgattttaacagctgatattttttattatatttatgatttttgaagtacactagctgtcacatttgaaaaaaatctgttttgatattaaactcaaacatttgaggaatagaaaacatatagtatccttaatttatgagcaaggaaactaagatgtcgcagcattaattgacattttgtatggtcttatgaatataagatgaaatgactagggctagaacttaggtctctaaccatcagctttattctaaccattaacgtgtgcctttctttggtttggtataaatattaactccaggacagaagcacttttgtttctgaggattaaaagaaaatacttaattctgttgagaaacataccaggaagctttatctaaaataatagataaaaaagtaattggataatttatattttaatatttaattattacatatttgctttttcttgagacaaagagaaagaataaggctgactaaaaaacaggaggaaacaatggaactctcctagcctctctagcattctaacttcaccatgtgttattaaatgcttggtccatagaaatacagaccttatagataaggagccagagtatatcacggacgtaataaatttagaataagggcagttaactctataaggtgaaggattattgatcattctggagaatataaaagtttaagaatgaaaagcagtgaatggattgatggtcacagctaagtacactctgtgtcaatttctgagtcaaactttttgtcatattggttaggttgatccagttttcctttctgtggctgctgctgtgagtttcagtgaagacagtgcagacatgtaccagaaacatttaagtgccttttgattgtagtttacagtaaaacatatcaggcccaaatttagggtcttgtgttacattgtggctaaaaaagttttgttgtgtgccaacatgaagcatctccatacccaggtccctatcttagaaaaggtaccaatcattagacaaatgagtagaatgtggatagtcatctaaagatcatagatagaatgagtatgatagagttccacattttttctcataaaaaacatttttattccatttcattctttttctctcaaggaaaaaatactaatatagaataattaagtttaaaaatacaagttttcgagttcttctgttttttcttcattattttgggtaagttatcatgtttctcataagtattgttaattttcttttagttcaccttcatatttgaagggcagcacattacttagtcttacttgggcactgtcaattgccatgtactagtcaatgccaaatgtcaaatgccataagctagaagtaacttgtaattatttgcagatagcataactccaggatacccttttctttaattttccctaatcagttattgagttggatatatgggctgtaagtaaaggagtactgatcccactgtgctcaggaaatgcttctggtcgagtccagcagacacccaaaggattagtgcagaatttccttaaacattttccatcctgaatcagagacatgtgtatccttgtttgaaaggcagattcctgagtccatcccagacctactgaatcacaatctctggggctggattccaggaacctaacctcagtgcttgtctctctacctactccttgatccttatgctccagcctcttgtagtctctgactcgtgcccagtatgtctccattagaaagccatgcacagctcttcctttgcctggatctcttattttccaactttctcatgaatggttccccctcattcaggtctcagttcaagtgtcaccttcacggagcagacttcataaactccccaagctaaagcaacccccatcctcaccataacattttctatcacattaatatgttttattttttaatgtttagtgtctgtcactttttactaaaattgaaactccactagcacaatagcttttctctgtcttattcgctgatatatttgcagaaggcactccaatacatacttgtggattaactaactgaatttttaaacaaaaattcaggtggctgtcacatgccctcaaatttggcaccacagggctagaggatgtctcaggacgactagcatatgtttctcaattaaaagcaaaacaatgtgatgccccaggtgattttaattatctggttaagtggctcttctccgaggcaaatcaaatctaaggaaacctccaagagtacttaggtatatcaagaaaccctgtgacaatgtgaaagttcgctgagctgggatggggaccatagctttggctcctgcttctgctggcttattatgtattttccttgggccaaataatcaaagattatggacttcagagttttgttgagatgctttacttctaggggcctacatatctgcatatctaaaataagagaatgagactagattaatatttcccatactaggttctacaaaatgctaattcattgagacctaaacattgactccctagaaataatgcaagatatttcaaacgctcatatggtcaaaaaattcaaattattctgtctctttctgtcttggagattcaaattactatgtctctttcttaattggagattcacaatgcatatttgcagtgctaaaatactaacaaacttccaggaaataaatttgttcacacttatttaacccaacatttatcaaacttatctaatcacagcatttgttttatcctgtacaaactatgaagtagtattccacaaaattcagcatgagaagtgctgaactagattatctcaatgctatcttgtggttctgagggttaaaaattgcctgttgccagctgggtgcagtggctcacatccgtaatcccagcactttgggaggctgaggcaggtggatcacaacgtcaggagttcgagaccagcctagtcaatatggtgaaaccctgtgtctactaaaaatacaaaaactagccaggtgtggtggcgtgtgcctgtagtcccagctactcaggaggctgaggcaggagaattgctttaacccaggaggtggaggttgcagtgaactgagatagtgccactgcactccagcctgggcaatagagggagactgtctcaaaaacaaacaacaaacaaaaattgcctggtgccaaacttcaaggatgtttgctatctcttctgctctagaagctctgtaatcccaatggggctggcttcacatctgcaaaatagagaattatgacgatttgaaactccactagcacaataacatttctctgtcttattcactgctatatttgtgaaatagagaattatgacaatttgaacctttttgctttcaatgctgaaatcactggtcagcattccctaggcttggagtcattctgtgtgagatcaacccctttttattagagcctgtacctaccaccttctcactccatccaggcaagtcctgggtctcaaaagctatgcaaattctaagggattcaggccaagagaacttttatcttggtagcaggaacccattctagtgccaggagagagactaacagaaagcattttggttttgtctatagaaaatatgcattgagtaaacaatacaaggaattttaaaagcttctctttgaccatcactggcacaatattgccgtacatcaggtaatttaaatgattctgcaccagaaagttcatgtacccctgaagtcatacattttgtaataaagtatttttaaaaaagaaactattgtgtgggtgcactgattaacgcctgtaatcccagcactttgggaggcgcaagcgggtggatcacttgaggtcaggagttcgagaccagcctggccaacatggcaaaaccccgcctctactaaaaatacaaaaattagctgggcttggttgtgcatgcctgtaatcccagctactatggaggctgaggcaggagaatcgcttgaacctggaaggtggaggttgcagtgagctgagatggtgccactgaactccagcctgggcaacagagagagactccatctcaaaaacaaaaacaatttaaaaaaaagaaagaaactattaagatctgctgtgatttgaattatagttccctcaagactcacatgttgtaatcctaatgcccagtacttcaccgtgtgactttatttgtaaatagagtcattgcagatgtaattagttaagtcgacatgaagtcatacgggagtagagtggatccataatccaatatgactggtatccatataaaaaaggggaaatttgggccagacacggtggctcacgcctgtaatcccaacactttgggaggccaaggtgggcggatcacgaggtcaggagtttgagacaaggctgaccaacatggtgaaaccacgtctctactagaaatacaaaaattagctgggcatggtggtgcgtgcctgtaatcccagctactcaagaggctgaggggaaggagaatcgctcaaacccaggaggcagaggttgcagtgagccgagatcgggccactgcactccagcctaggcaacagagcaagactccatctcaaaaaaatagtaaataaataataaataaaaaggatggggggaaatttggacaccaagacagacatgcaccaagggaagataatataaagatacacaggaagaagatgaccaagaaggaactaaccttgcctaccaacaccttaatttcacacttctaacctccacaaatgtgagataataaatttctgttctttaggctgcccgcttcaggtgctttgtttcagcagccctagcaaactaatacagcgtctagatgctggaatcaagtctctgggtcctgcatagaaatctattcaattgccagctaaattcctccttccagactaccaaatgtttgagtagactcgggacacgacagagcaggacagtgaacaatcttcctcagaccactttatttagttcttgtgccctagagtagctggtttatctcaagtcttggagcagatttcttaatgacattttggtgaatcttcctttactgttctagtgtattttgtttcagccataataagcagagactggaagaaattacaaatatttggaaagataaaaggcaatgaaattactttgaaacccactttgtacagccctgtaagcttgaccaggcaacattttgggcaaaactgcctagatttttaaagtggatgttagaaacaggtaatatagaaaattgaagtgaatcttccctgaaattactgctaccattaccactcttctttgaagaccagtctaatgcaatttatacctcttcagcctaacactaagaggtcagagctttaaaatggcacttgtaacaaagggaagagtcaaattgttcttgtcactaattagttcagatgttatttcaaattcactttggctctgttattgactcaagaaatcaagatctgaggaaatcaactgtgagaatgttacaaacagggaaaattaggtcaccatttatgttttgcagctagaaaaggaattcattgcccatgtttaacttctatttggcactaatctcaatataagagggttgacaaaaatctgaaaataattataatgtgaaaaataataaggcttgaatccaaaactttgtgaaaattagagccacttttttctctgtttatagtttctatctcttttgatccagcttaccatagaataataatatcatcatccacaacaccacaattatcaccattaacttcattttcaccaataaaagtcactcggtacccttctgaaactgtgcaaaggcaatgcctaaacccagttctgccctgtagttatttttagttgtattgagaatatgccatactgtggttcagttggacttagcaaatgacttaattctttttggcatttttcggtaagggagacttacttctgaattctcacttgtattgacaactaatgaaatggtcagttgtagtcatggctttactgtcaaatattccaaatgcctttccttatcaatggcaatattttaaagtgtattctcattttattaaagctagtagtttggtactctgatcatattacttgaacaatataaagatgcatagctacattttgggaaaactcgccttttttctatcacccaaaataaaaagattctcaattacagaatatgcccacttttaaaatgtagcttcatatacaggagtacatttcttatttaattttcaaatatataatatatttggggacacaaaggccagtgtaaacaagaacaagtccatgaaatacaacccgtctataatctaatagccctagtcaggggactagaattggggcctaaagccattttacttgtctttatataagaagagttacaacaaaaaccagaccattgtttaaatgctttttctttgtatagatacaggttttgtgtgtgttagatacaagctcattctaccaaaatagatgaaggtacaaagtttttcattctttcttctactatgtttatgtcatcaacaatcctttgttaataatctgatttttttaagggtttcctatagccactacttttagtccatttcaggatgcatgaaggaagatagcaggttgctcagaccttaacaggaagaatagggtggcaaggccctaccttttaagcacgaggctgcctatcatgacttctaaggaatactgtttgtcccaagaattattaataatgcctcctgaaagaatagctatgcaggcagaaattaaccttctctcttctactttttttgctccctgcttaacttcccaaaattccatacacaaatagctatttttttaatctccaaatattttttatctagtactttcttcaattgaatggattgatcctactttttcttattaaatgtccacttcttattcttcttgtctttaataccactactctctcctaaacaccttatcaacctccctgccatctctacttaccatcactgtgatattatttaatcccctctcaaccttgttctctctttttctgttgaccaatccacttttgttttacatacttaggatgctgaaggaaagataaggtaggagagaacagctagcagattgagaataattttgatgagttgacacttaatttggtaaattcaccagactttggctcagctaatttcattctgtcacatctctcaaggttgtcactcattaactaagcccacagagctcaagggataaggcagttgttatctctgaatgagaaacctgacagtcacatcaactgataaaacagcatcagcatgacttacacattccttaccattgggcaaatctacatgggaaatcgcatgcttgtactcagaacaatctaagtcagttttttaaaaagaagtaatccttagctaagagaccttgaaaaactcttgtccactataaagataactttgaccacagaataataatactccaaatctttggccaaaatttcctctcccatgggcaacacttgaatgtggaaagtcagggtttatttttctttctgatgtttctttttctatacttccatgtctgagaagcctcctttaggattaatatatttttaaaaaattctgatgatgcagtgaatcaagtatagtccaatctaggagtctcctgtaatgttaatatgactttgtaaatctctgatctcactcactataatagatggtgttcaacaaaagtaatagaaaatcttattcacagtggcttaaactaaaaggacatttacaaagaagactcatgggttgcagtcttaccgcaggtgcatcaagtagcttaattatgtaatcaaagaccttctcctcccacccttccttttccccgtgctcagcattttggcttcggtgttgatgactgtcatagcttcatgtcctcagagaacagcacacaaaccaagaagggagggaaggggccaaaagcctctctcatctcagagcactctcttatcagagccatttttgcactcaagctcttccttcccagtttacttctctgtgggcatacctggatcaccagctcacttacagacagatagaagaataaggttggcatattggctcagaataatcatgatccatcctcagcagctagacacattgttttgggtagggatggatgatgttgttgccttagtaagcaagaagtgggaatggctgttaaatagacaatcaacagatattatcacaccatactctgttgggtgattataatagtcttaggctttacccaaaatctattgatcaggcatctctggtgttgaggatcttcatgtaaaaccaaaggagaattggtttgcaagtacttagggtgctaggcaacctcaccattttccccatgtactgcttacagtacctttctcaatcaaaaagttctctacaaattctgtttgttgactattttctttattctcctaatcttgattgaagacacttacaaaagggtaagccaatagtacctcatagagaaatacattttgtttgatgcaaacatacttaagcttgcaacttatttgaaattttttgcaaatgagcatgcaaattttatattactatatcacttgcgtaacaattccagttaacaatcatctatctttttaaagttttatttttcagagggtcttaatctattttaaatatcatttgatgcagccagtatcctgaaaattgtttattggcaacttgattattccataattataatggcagttctagcagtatgtgccttcttcagataatgtcatcataatttaaagagaaaattagtaaacaacccacagctgttttggtatgaaatgtgcatgcgtagttatgaatattcatattcataaatattttatcctaatgaaagatattaattctatattttaaaagaaacaattgtaatgggtattagaatataaaactacttgttaagattgtgtttcattttcttattaaaacattttttctaaacattttaataaactttatttttatagaagttttaaactcacatcaaaatttagcagaaggaacagagatttcccatatacccccatacatgcagagcttctccagttatcaacatttcccacagagttgtacctttattacaattgatgaaccgatattgacacattattatcacacaaagtccatagtttatattagggttcacttttggtgttgtacattccttgagtttcaacaaatgtatgacatatatccagtctgctaatatcatatagggtaccttcactgccataaaaatcctgtttgtgccacctgtttaccccttcattctgccaatagattgatttttgaaatgttaaaaaaccttaataattgatataatttaatagaaaatacctttacaatcaataaaaacatattatctatatgacttttataccttttagaaattttatatgatttagtattcctcacttaatatgaatatattcaatgacaaaacattgtgtgacaaattttataattcattgaaaacctctagagcagggctgtcaaattaaattttctgtgatgaaagaaatgttctatatcttccctgtcgaatagaatgttactagccacacgtgtctattgagcacttgatatgtggtttgtgtaaccagggaatagatttctcaattttatcaagttttaattaatttaaatttaaagagtcatatctggcttgttctactatattggatatcacagatttagaaggaagtacaaagtaggagaaagaatacttcttctttcatacctcattgaaggctccgtatgctccttctcagaatatggagatgctctttaataaaatagtctgcaaacatcaggacacagaagaattatctggagaacttgtgtttttttgttgttgttgttgtttgtttgtttgttttttgacggagtcttgctctgtcccccaggctggagtgcaatggcgcgatcttggctcactgcaacctctgcctcctgtgttctagcgattctcgttctagcaattctcctgcctcagcctcctgagtagcttggattacaggtgccagccaccatgtccggctaatttttgtatttttagtagagatggggtttcactatgttggtcaatctggtctcgaactcctgacctcaggtgatccacctgcctcggcctcccaaaggagaattggttttacgtgaagatctctagaataatgactttcaaacatatttgcctttttgcccacaattcatagtaagaaacagatttattgttacccgcacacacacataatatatgtatattattcataagtatacatatatttttatgtgaactctgatcctttaaattacattttactttatttcatttttcaaaatctggtagtgatccactaaaatgtgtcaggactcaattgaaaaaacagtgtgctcaatagccataattgaagctgcacacaggactctagggcagagatacagaaagaacaaattgagaaagtcttttttttactccacccctttcccatggctaagaaatgtctgattcaacaaagtcaccaatggctctttttttctcttaaatgattcaagaataaactacatatttatgttgtaactgccttaaaaatcaaacataaatgtcccatgaaagaattatttttataagtaaaataggcttatctttttaaagtatgatgttgattttgtccaaaaatagatgttgtggtgacttttcatgctgaactgtaagtgagtagttttaaggcactctagggtatgtaatgttagtttttaatgtattctttcatttttatagacccagaaaagacaagaagatattaagagcacacatatagtctataagtctgttcattgtatgaacctaaatatttattacagactcttatgccaaataatacagcaatatttgtgtttatttgtttaaaagtaacctggaaaagatttccgtttacaacaatcttagtctactttttttctcctgttggaatggatcttaattttatccatgtgggttacgaatctgaagcaattaaaattaatgattgtgtggcgtaatagtacaagaggctatttaatccctgggggataaatggttcttcattattatttattatcctcctgtttcttgttaaaatatgtaaataaatagaagagggacagcttacaggcattttcattatttttttatgtcaccgggacacagtttaatactctcgttatgcgtggtctatacacagttggaattctgtattcagtgatataacagcttcatagaaatgtcttaaatgtgttgtggaagcatgtaaaccatcttaaagatcaatgcctcatgggtttatttgtgtgtggccaaagcaaatcaccaatgtagttgttcatgttgccatttgcagtttgtaaaagacatgccatgtgtgcactaaatagtgcattttcggctagctgtatttgtagcacaatgtcagattgaatttggagatatgattcactctctttgttccagagcagatacaaattatcatggcatgaagtaaatagagctactagtggttaggtcagatgttaagaatgatgtgtgtgtttctttgtgtccctaagaatgctatggtaacttttggtcagtagatggagttgcaggtcccagacatgtttgttttcttttggatactttggccttattcaaaacagaatatagatagaaagatagctagatagatgatagatagatagatagatagatagatagatagatagatagttcaggagccaactaacagtaattcagtttttccattcattaatttaataatgaagtacatatatatagtgtgtgtatatatatataaatggtatatatgtatatagtattgtgtatatatatattttcctccaccctgcacaaaaacaaaatgtatacatacatgcatttggtatgtgtttgtgtatttatatacatatacacacacatatatgtatatgagtgtgtgtgtgtgtatgtgtgtatatatatagtaactaggaacccaatttaaggcaaattctttgtcgtctcatattatcgtaagtaaatattccagatcaatcaatataagtagattgccataaaggattttgaatgtttaacttttatggaaaaataacctaaagttgaaaaatataaagtttaatacttcacttaaaaattgtaaaatacagggtctcactctgtcacccaggttggagtgcagtggcgtgatcacaactcactgcagccttgacctcccaggctcaagtgatcctactgcctctgcctcctgagcagctgagactacaagagtgcaccaccatgcctggctaattttgtattttggggggttttgccatgttgcccagactggtctcaaactcgctcaggctatctgcctgcctcagcccctcaaagtgcggggataacaggcacgagccactgtgcccagcaagtactggtggataattctcagtgagattttcttttgtatgaaaattttttattttaaccttgagaaaagcaaaaaaaaaaaaaaaaaaaaaaaaaaagagagagagagagcctaattagtaatgcattagctctattttaaaacctattaaaatttagttctttgtcttacatctgatggcaaaattttaagctcatgcgtgattcatgcctctcttactgtgaaacattttgtttagcaaagatccaggcaaaattaggtgacagcattaatcctttatttctctctactagcgtctaattttttgactttaggttagaactgagcacatgtgctttggctgaaggctactgatatttttgtttttaaacttctgaacagtttttggaacaccatgagcattttacaaatgtcagataattacagtactacaaagtgtaaggcaagaccaacaccaacagcgttctagaagaaatgtttgaaactttacccttgcaaagaggaaacataaggagaaggatgaaagctaatggagttaagcaccaaaccctcaaaaactagtagatatataaaaaaaatggttgtcagtgtaagtttctatttgtctcccattctttacacacctgattttgtgaattttcttgtaccaaagaattcatttttcctgctgctagtttcttaaaaattatccagcctgctagcccgaggtttgcaatgtttgcttgcatatgagagaaataaactaaagctggttaagccaagaaacgttttatccagagattattcaggtgtcttgaaacctaagagccaaaattcaattgttccaaaggaagaaactagagccaggggcctcaagcctagtgaactatttgccatctctgctccctgcttctctctgtccacctgcctcattctcgtctctgtagactggctttctttccttcacagggacatggaagaaaacatggccactcctcagttcttgagttatatgttacaaatccagctgcataaagggggagtaaatgaatctctatgaatcctaatcccaaatttttaaaaaggagactgagctgaaataggtcaagtgctgatcctagtccaatcaaatatgtcaagatggtatcccactgtacaaatgactacagaaaactttctgccctgagtgaagagggaattagggaaaaagtattgtgaattgatcagtcactccaaaatgccccaattagtgttagactttttttgttttttttttctttttctttcattcttttttttttttctttccttttatttttagctttttttagagacaggatctcactctgttgcccaggctggagtacagtggctccatcctggctcactgtagtcttgaactcctgggctcaagtgatcctcttgcctcagtttcccaagcatctgggactcccggtgcacataccatactcggctaatttttaaattttttgtagagacagtgtctcagtatgttgcccaggctactctcaaactcctggctttaagctatccttctgcctcttcctctgaaagtgctgggattataggtgtaagccactgcacccaacccttgtgttttgtttttaaccataacaatcactttagtttgttttaaaatatcaacaaatatttattgaaagctcaaaaacagtagagtatcagtctaagcattaatgtatttctttgttgccatttttcaaaattacaagtaagcttcaaaattatgaatggtgccagatagaaaactcctaattcctgcttctattcagtggtggtaactcagcatctataatttacataatggtttcttgttagtccacatgtttaaaattacgtctattttaagatccttgctgtatatatagtgcaaggacatgctgttttcctgaatcagtgcttcccaaactgtctggtgcctcagattgacctggagaatttgttaaagcacagattgccgactcacacccagagtttctgaaccagttagtctggagtggagcctcaagaatgtgcctttaccagtaagttacgatttggtgctgagaatgctagtcctggaccacaatttgagaaaccattgccttaaataaaattaaattgaacttctccaaggttggccagtgaaataaggctttccatgttaaagtcttagttgtaaccactgccctcctgaagttgatcttccctgaagagaccgttttacacactaacaccaacactctccacaacactggcctcaccaagtacgcttgaacatttcaaatcaattcataatttttacctttgttctgagaactacactttggactacttcagactatgtaaacaagggatcactctgaatcaaggggaaattataaagaagagaatatgcaacaaagtaatctgaattacaaactttgtgttatgttttattttctggcaggggaggtggttggggaacaccataagagatgacttctagactatcaatgagactttatgtggaggacaccaggaatttccttggcaaaaccactttaacagggcgtaatataaatcccaaatctatacaagacaatgttttttaaatagtggtttgtgacatattagtgagtgagtaaatcaatttagtgggttatgtcttttttttaatattaaatagaatggaaaatagcagaataattcttaggccaattattatactgtgaaacatgttatacaatataggtcatggtcataaaaatttagagcaaactacattcaataattttttgaagtggatgagataataattattaattatttttgaaacataattatcttggaatgggacttcagtacacttttgtgcaaaatggtgatgatggaggaacaatgttcccaccacacccattctacagccagactagagataatttatcaaacagaggaggcaccagacatccatattaattgatccatattaattgactaggattctgcatctttcaaatatttcaaaactcattgcacttttgagctggatggaacatccagaatcattttttaaggtgacttttaaaatacgtttacagaattctaagagtcttaatgagatttccagggctcatagtccctagtcctgtttgaattaaagctctttatcaaattgattctaagtcttgttgatggtatttactgagctctgactgtgttcccggcaatattcataatcatcccatgaggaaggtagtattatcaccccatttttcagttgagtaaacaaaggcatagtgagtttaagtaaattgctaaggttccagattatattcttaaccattacactataattctcacagcaaaactaccgcagagctcaaaacacacccacttaaaaaatatccttatttattctagccacttaatttaaaagggcttttacaccttactgaagtaaaatactagaaccagattctagtattttggttctagtatctagaaccaatacatcagattcagggctagaattgtgatcttcagtttgtttaatattattcgcattcaacaagcatttgagcaagatcttgcccattgtcagtacactgggcaacatcaatacgagtttctgtatggactgagccatacttgagattagccaaggagatggctatggctaaccttcacagtctgcaaaacctcctggcaggccctcttgttcttactgttttatgaaggagaaaagtaaagcccaacaaggatacatagctcttcgtgtgttacctgttagtgagggtcacaggcagcctttccatcctagacaacctgctttcaaagcagtcattctgttcacctcatccattgctgtttcgttggccaggttccccattgccatattactttgggaatcagaacatcctacttcaagggaagcttttccattcacatggaatttatccaagcttacaacacactgttacaactttaggaggaaacttccattttctttgagtgtttaagtagaggaggtaattcgtaatgttctgacttcccttcagcatgtggctcaaataaattaagaagaaacaataaaatgtaccttcaatgtcaggattcacttgattatgtgtatcaaataaaaaacatcacttttattaaagcccaaattatgatactttcatctcttccttgcccactaggaatttaattgcctagaattcagttgtttcagtcttcaaaacattgccatgtgttaagaattaagtctacttacactgctttcttctcaggaggcaataaaatgtatgagactttattctcataagtctacttgcactgttttattctcatgagggagtcactccctgttctatgactgctcctttcaggataccagtggtcatgctgattccagttatctcaaagctatcaacccctgaaatattggtgtgattcggagctctgcacattattcacttacatgcaccctccaacttcatgctgaatgccatcacttgggtctgaaagtgttattacccattatagtctaataaacatccttttcaaataattccttcacctgctcatcttcagtgtctaaactcttagccgtagtcgcacacaccaacaaaggaaacacacttacttctataaggatcagcaataatcttcaggcatagagcatgctttctccaacttagaaacttttctctacaggagttagtatctctagaaggacagtgaaactctagatgctccataaaataacctctttgttacttgacagaacagatgagctccttagagctacaattgaataaaagtctcatccattttcaaagaagatgactgcttatattctcataatagaaggtcttcttggtggttttcccagaacacaagaacaatttgccccaaaatgatttcaaggagttttcaagaaagctttgagatgatattttttttttccaacttctactcagcaaggctttaaaaattctaggactgaatttcatttgaagtacttggtcataaataacattagaggagttctaggaaatgattttacctttgatacctctaaatatatgttgtaaaaaaccagaaatataatttcaaccgtacatcttgtaataatgggaaaattgctgagacttagatgatacaaataatggaagtttcatagaatatgtttggaaaaaaatactgacctttattctccaaccaccacttcatttttaacaaagtcctaataacattttgggaagctacttcttcatttgcctgcaggaacaatttgtaagacaaaggcatcagtttcctttctagttataccacattttgcccaaagctggtattacccagtgtgaccattattttattcacaaaagtagcttcaattgacctttcaattgaaagattctaaagacctgaatccacccttgaagagtgaaaacatgttactaataagtaaactgggcaaaacatttcaaagtacaacagcattttcaaaagaagagtaaaaatttgcgttaaacaatgtagtaactgcctgaatttctagagtcattaatttgaagaaataacaaacaggtttttttttttctggtataactagatcttgcaaagcccatcaaagcaaagaatcataataaggagttacgtggtggataccttaaacattttattattttgaaacaggcaagtacatattattgtaccaatctttgatgcaagactgagtattttcgtttgtgacttggtccactgatgatggttcctctccttgtttctcatctataataccctgactacagatttccaggttccatttttttagtgtaaaaccttaaagaaaatttctcatcaggaatttctatttataatttttgcaccttcacatccaatttacagcaacttgaatttttccgtaacatttaacttagttttcatagcaaatgctctattcacattcgttttcatctttataagaaataattaatttatatatgtaacaaattcaactggcataaacaatgtcaggaatagttttcgcaagcagacaactccaggtatggaggcaaggtgagttgatgaatcagagcgaatcctaccttcttttggattctgtaggtattgaaaagcagtcagtaggttttaaaaaggtaacagagagccatagttaatccaggaagttgagtaaatcaaggttagttaataaaattttagtattttaattaagaaattatctttgcatcttgtgtaatgtgaaatgtataaagcatcaaatgtgaaagtcacacaatgagggcaagaaggctttaccatcctttgctggaggatggtaaagatgaattcatgaggttagttgaacttaagtaatggatagatttaaatacatacatgaaatgaagagagaaaaggtaagacttgacttcttcattgtgacaacatgtccatatccagacatgtgtcagattagcagtgggccagaattaaattctgctgagtgggcagatgggtggacactggtcttctcctgactttctctgaatcccaggttatcccgggagcccagtcaaggactccatgtgtattgtctatggtgtggtactccagctgagtgcacactgcctgttccccacccacctccacagacaattcaattctactttgcatgttgggtgcaaatgaaagatttaattgtacagagaatgcatcagcaaaagacttttgaaaaaacattctaaaatatttttcatggagagaaagggaagaacagatgagagcaaaattgaaatgggtttttgaattgcaaagctaaaattttctggtttaatttcaaaggtctgaggtgaccagaaaagtgttgggcttgcaagacagactaaacactgagagggtcagcgagagggagattaaatgacaactcagtactagagttagaaacagatttttttctttgaaaaaaaaaaatcagaaaattgggaatagaagtaagttttggataagaaacataaactcacctttagatccatttaatttggtcaatattaattcagcacctactctgtgtcaggaattgaagttaagtcattatgtgataaacttccagaatgcttgcagtcttgagaaaagatcagtaactaaaagtctacaaagtaaaatgtattgtaggggttaagaggatagtcccctgagtcaaaagcagacatatattggtttatattctgcacccatgcatctctgaccttgtttcctcatcaatagagtaatatgtacctcattactatattttgaggattaaataaaacagataatccatgtacaacagttagctgagtatctggcatatggaaagcattggttaatatgatgatggtggtggtgacaaggaaatgggatgatgatgatgatgtacagcagtggtcctcaatgtaattttgcttgttaggggacatttgccaatttctggagatggttcatgtaaaaacatcttataatgtacagaataacctccaaacaaataattttccagtcccaaatgaccatagagctgcacttcggaaactctgatgtagaaagaaatgctatgacatggataaaaagatgccatagaaatatgggagtcatggatgaaagtaggaaaagttaaggtaacagaatcacctagacagatttaaaaaaaaaaaaaaaaacaagattagggccctactcaaaggcatgagactcttatggggaaggaggttgaaatcagtatttttttaattttgagatggagtcttgctctgttgcccaggctggagtgcagtggcacgatctcagctcagtgcagcctccgcctcctcggttcaagtgattctcctgcctcagccgcctgagtagttgggattacagttgcccaccaccatgcccggctgatttttgtatttttagtagagatagggtttcaccatgttggccaggctggtctcaaactcctgaactcaagtgatccaccctcctcggcctcccaaactgccgggattataggtgtgagccaccatgctcggattaaaatcagtattttttaacacttaaaatgttaagtgaatcatttttacttaatgacttgtaatcagtaattactgtaatccatattttttaacacttccgggaatcagtcttttttttctttaatacttctcagatgattctagtggtaccacaagttgagaactgctgcccctcatgaaatagctaataggtagaacaatgtatgaaattgacctttagtttgtatctcttggaaactgacaaatgttaaaaaccacagtgaatttctagtgaaatttttttgcctggcaaagaagtcattctatagcaccccctgggggaaaaaaaaatggagggaaaagtggaggtagtagtaaaacagactggtgctgctccaatttctcttatttgtgactttgttagggtcaggcagctgcaagctattcattgcaagtagaaattcttttatacttgtaagtgaagattttaagctaggtcaggataaagtcgtgagtagtccatttatccatcaattgtcaatgctttagcagagagaaattagagaagtatatagatgacttcaaaggcatgcagaaaagagttgagaatcataccaaaggaagatagcagaaagttgaggatgagtgaggctgggtggcaatgagttaactagaaacaagcttatctttgttcagagagaatctcacactttgaggtggaggagctggaaaaaaagaaggaataatagtgtttaaaaggaataatagtgacattattcagaagaataatatcagaggggctatggacttgcaagaaagtgactattgcaaaggttattttctttttatgaaaataacttatttcactttacctgatatatttggcaggcattatttgaatttaattgatagcttcactgaagcaaagttattaaatccttgtcagttaatgagtggtccatggaccagtagcattagtatcacctgggagattgccggaaatacataatatgaggcccgctaaaatacgtaggtgtattgtacacacattaaaatttagaagcacttttgtaaattatggagtcaagatatacattcaaaccaaatgatctgtggaaactctttatttcatattctaaatcctgcttagcctgaaaacaagtttaaaagattttaattcaatagatatatttttctacaagaataagaaagaatttttaaaaactctaacatatctctctctgtatatttcggtgtacaaataggatttgtttttattttaaagaaagatggaaaattagactcttgaggaaaggacctttatctattttatctgcaaatcctaaatgattagatgccttcccctgggttaatatgataaggactggtatttttttgcaattgaatgtatcgaaataataataattttcaatgcaaaactcagatttcagaagtactgtagtctataatcaaagattatatgtgatatgtaacgcatttaatcagatttgtttgatgaaagcgtactctatagtggtatctattttgcatgaaatcacagaatcttaatgctggaataaactttataagtgagttaaaataatccacatgcagttctgcaatttctttttccatgtctgtggattgggttttgtttttcagtgtcacttaaaatatggttctctgaattgaatcgagcatcagatccacaagcagtgatcacttccagtgatctggaatctgaacttcaatttgtgtagcccaaagattcctgttagctttgttattactacatctttattaacattagttagaatcatttaaaaattatattattaatacaaactatcagataatttcccatgaattcttgctaataggattctctacaaaactaggcttacacaattgatattttgaaagtaaaagcctgtttgtcaagttatccgttgtgtagatttatagtagcttgttagtatttgtcaagataattttgaatcttgattcggtcacttcttgcaacagctatcattccatgttgtgtagtatcttcaaattttatatatctttttttatccttaagtaactgacccaaatggtcaaacccaaggttgtgctctgctaaaacaaaaacattcttggactctcatttactaatatagtaattctatttaacgaaattagataaatgtggaagaagaatctctgtggatctatgttggcttctttttagttggttattttctgaatgcaaagatgataatttggtaagcaattggaaaaacaatatttcttcttaaactttaaaatggaatagaaattatcaaaatgtaaaagcatcagattagcatctattgtttaaacagagtaaaatgttatatagagagagaggatgaagggtggccaggtacagttactgggagagtcataacaatgtcttaaattacgttcgtgttaaatctcaatcataacatcattttactataaaatagattttatttaattaacttctgattttacaagttatatctttattacttctgcaggaaatgataaaagcctctaaagattatttgatatatttaagataacaagtccgtctgggtcaaatccagtaattaatatttccctaatgaaaataaaatgaagatttcttcttattaaatagtattatatgctatcttcatttattaatgtgactttgcctcttcaatgtaccttttatccaaggatataatagtcttataatttgatctctgtttcattgatgaacaaactgggatatcagaggtgtaatgattttccttgaattgtatgtcccattaattatgaaggtagttttattataatctatgacctctaatatcaaatgtttagttccattccttataaagttgctgatgatccctttaagtgttactaattggaaaatccataatttctgggacctcgtgtgtattgcttcccattgtatctctagattctaatgtaagtgcctggcatgtagtaggtgttcaataaatattcattaaatgaatgtaccaatgaaatgtaatatatatgactctgtcatgtaggaaatccctgctattgttaagttcaaatacataaactatacttactctgtcaacttgttcctgtcctatttcttgtgatgagtactcagcataagccctctgctgcatctgtgctgatctcagtttacacaatcccacaaccccttacgagcagacacaatactgtgttcatgcatgcagttgctaaggtttttcttgccaccttaattgaactttttttttttttaccacaaaactaaatttatatagagaaataaaagaagagcacttaatatatgtattcctgagtgaggtgcctggggtctcttttatttactagctatgtaacagtagataaaatatgtcgtctatctgtgtcctgtttttcccgtctgtatgatggggattatatctacctcattagatttgtaaaaattaaatgatcaaatagttaacaaagttatctttattcttacattttctactatatttaagaccttgtttatgtactgtacttctctctactactatacggtcaaactgccctctcctgcctctgccttcaccccctccaaacctaacaggactatttgataaggttatacattcatcccctcattgcctaacataatggtctttctcagagtttactcttctcaatctctctgccccataaatagttataaagaccctattactgactgtaaaaactcccttctccaatttcttggctcactccaggactttcctacttctctagactcaatttctattttccagacttctatttgtattcttttccaaagaaatctcactcttttgtggccatcagtatatagtcattgatcacaagaataagtaagttttcatcttactgtttttctgtccctcattcaagagttattcattatgtgtcacattttcttccacacgtatccctgtctttctatccgtactgacattctttttaaccgggtcacctgctgtgtgcatttgaaaagatctatccaatctcttcctcagtcctgtacacttgacacacaaacatgatctttctaaatcagagctcgaattctctgtccctctcctacttacaatttttcagtttattttagtcgccaaccaacctatattttattctatctattcatctagtaatagacctcaattgtggacaaaaattcatatgttgaagccctaacccccagtacttcagaatgtatttggagagagggcctttgaagaagtaattaagttaaaatgaggctgttagggtgtgccctaatccaatctgactgcattcttataagaagaggagattaaggccaggcatgggggctcctgcttgtaaccccagcactctgggaggccgaggtaggtggatcagttggggtcaggagttcgaaaccagcctggctacatggtgaaacctcatctctactaaaaatacaaaaattagctgagggtggtggcaggttcctgtaatcccagctacttgggaggctgaggcaggagaattacttgaacccaagtgggagagattgcagtgagctgagattgcaccattgcactgcagccagtgtgacagaccaagacttcatctcaaaaataaaaaaataaaaagacaagattcagacacacagagagacactagggatgcatgcacgcagaggaaagaccatgcggagcacagtaagacggtgaccatctgcaagccaagaagagaggcctcaagagaaaccaaacctgtcaacaccttgatctaggatttctggcctcctgaacagagagaaaatacattttttgttgcttaagccatccagtctgtgctgtggtatgtttttatggaagccctagcaaattcatacatacttcttctgtcctttatggtcccatgctttaatgaaaacatgttattattttccattctgtgctttcaatcacacctttttctcattctcaaatgctgcaactctcctatcaataaacagtcttctcaaaaccacattgcctgaatctttcctgactgtgacttcccatagtactctgttgcatcctcctttatggaaatatttagtttatatccttaggatgggttatagccaatgatgtacaaacttatatccccagctaggagataattttcttgatagcagaaaccagatctaacgagacatgcatatttagcagactgcactggatgaaataagcccaatatagtgaaatgataactacttttttatgttctcaaggtttacatatgtaatcccactaatactgtaaaccttagcaggagtcatgttttatcacagtgcatatctgaacatgcagttagaattatacattgtatacacacacacatttaccacacacattgacttgtgagcttgcacaaacatgatgaggctggatagaggtgtagcaattgtgaattgctgagttcttcaaagtgagtacattggttttgctgacccagaccagtctaagtgtgtgtgtgtgtgtgtgtgtgtgtgtgtgtgttgtgagtggggatggggagaagctactgtggtgttttgcagaaggatgtatttgccctaagaatgaactctcagaagagctctgtatccattagcttttgctggcttatgctgtggtaataacctccaaatctatattcttgcaacagcaaagtttgtggtttagctgtgcctctgttccatttcttcttcatttctgccaggcaaatgccaggtagaggaaaaagattaatagaaagatctcacaatatctcttaaaactcctgctcagatgtggcatatgtcactactgctcacatcccactagccaaagcatgttacgtaggcaaacctgctgtcattgagatgggaataatatccaacccgtcccccccaccccccgcccacggaggagctctgtatcaataggcacttaattttgaggaaaatacatgaaaattaaggcagctaaagaaaactcctgagttcccattgcttcccagcccaccatttcctccctgtgttctcttctgtttttttctcacctatgtccttgccttaaacacaaagcaagagtacctcactcttggctctgcaggcaggtactcaggtttgcttgtatagtaagccccttactgaaagaggagaacatgtcctgagtgtgttcaaaatactgatcctcactctacagctcagactgtgctttgtggattttgggagaagtgcacattaatgtatggcaggaagatcaggaacacagggccccagataatcacctgcacaatgagtaagcaaatgtcttcacaaaatgtaaggtcctttcacaatcttgcatgtatagatagtgtttcttggaaagagattaaaaaaaaatctcttctcaaattaaaccctttaatttttttattgatttgatttcattcatttattcaatcattcatttaacagtattgagcacctgccctgtactatattctgtgtttgacatgaaagatactaaattactaatgtctttgtcagctcaggctgctgtaacgaataccataccctgggtgacttagcaatgaacattgtttctcacagttctggagattgggagtccaagatcaaggcattggcaaacatggtgtctggtgaggacctgcttcctggttcatagatggaggtctcaccactgtgtcctcacatggttaagagagaaggagcaagctctcttaagattcttatgagggcattaatcctattcataagagctccctcattacatcatctaaaattctaattacctccccaaaactttacttcctaataccattccattagggagtagggttttaacatattaatttggtggaaggaaatgaggggttggggttggggaataggcattcaggtcataggaagtattaatgaaaatatctaacagcaattgagtgtttattatatgtcattcactacgataaatgcattacaagatgcattatctcctttcatctttacaaaatcctaaggggtagttaccattttatagtaaaagaaaaaaaggcttagagagactacatccctgtgccaagttcactcagccagaaattggtggagcgagtacatgaatcctggtctctttgacttcaaagctcacattcttaaccacacagtaaacatagtgatatattccctcaagaaccttattatctaattggctgatgagtggcggtagaatttctaagtatcttcattaaataaaatgtagaaacaaagtaatatatttataatctgagtttccacaggagaaaagagaaaagtaggagtgattaattccaataggcaacagacaggaaacatgggaagccttccttgagaggacaatggctcagctgggcaaaaagggtaagtaggatttcaataggcagagagcatttatagcttgagcaaagtcagagaaatgctgccatgcataggggacagggcatggatctgggtgatgctacgtgaagagcatccccctaacctggtaaggttagagagaagattgggatcacaaaaagaactttaatcaatgtactagtaaatttgaactattttggaagtcaacacagagctacttcccttctaaatcaatattgacttttgaatgggtattctagagaatgtgaaatgacagctttaaagatggctttaaaacaattattcaaaaaaaatgttcaaatcaaaacataatacctctgaagacaaactctataatgctttaggccaactcagtctctgaagctcaaatgagcataaatgcaattagccatttgctcccttaaaatgagggtaggtctgtctaatgtagcttgtaatttgccaattgcatgtaaattattttcacttgaaaatcacttaagttatgtaaagggacagtcctttcaacatgttaatcccaaatattgacacttttttccccaagaaatactgttgtttgattttcaagatatactacaaaataatacaaaggcataaaactctttccagttgaattaaatattatcaaaatccttcaggaataattttgttaaggcatctatgcttaatattatatattccatacacaacatttctttctgatttgattgttaatatgttctacatatagacacaattcttcttatggcagattttatataacatctgaattgcttatcattaaatattttataacaggtaaaatgatgaatgaaaaacttgaattggtgaattaaagttgggctgcatcaaaatttcttgtctctgcatgaaaattgatgagtttgttgatgattcattgcattttgcatttagaagcattatatttagtgccaccaggttaccatataaaatgtaaaagcctagaaaaattaatatcatgtctctcaaatttgatgatgggatgagaaggtaaaatctaaatctcaactttcaaggtcaaagagggatttcttgccccattcaattactgctcaatttgatagcagtaaaggagttaagagcatctctcctataatttggctagactttcattatagaaatagaatacattaacaggaaaccattaaatacaatttacgtatgaatagccccctcagtggaagctttgtttcttccatttgcaggataaagtaaaggtaactgtttcatatcaattaccagtcactgtggacaacatacttttattaactctgtggtcaaatgcattcatctttatatttcaagaatggcacaaatctattctttttcagtattaatctatgtcccacacaattactgccctgacatttattggagtaataaattggctttagtgtttgttggcttttcccttctttcagccattctgctttcctgaattttataatgtgccttcacttttttaactgactgaagggaaggtggttctaatttcacattagtgaatgtggcccatttattttcatttccttggtaccctaagagaaaaagaaaagtatctatattcacagtttcaattcagaacaatgaatataaatgcaaacaagctttgaggtttaaagcttctatttaatcattatagttatagtagttatgtttcttggatccataactatactaaaatggttgtaagtgtgtaattgcattgaagaaacctgggttcaagtgtaaactctgcttctctctctctctctgaaaccgtggggccctaggagttctcttaatttctccaaatcttatttattcatctgtaaaatggagatactaccacctaccttcagagttattgtaaaggtgaaataaaacattttatattcaataatatttatagaaattcatattgttccagacactggtctaggcgcaaattacatcagagaacaaaacctaagaaaaaaccttctctcctggaatttataattatttctcatacaagaaaacaaagtgccattctatggtataaaggaggtgctcattattcccagatattttcagcctataacaacaaaatgaaatgacaattctttcaaatagcaaattttgatagatgaaagaccacaacttctcctcaaagctttcttcagtactctcagaactcccaaggagcagtctaatgtaagctcagagaaatggctcaagttctctccttttctctccctcctcaggccaccatgacaatgagtctgtgctgctaaacttgtgcaactgcagttgtacttggaatggccctgcacaggcctccaaggtgtcccttaccacccatctcccatacttacaccccagtctcaggaagtgctaagttcacctggccctatacattgcgtagatattgctctagacaggagaagaatgtataccctactccattcttgaagagatccgtttctctaattcatattttctgtcccttaaattgatcttttttttaagtatgagtgattgtgtgaaatctcactgatttcagaggaaataccatttcccactcaaaaggcacaagcccttaccttcagcttctgagagaataattagtagaatataataaagcatcctctatcatttattcttgactaacactatctgaagggtacctattacccagtccacatcctctttactgtttatcttctagtagaggaattctacaagttattcctgcagtcctagccttttgccttaactttagaaaccagctacttgaagatttgcattttatcttcaccatcatagtttcaaagacattggggtcaaatattggtcatagctgagccctgaaaagataacagtagatggtctactctcttttactgatctagctccaaaaaggaccacattctccttgtcatatatatataataggtttgagattatagataccagtttcaagtgatatagtagacatgttagatttggatataacagttaagcaagggcttcaatttctttgaggattttgatctgatgttaagttgccaaagcagaacgtagagcttacagcaataaaagtgaatcagacagtgaggagggaaagcaggtgctgtattgatatttacacatggacagtaacatcatcaaaattgtcatcttcaaacatgtacagcagcttttgcaaaaatgagagagaatagtaaattcagaaatgagagtaactttaaactgtaatgtacataatgggtgaagtcttccagatagctcctccagattttgcacaaagcagtgaatcttgagtgagtccaatttttggttacgggtattttctttgagttgataatagatatgtgggattctgagtgttcttgaaaaagtccttattccggcagccctcatactggtaatattttgtcataaagactttgaaaggttctactgttgcatgatttgcaaatgactgctattccccctcaaaataacacaaattggatttaagaccaatatcctcaaaactggctgaaatgaaaaatgaacaaagtaaaacataaaataatatttctgcaaaataataatattttaataactcaaaagcagttatgtcagtaagtgagagcttatctttggaaggatcaaattcaataatacaatgggtcaacttcagattagctattgcttaaaattattggtgattgaatagaacttgtaattccagactagtcaacagaatccaagcgtatgtgatgcctcacatacatttgttaaaccagagaaaacattagataaatatcgacttttctcttgtcattttgagtctaatgttttcttttctttcagttttttatttgtttgtttgtttgagacaaggtctcactctgtcatccaggctggagtgagatgaggtgatcatggctcactgccgcagcctcaacatgctgggctcactcactcctacctcagcctcccatggagctgggaccataggcatgtgccaccaggtcaggccaatttttaaaattatttttagagacagagtctgactatgtttcctaggctgatcttgaactcctgggctcaagtggtcctctctcttcagcctcccaaagtgctaggattataggcatgagccaccacacctggctgaatctagtattttctaaagatactactaatagtacaaaggtatggttgatattgccacgtcttaggtaaatggaaactttacccaagattttgcaagtgttgaagagttaacaagacaagttaacagaggttctcaaaattgaaaataacccaagccccaagccccgtgaaacatataaaaagaaaaaatagtcaaatcacctccaaatatcttaggatatgtaaactacattgttgtgttaataagcaaacatctgatttagccctttttttcttacacaataaactccagacttcttaatacaccattttaatgtttttactttattgtgccaacgtgccttttcagatttgaacatattttgcttaggcttttgtcacatctgataattgcttgttcctgttcttcaccgtctttcaacattctacttacgctgcaaggcactatttaaatgttaccactttaggaagaaagaatcacccaccctcaatggctacatgtgccacattcttctattaaatgcttattaccatcttcccatattaggttatattgcactctttgcatgtatctcattcattaaattgttagtttccaggaaaaagagacatgcctcatctctttccttgatctcaatggcatgtcataaaatatagacattttggagttagacaaacaaggtagggttttgaaccctagttaagaagcattatgttccagagcaagttattcaatctttctgaccttctgtttgcttatctgtaaaaggaacgtagtaaccttcctctcaagcttgttatgagaatcaagcgagggatcatgtaaagcacttggctcagttcctgaccccaagtagaggcttcataaaagataatcaggactcttgaaggaaggggtatgagaagaaaagtcatttattttcaagtccacctgagtggccatgagcagtaggggcagggctaggggacaaactgaacagctggaggaagtctctaccaactcacaaatctaggtgattttcatgtggagaaaagcatagtcttatttaccttgtctcaaagtggcggttttatctttataattacattttgctatatttgttcttatagaatttatgataaaatacattagcccattattttaattttatggttatcagttaagaagtagcactccatattcttacagaagctattatcaagttatgtgctatgttccttggtcagtttgggctgccataacaaaataccacagaataagtgttataaacaacagaaatttatttctcacagttctggatacttgaactctgaggtcagagaggcagaatggtcgggttctggtgaggcctctctttccggcttacagatggctgccttctagctatgtccccctcatgacagagagttagatagagaaatcaagctctctggtgtctcttctatatggacactaatcctctcatgagggccccatttttaggagcttatctaaacctaattaactcccaaaggccccatctccaaatacaatgacttcaacatatgaatgttgggggaacacaattcagttcattgcactgtgtataaaaatatttgaatatttaatcatagactcagcatactatagattttaaagagacttagttacacttagccaaattcccccattttttacaatggagaaaacagaagacaggagtggttagatggcctgcccaaggttattacaccaattaacaaataaaatgaaagtagaattagattctctgattttttaactagtattttcagcaaataaatggcaaataaagtgacacatgggcacaaaccacgaaaaatgctcatgcagaatgagagtaaaggaaatagaacagaaagttttagaaaagagtaaaataaaaggtggctgaaaatgatcatcaaaggggtggcaagagattggaaaacagaagagaataatatctggaagacaaaagcaacattgaagggatggcagacaaggcagaattctaaataaaatagcaacatttctaacatcccagaaattagagtagatagtattgggttctaataatgtgactcacaaaaatggagtttccaagtattctgattaataactaacaactgtatagtaacagatgctccattttgagtctaaactgtgcctaatctaagattccaacataattggaagcctagaaatgtctgtttgctgaagaccgttagagtgagcatcagagaaacttttgggttatgactttttctaaagcaaaagagactggatgtatatgggccagactctaaaagtacacgtacaaatacagcacagcaatcattactcagactgtcttatgactagttccctatggagtcatggctgattcacacagcattgcaatgaaagaataagtacatctcggaaagagctgctttattataataaccacaggacactgagtgcacaagatatcagcagattgagaccagcaaccatcgctggagctggttttcttggcatagggagtaacaccctcaatgtagtagcatcaggagacaggggtgatgccagaagaaatgacagcactctctgtagatgcttataattgggttgctgtttttggcatgagaaactattaaattggtgcaaaagtaattgcagtttttgccattaaaagtaatggtaaagaatattttcattctctatttttgtattaaaagtaatacaaagaatatcttaattgcgggccttagcaagagagggggaaatacctgaagccacatagcagccaagaaggcttcctcacaaggaacagtagaaacttagaaacctccagctcagcaagaagaattatcactggaggtttatttttgccagaaacattggattgggttgagaaaggagcagagaagggaaagatgaaagagaacagagccagaaaaatattattgcatggcctattttagtgtgagagacagggaaaatggctaatacaatctgagaaacaaacaatgcagctcttgacagtagtgtgtgatcatagtacacagagtctaatcaacaggtactgaaattttaaatggctgctaaccccattgctagaggccttgcaaaccataggtgcttatattttgaaagatgaatgtagttaaacagatgaaaagcctagatcatggtttcacacagttgacataatatttagcttgtttattcactcttcttttggctgatgttgtgtccagaactctttattcttcattattgtgtaggactttaattgatgtctgtggttgctttttgaacattttattcaaagccaggtgtatgaagcagacatgtataccttaattgctgagatgtgtatagtaaatcatttctttgacagcctatcagtgttttctaatgaatccagagccattcatataatttgtcattttagtggaatcataggaattggtagtttgtggtcattttagaattaatttattgaggttctttcaggggaacctgcccccgataattcaacattaattcacgtaggttcttttcgatttccctaagtgtcgggcagtctgagaaataaagggaaagactacaaaagagagaaattttaaagctgggtttccgggggagacatcacatgttggcaggttccgtgatgcccccgtcaagccgcaaaaccagcaagtttttattagtgattttcaaaaggggagggagtgtacaaatagggtgtgggtcacagagatcacatgcttcacaaggtaataaaatattacaaggcaactggaggcagggtgagatcacagtactggggcgaaattaaaattgctaatgaagtttcgggcacgtgttgtcattgataacatcttatcaggagacagggtttgagagcagacaactggtctgaccaaaatttattaggtgggaatttctttgtcctaataggcctgggagtgctacgggagaccggggcttatttcatcccttatctgcaaccataaaagacagatgtccccagagcagccatttcagaggcctacccctgggaacgcattctctttctcagggatgtcccttgctgagaaaaagaattcagcaatatttctcctatttgcttttgaaagaaaagaaatatggctctgttccgtctggctctcaggcagccagacctaatggttatctcccttgttccctgaacatcactgttatcctgttcttttttcaaggtgcccacatttcatattgtttaaacaatttgtgcagttaacgcaatcatcacagggtcctgaggtgacatacatcctcagcttacgaagatgacaggattacgagattaaagtaaagacaggcataggaaatcacaagaatattgattggggaagtgataagtgtccatgaaatcttcacaatttatgttcagagatggcagtaaagacaggcataagaaattataaaagtattaatttgaggaactaataaatgtccatgaaatcgtcacaatttatgttcttctgccatggcttcagccggtcccttcgttcagggtccctgacttcctgcaacaggttctacatggctttttgaacaataagattctacaggtacatctagaaacgttcttaaaacaaaattaaactttcctttagaagacatcatacacaagggtgctgccttcaggtcactgaaatatccagtggtgctcattgatttccccacttttccttttcctctgcaacctcatatgcaagccagaaagttcaggagttgatactgccttgattaaagtatccaaatacttctgtgcataatttagattactataatgtgaattatgtgtgtgtgtgttaaacctaatactatattttttaaaaatagaatcaagccaataaaaatgcaaatatatttattttggaatataaggaagaaaaactgaaaaatagccccaaatataaacaaatatagctaataaggtgatgatcacaacaatgttcattgtatcaaaaataaaaacttccaagtgtcacaaaatggagtattaataaatcaggtattcaatgccaccaaatacaagcagcagtaaaaaatatgtatgttattgaatttaggcaagcaaatatattcctagtgtattgatatactacataagtggcttacaaaattatgagtatagtattgctatggtttgaatgtgtccctcacatttcatgtattggaaacttaatccctaaattcatatgttgatggtatttggagatggggcctttaagaataattaatatgaaatatgttcatcaaaatggggctgccatggataggactggtggctttataagaagaggaagagagacttgacctggctcactcttgccctcttgccatttgatacctcccaccatgttataacagtaagaaggccctcaccagatgtggcccctcaagcttggccagcctccagaactgtaagaaatcaatttcttttcttgacaaattacccagtgctgttctgttatagcaacagaaaacagactaagacaaacatgatatcatattttgttgcaagtaaatactgttaaatatgaaaatatagttagagacaggtagagagaaagacaccaacatcttaacagtatctctgcatggtatattgtcagtaattgttttttcttctcattcatttgggttttctgcaaataatatgcattattttgctattaagaagaatgggaatggttactttttataaagggctttattttctcttagcatttggtttgcatagttacgcactagaacaaatgattgactgtaactgaaatagtaatatataaatagcaagcatgacagaaaccatttaaacaatataccttgactctcactaaaatctggccctcaggtctatgtcacaagattgtatgattaatttaacagtattcaatgacttgctcctaaaaaagtaaaaaagcctgtaggttagaggcttcatatattaactttgtgctctaatacattgtattatagtagattctgctcctcttgtattttaatgcacacttcttttgaaaattttttaaaaagataaataacttgtgtaacataaatttgtaggtcacacatccatctgaacctttcatttacccaaattacagaaccatcatgtgtaatttgtctcaattagtaattttatagtttgcaattaactttattgttaattgattccttctgtaataaatgtttgaggaagcgaaatgaatatgacataattctttgtcaaagacgaaaattttaggctgagacttgagcaataactgcactgccttggaaagacaagtctttttttcctgccaaaaattgtccccaagtgactgatggaaaatttgtatcagcttttcatgaagactgaaaattatattggtaattttaatattgttttacttcttactttatattttttctcactgaaaatgttacctaatttaaaaaacattgatgtctaggtcttgatgtactactctccttaaaaagatgtaataaatgtgctttcttaaggaaatatattttagtaacaggttgaggatgcctgtataaatttataaaggattaattttatattatattggagtcattcactaatgcaaatggtaatttgaaagcttggcttgttgttgaatcactgaatatatttcagagtagtagtttgtgttatgctctttagtggtgaagaaaaatcttcagtttaaagacttcattatgtttttgaatacatgggagagacgggtaaaatacaattcgaaaacaatactagcaagttagtatgtatattcttacataaatgtctggaatccaaagtaattttgtatcctctaattggtgctaaaagcatttagaagtgtggtctgtgtttttatattgtgtagaaattcaaagacaggaaaaaatttaaattgatatagttcaaaaaggataaggagcttaattcctttctcataaataactgtgccactgagtatatctctttactcagctattgctcctctcttgctttttctgcttgatttcttgctgttaatgaatctgtgttggccctggtttctggcaaactaatggttgaggagggtggctagtggtaaagataagaaacttaaaacaagattgtgcggaaagagaaatatattagtgctccagccagctaaatatattagctggcttccatctcttggtatctttaaacaataatttacaaggactggtgctggccattgatgatacattcattggtgaaaggagaaaagtaagggcaatgtaataaagttctcataaagcaaactatattctatttaaagaactttattttcttctaagattataaaatttcctcttttcttagttaaaaatatctttttgtgtaatgaaatgatggtgttactagaagaaaggtagttttgttttttatttatcatccaaggaaaacaataagacaaaaattataatttggcctcccaaatatatgtttttacattttaattttattattctatgaaacacaataatcttggaagtagtgtaatagaaacgaagaaaagaaaggcagttcctctctgtattcaagtgaagaagcacatctgggaactgccagtcacgtggttctagccttatgtataagcacatctgagaaaattagagctacatgctgagaatcagaaaagagacagagagacagaagtcatcaggtttccatttttgttatcctctcttgattttacttataggaaataatacattccttttttgcatgagatagtttctgctggatttctgtcacttacaactgaaagcatccagatgaaggcgtttctggaaagggcaatctccagctctctgtgaagggtccttgaacattttctttcaagagcaaggtctgcagtgagacacagaagtgagattcttgacccaagttaaaggggcagaaatctgagaagagggttcagttgtggtttcttctccctgctccaggctgtgttgccttggtgttctgccgatgacctgtagttagtggagatctgtgctactttaccaaatttctgatgctccattatctctctgggtttcttgatgcatgcttggttgacttccactaagaataaatatccttttaacgtccagcactccctagcagtcggtgggcaacccttgggtctctcttcagtctgaataaagctgcttcttttgcttattcagtttgccttacagagtttgctctggaactgagttgaaatttagcatatttgttaccgtgacataaacactccagaaaatctcagaattgcaaaatgcctcttggtaatgaagttccctatcttggctcttggtaatgaggttcccattgccaagacagcatttatggaatagcttgtggaagatgaaagagagagtcatcttttaaacacagccaataatggtgactccggaaaggcagaaaaggaatctctgaagtaggtgtcctggagtcagttgttgaaacaatcctattgacaagtactgtgatagacagaacaagatacatacgccaacaggcatatgaaaaagtgttcaacatcactaattgtgagagaaatgcaaatcaaaaccatctcacaccagtcagaatgactattttggggaaatagccattggggaaatcgtggctctagatttttttttctggaagaattttcgtttgatgcagggggtatcttttgtccttggtagaaagtttcccaagagcctttgaatctgcagttactgacttaccattgtccttccaaaccttgcaggaccaaaaggggacacaaaggggtttctggaggtgctagtaatggtctcttttagagctgggtgttgcttacaaaggtttattaactttgtaaaagttcatcaagctgtagatttaggatttgagtgcttttctctgaattatgttatacttcaatacaattttacttaaacagaaaaaatacctagaaagaagctttattgatataaaaaattagcagaggcgatagcattcataaattattggaagagggattcaatgagacaagaaaaggcagaaagaaaaatgagacaagatagacaatatgccgttgctacctctcatgtccctgctgcagctcacattgattgggtacctattgaatgccaggaatattctctttgctctacatgtaacaacacctcacttagctcgtgagttaaatagtatcatttccattttacacatgagatactaagagttcagccaagttatatgattctaggctcacaaacctaggatctgcaggagctgggggtctgcctggaggcaggattcttcctaggatatatgtaacgctttttggtagtcataggaactcccttttttcaggcctccaaaaacgctggcatctgcttgctgtttgcaagggtgaagaatgggatatgggtagaaaggcatagaaagcgtattggaaaatctcaaggggattaattcccattccttcctttgaggtggaaatccatcatctcagtgtggggaggcactgctgttaaattctctgccctctgcaaacagccatctgtctgagaactccctgaagtggctgctatccaggatgactgtgttgctgcagtctttgagtggttggagcgctgtaatgtctatgttaatagctgggaaatcgcagtagcagcaaccagaccactccaatggaacaatccaagttggggtaagtttgattgagcaaaaaagtcatgctgactgtgtgatgaagaggcagaactggtaacagtgacaggccctgcagtcagcagctgtggattttatgtgcagggcagactgatctggaaaatgggaagagctgactgccaataacaccttggggggaggtttgttcagtgcatctccctactccttgtatacctctgatgacatgcagaagcttaggaaataaaacacacttgtaacatcacagggtgcaagtaagtacatgtggatgccagtgtagagagaagcgaaagctagttttcattgcaagaatccaaacagagtaacagggctttgtccactgtctccagtccatggttccctggtgttcctagagtcctattaaaaaaaaaaaaaaaaaaaaaaaaacacgggctggaccatagttaaactgctgcagcagagcatagatcatccatcagttagctattatttaggggagaacaaagggatttcatgattcctatcaataggagtttgcagactagttaaggagatgatgattgtcaagaaaaggcaaccaagaactttgcccagtaagcgttagcatgccaaatgagtaatgcggccatgagaacaataggagtgcatccctcctcagaggaataggttatctgctatgtcgaatcaattatattttaaggaataagaaaaaagctaggattggggacactttagatttatggtctatgtgtaacaatgcacagagttaaattttctatatcccactaagaaaaatgttctttttgtacacaggactgtaatttgtatgtggccctctgtagaactcatccaaggcatttctgaaaagaataacataaaataaataaaaaatagtcattattcagtgctgtggaaggctctgaagtcttctatccaaagcattgaatattcagttaaaaagtcagattgcctgaaaggggcaccatgactcagtctttcataaacaccagcaacttcttgaattcttttatctgctcattgacaatataaaatcgccattgctctgtcaatctgtcattaaatatttggctctaatagtgatgccatttgggatttgtggcatctttcactttaaatctttaaaatagaaagtaaacacattcagttttatcagcatttaattgtacaagctcaacataaaaattaaacgttcacctctaaatcacactcatcatttttcatgagcccaggctgttctttgttagctctttttggctaattatttctagtagtaataacaataactgtcgtttagtatatgcctactatgggccaagagttaaaaatgctttaacaatatttatttcagttaactgcatttttcatttctagttaatcataaatttatgtagaatttttttctaaatttagcattaaaagacaaattaacaagtacctaggccaaatctatatttttcaaatgaggtcactaaggctgaaaatggttaagtatctagcttgtaatctttttaaccttggattgtttttaaaagtatgacttaaacatgacttcaaaagcacaaatcaattgtgcacaaattgtcaaaacataaataaattaagagtatgactataaggatattaaaatattctattcaattaaggaaattacatacaaagccaacagtttaagagaagatatattcaacatctagatttgataaaggaaatattatacagaatatacaaagaatgcattcaaatcaccaacaacaataatttttagggactccaagagaaaatggacaaagaatgaaattaaggatgcagaaagttaagcccaaatggatgacaagcatataataagatatttaaacttgctagtaaataggaaaaaagacaaactataacaatgcaatattttatatcaatcagatggacaaaaattagaaagatgagtaattatcaggactgctaaggatgcaggaagctggaaacactatgcactgttgataggaaagtaaactggattagctattccggaaatgattgtcactgtagagatgtatttatatggcagctttatgacattggctacctggtagaatttagctgtgtaaaattcttatattcaccaagagacagaatttgtattttgtagaaaatacttataagagagaaaggaagccattttatctgtagtttcaaactcttaactagaaattaaaattagagtttttttgtcagatatagttatttagtcctatattcccagaggccaaagactatgttcattattgtgcattgaatgtatttgatactaataaatagctgtgtatgaataagagaatttaaaaaattaatgtagatgatttatttttattttttatttttatttatatttttgagacaaggtctctctgtcatccaggctggagcacagtggcacaatcactgctcactgcagccttgacctcatgggctcaagcgatccttctccctcagccccacaagcagctgggactatagacatgtgccaccatgccagctaatttttgtattttttgtagagacagggtctcactttgttgcccatgctaatctcaaattcctgggttcaagcaatctgcccattttggcctcccaaagttttgggcttacagtcatgaaccaccacacctggcctacatgatttttttaaatcctaatatcctacatatacatagagtcatatggatcatcttaaaaatgatgagtgaaaaaaaatagttcaaatgagaaatacagcacaaacactactcatataaataaaagcagatgaacacacaacattactatatattttataagcacaactcagaacatatatcaagcttaatagagtatgaggtgggggagaagttggataaaacaggtgttcagaacaaaaggagaaaagaaagcttgagcaggattttagaatacttatcatgactatgtcccatgcactattaggaatggttagcctaattctctgcacttgaggtccaacaagcaaacaaaaccacttctattacacagcttgttagcagcaaaggcagaacttgaagcaaagttgcaagaatttctgttcctaattttattctctttttatattgcatactgcttttgtactaaatatttacataatatattcatgtgataaggatattgtaattcaattcaaatacatttattaagcagcaattatatgtaaaagattgattgtcttgggtgttcaaggacaacacagctagacgtataagccaaataaagcttggctaagtttggtctagttcaatttttttaaaaaaaaaaaaagaaaaagaaatatgaaaaaaaagcagtaaaaatagaaatccatcttcaccaagcctttaaagcaatataaatttatactgaggttcctgcatactataacacacagaaggaattcctaaaaatgttctttatccagctgtctacccaaagttctatcatcctggcaaactgctctctccaaaattcatcatcttggactctctctgaaactccaacccttctctcttataccctgttctccaacattcgaatttgtttagtttgtcttcttcctaatatagctatttctgtttaccattttgagctctggaactctaaccactacttaccaccaaaacaaaagactagcaagtaggttcaggggaaagactatacataaatacacaggtccacaatctctttggtgccagatgtatttcagaattccaaatttttcaggttttaggaagaaatttggtgaataataaacaccactaaggggacagggaagcactaatgtaataatgatatattattattactgcaacaagatatatagtcacactatataagacagagacacatcagttcaggtcaagttttgcccccaaatatattcaggatggctcaagttttgctgtctaatgaatttttaaaagcttaatttttatagctttataaattatgaaattaaagatgagggaatgtggtcctatacatcaatactcaaggatcatatgagttaatttgcataaaactcatagatcagtgcatatctgatacggtttggctgtgtccccacttaagtctcaccttgaattgtgataatctccatgtgtcaagggtggggccaggtggagataattgaatcatgaggggtggtttcccccatactgttctcatgttagtgaataagtctgatgagatctgatggtttcatatttaggagttccactgcacaagctctctttcctgccaccatgtaagatgtgactttgctcctcattcatcttctgttatgattgtgaggtctccccagccatgtttaacagtgagtcaattaaacctcttttccttaaaaagagtacagactaatacagtaaattggtactggttgagtggggtgctgctgcaaaaatgtccaaaaatgtggaagtgactttggaactgggtaacaggcagatgttgaaacagtttggagggctcagaagaagacaggaagatgtgggaaaatttggaacttccccaaagttgagacttgttgaatgactttgaaaaaatgcagatagtgatatggacaatgaagtccaggctgaaatggtctcagatggacatgaggaacttgttgagaactggggcaaaggtgactcttgctatgttttaacaaacagactggtggcattttgcccctgccctagagagttgtggaactttgaacttgagaaagatgatttaggacatctagcagaagaaatttctaagcaacaaagtgttcaagaagtgacttgggtgctgttaacagcattcagttttatgtgttcacagagatatggtttggaattggaacttatgtttaaaagggaagcagcgtataaaagttgggaacatttgcagcctgatattgtgatagaaaagaaaaacccattttctgagaagaaattcaagccagctgcaaaaatttgcataagtcatgaggagtcaaatgttaatcaccaagacaatggggaaaatgtctccaagggcatgtcagaggtattcatggcagcccctctcatcacaggcctggaggcttaggagggataaatggttttgtgggccaggcccagggccttgctgctttgtgcggtctcaagacttagtgccctgcatcccagccatggctaaaaggggccaacatagagctcaggccatcagaggatgtacggaaatgcctggatatccaggcagaagtctgctacaggggtgaagtcctcatggagaacttctgctaaggcaaaaggaaaatgtgtggggttagagcccccatacagagtcctcactggggcactgcctactggagctgtaagaagaaggccaccatcctccagacctcaaaatgatagatccaatgacagcttgcagtgtatgcctggaaaagctgcagacactcaacatcagcctgtgaaaggagctgagaggtggctgtaccctgcaaaaccacaagggtggagctgtccaaggccatggaagcccatctcttgcatcagtgtgacctggatgaaagacatggagtcaaaagagatcattttggaaccttaaggcttaatgactaccctattggattttggacttgcatggggcctgtagcccctttgttttggccaatttctcctatttggaatgggtgtatttacccaatgcctgtacccccattgcatctaggaagtaactaacttgcttttgattttacaggctcacaggtggaagggacttttgacttggacttttgagttaatgctggaatgagttaggaccttgggggactgttgggaaggcatacttggttttgaaatgtgaggatatgagattttggagcagtcaggggtggaatgatatggtttggctctgagtccccacccaaatctcaccttgaattgtaataatccccatatgtcaagggtggggccaggtggagataattgaatcatgggagtggtttcccccatgctgttctcatagtagtgaatgagtcacatgagatctgatggttttataaatgggagttcccctgcacaagctatcttgcctaccagcatgtaagatgtgactttgctcctcatttgccttccaccatgattgttaggcctttccagccatgtgaactgtgagtcaattaaacctctttcctttataaattacccagtctcagctatgtctttattagcagtgggagaacagattaatacaatagctcatggtaaatacatagtaaatgttggctataatcattatcaatacaattttatggcactggataacacatgtgttatttcatttaatccttatgaccactctttaagttagcttttttttttttttttttttgagacagagttttgctcttgttgtccaggctggagtgcaatggcacaatctcagctcactgcaacctccacctccgaggttcaagcgatcctcctgcctcagcctcccaagtagctgggattacaggcatgtgccaccatgcctggctaatttttgtatttttagtagagatggggtttcaccatgttggccaggctggtctcgaactcctgacctcgtgatcctcccgcctcggcctcccaaagtgctgggattccagatgtgagccacctcgcccagccagctattcttaatacactccatagaagaggacatcaagactcagtatcttgcccaaaaatatttgagtagtttgtgagcaagttaaatttccgtgtaagctgtgtctgattctgaagtatgcttttaatcatattgtgattcttaatttcagagagttagcctctggttaaagatgacagattgaacttatatgtttacctgttctctctcctgaaatgtaaaataacagtaatgggatatttaaaaatgcttaatccacaggtggtggcaggatggtagaggtaaaataacaacaaaattttggaaactagaaagcagacggacaaatctacttaatgactaaataataccaaggaaactaagttctaagccaagaaacaacccaatttacattgcagaatttcccaaaggctcaggacattaccaaattagatatctctagaagcgaggataatattgggatgagaaaaggaaatattggtcaaaactctttagattcatgttaaacctttctttatgccacacatcttaagtacctgaacaccactctcccctggcctacagtataaaactggttagaaggtgaagaaatttaagggaaggcttacatatggaagagtaaaacattttacattcgttttgctttcagtgcccaatactggcagccaagtttatacccttcagaaagacaggtgagaaatccttctttggtagtatctaagcagtcctagaaggcttctccacaccagttccttctccacaaccagggccaactctccaggggaaaagactgccagaggcttatcccagtgaaggaagcacattatttctactctgagccaggctaactttccctagccttcccatttcctgactccaacagattcagagagggaggttcttcactgaaatggcccatcctaaagagaagcccagagttggcaagcctcatccactgagcttttcatcacctttagtttctgtttgtaagtgtaaaaatgccaatgatcaacagatatttgagataaaggtttgtgataaaaaacatcaacaaataagaaagaggcaaattgaagacttttcaggagaaaacgacaacaagccattgttgatatcttcagggatgtaaaagattataatggctccaaaacaaaaaagctgtatggcataaaaaaggaatattcacagattaagacctcttaaaaattttgtaaatcaatcaataaaaaattttaatagaaggtttagaatatagagttcaagaaatatctcagaaagaacagtaataatgatagtcgtagaaatagagaattgagaaaatgtagaggaggaaatatcaaataattaacttaagaaactttgccagaatttaaggataggaattttcagattttagaaagcaatttagttcctggtatcctggatgaaaataagtctacacaaggcctacattgtgtaattttagaagactagaagaggaataaaaacttctaaaaactgccaggaaagaaacagctttaataacaaaaaaaaatagttattatatattttcttagcatcataagaaagttaaaaaacaaaattcaaagttaaaaaaaagaaattctaagaaacaaatgatttccaaagaagactcctataaccaggcatggtgttaattaattgaaaggtaagagtaaagagtaattagatatacaaaacctctaaaaatgtaattcacaagaagccactggagtatgtgctctaccaaaacaagaacataaactaaaaaatatgaagacctaggattcagtaacagagaattcagcaatagagaggaacaaagggaatttctagtttaatgtgaagggaaatctgtgaaggaaatcttttaaaaggatcttaaagtattacattgaaaaatactagaccacacactgaaccaattaatcacaaaatctggggatgggccccaggcatcagttttttctaagctctttaggtggtatcaatgcatagataagtttgataaccattggtgtacaagcttgttgtacaaaatgtgctccctgaggcagtagcattggcatcactggggaacttgttagaaatgcagtatctcaggaatggcagggacatggaaatatgttttaaagacttgctacagcctgagtgtggactactgtgagagtgagaaaattctaggggctgcagtcttagaggaaagccccacactctcatgggctttacctccagtacctccactaaaatcttatggtgaagaaccaagaaagttgatgtccttgtgcccccagcagaggaaagggaagaataatcattgtaaaaacaccagtgccttctccacaaggagggccagctctccaggggaagactgtcagaggcttatcccagtggaggaagggtattatttctactctgagccaggctagctttccctagccttcccgttttctaaccccaacaggggtcagagattcaaggaaatagatttggaatgctgcagccagagaagacagtgggggacagaagcaaatatatgtatatatatttaggtcatatatatagatatagatctatctatatatatagatctatatctatgtctatatatatctagagaatcactagtgaaggtcacaacctcgagacagcccaccaaagaactgagattaaatcataagattataaaatacttcttctcccccacactgtaccaccgcgccacggggccctaatagaacaacggttacagctgaaaagatgcaagacacagactttctctgagtattaattagggacgtcgaaagttaagagtgaagataaaacaaggacaaaggaattaaagacctctggcactatgactactgcaaacattgaacaaaaacacaaatattaaaaacatctaactcctagccaaattaacataaatcctcatattaaggatcatttattcagtttctagtacctgatacatatttggctttcaaggaaaacttacaatgtatgcctaaaccaagagaaaagaaaagaggtaaagcaatcatcagaacaagcttcaggtgtaacacagatgctggaaatatcaaatggggcatttaaaataactgtgattcatgtgttcgttgctctaatggaaaacttagacaacatgaaaaacaggtaacataagcagagaagtgaaatctctaagaaaaaataaagaagaaatactagaaataaaaaagaatctaagagaagttgaagaatatctttgatgggctcatactagacttgacacagtggaggaaagaatcaatgagcaggaagataggacaacggaaacttccaaaactgaaatgcaaagagaatttaaaaagcaaaacagaacatccaaaaaattatatgacaatttttaaaggtgtaaaacatgtataattgtaataatagaaagggaagaaagagagaatggagcagaagatatcctgaaagtaataatgatcaggaactttacaaaattagtgacagacagcaaaccacagattgagggaatttagcaaacaccaaacaggataggtacaaataactaactaaataaataaactaagcatatcatattcaagctgcagaaaaccaaagataaagacaaaatctagaaagaagccagagagaaacactttatgtatagaggaacaaggataagaattacatgaaccttcccatctgaagccatgcaaagaagaagaaagtggagtgaagcatttagtgctgaaaaagagagaaaaacctcataaatctgaattatatacctagcaaaattattcttcaaacatgaaagagaattaaagcttttctcaaacaaacaaaaactgaatgaattcattttcagcagacataagaatgttacataagaaatgttaaaaaaaaattttaggcaggaggaaattgatatatgtcagaaacttggatctacattaaaaaagagcattagagaaggaaagacaatgaagggaaaatagaaccttttatttttcttatacttaattgacctaaaagataactattaaaaaataatagtaataatattttaggtgattatagtacatggataagtaaaatgacagcaatgtcacaagggatgagaaggaggaattgggaatactccgttataaatcacctgtactacatgtgaagtggtatagtgttatttgaaggtagacatcgattagtttaaaatatatactgtaaactctaagctaaacactaattttttaaagaaatatagttgataaactaaaagaggagataaaaaagaatcagataaaatgcttgtttaaaaccagaaaatgcagaaaaaatttgaggaagtgggaaacaaacagcaaatgtaacaaatggaatctaagttacaaattaggtagatattaacttgatatcaataatcattttgtgaatagtttacacagaccaattaaaagactgactgtgagggtggataaaaaaaagacaagacttatgtgtttaaatatagactcaggttaaaagttgaggattggagaaagatatgccatgctaaccctaatcaaaggaaaagtggagtagctatgttaatttcagaagaagccaacttcaggacaaggaataattatcaggggtcaagaaggatattacataaaaagcacctgctctgtgtctaacaccatgacaaatttttaaaatttacattatttaatttattcctcttgaaaatacaattggtgagtggtatttactctatgtttaaagatttaaaaattaataaaatgtgaataatgtcattatgaattagtctccttttgttaactaaattacattgcaacagcaaacaaaaatcagcatttgaaaggtgcaaacaggaactcaatacaccatttcattggttaattttatatttcattgattattgtcatataagcctattcaaaactgctgacactgttgctgctcaggtaggcaagagactcaggaaaaggcttatcagtagaaccttgtacaccagcctgttgtcatgtgtggtctgtggctatcttgtctcacaggctgctgatgccacacgatctcacatgtaatcctggtggcagtttctactgccacttactgtctcacagctttaccacatgggttgatgtgtttggtatgtgcttagcacattttatctgcctgccaagttgaggtttgctccacttaatgaagctcctgccttggtgtcctgctaccatttatcatttgcaaacacctcgtcctacagagcagagctagagggagcatggcttcatgttgccgatctggctggagtccaggttcttgtagccagtgatccgcaattccatttcataataagaaagagcttatagtattgctggtgaaactgcctgaagaaatccaggtgctggcaagtctagatcctattatataggatctagataatgtgctgacctgtatattagtgtttaagtccacccccctcattccaagttacatgaccttctgcacgaccaaccttatacattctgcatttacaaaatagacaatatattacttggtctgatgtgggaaatgacatgagttattatacttttacaataaagagatagatggtatcttcatttgtaaatgtacatggcgatttattaacttatgcaagaaaaaatattaatgctatgttataaatattattcttcaactaaggactttacatgtaaaatctagatcagatttaaaacaaaataaaacaaactagcaaatagtttaatatcaagatcaatgttacagtcctcacacttcctggcttttgaagtttattttatccatattagttttatttaacacactcttatgtagtactgattatgtgatttagcaagttcttcaggtgattcttatggaggtgaaaccactgaattacagggaaaagtaaagctcttgggtacctcctattatatgaaccttattctcttacttttcagttgactgtttctatgcaaataaagatcaatagtgtaattctaactctattacacatgagaaactttatattaagttacaagcttggaggccacgaactccttggaagagatagtagggaacaacccaaacacattttatctagtgactcctggtatttatggaaataggttttttgttgtttttttttttttttcaaatttaacatgtattttaagttcaggggtacatgtgcaggtttgttacacaggtaaacttgtgtcgtgggagttcattgtacaggttatttcatcactcaggtattaagcctagtccccattagttattttttcagatcctctccctctgcccaccctgtgccctccaatagaccccagtgtgtggggttcccctctctgtgtccatgtgttcccatcatttagcccacttataagtgagaacatgcagtatttggttttctgttcctgtgttagtttgctgaagacaatggcctctagctttatgcatgttcctgcaaaggacatgatgacatccttttttatgtctgcatagtattctaaggtgtatatgtaccatattttcttcatccagtctaccgcttatggacattaggttaattccatatctttgctgtcgtaaatagtgcttcaatgaacatacgtgtgcatgtctcttcataatagaatgatttgtattcctttgggtatgtaccccgtaatgggattattgatttgagagatatttctgtttttaggtctttgaggaatcaccacagtgtcttccacaatggttgaaccaatttacactcccaccaacaatgtataagtgttccttttcctctgcaacctcatcagcatctgttattttttgactttttaaggaaaggggttttaacctataactcacattgtatagacatactttcatttgcctttgtttctgtttaaaaactaaataatcatccgtgataatttcttgatatgccccaggaacaagtgaaccaccttactgtcaaaggggctgctctctaccagcatgactatactggagaaaactatcttttgatgttagagaacacgatgtcgatgaaagcactagcaatataatatccctcaaagcaaaatggttaagaacgtaagctctgtggagcaagtatatttacatagtgccatcacacaaagtattacttacagacaaacacaggtgaggaaataggaaagaaaactatttagatattagctaaggctgatagttaaggacagaatttgttacatgttaatttaggatacttaattttaaaagaataaatacatcactaatgctattttgcatgttttagcaccttttactttttctgaagtaaacacatggaaagagaaattaaagagccttagatgaaggttaaggcagtggctttgagcatattagttgggtggtaatttaaacaatacaaaattacaattgacggtgtggtgaaacattattgaagcaggatgttatgaggactatggttttaacaggttgcaggagaaagtgtcgatgcaaaaagggcagagatggtcctgatattaatgcctccagtaatgataaaaatatattgaatgaattttatgatacaaatacattcgcaaatatggaaaattgtttcttattcaaagaatgttatgaggcatgaagcctgctgaagaatatgagctaaaataagctaataaagagagagaatgtggcagtcgctgtgaatccaggcagtataattcttgtcaggtttttgcttttaattctgtaaatctcactcagcttctatgagcaagtcatggaactttactgccccactgaatcgctagattttggtcaaaactgaagattttttaacgccaaggctagtcgctctgcaaccaacagacagccttttctatcgagtgtactaggctgattcgatgaggtgtcagtcattccatctcttacttggctctcagttcatgcaccagattgacaaggagtctatgtcatttgcccttcttgtgatgtgggacatgatctctaccagaaactccttttcagaaaaggattctcagcagcaagtcacttctataacttaccctaatggtggtctttacatcatcgaagtgcatactaaaaataaagtttaatgctaacctttccacatcattcttctttaaggattgttcagaatgttcctccatgtgctacatcttatggaatatttactctaaggttacccccctgagtccatacctggttaacttaagaaaacaccttccttccaaataggtaaagtcagcttctacaatgagttaaatttatgatttagagaaatattatgttctgggtattcagaagttctaattgccttatgttttacttcttgactgtccaggtggcctttcacaaacccttcacactcttcaaagtggcttccttcttcttttcagggaagcttgaagaactaagaaaatgtactctagccctcttaatctctctccttccatacccacagtaaccagtgatgcttagctattttgtagtttgaattgtttcatttacataactcccagggaaagaacatgtggtgttttccacaggatctaccatagacatgagcatcaaaaattgctcattgaatataaaagcaattcgcttagcgagctctaatttcacttgaagttgtttcccatagcgtgagactcctcgggcatgagaaaacaagagagactcccttaggagtcagttatttagaaaggaggcattcagtcccatataccagttgcctcatacattttaccttcagacgcagaacataatatatatatataaatataaaatttttattttttaatcttttaaattttactttaagttccaggatgcatgtccagaacgtgcaggcttgttacataggtatacatgtgtcatggtggtttgctgcacctctcagtccatcatctaggttttaagcccggcatgcattaggtgtttgtcctaatgctctctctccccttgccccccatcctccgacaggccccagtgtgtgaagttcccctccctgtgtccatgtgttctaagtcctctatgggaagaactatccaagatgtctaggttaattcttgtatttccaaaatgttttcattggctctccatgatttttctttttcctttgaagatgaagcattcaaaggcaccaggtaagggagataaggctcagtaagttagtgaagttattggagctcgcttattgcaaaggacaaaatatatacgcctgaaaagtgaaaatagcaatagagtgatttccagggccaaagaagtcagggcttctggcagcgaggttgagatggacaatgtgtttggaatcgtttgtgtttatggtgcctttgtaggcctgtgactgcctgtgcttaggaagataagaaacgctgagaggtaacaattttctgcctaagaatgtgagaaatgacagcaaaataagtaggactttcgtgttgcagcagtggtagctggaaagcttactgaagttgagctactgataagcccagaatggaaataaggccaaccctctgatgctccaaccacctccttgaaaatgatctttgtgaggccaatattcaaaattctcacaattcaaagacattactgtgtcctaattatctttgactttccatagcatttggctccccactattgatggtagtctctaatttgacatacaggttgccccattcctctgttgtctttttttttcttttttggcctactcccctcttttcagagaaaagggactaggggctaaagaaggctaaatgctcaccacatgtcttctgattaactctgtgtgttacgtaaggggaatgacggagagagcagtctgttactaggtgaggtcaaggacatccttcagaagaaactgagcaagtgactgcttggcaactatgtacagaagggatgaagaatgaaagttaagtagacaatctaaatgaattctcgaaacttctgaaaggagctatctttgaccttgaaggggaatgtaggcaaaataaaggataaaataactgacactcattaaagaccaaatttgtgtagggcacctcattttatacattatacaagaaaaaaattgataaacaaaaaaattagacatttctgctcattagaggacactactgagaaaatgaataggcaatccacagagagaataaaaagaaacatttgcaaaacatatatttgagacctcattgtctcattttacttcagcaaattctggggtgttaggaattacagttttcctcttttagaaagtaagaggtttttaattttggagaatttttaataaaaattctcaaacattaataaagccaaaagaattttacagtaaatgttcatatatctatcacctagattctatcattaacattttattattcttgttttgctacaaatttattcatcaatttgttttattttttaatatgtagttcaaagtaaattgcagttaacagtacacttctccccacatacctcaacatgtacgtcattaactataattcaatattttttatgaatctttttcttttgatataaaatatacatatatatgtgtatgcaatgaaattcacaaatcttaagtttattcactgagtgttgaaaaatacaaacatacctgtgtaagccaagctgctatcaagatacagaccgttgtcatcaccatcatgctccattccagccattgccacctgtccccaaagttttaatcactgtgtggattttttttaaattgtttaatattgcctgtttagaagttcttataaatgaaattaaatagtgtgcacttcttcctgtaaggcttcttctactcagcacaattattttgagatctatctatgttgtcaatatgttagtattttttcttttcattgtttactagtattccactgtgttattataccacagtgtgcttattgattctattattaatagatatctaggctgaaagcagtttgagactattataaataaaactgctatgagtgttattgtacaaatatttttgtgaatacatatttttaaattccttatgtgaatacctaggaatggaattgctgtgagatatttctcaaaagtgacagtatcgttttgcatttttacaaaattagatgtgagttgcaattactccacatccttaccaaaatttggtgtggtcagtcttttaatatttgttattctggtggggtttggagtggtatctcattgtggttttacttttcatttctctaatgattactgattttgagcactttttcgtgtgtttattggccatttgtattaatatattggccatatattattttgcgaaaggtttgttcaaatattttgcccatttaaaaaattgaattattgggagtcctagatgggcggatcacttgaggtcaggagtttgagaccagcctgaccaacatggtgaaactctgtctctgctaaaaatacaaaaattacctgggtgtgttggcaggtgcctgtaattccagctatttgggaggctgaagcaggagaatcacttgaacctgggaggtagaggttgcagtgagctgagattgtgccactgcactccagtctgggtgacagagtgagagtctgcctccaaaaaaaaaacattagattattggacttttttattattaaagtttaaaattactcatatcctggatacctgttctttatcagatatatgtttcacagatatttctccctactctgtggcttgcctattcattttctcaatggtgtcttttgatgagaagaagttttaattttgatgtattattttttttcttttataattattcttttgtgtgatctgtttaagaaagctttgtctagctccaagccatacaggtatccccctgcatttttctgtaaaatatttagcgtttcatattttacagttgggtcaatctttaaattaatttttgtgtgtggcgtgaggtagatgttgagatttattttttaccatgtggatatctaatgattagactaccctttgttgaaaacactttcctttctctattgcattgctttgccttttctctgagacttttacataagttgtccaagatttcagttagtagatcaagggacatgagtccgaacttatgtttgattgataaggccatttgtgttctttcccgatttttacctaacgaaaaataatactatcaattaccaacacttactagtcactgtgataattgtcttagcatagactgttttatttcatttgtaaactctattaaataaacttttttaaaaataaacatttttatgatgtccacttaaagataaggaaactagggctcagagtggtagaatgtgtcaaagccacacaactcataagtgacaaaaccaaaacttgacctgaggcctgtctgaatccaaaaatggctctcccaaccagtgtgctatgatgccctgtattagttccttctcatgctgctatgaaggaatacctaagactgggtaatttataaagaaaagagatttaattgactcacagttctgcatagctggggaggcctcaggaaacttacaatcatggtggaaagcacctcgtcacaggatggcaggagagaaaaatgagtgccagcaggagaaatgccagatgtttataaaaccatcagatcttgtgagaactcactcaccatcatgagaacagtataagggaagcttttcccatgattcagttacctccacctgatccctcccacgacatgtggagattatgggaactacaattcaagatgagatttgagtggggacacagccaaaccatatcattcagcccctggccccttccagatctcatgtatgtcctcacattttaaaacacaatcatgcacttccaacagtccctcaaagtattaactcattccagcactaactcaaaagtccaagtccgaagtctcatctgagacaaggcaagtcttttcccccgatgagcctgcaacatcaaaatcaagttacttacttcctagatacaataggggtacaggcataggtaaatacatccattccaaatgggagcaattggctaaaacaaaggagctacaggccccatgcaagcccaaaatccaatagagcattcattaaaccttaaggttccagaatgatctcctttgactccatgtctcacatccaggtcatgctgatgcaagaggtgggctcccatggccttggccagctatgcccctgtggctttgcagggtacagcacccctcccagctgctttcacaggttggtgttgagtgtctgtggcttttccaggcacacagtgcaagctgttggtggatccaccattctggagtctggaggatggaggccctcttctcacagctgcagtaggcagtgtccccagtggggacgctgtgtggagtctttgacacccctatttcccttatgcactgccctggcagaggttctccatgaggtctctgcccctgcagcctgcagcacacttctacctagacatccaagtattttcatacatcctgtgaaatctaggcagaggttcccaaacctcaattcttcacttctgcacacctgcaaacttaacaccatgaggaagctgccgaggcttagggcttgcatcctctgaagccatggcctaggctgtatcttggtcccctttagctatggctgaagcagctgggatgcagggcatcaagtcctgagactacacacacctggggagccctgggcctggcccacaacaccattgtttcctccttggtctctgggcttgtgatgctaagggctgctgtgaaggtctctgacatgccccggagacattttaaccatggtcttggtgattaacatttggtccctcattacttacgcaaatttctccagccagcttgaatttctccccagaaaattggtttttcttttctatcacaagaccaggctgcaaaccttccaaagttttatgctctgcttcctcttgaatgctttaccagttagaaatttcttccaccaggtaccctaaatcatccctctccagttcaaagttcagcagatctctagggcaggggcaaaatgccaccagtctctttgctaaagcttagcaagaaccacctttattccagttctcagtaagttcctcacctccatccgagaccacctcagcctctcagcctggacttcattttccgtatcactatcagcattttggtcaaagccattcaacaagtctctaggaagttccaaactttcccatatcatcctgtcttcttctgaggcctctgatatggtttgactgtgtccccttccaaatctcatattgattcgtagttcccataatccctaaatgtcatgggagggacctggtgggaggtaattgagtgatgggggcagttacccccgtgctgctcttctcatgatagtgaattctcatgagatccaatgatcttataaggggtttcccccttttgcttggcacttcttcttcctgccatcatgtgaagaaggacgtgtttgcttctccttccacaatgattataagtttcctgaggcctccccagccaggcagaattgtgagtcaataaattacccattcttgggcagtcctttatagcagcatgagaatggactaatacaccatccaaactgttccaacctctgcctgttactcagttccaaagttgcttccacatttttaagtatccttacagcaatgccccactacccagtaacaattgactgtgttaatccgttttcatgctgctaataaagacataccgaagactaggtactttttaaagaaaagaggttttaattgactcacagttccacagggatggaaggaagaaataggcctcaggaaacttacaatcatggcagaagggaaagcaaacatgtccttcttcacatgacagcaggaaggagaagaatgagcgaagaggggaaaagcccctcataaaaccatcagatcttgcgagaactcacttactatcgtgagaacagcatggaaggactaccctcatgatctcatcacttcccaggaggcctctcctgcaatacatggggagtataattcagattacaatccaagatgagatttgggtggagatacagagccagactatattatgtcccttaatgaaaatcagtgtgccaatcatacattttaccttgtgggaagtaactgagacattagctaagattgcttctactacatagaaaataagcatatttgattctatgtactaccctgaggaaactggaatttcaaaccagtattcctctaaatggtagctcactttctttaatgacttatgtttttattctttactctatattttactgacagtatttgaataaatctgcttgcaaatgtaatataaaagtagcccagagtaagtatggaaagctgagcttataaaattcttcttccttatcagttgaaacaaaacagacatttcagtcctctgaagtaatttctataataagaattccaatctgagatcagattttcttagtttcaagaaatctgaggaaaagcattgtgatttaaaatcctactagggcaaaagctacatgtctatttgttcagaaaatatttggtcattatactcttagtgtttcaataatgacctaaagagaaaggtgctatctcaatatatgtgagatttattgcaagtatatttgtaaggagaattgtaccaactattttgcaagagcatgtaaaaaattgaagctccatactatatttccttaaatgtaattcagcagtaacttgaaattgctttcatatacaaaaaatgacaatagtatttcctcaaatggatttgaatacaatggttttgttctttaaataataatggaaaattgaaaattggcacaataagatattccttcctgctttattaagatcagtcatggctgcatttaatagaagcaggcaactttttttttttttactgtattattttgtttgttcacttttgcctcttgtagctctacattagtgcaaagaaaatggagctgtgaagagcttctgggatttgctcttgatcttgcaagcacaatcccctcccccagtgtgacatttgttgaactccaattactacttttatctgtgtttgaacacacattgctaggttcaacaaacacatgctttactgtgcttagaaggaataaagataacaatctcatgcaagtttgtgactgtttcctaaggattataccttggaagtatagaagaatagatttatagttctatctcataatggggcttcctaaaccatgcctatttataaaattaagaagaggatcaaatgaaatagctaagtaatgtatatttgtgaagtatgaaggggcagattctattactaaacaaggaattgctttcttattccttaattatatttagtgctatgtcattcatccatcaaattttacagaagtgaaaagtgaatgggtatgagagttgtatagtatagttaagaaaatttataaaaggtttggaagtattaaaaataaatctacattgaatgtaaatgaaattgttaaggaaagttatcaatgatgaaaaggtaagatttctaaagttttaagagagtttaaaatagatgttcattaggtcagagattgttacatttttctctgccttaagttgctatgtttattatatttaacttaagcacaaaacaatattgctgatatattaaatattagtatttatttgaaggttataattttaccataattcaccatgaatttatcataattcaccataattttatatactggttgcattaatagtatatttttataaagtgtacatttttctattttccacaagttagtgaaaagacaagattccactaacagaaatgtattgtacagtaaaccctaggattacatatctattctacctaagagatttcaattttagccaaggtccaatacacaattctatatgtaattgagatggtgactgagaattgggttaggaattaaagtttagtgacaaatttagaaacatccaaatccattactgagttgccaccatatgcacatactattgtatttgcttgagaaagttgaaaaaatattttgagacaatttctgtccttggagattttacagtctgataggagagataagataaatgaaaaaatcttaaacacacatgcacagatgcatataagcaggcacacacacatcctacatacagatacacatagtaatacgtgttaagtaaatataaaaaacagccagaaaagacatgatgtgttagaagtctagagactttgtatctattcgtattcctatcattattttatttgcttaaatattcttatcctgttttattctctctaaatatttgagatagtaaaaaaaaaaaagatataatttgcaagatttttaagacaaagttaatggatgaaatatgtgtgaagaaaaaattttgctaggaaaaagtaatttaaaaacaaagggacagtagagttcaaaatggatgttctgcgatcttaagcacttcatagatgtaggcaaaatcgttggatatgaaccttctagaaagcaattaaagggagatctgattaggtttgtcattttaaaagtctaaatagagcagttgcacaggagggacttatctgtcctccatactcagcaaggagagaattgttttctatctaacctcaaaaagagaacattgtgggatagagtcaacattctcaacacatcgttgctataaacataacagatttcatgggattattttgatgacatccttccagatgggctgctggtttaatgttaatttgatctggagatagtcgtgatgtgtaattttggaccagtcacttgccctttataagctttagtttagtttctaagtttagtttcctcatctgcacaatgagggaattagactgattggatgatttagagaagaaattatagtttaagtgcccgtgagaggtgaaatcattggtgtcaatgatggcaaagaaggattggagaaagaggtattgagtttggtcacagacaagttgacagttttgcaaaaactttaaggagacagttggaaacaaggccgcagataattactgaagctgaaaaaaaatgtaggtccgtgctacatatcaaagattagagatatgaaaaaaaaatttatcctgggggaaatctgtagataaaagacaaaagccaatccataaagaatgacagaagtaagagtcacgaaatgaaagaggagccaacaaggtgacagagaaatacagaaatcaagcatttaaaaaggatataatgataaatgataattgtatgaattatcatcaaagataatacttgaagataagatacaataataggtgtgataaaatacaattgatatattcaaattaaacacacaaagaaaattatattagtaactatagatgctaggtaccacagaatatttttttctaagacatttatggctctcaaaactatattatgggaacaaagtgctgtaaataaaaaataatcagagcataagctagagtatcacaaatacccaaagataaacaaaaatttctgcatctttggtaaagatgggttacattcagccaacagtccatggtgggttcaattaagtaaaaaaattaaaaattacacctacaagacaaagagacaagattaaagaagggaggaggagtaaagtatttttgaatgtcagaaaaagcttggacaaaggcttagacataggaaagtttgggattttcagaaaacagctagtaactatgttggtcacatagagtatgtgtaacgcagtagctattgatattttcgaaaaagttaagttgagactcaataattctagagtaagaaaagttatacttaatatgttggatgatgaaaaggtattcaagatttttgagccagtaagtggcatgatcagggcagtcccttagtaagatgcatgtgacagttatagataggacaaaggagaaaagggttgagcagggataagctgggatgggagttctcattacaccatggcaatagtgtaggtggcctgaactggagaagtcacagtagaaatgaaaagatccagagggctagcagacctgggcagaaactgaatgtcagtgtgtaactactggcaaataatagtggaccctaaggctaattccctatctccctgccatctttcttacttagtaaaaatggattatggtgttttgcttctacctatctcagtgatgctgtcagaattgattatgcatatttctccaaagtaatctaaagtgctttaattctttggaactggacactatgtaaatacgattattcattacgtgtaaaagaggaatacagaatgatggatgtgcctagctaacgtgagagaactgtttaagaatacagagagggaaataagctaagtaatcaatatcatgttttaatgtggagagctaaagacattgatagaaggatactgagtggaagggaaatagatgaggataatgcgtttgggagttaagactgataaaagagggctatgttacactaaataatttcaagagaaaaggggaatattttaggttcagtgttcaatattataaagtaataagaaaaaagtttaaaatgaaaattagaggccatttataacatttattaaaaagttataagaacagttaggtatgtagatgtacattctgaatttcacatcaaaagtgatcaacacatacacaaatgcattatagaataatattttatttcaaagacaagtcactggaattgtacagttcaagtgattaaagtcaggtgactagtattcaaaaggatgggcaccattgtaggctactatggcattgacattaaggtgtcaatttctctggagtacacagagatcactttaggatcatgtttttacttggtacctataacaatagccatgaaaagaaagaattatgacagtgaaatttggactttgaaacattttttttttctgttttcagtccaggattatggatcagattgacctagcatttaacatagattaaaagtctatggtaaactgttagaaaatagtgtatcactttcttgttttctcaagccactgaaaaaataataattaaaaaagaaaatagtacatcgcttagcataaactaagttatgtcacgttttgacaactaatgccgtggcctggtgcagagagtactctctgctttggattaagataagaaatgaattaaattggtcttttaggtcccttccctccacctttattgaaaccttaccacactagctgcttggtctccttcccatttagaatggctttaaagctttccctcctatcagctgatagttttaagattaaagtgaacatatgagtgttgaagaacattctaggattcaaagctataatggtgacatgaggactagaggtatttctctgagggcaagaagtatcacttgtgtctgtttgtctggccagttgagcacgatgattccagccacgagagaagagaacgctgggctgagaggttagctgttggaataaggtttggttaactttggaattatacaatcagcaaagggatgtcctcaccagtacttctaagagatcaaacaagaggcctccagctccctaaattctggttctactgtaccaactctgctttaatttgttttaggtaatgggattccaggtgctattacattaagaattctaatttaactcttaaaaagtgttttcttagataaagtaactgggactcagggagataaagtaacttagtgactcacctaagtttccccttgtctccaattccagggtgccacccaccgtattatgatgttgatttgtgaagagactctcaagtaggttcaatttcatagtcccagtttaagagagaggccaagtgaggatttggcataccacgtcggaaaggttgccaagtcctggatttcactgatgagacggttccattctcatctatgtggctggtcggctgccacctaaaccaaggagagctcccatttgctttgtgtgaactggctttgctgtagcagtgctaactagccatgaggtagatttcttacaatcagtttggcatggctctttgctcatagccttatgtatgacaatcaagtctacatggatgcctagaggattctttagggattggaggacataaatgggactgaaaagctcataaatgagggcatgtcacaaaaactgaaattagagagtaattatggtacttagggctatgggaagaactaatgggatcaaactaataaaatatttcttgagagcaagtgacattagcttgtgtgaggagtccaaaaagactgtggaattatgttctgtgccatcaaaatccttaccccatccacccagaagagaaaagtatatccctcacaggcagattggcctcatatgcctttgctctaattttccgtttgtctgaataaagatgtaacacaatacaattgaaaaaggatgcggattcagtgctggacagtaatagttctagccatgggttctctgtctttctagtaccaataaagaaccccctctcctctctgtgaaaaaaattagttattcatgtggcataatcggttttaacacttagttcaaggctcacaaaatccaagtgattcttcagtaaaatgttaatttcctgttttacttgcagcctcacacccatattgagatgtcactgggctttttttctccatgaaccattttactgaatgtgccaagtgagaaatgtaaaatgaggttgtcatttcaatctggggggaaaggcagggcatgtgttgtgtaggggaaaactcaatgcagcagtctgtaatgcatatgtaagacaaattcagatgatttggggcccttttgatagcatgttctactttttttataagaatattaattattatattttcccttgagacttcattgaagagttaacaagattattgattttttttcaaattaagcaaggaatgtacttgagaatgcataattcataataaataagcatcaaaacactttataaagtcaacaagcaaagttcattctgacctattcaatttttaacttgaataaatttcatatttcttaccataacattatacttcaatgcactgaatactgatatacaagtatatttaaatatggcaataaaaatcagctggaaccaatcagatttatgtgataggacccttgaggctaatattttactatatcatttatttaaactcttatcttactagtctatttaataggacaaagtgattaggtgcttctatttgagagtgtacagtatttgcgttctgtgtcactgacactaatggcagggatctgtgtgattttcggtactggaaattagacaacaaaattcactatcagtaaatttccaagaggattcacaatttggcttaatcagtggatattattattttacaaagccacctgctttgtgcaagtagcaacaatgttctttctatcaaaaatgctcctacaaaatagatgcggcagtaaatgttttacaactagctaattgctacctgttcctatgaaggccattatggaatgatgttatttgcactccattcttatcctcgtactatcccaaagcacatgtgtaggactttacttagagttatcatattgtcagagcaatattatcattttagggggatagtgttgtgttgaagaaagtacccccaaaatgaaataaatagattgggtgagtttcttgcctttaaaacttactatcaggtgtttcggggccaatctctaaatatccctgagccttagtgtgcttctcaacaaagtaatagtaaaatattttgctctactcaggtctcaggactgttatgataattaaaaatgacaataaaaagtattctgtaaactgtaggacaacagaaaaatggccataattatatttttaaaatgtatgcttctggtggtcttgtaaacacaattttattaactacaaatgtaccatttgaaatggactatctatacagttttgacatcatatttaattgattctgttttttcagtgggtttacccaagcttcagttagtttgaaactgttacaaataaacatttgtatacttttaaaattattgttttgatgtgctggtatttgggaaaagagcagtaagtaatgggtaaaacttaatgatcactgtcctctaggtgctagcattgaacagttgtgtccctttttggcttcaactcttcctttccctgctttctttcttactcgagccatcttgtgtctactctcttttcctattccctaatccttgcccttttccttcttttactgttcaattcatccatttcatttgctaccttttccttgggtgtctagttattaggaaaaaacattcacagcattacattacacatgattactttagaaatttgattttctttgcttatattgaatatattccctatattgaaaactctgaaattttcaatataaggatttctgaaattttcaatataaggaatttatttatgccaagcttcttgaatatcttttctattatcaaatacaaatctgagcaagttcctaaaacttaagtagtcttggaaaaaaaatcactggaacttttaaggacataacaacagtttgccagacttctattaaaaaagtagatttgctcaaaatatagcttctttgtgaactataggtatggcttcaaatgttttcactgactgcataatgagcaactagagagcaaggatttggtctaatttatggctgtatacctagtatctagcttggagctctgagtaactaaaacaaaatggtaaatggacttggtgtagtcccaattgctacatggagactcttgctatgcagcaaattacacacacatgcaagtaattttattcaagaattatttgacagtaaagacctaggcagttgtgagaaatagtggtatctaaaataaaatcaatcattaacaaagagtttacaattttgaaagaataattcaatgagttctataagaagaaattattatgttggcttacataacccttcattatctgatcctctctttattctctattttagtttctttccatccctcctccctaagctttaggggttctgaactggtgcttttcaaattgtgtggaagaatgatttgcttttgtttgtttgaatatttcatttctaatccactgtggacgtgtgcatggatcctgctgcatgcatatgactagtacactgctcatttcacatgacaatacaagaactggtccagactatattcaaggccatgatgatgagttcactgatactctaatgttgtaacagtgtccactttccataaaagtttctaagcacttattcgcaatgtccgatcttatttctgtgcatagtctgacagtgaattagtgaattagtggatcactctccaccaattagcacactcttaaattacttgcagtttgcaagccagttgatgccccctgccattttgcttttggtttctccttcctgtaatgaccctttcttctgctcccgactaatcttctactagtctgttgagacttagcactagagtcacctcctccagaaagccttccaagactgatacaaaactctattactatgcttatcctccacatatatcacagcacctattgcctggatctgaacatgtgtgctcaattttctgaatatcaactccttaaaggagcttgctttttttttttttttttttctgtccagtgcctaaaatgacctgtggtcatcatttacatttaatatctaattattgaataaattaatcatcaaatgaagcaaaagacatgtaaatgactctggacccacaaaatagggagatactgattctggttgagggaactgggaaagttgtcgctgaaaaaaaattttgaaccaacgttggaaagaagagaaagttggcaggcataggaaggaacaacatattttaggctgcagaaaaggcaaagaggccaaaagggcaccgaattgtgatctgatcaagcaatgatgacttgtcttatgtgactagaatgttgagtctctggcagataaggctgaagaaaaatctggagagggaggcatttagatttaacttgtgggatgtgtgaaatcattaaagattttaggcactctaggaaaattcattcctgtgttcagtccacagctcctaagcaacaattgaatgccatataccatgtttggccctgctactgaagcataatccccatcttcaaacagctagtggagtagacacacaagcaacatgaaaccattctcaagacttttggtgagaagtaaatgtgtaaaacacttaaaacaatgcttggcatattacaagcactcaataattgtcagcaataatcattctcatacctgacttattattctttaatcttacaagtttacaacattcttaatgtcaggtgtgcctatccaataaaagtggacattgattttttttttttgctacttttacaagtaggttatagcccattgtctctgtcctagtagaatctgaaaataaattgtgttatcgaataagagagcagattatatgctaagtattgtgctctgggctttacatgtgttacctctattatttaattctcatagctccatgagccaatactattattacttccctttaaagatgtataacctaaagcttagaggggttaagtaacttgtccaagggaatctgagcacaggtctatccccagaaagcaaattcttaactataacattctacagctatttattcagaaatacattttttatattttgccgtgatgtaatgagtatgttggtaattcctcgtgtctgcatttgtttcttactttattgttcctcttctttcagattatcaaagtgtgatgtaggctgattttttttaaaaaagcttctttttaaataatattttttctactgaaataagtaatttctttttcttttcattgaattgtatgtcatataaaatgattattctcatgtcattgtaacaaacagacctatttgttacttttttcgcctaactcagggacataatttccttaaaaaacgagtaagctttgaatctctcactggagcaggttttactttcagtgcaaacgagaatccaaagtttgtatcatggaagttctctaataccaggatacataatgggatttttatagtcactcctcaaagataaaggccatttatttttttattttcccataatgaaccatttaataaaacactaagtgtctgtatgccatttacaaatacgttcaagcactatatttcagacttaaggaagccattctcctttcaggcagttttaataaattgagaagccttgtcacttattacggtaaacatgaactcaatcaaattattaataaaagctttctaattcatctttggatgttttcattcccctaggaaatacagttttataatctaacttttaagccatatatatatattttttttcatttttctacattatgattaatcacttgctgattgacattttcagttgggtcttattttcttcctgcctaattacatccagtcattttgttatccttctgtaatttcatgacaactctactgaaagtattgtgactgtagattgatgttccacagcttcttatagtcttgtaatttagggcctattaatggcagactgaggggaaaaaaaaagaacttaattggttttaaattgcccttaaattgtaattagaggagaagagaagtaagtcataacttaagtattttttgtcacaacaaaatttagaggcatccatgtgacacggtactgtttttgatggggacggggaaaacttcttgataactagatgtgtgaatgctactgcaatgcttactgggaaaataaaccagcaccttatggagatgtgtatgagcctgaatgtggcacaagggcctgcagggaaggaatcccatagtagcagtatgaccttaggtctgggggtgactagacagaaaggtgaaagcataatttaatataaaaacaaaatcttccagcaagacatggggcatagaaatgagttgcttcctaacagaatttgagaaacagccctacataagataagtcttctaatcttccatgtgtatttttgttgccaccatgagtcgactttggctgaaagtacattgatcctgccatggttttggtgtggccgtggatggaagggcgatctggctgccacatctgtcacccattgattttccagttgattttgccatgacttggtaggtggggtctcctttctttctccatctgcatctctcccaaacctcaatcaaaaagaatgcccttataaggagcagaaatcatctttagtcatgttgttgaattctatgtgtataatttcaaaactagctctgcttgtagagagtagataattttatataatttgctaagttactctacctcttttacagtggagggaaaatagtcttagatgttgaagagaaacacttgtggagtcaaatacagaaggaagaatataagatttaagattggcataggttatgattttgagggaagagacagttgtagctaagatgatttatttgcattatcagtgaagtgactgttgaaatgcagtaacaattcagatggcaagtggtaacaaggcaggtaagagtatattcaccagtattttttgtgcttcttttgtcaagtgagtgatttcaaagcctttcatatcattattcatggatatgcagtttgtgcatcgggaattagccagagaggcagtttttattttcacagttgactttcagaattatgaaaacctaacttctttaactccatttgcttgtacattgttttgacacattctgtaatgaaattttatgacaaggtaaagcatttatactggagagtacctgattcagttaaattagataaaagcatctgaattggacacacttcccatccccttgcagatgaatctcacttttacagattgtagaaaagagcaagaggggtgccatgttacaacacagagagattttcatcttgcttctttcttaccctttcctagtgcctgtcaaattgcctgaaacacagtaggtagatactcgtatacatttgttgaaaagttcataagtaagtagatgaatattaattacaaactatgtaaagaatttgtatcataaatcaatttttcatatacattttgaaaattaataaaactattaataagtctcttattattttacctgacctacctctgcctgaacctgtatgggtagtttagtggtagacatgtaccttgtatagttatagtgaaaaaaaaattccttatagtaatccatgtcatttatctgagatttttttaagaggcatatttgtatgtaaaaatacataaagcattaaatttttcagtacttccttgtctatagataatttctgttgccaaaggttcagcatttccttgggcgggatcttgagaactcaaagcaaatgccagttcttttacactcaaccctgcaggcttgaggatgaaatatgaataatctgatctacaaatacattcacaaatgtgtataacagctgtatgtagacagaatatgaacagtttcccgttgctgtttaatacttttctgagctttcttcaagtgtttggtgctaactgggcacctcaattattctccatctgtgctcactaccaaagctgccagccatcatactgcttgggccccggagcctatggcagagagcctgacggggtaaatggtgcaatctagtacttcttcctgggctagcctagctagttaatctagtgaacagattactttgtcttcagcattgacttagactacgaaataaagctatgggttgtcacagcctcaaaggcaactttgaatggagaggatattatattagaattccgttcaacagtgtttttcattgcaaatgggatgaaatggtttaaaagtgaaactgctataaatgaaaggttttgggtggggcaacaaaggagttaagtaatcaaattagaggatgagatataaaatccatcagcctcaatttccaatttcactccctatcaaatagtatgctaagctaaaccagagagccttttgttctttaagcctatagacatttttcactgatatggagacttttcttggtaaaaatggacatccatgatttctcataatatttgaatcaagtaatatgtcttatgatgaccacaattaccatttatggagaatccattatgtggcaagctctgtgcaagaagccctatgatagctaattcttgtaataactccacaagttaaatgctattacaaattgacaggaaggaacctaggttcagagcagttaagtaatgctgaatttatacggctagcaagtttctgtgctagagatttgaacctggctgcatttggcagcataacagttattcttaatttatttcacactctgcatctaagagcccaaggctctcatgggtttggaaccaatttctgcagcttctggattcttatcttcactttttataaagctgcagatgaatttgtgagtgggaagagggacactcaaaaacgtcacttaacttttctaagggcattgaggacaatcatcatggcaccaccaatgtgatcctaaattcagagactttttacaaaaaatttgtatttctacatggtacttattttatggttatatttcaccatggtataaaatattaaagaatatatattttttaaaattgggggttcagctgatgaaatggtggagaaagcagtgaattggaatgttttctcttttcccactaagcctgaacagactgctccatctcatatgttaacagatcacacagcctcagccatggataacttggacttttcaagttgatgtgaagaatagggaaagaggaagaagaaggacaggaaaagagaaaatgggaagcaactcaggatctgatttaaaactgtgaaaagaagaaccagaacatatgcccccctttaccctccttgaacagtaggacttaaagcaagtggaacaaaacttttccctttctttgtctctccctaagcaaatattcattttcttgaaggagattgctgatcagaatcaagctctccctacctctctcttgccacatcccatcttgccctacaattcaacttgcttactcctacaccttcaagattcccccactttcagtcaatcaatcatgtgaagagccatgctgtaattttgtgcttttcacatcctcaacttatgttacaatgagatttcgaggtgctttttgctggctcaagctgataagagaaaatatgtaagagtgttggcttcttgagctaacatcagtgttgtgagttatataatgaaacctgtctggatcggaatcctaaagctattatctttctagaactgagataggacacttaaggagccatttagaatctcttagccacttataggttgggaaatcaggttcttttcctcttaaaaaaggtttgttgagggtagcttaccatattgtcagcattttgccttatcagaccttgggagatatactgaattctaaggtatgatttctccatacggttattttgcctattaaataaggtctcaatatctattctggtggtgtttgaaaagttttcacttgggatcttctgtgaccttggtgttgtgtgccatttgtgcatcattaaaaggtcgtaatgaagttctgctgcacacagattgtaaaaggtcaagcagaaagttgggagccaatgaggttgggaagaaaaattgtgcttgctgcagaagttgagggattcattatattgatgctatggggttttcagcagagtaataactgggttagcaatagaaagtaaatcttctcagccacttagtctgaatctgcttcttcttgatttgtggggatatatttttaacagagtacaaggaaagtcattacactcagaggaaagccagtagaattggtaaatgcactgtagatagaccagccaaaagaagagcagagctagagggataaagcatgtcagcttcctggttcccactctgagaggtattgtcaacccatataaaataattggctgagaagaactttgcataagtaattattttaattctttaaaggatctaaaggactgttttttaactttaatgtcctggaggtacaagaatagctaattaacttgcttaaaatagctatcaacagaattaattaaaatgatttaacataaaaataacatcaaaatagcagcaacttcaagtcaatttatttagaaaggatcagcaaggtaagctaataagggcttggctactctataaagtgcagaagctccagttactggatctccattgaatattccctggttgcagtttcttaaaatgggactctagaaattatgtgtaaaagtgcagcagttgattgcatgtctcacaagcttacatatggagtgagataatttcttctttaaacaagccccaaaccatctgttgacttaagtcaaccctctgaattttactttgaaataaatcggaagcctagttattccacaagactagtttaatgtgttttctaaattcatacatgtgaatgcttgggggggaagaaactgtaagaaagctttttctgtagaaggataaaagtcattaagatatggcttataaaattaagactattattaggaatttcaacttaattcaaatccactgatcttaactgagtgtttaaaaggttttaaaaaagaaaaagtgacttttaagaaagcttttgaagcttgggagtgagggacaatgggcggttactgacaatttatttaattattatgttgtattatcaagtattttggtattaaggcacataatctaaggtagaaggactacgtatagttctcttttccataggtggcaccctgttttatatagaaactgatttttttcttcatcaataccacatgttggctaaatggccaatgtatcaagtggagttaatcttttattgctgttcacatataataatctcaacatcttttaaatttttgcttttaaaaaattctgattaaatgccaactaagaagacagtaaattcaatggcttgaacgtattctctaaaaaaaaacactaattatatgaaccagaatgttacatgacagccctttagaatcagaatagtgtatgtcatatatatcattcactcatatagccttgttattcagaagatgaaactattgtttctatctaatttttttctctaaaatgaaaatgttgttgaaattgctatctttgtgatgaaagaaacaatatttattaatacatttttcttttatctctttagaaactattttttctattaaaatgtacatactcagaatactatcattattaatttaacagtgatttaaatataatagttatgtggaaaaatattacatttattattttcttccctcagtataacactgtattagatactgatcataacaaccagaacctttgtcatggcaatcttattcattcatttactcatccatcaaacagttccttagaaattgttccataccaggctttggaaagtttcctctgaaagaaaactctattatctagcaaagaaccagagatgtagaaaaacgattgcaatctaacatgataatgttggatgtaaaatatcattgcatacatagaaacaataatatggaatacagctgatctctcatgagaattaatggagtatggacaacaatggaatgacatctgaaaaatgttgaaagactgtgaaaactgaactcagaattttatttccaaggaaaataactctcaaaattaaggcttaaataaatacatttttagataaataacaactggcaaagttcatcactgcagacctgttttacaagaaaagctaaaagaagttcttgatgctatgggaaatgacatccgtagaaactctgatctgcagagaggaatgaagagcactggaaattatcaattttgagataaatagaagagataaacttcttttattttcttatttttttaggtacactaatgtctgtttaaaataataacaaaatattgtgagttttcccatatatagatgtaaaatatgacaacatttgcacaaaggatgagaaaaaataaaattatgtcatgaggttcttatattttatatacagtactaaaatttgttatcaactagcttagcaaaaatggtaatgtgtgtatttatgtgtgagagagagggaaacagagagacagagacagaaagagacagattaagagagaaaaaggatgttgtaaaattttaacagttggtaaatttaggacaaacatttgtaggcatgtattgcattagtcttttaaccttagtatggttttgaaatttttaatagtaaaagggttagaagtaaaaggaaaagcagatcctaaaggattaaataaataaataaataaaaacaagggggctgggtgtatcacctgaggtcaggagttgaagaccagcctggccaacatggtaaaaccccatctctactaaaaatacaaaaattagccaggcatggtgacaggagcctgtaatcccagctactcgggaggctgaggcagtagagccgtttgaacccgggaggcagaggttgcactgagccaagattgtgccattgctctccagcctgggcaacaagagtgaaactctgtctcaaacaacaacaacaacaaaaaacaatagcaacaataaaaaaaagaaaaaaacaagggaagataccaggaaaagcatatagaaagcttcatgaagacaacacttttttcccaacacctaatatagtgatggaatttagtgtaaaatattttttggtgaattattaattattaatgaacaggaacttgacaggtgaaagagtagaaaaaggaaaaggaaaataattcggaatattagcctatcatcataactacattaacatatagtatagtgatcaagagcaggaattctggagctagattaatagtttgggtttgaatcttgactccactacttactagctgtgtaatcttggacatataacttaacctctctatgccttagtttcaaatgaatttaattacaatgcttattaattacattaatattaattataatattaatgtatgatacatatattaataaggatatatgagaatatgtatatgtataataggatatatgtgtgaatatatatatgtatgtataaatttagggaaagcagttacagatattcattacattagtctttcaacttctcaatagttttgaaatttttaataataaaaaggttagaagtaaaagaaatagttcctgaagcactaattattagacaaatattcagagtaaaaaaagaaataagaatgtaaggttatatatatggatatacattatattaatacacatagtaagtactatatattaagtactatatattaagacacatagtaagtactatataaatgttagcttctattatattgtcttataaaacattaaaaaatatcttaaagaaaactgcatattcaattcaatgaggtgtcaagtattttataaataagtacagtatataatccttaaattaaaaagaaataaaattgtattttttgaaataagtagaagagatacactttttattttcttattttttgaaagactactatctgttttaaaataataatatgttatgggtttttccatatgtagatgtaaaatatgacagcatttgcacaaataatgagaaaataaatgaaattaagttgtgaggttcttatataagtgctaaaatgtattatcaaagagcttaacaaaaatgataatgtgtgtgtttctgtgagagagggaaacagagagacagagagaaagagacagattaagggagaaagaggatgtatgtataatttatatgtataaatttatcattcactctttgtcaattatttgatcatatcttttgaaatatattaagtaaatattctcaaaacacataaccaaaccttgacttctgaaagagaatttttcttggtgtggaagaataattcaagcgtgatttaaacattttaagacattgatttgaattcctcagtgtagtgtcatagcctgcttcgaaaatacgtctcattgattcctgcctcctgatattcttgttcttgtgtgtgtagatacttcttctggtatacaaagttcctacttacttgcttctagtgaatagaatatgttaaaagtgatgaaatgttacttctaagattacattattaaaaaaaaaaacaacatgacatttctgtttcccttgtactctctccctctctggctcttctcacctgctgtgaggaagacagccaccatgttgtaaccttccctatggagaggcctataaagcagaaaactaaaggcagtctctgaccaatagccggcaagaaacgagaccctcagctccacagcatgcaaggaactgaatcttgccaacaatcacatgagtgagccagaagatccagctaagcagcaccaaaatttgttatccatagaaactatgatgtaataaatataattgaagttttgggttaatttgttacacagcattactaatgcacttggatttgtaagactgctttttaaagcaaatttaaatagctagataacttaatgacatttctgagatcttaaaaaagggtcattacaacagacttgatgccaactttcccacaatacaaataatttgcaggctaattatttatgatctcactaatacaaattttcagaggaagtttattttccttattttcttctgtttccctcatttagaagagataatctaataactaaagtaacttgaaaattatggacaggttttttttttaagattctaaaattatctgcctcaaaggaaaaactgaaatcatatcaagataaggtatttatttcaaatatttttaagtaaactgtcaacctgttccaaggttaagtgtggttttacaaaagttgattctctttcctttcacttttgacccaaatatcagtttcatctaaccacagtttttaaatagattatggaacaagtctctctctctctctctctctctctctctctctctctctctctctctctgtgtgtgtgtgtgtgtgtgtgtgtgtatctcataattttggttggttttaggttatagatagttccactgtagtgaagtaaaccagtgtgttatcaacaaatatgtattacatgatctaaaggtaaaattatgtcttgttaacactctttttaaaatgctaaacttaaatgggtccttgctatgggcaaggtgtgatttggcaggaccttaaatctaaatgacttgttaatgttggaaattatgaccaatacacaaagggttggaacctacagtctgttcaaatgactgttctggtgtttgatataaaaggaatgtaatagtaagttcttcaaatattctcaatgaaactaaagtgtttttctcagactgtgatgctcttggtgataaaaaataacatcaacacaagaaaacttacttgacatacttaatttcaaatgcttttgcttctctgtatttctgaatttgttgtttaataaacctcataaatatttcactgtttcactgagagaagttaccttaaataactccttcagataaagaaaaaaattaaaaacaaagtcacaaaggaatatagttatatgatactatgttgaaaattgtcaggtttggcaaatcctgatcatttttcttccgttgctgagagactgaaataaatttgattaatctacctctctacctccaaagctccattaaattaatcagaatacaaatgggaatttagtaaaactagaatatatttgagggggtatatttttgctgattataaaagcagtctgaactgtaataacttttatttctaccaactatttagaaatagttgatcaataattgcaaattcaatacccagaattgatttccttccttgttaaattagagaaggtatttacagtggcatttgtttacaaaatgcagcttaaacatctgcttccaaagtcggtgttttctttcttctaccgttactgagtcagatgaagtcttaactgctgtcaacgtaggcagatctgagtacatttctatgaaaatacttgtcctcaggtctcctctactctgatgggcacaggatgttccactggaggaatttcatcggacaaagttttcacaaatctgtgcagatcagttctatttagtactttaagtcccctgttataccctgtaccagggccccctgatgactaaacttagatatcctttaaaaatggaatgatcagattcaactatttgaagaaaatactttggggcacctggggaaaattcaaaaggacgtaaatattaaagaaagtaaaatgtggaatgttcaagtacagagaattgtcttgagaatcaggacacagaagttttctagtatctgttctacgaatagcataccctagttctttaaagtaatataggatctcctctcaacaggctggcctgaggcaaactgggaagtaggtgaggctggagtgtttgtttcccacttgtatcattccttctagcaataaatatgcattagcattttaagtgggtgtccttgctttgactactggaaattggcattttaggcactgtgaagatagctaagagaaagtgtttctgagtagcagtagccttttagagctccaagatcagcatacagctggcagcccgctctgcctaggtactctggggctctaatatcttgaggacacattaggtagcacagcaaaaatgttgtatagaatacataggtatccataggaaagcttcaggtctgtcccactcccttccagcctgcaaccgtgagcccagtatgctagatattctgacctctatgcatctcctttctaaatcaatagtagagccccagaatgcttaggcagagggggcagccagccataggctgaagttgcagctttcaaaggctactgctactcagaaacactttctcttagctatcttcacagcgcctaaaatgccaatttccagtagttaaggcaaggacacccactttctaaaccgcgcatgtacttgacctgaacctaagtctatcttatactcagaattagctaaatattatttgcttaacagaaatatttgccttagactgactatttgcaggctttcaaaatttgttttaaatatggatttagagaatgttgatgacctcaaaaagaagttatatttgatataaaaatgattagagtcaccatttcgctttaatcaatctcaataatcttctgcttcattttttaaacttttaatgagatttatctaagataataggtgaggtcaaatagattttttatttttaatataaaaatgtgaacagaaagcaatttattgaatagcaagcgtattctacattaatgtgtgtgccgatgctgtggggtaattctagagatttatttaacacctgtaacatgccacgtgagagaaatgagttggtgggagaaaagagttattgttaaacatagtagtatttaattctgtgccaatctgtgtggtggacttaaggaggataacagagtttcaaaggcaggggtcatattagaagacaggaatgttgcacagtctttggagagatataaagaatggggtttaatgtttcttgaagatccaggaggagccccatggtttagaagccagaatagacatgacttttcataaatcgtagattaagtaatactttatctatagtagaacctcatggggaagtgaggtaaagtgcataagaggaatttaactgccttggatatgaggctaaataataaaaagtttttcctgtagtttgtgaatctgggtgtggtattaccaaagtagtgttttggaactataactctgatagctgtgcccaggcctcatgagacatgagagaggaggccagatgaaggagaccaattagaaggatattgcagtgacgggaaagatgatcatagtgggaatgataaggaaaggaatgtcctagggacaattttcaaaagtaattaatgagacttcctatttatataaacctatgttatcaaaacatatatttttcaaagcaaatgaacactttgaggctggatgaaggaaaaacagcacacttggttgtagacagctgggcagggaagtgtgaaactgcccacagagggtacagtataaggggttcattgattgttcagctgtttgggcaacttctgccctgaatgtaaaaagaagatgaggaaatcatctcagggtgtcagataagtaccaggaaaataattcagtcttcaattttgatattatttctggaaaatcagtaaagtgggtattagcataggctcggagtcagaaagaccaggttttgagttctatttagctgtaaacctgactacttgtgtgaactgggttgagtgacttaagcatcactaaatctcagtaaccacatctgtaaaatagaaacagtaaatgacctttatagtttgattgtaaggattaaatgagatagctaatgtacaatactgaggagagagtttgacatgtagtaattagccagtacataaatattagctgtcgctgttcttatggtgacgatgttataaaatggccaaaagaacataggatgatggctttggaaggagttagaagcaacattgcaagtctgatatttttctgcagctctggagaaaactaaggctatgaaaggctaaatttaagtgaaaccagacagaagattcctacctcacatttttctattaaaatgagaataaaagcctgaaactatgccttctacttggttattatttgcaagatagttcataacatatacctcactatctctgactttttgtgttttttttttttgaaatggagtctcgctctgtcacccagcctgtagtgcagtagtgcaatctcagctcactgcaacctctgcttcctgggttcaagtgattctcctgcctcagcctcttgagtagctgggattacaggtgccagccaccgcgcctgactaatttttgtatttttagtagtgatggggtttcaccatattggccaggctggtcttgaactcctgaccttgtgatctgcccacctcagcaatccaaagtgttgggattacaggtgtgagccaccgcgcccggccttatctctgacatttttaaatgaaaagttaacatattaaatattagaacattataaaactatttttatgagaatgtcagggttggctaaatatataaactgataaattactatgaagttggtatactcattgatagtaatgggcactgggtgcagtggctcacgcctataattctaacactttgggaggccaaggtaggaggattgcttgaatgcaggacttcaagatcagcctgggcaacatgatgagacccccatctctatgaaaaatttgaaaattagccaggtgtggtagatgcacatgtggttgtagctactccagaggctgatgtggaaggatcacttgagcccaggaggtcaaggctgcaatgagtcatgatcacgccactgtactccagcctgggcgagggaataagaccttgtctcaaaataaataaataaataagtagtaatgggcaagagtaagatacaaaatttttaaacattgaaaatttacgtaggaaaactccgaaattttttggtgaccacagggaagaaaaacagggaagtgaggcagcttttagttttttgacactttagcatttattcagaattttatttttaagatggcagcatttaagccaggaagacagagaaatgttggtagaatactgaaggacatagctagttaggaaaatagaatcaattaggaaaaaggaagtgaatgcttagttttcttgtatgaaaccagaggcaggagtaggctatcccatctaaaaaagatgtcaggtggatcaggtttgatgtcttatgcctgtaatcctagcactttgggagaccgaggtgggtggatcacttgagtccagctgttcaacaccagcctgaggaacatggcaaaaccctgtctctacaaaaacaaaacaaaaccaaaacacacatgaaaaaacaattagctgggcgtggtggtatgggccagtaggcccaaccacttgggagactgaggtgtgaggatcacttgagcctgggaggagaagattgcagtgagccaagattgtaccactgcactccagcctggatgacacagcgagaccctttgcgagaccctgtcccaaaaaaaaaaaaaaaaaaatcaagtgtgcatttgtttggaaatatgaatctgacaagtgaataagaaatattctcagttcattccgttatttattatgtacatgttttctgaccgaaaccgtattctgtgagaaactaagtatttccaagaatatagagacaatggtttgctctcaagaagcttatgtccaagtaagatctagtcggaagatctggaaacccttctgaagaagttagcattgagaatgtctttaaaaaagatttcagagggcagagattagaaggcgcctcatgtggaaaggaccagaatgaattaaaaggtggaaaagatgcatagttgataacagagaagtaaaagtaattatgttacctggttgcagaaaagggaaaataaaggggagaatctttgaaaagtaagtctaagtctactttcacgttattgtatttatcctcgcagttactctgagtggtaattgcatgctcctttcattctacaaatgaaccagagaattcatgggtttgcctaaaatcacttaacaagaaagtatggtacaagaactccccatcctaaggagagactatgtccttggggaaggaagcagaggataagattttgaccttgggtgagttaaaagatggcattgtaagatagggactagagaaagccaacagagaactaactttggcatgaggatgaacagtgtgtgctgtaatggttatttgacaggtgccagtaagagaacaaaaataagattggaaaatatagactcaggagttttatgtgaataaaaccatgaaagtgtggggcacatcaaggatactgaaggcaaaatagaggatttgggtatagtagtgaggtctgaattaaaattgagcaacgggaatgtgagggcagccacgtctgtaaagctgtctaactgcttcccacaaagcttgcagtccagagcaggaacagaccaagcagacacagtgagtgacagagagaagggtattggtgtttgccactttagcataaggtaagatgtcaaagattcgttttggagcccccctagaaggaactgaccatggagttcaaaatgagttcatagcagagtagcaatgaggaagttaaagagaatggctgagtgaatcactaccagtattaatatgtccatacctatgaagtagatttgaaacataaatgactcaacttgaagacagtaagatatattgccactcccaatgtaaatagtatcatattttctgattaataaattaaatgactgagtaaaacatgccctcttgagtggaattttctggagtgaaattccatataaatatcaaatggcttcattacctaaataactccttaggctatgtttgtatgatattgatataaatatatataacaactatctaatcatatttttaagagaataatgaatcaataaaaataaaattttagatacagtgagttcaagaaaatcataggtttttttttcaagtgaagaaacagaatgaagtcatgctagggatacagaagccattcttttagaacattattccattccatcgcaaagtttgtgtacaacttctacaagttttagtttatatttaattaagattagctaagaggttatgctgcatgtatttcaataacttttgaacaataaaatttcagaattttggcgggggggcactttagcatatgtaaatagtttcagtatgaacattgagcagcacatcttttgaacataagagctaatgaggtttaactaaaatcatttcttccactggtagaaaattccaaatcttggcgtcactcttttggatgaagacactggttctctgagttcttttccttctaaaagtctatatgtagcagtgaagcctgaaagatcattttcaatgttttggaaattctaatgaaactcttaatttacttcttcccatttggttgaaagtatcacagttctaaattcgtgctaatcagaagctcagattaattgccggtgatatcaccaaaacttctggaatatgatgatagagcagacacacttacctgaatcatatgtctgattatcacaatacccatatccatcacttattttcttacaaatacaaaatgacagtcaaaatctttcaaaacataagatccacagaggaataatagagtggtccttttagttaaataaatgataaatactatatttaaggtactaggaatatcttgacttaaatgtaaatgtttcctggaatgaggtaataagcaaattgttagctttcatctaatataaatgtggagaatggtttgtcagatacactagcagaaagtagtctgttacagtatgcaggaagggtgtcagtgcactgaaaagcttgggaatagaattcttttgggaatgtttgtaacataagcttgtttggaatccagtgtagagggagcatctcaaaataaaaggcttgatttcaaatggagaattgaggatgtaaataactctcacgtgtttctgtctaagactgactctatataaatacctaggaaaattaagagaatcaaacagactttataaatcacaattattgcccatttcctattggcaaagatgataatgtgctaatatttatggttaagcttctgtggttggggtgttgtttgtgattataatttcacactaatttaaatgatgtttactttagtagaagcataaatatacaaaaggaattatttaattccaaactgttctttatagtaatgaccaactacatgatgacaagggtgagtttaaattctgggtgattacttattttcttgttgcaaacatattgaaaatctggaataaaatgcaagtcataatatttacgatcagacacggatgttactttggcaaattacacagggtttacttttctaaaggatagaaagggaagccagtacaatcaaatttgaaggcagagaattcagcaacattattttaccacaaacattgatataagtttctgagcttcccagtgccaactcactagtggaaacgtagttgtggatgattcttagcgtgtaaggggcacatcagaccttctgaaagttcaattactctcttcagcctagctttaaaaagacaaaagttaagcagtccgttacacagtcttgcccagatacatgctggccacaactaccactgagccgtgggcttcttagtcttagggttctaccgtgcacaatgtgattgctagtatataacagacacacttaatttggaataaacttctaatccaccactcttggtcttcccaagattgtctcacttagacccaatacattcctgattctagtgctgtggcatcagaacaagccaaacatctcttggagtggctaacagacccttggatgagctatagatgttatttggcaggagattacaaaatctaccataaatctgcatcctgaattctggtggcatttaaaatatgttcttacaatggtcgaacttaatttttaactctactaaaaataaatacaaacaatctcattatatttctaaagaaatatgtttccacatcataagaactggggaaacttaggatacaatcaataattctttattttaagaaagcatactgtcaagataagttattacatgaagataatgattttaaaccacataatattggttgatttggatccttaatcaataaaaattagcaaatctatttaaatgataatcagagctcctagattagaaataattttgatgaagcggtcctttaaagtaaatgccagacatgattgaaaatgtcacaaaaggaatcggaatttcctcctgatgcccaacctgacagtacgacttgcccaggaattacacattcttattgagaggagagtggagccagataggcacagacatttctgcaaatttatatgactcttttcagtttttaacagtaagactggtaagcatttctatattaaaaaatgtcttaaggaaaaataaaattttattccagatacttatgtttcatcattagagctaaaaagaaaaatgaaaaggacataaaaataatgcataagtggattattgattcttgagcatgccagtatttagatataaatctcagtggaactgaagataagctattaatatttaaatttcattgctttaattaattttatcagtatcaaatcatgcatggaaatagctaatttgacactaaaagtatacactttacattgctatatgaagaatcactgtgggtgtaacaacatctgactaagtaattaaactaggcgacatcactttattttacatatgtctgcctacactatatcattcaattagctcataattgtaaaaccaattaaattctgatttttattaattatttgtcaaatatatgtgatattctgtgtccaaaatttgaccagtggttttaaagcaagatgttttgtcattttaaaaataatttattttcaaataaattttgttttatttagaagtgatacaggcaataacataattctaagtttttgaaatatatttaacatttctttacatatatgtatatatgaaaagaaatgctatgaaatgtcatatgttttatatatatttatttatttaacaaagtctgtaagaattagactcagtttcctttattggtttagccgtttgaagagcatagggaaataaggccttacccttctttgcatcactccattcaaacctcagtgccatttcctgaacactcacatttggtctgaatctgctctggattctggggactcaggatgcgtctgaagaggcccagacagcgttcctctgttctcaaccaaaggtttcatctaaactggaaatgtttttctgtattctctttgcctaataaattcctatacatctttcacaatccaattaaattgtcatattttctatgaaacctttcctgaagctgctagagagtgctaatagttcctttctcctctgggaccatagagagagagagagagagagagagagagagagagagagagagagagtgtgtgtgtgtgtgtgtgtgtgtgtgtgtgtgtgtgtttatcctcacatgtgtgtatgtacatatgtgtgtttctaaaaccatcaacacttgtcaaggattgtatacaggaaatggctaatgaattctatctatgtggctgttacttttaaagggttaaagagtatcaccacttggttaaaattgtttgtggcccttggaaatcactaacaatggtacctaaataattcaaatttctcctatccaaagcagctccaagtatgttcagcttgtgaacaattaacatacagaattctctacagctattaataaatgctgatttgtttaaataactggacatttaaaactgattctcaatagaaaatttgccttatgtatcttacatgcatattttcctactaaatcaatacactgatggacacatcgagtgacaaattacagataaaaatatatttctttccaggaaaaaaaaaaacctattcccacttttaaaatgagattatgtagaatacattgtgggaggaaatgaagcattatagtacttagaaagtaatgctcccttaagatccaaatgcatcaacctagataccctgactaattttacaggagtttaatgcactactagaacattgaaatctgtgaaacagctccactaacttgatttttaagtgaaacttctgttgtttaaaggaagcagtttacttttaaagttgttaaaatagagaaattaattgtataaatagtagcaaatgatgatcagaaaatatttggacaacatgaggaaatatatatatttagacttttagcttctttctttctttcttttctttttatttatttatttattttttttgagatagtctctctctgtcccaggctggagtgtagtggcatgatctcgactcactgcagcctccgcctcccgggttcaagcatttctcctgcctcagcctcctgagtagctgagactacaggcatgtgccaccacgcccagccaatttttgtatttttagtagagacggggtttcaccatgttggtcaggctggtctcgaactcctgacctcatgatctgctggcctcagcctcccaaagtgctaggattacaggcctgagccactgtacctggcctatcttctgtctttttaataatttcagccaaggaaggcacatttgatctttataggaaatgaaaaccagaaaatttcacagatgtgcagttactctctaatgagttaaaatactgtttcctgggaggtgggggaacaaaatggaggaacaaaaccaaacagtgaaatatgtatctatatatgccacatagtcttttgtctacagaagaaaaaaatctcaatattgctaaaacttaagtagaatatttcaaaaaccatactatatgatgtctctattatatttttagaaaaaaaacactagtgaggttttcaaggagaggaacaggtaagatagattattttgctaattaatgtatagcatgtaattctggaaaaggatgactagtatgtgtgtcagattcatccttttggagagatgtttgaaaacatcccatttcattatgtcaatgtagttccctgaatccacacagcttgtgcagtgtggaaacacagaagaactcagtaacatttattagaagtattaatagtgatcaactgtccattggaagggttctaggcagaaatttagactagattgtttctgaagtgtcttgcaactctgaaattatatgttgtcttaattttgttttcctatttatgtgtgtataggattagaatatttcttacacaaaagtatatagacattttaaaaaaaagaagtaatgacctaatggaagggttttactctttggggtcacaaagaccaaaatgtaaatcctaaatcattatgatgctacttcctacctatgtagcattaggattatttatttagtttttgagacgcaggttctttcttcatagggtgatcttaaggttggaaattactttctctgttttacgccatagtctctgaaaaagaaaaggactgacaaccacagtggtttactgctgtttcaacttagaagaaacattggatttgttaattttagagaaactttatttcagtcatattttgcaacttactactctgggaatatcttgcatttaccctctcctttccaaatcaacaaatctaaagaatgattccttaatactagctgcatttctataaatgaagattatatatcctttattttttagtgacacaagtaccgtaatacaacggtgtgtgtgtgtgtgtgtatgtaaatgtggatatatttttccctttagtctcagattgcaacgttagtgcatttggctaaagactgtatatactctcaaacagacaacctgcagaatgggaaattatttttgtaaattatgcatttgataaaggtctactatccagcatctacaagacactgaaaaaaatttacaagaaaaaaaaaactttcccattaaaaagtgggcaaaggacatgaacagaaaattttcaaaaggagatatacatgcggccaacactcatatgaaaaaaagctcagcattactgatctttagagaaatgccagtcaaaatcaaaatgagatacgatctcacaccagtcagaatggttaaagaaatttaaaagtcaaaaacaacagatgctggagaggtttcagagaaaaaggaatccttatacactgttggtggaagtgtaaattggttcaaccattgtgaaagacattgtggtgattcctcaaagacgtaaaaacagaaacaccatttgacccagcaatcccgttactgggtgtatatccaaaggaataaaaatcattgtattataaagacatgcatatgttcattgcggcaatattcacaaaagcaaagacatgaaatcagcctaaatgcccatcaatggtagtctggattttaaaaaatgtgggacatgtacaccatggaacagtatgtagctataaaaaagaatgagattatgtcctttgcaggaacatggatagagctggaggccatcatctttagcaaactaaaacaggaacagaaaaccaaatagtgcatgttctcacttataagtggcagctaaatgatgaaaacacatggactcatagaggggacctacacacactggggcctattgaagggtggaggatggaaggagggaaaggatcaggaaaaataactaatgggtactaggcttaatatctgggtggtggaataatctgtaccacaaacccccatgacacaagtttatctatgtaacaaacctgcacacgtacccctgaacttagagttaaataaaaaatattaaaagataaacaatggaaaaaaaactgtacatactctccacatattacatttgattcttttggccctttgctgtaataatttctgtccaatcaaacatttcaccagtgcctacatccaaaatatatacccaatgcgatggaaatgctcaatcataacatagaataaattaaccctttcctatagttctgttaccggcagcaaatccgtacgggtctgcaacaaccccagttcttgcctcctcagaagaaagaatttgaccaaggaggcatagggcagaaggagagactgagacaaattttacaggagtgaaagtttattaaaacattttagagcaggaatgaaaggaagtaaagtacatttggaagaaggcctagcaggcgacttaagagatcaagtgcgtcatttgaccttttgacttggggctttgtatgttggcatacttttggggtcttgcattacttctcacctgattcttcccttgggatgggctggcacatgtgcagtgggctgtctgcaagttcagtggccagtgtgtttaatggagtcgtaggtatgctcacttgaggcattcttcccttaccagtcgttccgagaagaagatctaggttagactccaccattttgcctcttagtgtgcatgcttaaacccacttgcccagctcctgagatcttatcaggaggctgctgatcatcagtttcaggtttttttttttggttgtttatttgttttgttttgctttgcttttgtttttttctctattgggagactgcctttccctggtgctggctgagaccaattattattttagagagacagttaacaactgcctaaccatcatttgaatttgatggtcgcctgacattcctggtgtgtgtgtgtgtgtgtgtgtgtgtgtgtgtgtggtgataggggaagcgctctcctgccctgctcatacctgactagctacctactgtaatagttctggtaaaaattaaacgtgagaaatctagttattgtgttgggtgggctgctgaacttaaagatcatgttcatcagtggataagttgcatccttcatccagtttacaagtcacggaatacacttacccatgacttataacttagacaagaaaaagtctgaattgctccatgttggtgtgcattggagggagagaaagacacatattatatttatttatgacttggtgaaatggggatacttaaattatagaagcttcctttcttagtccatttaggctgctataacaaaatactataaactgagtggcttataaacaacagaaatttatttctgacagttccagaagctgagaagttcaagatcaaggcacccgaaaatatggtgtctgctgaggcccacttcctgttacatataaggtgtcttctcatggagtactagcatggcagaagagggcaagacagctctatggggactttgttacaaggacactaatcccatcaatgagggttcccccaacctgatctaatgccccccttacatgtcccacttcctaataccatcaaattagtgattaggttgtttttttttttttttttttgagacagagtttcgctcttgttgcccaatggcatgatcttggctcaccgggttcaagcgattctcctgcctcagcctcccgagtagctgggattacagacatgtgccaccacgtccagctaattttgtatttttagtagagatggggtttctccatgttgatgaggctggtctcgaactcccgatctcaggtgatctgctcaccttagcctcccaaagtgctgggattacaggcatgagccaccatgcccggcctaggttttcaacatatgaatttgagggaaacacaaacattcagacattaccatccaccttgaattatttaatcgaatttggggacattcctactatccagtttatccatatgagagagtagttgatgattccaatgtgagccatttaggctgtaagattgatactgaaaaatgtacaatggctgcagtgtaattattactttcctagtgatgtcattaaaatgaagatctaagaaactgatttcattattcaaagtgggcttttgtaactgctcctgtatttaaagagaaaatatcaaacaactttaatagagccttccatccgaggattctctgttgaggcaaaccacacatttatataagatatatacatatattcccaatactttcttgacatgactacccagcactcacttttgatatgcccatcctaatgttcttttatttaaaatcctacttagatcattgggctagtgaaaagtcaattaaaaaaacaaataataatttaaatagggagggtagatatattactgggcttattaacactagctttagcaatcatttttctatgacttttcatttaaaatgagacacttttaaatgcaagcaattggcagcatgttattcagccattaaaaataatggtaaaaaagactacataatagagtttaagatataatagtaaatagaatatatacaatagtatatactgtatatacaatagtaaaagaatatatacaatatctactaagattggagctttgttttaaaaagcaatacatttttaataagaaaatatataaacatattaatagtatttatttttacgtgtgtgacagaatttctgttcatttttttctttttttttgaaacagaggttcattcttgttgcccagggtggagtgcaatggtgcagtctcggctcaccacaacctccgcctcccaggttcaagcaattctcctgcctcagtctcccaagtagctgggattacaggcatgcaccaccacgcccggctaatttttttgtgtgtatttttagtagagacagggtttcaccatgttggccaggctggtcttgaactcctgacctcaggtgatccgcccatttcggcctcccgaagggctgggatcacaggcatgagccaccatgcctggccctgtttatttttttctactttattctctatcattttatttaataaacatagattatgttcttaaataacatattagatctaataaatgaaataaatatcagacatataacatatatgttagaaaatgacatgtatagtagatgaacatatgttaatataaagctatacagtgtagggaaataatcctgtagattctggactctgacagaacttagatggtgattccccttagcaagttagctcaactctgtgtagctccattcattcatgtataaaatgggtatatacaaataatcttaatttatgaattaagataaatatattgttaggaacagatgtatttatatatataatgaaactaaaatagtgtctcgcacatagtaggtagtaaatatgtattaactattatgatgaaatttatactataatgaaaacactttaaaattgcagacaacctaatattcagtgttcttcgaaaacacatagtgaattcctggaatttaatttaaaatacataataacatctcatatattgaggttacttgcatgacatctttaactatttggaaaaaagtaaacaatatagattttaagtattggaatacttttaaaaaagaaatgccggaaagttcataggctgatgctcatgtaactcattcttcacatagtctcaagctctcactcagagaatttcttcttattttgcatccaatgctaatacccggctaatatagaaatttttttcccttataaccacagcaaacaaggaacaggtaaaaaaaaaatggtggccattggaaacagtctctctgacaagagtgaaaaaaaagagctgatagccacatggtggaaacagagacaggactgctgcacattatgaagaaacaaaaccacgaccacaacaaaaccaagcactgttcattctgtagagggataaacagcctctagatggaaaatatcattttgtattttgctgtagagtgaatacaaaaaggtgatgcttctgctaaattattatgattgttatggttagaactcactgtttcggaaagcaggaatattttttcacacatttttaaagaatttttttaactttagtacttttgtgtgggatgggctatggaaagaaataattgcattaaataacttattccttaacaatttcagataattgagtaacaatacagaaattctaaatcacaattttttaaaaaaagagttttcctcctttacagttcagaatatttaaaaaataatctacaggcacttacattacaacaaagtcaatcaatttaactaacaatagttattgaagaagaaaattcattagtgaataggttgcagcaaaaattaacgtatcttcacatagaaattttctccagattttacatttttaaaaaaataagactttctgctctctaaaaagacagtgcaaagtgaaaaatgaggaagaaaaatcaacagaaattgaacatgcaaattatattcatttaatctttgtcctctaaaaattcagaatataatagaaaccagataaccaaaataagggagagattataattgtgtttatcagtattcagaagtcaaaaaatggtaagaagggattatcctggcctaaataatgatagagtgatatcaaccacctaataacttctctgagaaaatactgttcctgacatttaatgctccaaattcttcctgtaatctttgttccactttttgatatgtcataaaagtttacacttttgtaattcaatcatgattcatgtttttatattggaataatgagcttcagtcttgatatcttgctaaagttaactccaaatacttaaacaatgtgaaatatttttcttttaaaaactaaacacgaaactcaataggaagactgaaccataattcttcttttttgtcaaaactaagactatatttcctcaattgcaaattatctttgattgtaagaatcatcaccaaactagcgaaaattcttgaaagaaaaacattctcatatttaaaatatattttggttgtgaaatgagatttaacttcacaaaagttaaaattataaaaatgtaaacattatttcttaaaatttgctccttagggatggatagataatgtgataaagcaagtgtaacaaaatgttaggtgtagttgttatatgaatttgtattatattctctttactgtatgtttgaaaattttccagataaaatcttgggaaaaatatgcttcttagaacagagaagtttaaaactccttattcaaattaagaaaaataacatttattaggctttcaattgcatttactgaattccctctctatgattactcatttataaatggttttataaaatcgtatcctcataagtcaggtgtgaattaaagtcatttcttgggcaatacagtccacataagtaacttcattcttacccattagtcttattcacattttctcctttcctggtactccaaacctcctcccaaagaattttcaaaatatatagatcttccctttggagcacttttcaaattagaccttgtattgtggtcattgtgtctgaccttaagcattttgagtgaacatattttgtactttatccttcatagcagaagattacagagtaagaaaggctacccttagaaagaaagtggatatgtttttcttctttaaattaaaaatctaatgggcaaatttctaatttttaatctgtcactaaactattgaaaagtaaatatgttgtctgttggcagcaaaaagatttaaaaatacatataagctccacttttttaaatgagctattcattctataacttttcacatattaggctggtgcaaacataatcgcggtttttgccattacttttagtggcattatctgagcttctatcatggtcaagaaaagactctgactagagcagtcttccaacttccgttacaatgatgattgtcaatggatttgtaatgaaattaacaaatttttggataaaatcattaatatttatgcataatttttaaaaggccaaatagtacaaaaacgtatatatgaaagttattcttttctgatcatacataccacaagcaccaaatattttaccaactttctacagtaatgacaatcactttttcctttcaggaatatttgatgaagtatatatatgtgtgtgtgtgtgtgtgtgtgcgtgtgtgtgtatatttatgtatgtgcacatatatatttatgtatgtgcatacatatatatatttatgtatgtgcataaatatatatatatttatgtatgtgcataaatatatatatatatttatgtatgtgcatatgaccggtttttggattatattatatgattgttaaacaaatactttttaatttttttgcctaatcttaagacattaattactaatagttttaatatgcagcctttaggaaagaaatcacatatgtaaaaatattcactacatgctctaaaatgagccttggtggaaacatgaagaggatataacataacgttaagttcagaaaagaatacgagttttataactcagtataagccactatataaaacatatagttacttaagatgattggaaaaagaaactgaaaaattttaatagcctttgtacatttgtggtgaaatttatggaattttttcctcctatttcacccaaaactatcccaaaactttaaaaaatattcaaaatcttactatatttaaaataaatatttgaataatgcaaaataaaataatatgtaacatttatttttttcttactttaaatgaaaagtttacagtagaatctctacaaaatcgtttgtgtttggcacagttattttatttttcttgttataaatccccaaagccaagattcagaatcttttagcatccaaaatgtaatctggaaatgtggtgtaaaatatttcctgaaggaatactattatctttacatagacaaaacgtggagctggaggccattatccttcgcaaactaatacaggaacagaaaaccaaacactgcgcattctcacatataagtgggagctaaacaatgagaacacatggacacatagaggggaacaatacacactggagcccacttgagggtggaggtgggaggagggagataatcagaaaaaataacgattgggtactaggcgtcgtacctgggtgacaaaataatctatacaacaaaccccgtgacatgagtttagattatccatataacaaacctgcacaggtacctttgaacctaaaataaaagtaaaaaacaagtatgtgggtgtttgtcagaagcactcatttccttacagccattttgttttatatctagcgtggtaataacaagctgattaacttttctggagtagttaagtgtaaaattacaaagctgccaatgcatgcgtattctgctggtatctcagaaaaaggttttatgaaaagtgcttttattattttaagccacaattataccacgaaagaaaaacacatacctgcataattttccaaagtattaagtaactaccaaatacgtcccgtactctcacccctaaatccaaacccagacctgggtttcagatctttgcatacacacattctctgcattttttcatgactgtgtatcctggcctttagatataatgtaaagttctatgccacaactatacctgtggtcactacaaaatgaattttagtatgtttatatttgcccacataattatttgacacttcataattgatcgtaaggatccatcactcaatgaatttcccttttgaataattaattatgaataagaaatgcagtcagtcatgtgtttaatttctcttagtcccaattatgtatcagggaaagaaagcaaatgagttctccattttaagaagtattttttgtttgccttttgctttgtattcctgcaatatggcatcatttgctgctcagggcagagacttttaaatcattatgaatgcaagcaaagtgttaataggttttgctgcatggcatatatgctattatatatgtgtatgtatagcgtatatatgctaatattacattttgttttttcctcaaatgccaagatataaaataaagtaatatcatagaataataataaaaaacattcattttgcttcaaaacttattttgtattgacattagtaacataagtgaatgattaatttgcaaaaggtaagcaattaatatcagaggctagcaaaggttcagatactttacgagagaaggcaataaggttcagaagcaagtgacaataaaaaggagactagaacaggaaatagagattacgtaggaggcctttggagaacattcaaatgaaggacatgttacaagttcccattttactgcctttattgccgcaattgagggcgttgtttatcaaactgtcaaaagaaaagagagagaataggatttttaaaaatcattaattaaaactaaattattttggctgggcacggtgactcacgcctgtaatcccagcactttgggaggctgaggcaggcggatcacgaggtcgggagattgagaccatcctggctaacagtgaaaccccgtctctactaaaaatacaaaaattagccgggcgcggtggcaggtgcctgtagtcccagctactcgggaggctgaggcaggagaatggtgtgaactcgggaggcggagcttgcagtgagccgagatcgcgccactgcactccagcctgggcaatagagcgagactccatctcaataaaaataaataaataaataaataaataaataaataaataaataaataaataaaactagattattttttacttcttaaaaatcaacaaggatccaaatatttcaagacacagtaaagaaggtgcctgaaattcatcacaccaagtgttggtctctgcagagtacctattttatgacaggtttgaaatagaagttggggataccatagaatataaaaactccgatctctttttaaaaatcaatagcttttaaaatcctaaatgctctcacttctgagattaataaacactaagaatccatcctgaacacacacaatggcttctattacaaaaggaaaaatgaaaacagtgctattactgacacagtcaatagatcccaactcagtgtatattgtactttctatatttttaatttaaatgcatacagttctagggacgggagcgtgatcagcattcattcacttcagagcataatagaagatatggaagtttttcccataaataaacatataacctgtcttgggtactatctgcttaaaatattttctctggaaacttatctagccattctcagtacgtggttcttccgctagcctgttctttattactgctttccttccttccactaaaacttgagcagaaaatcatgaaattgtggtctctgcttcaggtttgaggacataaaacctagagtccacaaaaacagcagccttccttgaaataagagaggatacaagaaaagtttgcattcacactttccttagcttaaaggaacacacaattttagaagcataatgaattttcagagtacctgaaaatatttcttactttttgtgtttatatgcccttacagtaaaagggacctctactttaaaaatttttaaagtagttaatatatattaactcaaacaatccttcagcaagacttctattcttattatgaagggtgagactgccaataaatcattcgagagagctttacagtattcatgtggagtgtgctgcagatccacttaatccaattaagttcaagaagtaattctctcactgatggcatccagaatttctatggcaaattcacaaatgcattcagagggcagagtaagctctataatatttgccttggggactgcataaacaggctttttttttttttcttttaacatattatttggcagacgtaggttttagtggtggtacaatcactatatctagagttatcagtttattttaactcattaactctttatcagccaaaaggcagttctataatgaaatttatcttaatgaaaagcaagcctttatttattgaactgccttattaaaaaatgtaatcactttttctgtatgtgaaccagcaaagtgttctgtttacctaatgtaaattattttgtgttagaattttaaatagaaaaaagaaagaaaaagagactaaggtccgggcgaggtggctcacacctgtaatccttgcactttggaaagctgaggcgggcagatcacttgaggtcaagagttcaaaaccagcctggccaacatgatgaaatctcgtctctattaaaaatacaaaaaaaatagcctggcgtggtggcaggtgcctgtaatcccacatacttggggtgctgaggcaggagagtcgcttgaacctgggaggtggagtttgcagtgagctgagatcgcaccactgcactctagcctgggggacagagcgagactctgtctcaaaaaaagaaaaaagaaaaagagactaagacagtaattgtttattgctccagaaagtcccacccgcaaagatatttcaagggagaaagaatgcttggacaagttcatacactgagaaggttggtcatttgagaaccaaattgaaaggaattgtctaaccaaaccagtaaaactcaggttgaatatagagacacataaagatcaaaaccccaagagaaatggcaatatttgtacgtgacggaaggtgaaatttaagaaaacaatgatttttttttttttcagaatgttatggcaatcttccagaaagccacagatgattcagccccttgctactcgaagtgtggttctcagaccagcagtataaacatcatcagggagattcttagaaatgctggcgtcaggcttcattctggcacatccaggggattcttattccttctaaactaagagtagtaatttttgccttcaaagatacttgccatccccactggattttaacaattgtaaataacattgtgacattgatgcattgctagaccatcagttcttgcagctgaagaagtacagtgctgcagccaggaggcaggatttctctttttcagacagctctgaccttcccagggcagtgattgattttagatgaccaggtgcctgaagaaaattaacctggagttgtaaaatcaagatgaaatttgagttaatctctaatcagtctgacgaatgattcaagggcttcaacattggtcatctccagtgaaaccttttaaaacagctatttgtgtttatagctttctcttataaccatcaggcggtttctatatttattcaaaaattatagaatgcattctactctgagtttttaaaaatttctctaagtgatttatgctgacttaacacctgttgaaaacaaatgcctttcagttacttaaaagaaaaactcaaattaataataggcttgccttcaaactttgcctgtggcacaaatattttctttaactaatgtactatagtatttagtcagggaccatgctgcttccaaaatagatccagaactattgtttgttcattcacaacaaattaacgaagaggtcatgctgcagctaccatgatttttaatccaaaaatactgtttttaaacataggttgatgaatcatttattttccttctcaggaaccaaatacatatttttgttacagtgactggttttataaaagtaatatataaagtttagggtattttatttttgcatttaagatactgtaaaacttaaatcctacctagttacaagttaaataaatggttatgtttaaaagataatttctaattcattaattactaattagtggctccgctgcctcttcctgccatgtaggctttgattattttactactgttataagcctccccaaacatggccaagtcccaaagggaagagcaatcaatcaaatctattttaagagtactgtactaaggaagttttggagtaaatgaattttaaaaataaatctctgaccctctcccagcttataatctttcaacatataaagataaatatgtccaaattactattacaaataaaagtgcatagaatataaatatgtatgaagagataaataaaaggaatatgtttgtgcaaagcattcctcttagcccatgaatatgtgctataaaatggagttgcactgagaaggcaccagaaacagatgactcttcagagcttgtaagacggtactgaactggtgaatggaaggaggaaattatgagctggggagagacacataagctaaaccaggggaaagaagacatgtagaggaaaatatccaagtatgatagaaaataaagaataatttcaccaaaaatggggaacaggtactgtaggtataggcataagattgggagtcattttaacaatgtcagggaaaattttgtggaagatgaaatgaggattttggcaaaaaagttttcatttcttcatatatgctctaagagctatgtttgcttcctgttaaaaacacttgtcacaacaatttgccatttggcaattattaaaaaaaaaaaatgaaagtaataccagtgatggcattctgttttctatttttgagataaaccaaagagtgacattagtcataacattataacgtttctcttattattatgatgatggttattattattattattattttacttcagcagggaaattgggtctctagggcccatatctgctgccatatatgcactccaatgcatgacaatactggccacttcatgaagatatatagttagtccattccaggtgtccctaaagagaatatgaacattcaacttaatgattattcaaaagttagggacaattgccaattcaaatgtggaccatggattctaacttcaaatctgttctctgtctccctttcccccaatgtttcattcatcaagtccttaaattttctaagccattatcaaaatgaactggatctgcaccaggattttagaaaggagcagtcccatagctcattgtcattcccttgagctagccagtcccatgggccatacctaacaacagtgaatgcaaagaataaatcaaactctcgggtcactttaaaaagcttagttttcttatgaaaatgaagctttaactttgcctggcacatcagggatctaaaggaatacaatcttccatttatttgcattagccggaaaggtattgtgccaacacggaaccttattttcagcaaacgcaattttgcaggagagaaggaaaaggaagaattaagatatctatctgaagtgaatttaaccagatacaaaaattctgttatggctaaataagtgcaagtaataaagatacctgtttacagaatagtgctttctttactaaaattctacattgcctgttagaagatgagagtatgtcagaagcacacagcttcgagctaagcagctgcaacatatttcaaagctgtacatgagctatgcgttagaggaaggaagtaaaggctcatctcagtatattttagagaacaaattaaaacagtagtttgtctctctgaagcaaactgattaatagttacacacaaactcatcaataatgctaatgcctagcaataggttaatgctgtacattagcctatttgatataaatgaaaccacaggaaacatttatttaagttgtgagtttcattgtgtgattgcctctttcccaagtttgaccttataattaaattgttcacaccacacatataattattttctgctagttggtgtacatttaatattcaggcaatccttttagccaatgtcagtataatttagttaataatcactatctattacaaatacaaagattgagcctctttgctcctctcacctccaacatatatgcattctaaagtgtttcagacatttcctttttttccctctctaatggtttttcttccatataatctcatatatctcatgaataaaatttagtatcacagtttgggaatttaagtgaggaaattttgttttccactgaaattaatttggggaaatttttctttattatataaatctacaaatctgaacataatccaaaaaagtaaaaatctatataccgtagtgtgctgtatagtatagactagatttaaagaattagtgaggctaaccaaaaactagtggtaacaagatggttttatatattttcttaaactgtttatttactttatattttattgatatatcatttgattatctaaaaagcaatttataagttacgcccccaaaatagcaccgtatagacacataagtgaaaaaataatttctaccttttgtttttcatttaatatgtttgaacatttatattttaaatactcattatcttatatagagacttgtagctatagagcgagcttgtccaacccatggcctggtgggccgcatgtgacctaaaatggctttgaatgtggctcaacacaaattcgtaaacttttttttttttttgagatgacatcttgctctgtcacccaggatacatgacattgcttcacaagatatcttcaaaccccttgtctcctaacttagcactaatttggtaatcattcagacgttatcattacaaaaactacaaagcctattctttctttcaggcagtctgccctgagggtataaacaatagtatttattacatattctttaggacccccatgttataccctattaaaccttgataaatattcttctgtgtttctagaacaaacaaattgctttcctgctcattgttccttggctccgctaaaaaaaaaaaaaaaaaaaaaaagtcaagcatatttcaactagaaaaaggaaaccataggcagccagacacagagactatactgtttctcatttcatcagccttgggacttgaacagcaggtcactccatttgaaaactagcagacgtaataaatagaaagaggcatagaaagcaagctgaccacagattgggctgtagcacccagccatttctgtctgtcttggaaaggccaaagagaatgcactgtatactgccattgtatcaaatgttttgggcacctttttcagggcatttatgaaagaaaaaaagaaaagggagggattaaggactggataagccttttcctgcctgagtacctgtttcatgatgtttctttatagtcatcatgactggcaaaataatctttaaggttgcttggcagtgtccaaaaagtagacaaatagaccttgtacctgtggaagaaattttaaaaactaaaaaaaaaaaaaaccataaagttgctttatgaaaaataaattatatgggtatggagctaaatttggctaaagaagaaaaaaaatctgattttagtaacaggtagccaatgaaaagcaaattaagagcagccctcacatatcttatatattaacttcccagaaagtcactagcagttgtaaaaaagtatgctaaattagattgtacacatgataggggagtcactttcttgtgcaagagctgatgtgtgtgtatgcttgtgtgtgtgtgtgtgtagaattatggaggtgacacacacatccattatatatctatatatatatatataaaacgtgtgtatgtatgtatgtatatgtacatatataaatgcattgtatatatacacacatgtataaactgtgtgtgtatatatgtatgtatacatatgtaaatgcgtgtgtatagatacatatatacacacacacattttactatatatattacattcataattttaggctgggcacagtgactcacacctgtaatcccagcactttgggtggctgaggccggtggatcacctgaggtcaggagttcgagaccagcctgaccaacatgatgaaaccccatctctactaaaaatacaaaaattagctggatgtggtggcatgtgcctgtagtcctggctactcgggaggctgagacaggagaatagcttgaacccaggaggcagaggttgcagtgagccaagatcgcgccactgcactccagcctgggtgacagagcgagactccatctaaaaaaataaataaataaataaaaagtaattaaaaaataattttataaacaccatcatgagccttatatacaaagagtgagttttcaaacatttttaactgcagaatagcttttgatataacatttttaatggacacaatgtatataatagacaaaaatggaattaatgtgatatgtgtgtatagaatatataatacatatgtaatatatatgtgtatatgtatatatgcatataatatacataaatataatatatgtaatatataaacgtactgttattgagaggaactaggaacagaaactggattgtctcctccatctcccttggtgacccatgaagggttctccgcagaacatgggttgatttagttaagtacaaatataacctagttatactataatagtgtaaaactttctaaaatgcatttaacttaaacaatataatcatggaaatatcattttatagagcattaattccctgaaagatattgtaaatatacctctaccatcagaatacaaaagtagatagaaggtcggtttgaaaatggataacttttaaatgggaaagtccccaccaaaatacctacaccattcaaggtgaatgtttaaatgagatgacatttgtggtaatatattataaattttagaaaaccaattataacatgatttgtaacactaaagtccacctggcttcttttatgtcatttaagtttttattagatgtgatcatttttgagaaatcatattgaaatatattattctagtgagtactctcaatattgctttttataattaagaatattagaatttttctaatgtaattgaacgtgtagaaaccatgacagtggtatttagaaacaaaaattttcataagtgacctcagaagacaaggtaacatatttctggaattaacatctgggaatgaaatttaagaaaataaataaataagtttttgtgtatgtatgtctgtgtgtaatcatgtgtgtctataagtttttttttttaactaatggcttgtggcttttgccacaactgaatatttaaaaggcttccatttattcaccttgggaacgatttgagggttaagaagacaataggactatgagcgccactgtagaaagatgctagctagatataaatgattataattatccaatattctgaatgttttcttaatcaacagatgggatatttctgttcatggcaaagaatttcaaagatgtaatgatttcatttttataactattcaaaattttaagtatagctctgtttagaactcaaatcactttagaaatcattcatatttattcttcagggcaataattagtgaatggatatgagtatctttggactgtctacacaccaaacagcaaactgaaaacttggcagttgttcaatttatttgatcactgtggattgtcaaagggaatattcatggcccaaaagggaacctttaaaattatttgaatttagagctgcaaataatcatttttatgttttaatataatgtacatgagtcatttctatccagtctgtgttataaacagataattctgccagtcactcactcaaccttttgaatctcaatcattaaatctaaaattatttcaattgatgtgaatgtagggcacaattatgtagtgttttggagtgagtttatccagccagctatgaagaaaaacataatatgtaatggaaaaatatctgatccagtttacaaagaaagtggttataaagagttactgaaatagctcctggagtttgacagagatcaaatcctaagggaagtggtcagaggtgtggtacagtctctaattatgaacaaggatactgctcattatcactccaacaccagttcaccctaagaaggtagtgattcattgtcagtgggtgagtggtgcatagttagcagaataactgcccgccatttaactaactcgtgtagctctaagcatgtgtctggattacctgttttatcagttaatcctcctgcagtagcttctctgcagtatatcactgaggtggtattaacattcgtctgataaaatcaaagcatttctccataaatgttggaccacagcaaacacatatacaggaaaaataaaaaggaaatttacatacaaatcaccttcataatgttactaatttgttgctacttgcagtaaagctcttaatgagattatccaggattgggactatttcctttgagagtttcatttgcctcccgaacatttttccttcaattgtggctgtgcatttattacactccattacctatatttcacattttgtaattcagtttgtgcaaatttgtaaaatgtgttcttacaacaaaaggaaaaaaaaattaagaggaagcttgtgcatgatcacacttttcttactataatatgcatgtctatgtgcatttacctctatacccacctagcaaattggtgagggtaaaaggagggtcagtgggaaacatttttaccaaattcagaaaatctgctgcctcaaatgatttttccagtgtagtagatgctaagaaaataaatagacattggatgtctagcagtctcatctttctgcagtcctactgaggactgatttcactagagtatagaatggtacttctcagacttccctgtgcattgaaatcacctgatggtcttgttaaaattcagattctgatttaatcagttcagtgttaggcctgagtcactgcatttcaaaccacatcccacaaaggccactggtccacaaatcgatcacaccttgagtaacaagagtataatcgattaaactactagtagataaactcactttcagtttaaataactgaatataaagcaaatgcatgttgtaagcaaacaccaaaaaagtgagtaatgccttaaaaatgcataagccattagaagatttattacataagagcttgtttatacatttaatgagattttagctttgttaacttaaatgagatctcattaaaccaatgaaaatgccacaaaattaagatatcaactaagttgggctccctgctgtgaaattctcatagtcatagtgaagataaattattaaaactggacatttctattaaaatcaaaacagtctttaacaacaaatgtataaatcaaaaagccaatgtgcaaaggaaaacagtagaagttatgcaacagacgttttagtcccagctatgccatagaacccgtttgcattatttatacattgaagatgataaacacctggctcgaatctcataaatatgtagttagatctgaatatgataattcatttgtaagcatcgtgaatgaattataatttatacctaagacttttttaaaattgcaatattatttgctgctgtagataacatgcatatgctaattcacagtgtttaaggctgtttatgatctccaggttttaagatatgtgtggtcaattttagttgatattgcatttttaacaatgccccagtttcactgcaaaaatagacttaaatgcacagattttgttgaaatttatagcaatgcgtaacaatattagttcttattgaaggctttccctggacttctgaggattaaaggtgagaatataattccaaatctgagtaaacacttatagaaagtgattaaaacttatttagtgatagaaatcagtgattattttaacttggcagtctatgtgccaccattttagccttttagtatgacatagtaaagtaattcaaagggaaggcttaattaacttcagaaaaaaaaagttcaaaagaatgcagtaataaaaataggccctcttgtgaaaagaaaacttgttagttaattcttatatctcaaagagagataaactgtgaaaatacctgtagagttcattctcaaggcaatagagtgtttctcgacgtccacgtgtggacaggatgcagttctgatgtgttttgctgagtcagggatttcttgtggcagctgtcactgttgatgcatcatctttaaagacgtgcctgagaactttgccatgacccttggcggcttgttgatttttctgtggaaatgtatgaaagtataatttagtttgtttgggttttacatgaattaaatatggggtttttgctcctcattgagcaaaataaggtgaaaaaaacttccttaaatatttcagagtttgactcgaaacgaaaactcaaaatgtaatcttgtgctgttatttttgtttccattgtgtgatgccagaggctatagacaactaaggaatctttcaacatggcttgaaattttgcatgtatcaataaatacctatggtaaaaaaaaaaaaactttattttaattttagctactctataatgttcaccgtaaagtataattattttcacttatttttatcaatttaattaaacatattttattgagctctaccccactgctagaaacatattccaaaagtacaaggctcatcttgtctctcttggtttaaagtctttcaatgcctttgctttcccaaggcatttgcctaaagttaaaccctttcagtgtggcccacaagcccccttaggatctgtctctgtctgcttgatgtataacccaacttctcccctcaccccatcacttcacatgctggcttccagccacacggaactctaaaagtggtttctccaatgtgccatcttctcttaagccaccaggcttcacataggctgcagtttatcactaaaaaggaagtttccttttttttttcttcaaaatcccttcatttcaattaagaagtcaccttctgcctcctgctttctaagatcttcataaggggtaagaaaggtgccccttctaagtaaagtgaccattttttttctagttcaccagagaaagtctcaatttatgtcaattttctcaacatttcatttatttagcactccctttcactcacaatggggtgtgtcatcctggtttggatgacacactccacagccatcatacttctagaggctccgttttcccctctgcagcaagtacgaggccaagagcataactgttttggagtcagccaggcctattttcaaaacccatgtctgccttctgtcaactatgtgatatcaacataggtagttgctgaaaatttttgaccttgattttcttacttataaaattgggacagtgatgtttaacttctggtactttttgatttttaaattcaaccatgcaagtaaggtacatggcttagcacctggtacattttaggttctgttaatagataaatgtaggcacattaaaatgttaaagagttacttcggacgaggattcatgaatcaggcaaatcaaactataagcagtttggactccaccaaaggagcatgagacgaaaaattgtataaggtgtttgaggaattaatacacagaaactatttgcttgtttaaactggaacagtagctttcaggtctctagtcagagatgagttggcagtttctggttggttcagctgaagtttcgttttactgtttacactgagttaggtttgatcagcttacgtctgaacccaaagtgctggagccatctcagcctaatggcctcccaattaattttgtaaacaactttcaatgaatcacagctttttaaaaacttaatgatagcaatagcactgtgttctaatgatatgttacttccttcacaggactgtatacctcttaaagtcaaaaacgtgtctttgtcttttatttgtttttccgcaggccctcgcacaatagtgcccacactatagattcataataaatagttatcaaagggattagtgactagaaaaatgactgactgactaaaaaatgaatgaaaacatattatctgtcctcaaaggaagaaaggtacttttaatgtaagccactctctgtgtgtcataagtgctccccaaaaggacaaagaaaacagtgaagaaattaccctatttccaatcgggagatcagggaatattcacagagcaaatgacatttaaatagggcttcagcaggaagaaagatgtgttatggagtagtacttcagacagagggcatgatcaccacattttcatcaaataataaatatgttaatgaaagatatgtacttaaaaataacaaaaaagtatttctacaattatatgcataagtttagattttccaccctccaaagaggcctttgtggttgccattcttttcactgacaaatgtactgctgaatgtgatttctcttaggttgatatgtagtataaaaaatcatagccagctttttttctccctctcttggtttaactcttgcacattcacacatgggggggtataagatgttcattttttttcctttgctttttaatacgaaaattatctcttaaaactaaagtcgaaattaataaagatcttttttctaaaattagaaggatctatttgctttgacaaattctaactgtttatagtgtcacattattttcaaaatattacagatgtggaaaaggggtagaattagttttgagtaaaattatggcttgtcagcagataacacaatcaacctttcaaacgcaaacacctctttccaagtgtaattgttaggaaatgagagccgtattcaaatgctaaataagaaaaatgacgataggaataaaaactcttctggttaaaaaaataacgaagaacagaattttaggcacggttttcaaaagctctccaattgcaggtgctacctggctgttgactggttgattggatggccttgatagtgttgacagcccatgaattctctgacagcccagggaattcaagttaatggacagttaatatcatgattgaatggtgcctgatctatttgaggatggaaaatcaatagtctattagattcgccaggagaagtgggggaagaataagcatgcctatttgccttcattgctacgtctacactaattaagcaccaccttaagatggaggagagtctggagaattgaactggtaatgagattccgacttgaagtaaatgaagcaactttaccataaggcacactgacagacaattaaacctttttatcaatgcagctttcatgcagaaataaaatctcatatggcaactgtaaaataaatggaggactggaaggaactgtaaatctttttctcagcttgcagttgtacttgtaacttccacactgttttgacatttggggtttttgcattagaagtcatagtgagtaacattgcatttttctacatagaagttccgtgtgtcacattcattgaaatgtttcaagaaaggttttgattaaacataaaaccaattagagataagcagtttccttcaaaaaattttggactggaaagaggaaatattctaaagagtaacaattgctgtatttcaaaaatattttaaaatattttaaagctgttagttgtatagataaaggctcatttttgcttatacaaatatctctttttcctcacgttaaaaatactctaataggaaagaccatcatacatagccagagaatcttgccatcttaattttcagaatgggagtagattttattttaaacataatgatgggagaatgggttttttattggcaattaaatgttctagtgaactgacaggtattaatatgccattataatatagtaaagtaacataactcagctgcatttttaaagaaaatatgcctttgaatcagaggccttttgttatgttgcagtgaactagtggtatgataaactgttgtacaaaacataaagatattattacctattagaatcacacctaaattcctcaccatcaatattcttgaatatagtttttactgtatgacctagtcatacatttacctgttaaatttctataaatagagtctaaactttttttaggaaaatggccagagcatataaaatttttttctttacttttttcatttctgtgttatagctaacactgtgtacttcacactactgctatttattatttttctttttctatatagattactggcaacatttctagtttatcttttgtataaaagcagaaaaatagaacacctggctgtttcttctcacctcatagagtaatgatattttactttatcttttatttactctgatatatttaatacaatttttcatttcgcagtcttttgcagtagcttctcttttctcctttcaggtttcaaatcgtccttctttaagcccttgttttgtccttatttcttctgcagttatttagttacttgtctctctatccatgtcctatggcttggctattcgagtttcaaaaatattatagtaatatttcacttaaattgacttgtgagctttaagatattataataatatttcactcaaagccattttactcaaatagcttttattgagcacctgttagatatatttcactgggctatatttatactatgattcagatgtgtgcagtaattcatggttttactcaaaaatatttattaaatgtttagaattgtgtgttctgcatgtgctcaacactgtgaaacacactggggattcaaagactgccttactaggcatagattatgcctttaagtatcttataatacttgtttttaaaatacagcatgtaagttagacacgtaggaacattaaatgtaatctaaataagaataaaagatataaaaacatgcacttgaattatagtggtacagaaaaagttgaggaattttgttgtattgttctaactcgagacaaaaaagagcttcagagaaaagataggatttgagttcaatcttgcagataaacaggattttgttaagtggggaagaagtggagagatgctcatgatcaggtaggtgtgcaagtcagcagggttagggttaatattttctttggcagagttttaggttgtattgagataggaaacaggaatttagggtgagattatagaaggtattgagtgtcatgctgaggagtttagacattattctggggtcaaagatggcttctaatcaggaaattacatgacttgatatgagttttcaggatatggctagtgacaagagtagaaaaggatgtgttctcagattataactagcagcaaacatggaaaagaatgagtcgtcacagagttcagtgaggaagttattttataaatacaggtgaaaataatatatgcttgtgttttggccaagtagggtatagctaagaaaggggagacaaagaagtagaatagaaagacataatttacgggacttaagttatgactggatatgaaagttgcaagaaggggaggaattgaagttgaatttcattgtttggatcaaagagtttggctggctgacatggtggctcatgcctgtcatcccagcctttgggagccaaggcaggtggatcacttcagcccaggaggtcaagactagcctgggcaacatggttaaaccctgtctctacaaaaactacaaaaattagccaggcatggtggcacgcacccatatcccaactactcagatggcagaggctgaggtgggaagatcacttgagctcagggatgtcaagactgcagtgagtcatgataaggccactgcactccatcctgggcaacaaagtgagaccctttctcaaaacaaacaaacaagcaagcaaaaccagaaaacaaagaatttttcttttaacttaaatcagtgacaccagatcatgtttattcaggacaattgtcttcaccatactgagagatttccttccttggagacataatatctatatgtagatatagatatctatatctatatctagatatatatatatcttactcttctagcatttccacattttacctaatgaagtcctattaccttttccaatagaaaataatagtgcacaagactcttaaggacccatggaaatatatactattagcaatgttggttttggagcaattatgtgaatggctacactatcccatggccatggaatttatttgaggtcacattggttaattgctcaatgaaacagaggatcattttttgactgatatgctggagcccctgaaaataattcagtaattaccatcaattgagaatctatattttacttgacccggtgataatacctttacacgaaacatcttattcaattcttggtaaggaccataaggcttcttttacagatgtgtaaaatgaagttcaaaaaagttaaatcatttgatcaaagcctcaattagaatcaccgaggaaggattttaacttatgttagaatctagagctcgcataaagtttatatactcactctgaactttttgaggtgagaggcctctttaatatatgctgtttctccaagaatatagcattatgcctggtatatatataatagtttctcaaaaattcaggatcagttatacttttctattatgaactaaatctagattttttaatctgatcttttctctcaatatttttgtatcttgaagcaaaaacacaaggatgttccaaccacccatggtcaggcttcctcaaaaaaatattctcttcttgtcttttatggttttaagaattaattgtgttcacatattcaaagaaattaaaaaccaagaatttatatatactatattttttcattaaacattttatttttagataattatagatctatatgcaattgtaagaaaaggcaaagagagatcctgtattagtcagaaatctccagagaaacagaaccaatgagatatatagagagatatataggaggagatttttaaatgtgaactggctcacatgattatggaggctatgaacttccaccctatgccatctgcaagctggagaactcagagagccagtggtataatgcagccccactctgaaggcctaagaaccaagagctgtgatgtctgagggcaggagaagactcatgtccagttttaaaagataaagagaattcaccctttctccttttttttcttctattcaagccctcaataagttatatgatggctacatacattagtgagggtggatcttctactcgatctattgattcaaatgacaatctcttcaagaatcacacacacacacacacacacacacacacacacacacagagagagagagagagagagagagagagagagagaaataactctttaccgtctatctgtgcatcccctacttcagttgtcacataaagttaaccatcaaaggtcttatgttgcctttacccggtttcacaatgataacgtattgtgaaactatactacagcatcacagccaggatattgatattgatatagtcaaggtaaagaacactaccatcatcataaggatctctcatgttgcccttttgtagccactttcctccagctccaccctctcctaaacgttacctatgacaaccactactctgttcttcaattctataattttgtcatttcaagaaagttatataaatggaaccacaaagtaaataagacaaagtaagacttatgcccggcatttttcccttagtatatttctgtagagatttatctaggtgattgtgtgtattaatagatctttccagtttattgttaagtaggattccatagaatgatgtaccatagtttgtttaaccattcacccactgaaggacatttaaacagtttccaacttttgactataaattaagttgctataaacattcatttacacattttgaggtgaatataaattttcatttccctgagaaaaaaattcccaaaagttccattgctgggttatacaatagttgcatttttatttttttaataaactaccatattgtttttcagctgaggctgtaccattttacatttccaccagcaatgtatgagtgatctgatttctctgcatctccagcagcaattgctgttttaactcttttattttagccatttcaatgggaatagtgacatctcattgctttaatttgcatttttctaacatctaaagatgtagaacatctttttatgtgcgtatttgctatcaacatatcctattcaatggaaatggctcttcatgtcttttgcccattttctaattgaatcatttgcttcttttactgttgagtttttaagttccttgtaccatatttttatattttaaatagtaatatttcgttaagtatgaagtttacagatttttctttctatagcttgtcttttgatccttttaactgcatctttcacagagcaattttttaaaattttgataaattctattgtattgattttttttctttcatgcattgtacctttagtagtatgtctaagaactatttgtgtaacttatcccaaagattttctcctgcattcttttataaaagtgttataagtctgccaccaattttgagttaatttttgtataagatgtgaaacttagatttctgttccttgcttggttgcccctttcctgatcctttgactaaagagagcaggcattttggggactattttttgtctgcactccctggtatttccaggtacctctttttcaataccaagcctggactatatgaggcataaagaaaacacagcacactcgccattgttagaaaaagctaagctggacagtacttaaagaggtgaagaaaaaaaattattcaggaactattgcaataggaaagaaagagacctcagtatagaactgagctcaattctggataaagcattgacaagtggagatttatagccaaggaacagggtaggggtcagtgcatggaaattactaagaggaaacatcaggagtaagggggagttctggctaaaccaacttgcaaggattcttgctaagactgagtgatgcaggtctggcaagggcaggcctaattgagaagatgggtcagaggagcctggctaaactttggtcaaggaaagcaacttagtcatcagcatgtcatttcttgggtctgaggtccctaactgatctgctgatctgcttgctcttcatatttcaaagtctccgtctctgtctctttctctgttctctctctatgtgtgtgtgtatgtgaaatatatatagtacatacacacacatatataacaggttttttataaatgtgaatattaggtatatttatacagcaaaaactgccctataaattttaaagaactatttgaaaagatacaggctaaatatttttaaataacctttacaataaattcttattaaattttttcctttgctaaaattatagaattaactggtttatttagaaagagaaaaatgaaaaacaattaatagtataatgcaatctaaaacaagtgccttctaattattttaaagtaatattattatacttttgtagtgatttctccttttgagataattttttaaataataagttccttttccttcagttttaaaaatattttccctcatacttatttgcaccctcctatgactgtgcattattttttgtgtaccattttctagtttgcacgtaaagtcactgttatactctgttgaatagctattattgccttttggacttgcttctcaatttttttattctctattcctcacttataaggactccctcctcatgtttgaccatgcacattttattgaaccacataattttcatgaatattttatttgacctacaactgtcaagaggatcttttctctttttcatataataatgtttttctctatatctgaccttataactccatcgagaaattaacatattaaatgtattcttttatccttctttattgaggctcagttgaatttttatccaacatagaaaaatgtattagctgttaaggtactataccttattggaatatttattataagcaaagatgtgaagatattttaggtgtctaaatattccttccagttttgtgtttaatgttgctttcaaggaacaaatcacttgaaatttaaatttggattcagtgtatgctgatactacagcatttacattagaagtaaaatcagaagccatccacatgttcctcaactatgtctggtatggtcaattgaaaaggagccaatgcaaacgcccctttgataattaaagacattttaaagaactgcaaaaacctaaatcaccatctttgttgaattgtgtagaatgttccacactttttttctttattttcattattttttgtttgttgtttttagagtggtatacacttgatttgtcatttttagaagtgaacattctgccagtacctacttcccaagacttgttaaagttggaaactacagatgttcacttgggtggcttctcctcagtgaacatttccctgatttgtagttaattctctattccattgagtactgtgctacatttccctgtagatttgtgcttgctttttccagcttttccacatctccacctctcaaatgaactaatcataacattacgtttggttgcttgcattattactgtgtttagtttttatttctatctagctgttttaaggggatgttcgttgtattttttcaggtaagattagatattattcctgtttttgcctggatccgacatccagaaaaagcgtaaaacctgaaaccaataagaaacaaatgattttattccttgctatttaactcttcaagcattttcgttgggtttaagtacattgtaaaaattaatgagtattattaaaagagttaactattatgacactaactccaaggatatgccaagtgcatagtgggtacttaaaaatattccaatgtacaaagaagtaaataatgaaaagcgttaaaggacatttgcttgatatagtctgttaaaatacataattctgacctaggaattcttttctaacatgatgactttttccctaaattatctggataaatgccttcattttaaaatatgttttgtatatgtaaacatagaatcttggaatattttcttttaatccaaagaaacccgaggtaaaatgtagatgaattaaaccaatttaaagcactagataagaaatacgtgattttagagaacaatctctctatggcctttggtaaatagttacttctgctttttaaaggtcacagtcagaaacacccaaagtaagtgttgaggaatatttatcgtcagtccttatacacacttgggcaccatccagcattaagcaacagtaatttctcatggattggccagaatacactgtatttaagtaattattttaatccaaaaaaggtatcttaaagagttaaaatgttgtagttttcataactattagattttacattttgctaactactaatctgccagtctaagagaggaagtaccaattcatactccacagtatggctacataagctagtgaagcaggcaaagaatgggactgtagaaactggtgtggcccagaaagaccagtccccagtaactagtagttaattcttatctgaattgatcgtatgtaagaatggagaccaaaaatctccaaatgttacaattttaagattttaaatttaataaaagccagaactttggatttttatgtgaaccctcctttcccagtttttaaaggttggcaattatttcacaagcttttaaacccactgtgatcaaaataagctacaggaatatgctaaatacaggttaattttaacaatatattaaatttatattgaattttaaaatgatcataggctaaaaatggcctgttacatttggtaaagttaaaagttataagatctacttttaattaatacatgtttatgcaataaaaccctaaaaaaaggaaagcaaaggagtagtgtagtgaacacaaggttatagaatggtaattacacttggtaggggaaggaagggaatgaattattagttattagtatggttttgccttatggtctgaatggagagttactgggtgctattatgttatttaaaataatcaattaaatgaaaactaaataaatgagagcaacacatgaacgtgcaaggaaagtatgccatgaagcaagggctaagttccatgcatattaaatccagttttaaaatatattaaaacatgctaaacatatcgactcttggatgtaccagtggaagtagtcctggaactgccaatttggaacttctgttctaagagaggaacccagccagcaagatgattatgtgagtgagaagttgatgcataagacaaacagaagttcaacagaatgactcaaaaaatgtcacaaagtaatgtctgaataattaccaaattaatatagaggcagttggcactagattataaattagaaaaatttctagtggcttagaaagatgcctgagtataaaaacagtcctggtgtacgaggagtttatatatgaaactttacaaggttgaaatgtctagttgaagaatgaagtcactggatattgaaatagataagatgattgattaataaatggaaatcaattaaaaatttctctttattaccatacctgtaaatattttttaaaactttctcaatgcatcagactgctgttaataatatgagaacaaattgacaacatagagtttgaacttcttggatagaatcaagaaaaaaaatgtgagagaagccactattctttttcttctgaaccgatcacagcaacttctatttctcctttttagactcagtgccatttcggtgatatttgctaatatcactgtattctgctcactgttcaatagatccatgacacagattaactgccctggttggatgcaggatgtattttatatcttctgttgtattgaaaagtcattttaaaatgtcactcattacttccgcttaaaatgatggattcatacagtagaagacaagattaaattgatttagaagtccttatttataagctaataacatcatgtttctaaaaatatgttagattaaaataaaaatatgatttatttttattttagacccattattgattaaagaatttgacacggtgattagtatatagtaagtactcaatgagtagtcagtgaacatatgaattcatgagtatgtgcttggcctttaattgatcctcttaacaagctgatacaaaccaaaaatctttatggctaaacagaaatatatgtgtatgtgctatttttaataggatatgtatataaacacatatacatagtatcttctataattccttatgcccattttcaagaaatattgttagataggatggagggattagtaaggaaaggaagaagaggctacttaaaataaagtaatcccatcacacatctagattttaatgcttattttttatgttctatatggtaagtactttgacatttttcttaccttgaatgcattgcttctaagagcatttgtcaatagtatacaatctccaaaaaatacattttcacatgcaagtaggttaagatactaattttatgtactttcaaagtttgatcttcaagaaatcaaacaataacctaacagtgattttgagctctaaatgtttctaaggaagattgacaaaatgaaagcaaaacaaaaagaatatgatttatttccaaaataagacaaagttttatgagacatagtctttactattcaattcaaatgtattctactctagtatttattaggggaacatgtcagtaaaaactgatttaaaactttatagaactataactttcttatcattcttgcatctcctagctaaaatgaatttcaattcccttttttctgagaattttgcaacaattgttgccattcattagctgtgtgtctttagaatattcacttaatttttctgagcctggatttaatgatttaaaatgtgggcataaataacacttatctatgtcataggcatgttgtatagatttagtaaaatgattcttgaataggtcttaagataatgcctaacatttagaaaattaataacactttattatttctgatattttgattagttccttgtcaagtttttatttatcactaactgtacgtaggtgaatcaactgaaatgttcaaggctgacaattggaagagtctatatcagctctttttatagttacgacggaaatctttggaaatcaggattgataacagtagaactgatagaacttaactaccccacagcagtagtaggaaccactctaataaagataatttattttaccagatgctctcttctctaactttattttcccctcctttatttttagattaagtggtacaaaaattagctaggaatgtccaacatatgttaaatagaactcctcttgtgtgacagaaatatatttcctcatccttatctaggctgaagcattggccttaatttttcagtgccatgcctgcacaggctttagtttttatgccatgtgatgctggctgttttcacccacatggctttaatggcactacaagtatttaggcgtgcaaattgcagtagcaaacatattttataaacattaagggaagattttatgtaattcattaaaatactaacctatgaatatcaacttacagcccccagtaatgtgagtgaagctgtaaaaatgatctctctcattatggataatccccaattttaaaatggcatataaacaatttcaaaactcccggaagtgctctaaatattgtaaaatggatgcgtcataccaatttatctgatgccttactcaatgaggctttaagtctcaacccaatcaagtcacaaaaattattaatctttcaaatacaacaaaaaggtagccatcttttctcttttttcagtatgtttccttttaaattacaattttgttaaatctgattttgctcgcataacttctagtgatgtttgtcatattttatctaacgctgcatagtttacatgcacttatacattatccgtaaggtgttatacttttccacctcatagatgtacccagaaaatgcatctttctttataatgttcatttttaccccaattcgaaggttcctaacaatactaggaagagactaggctcttccaagtatcaggaatctctgactttccaaattccttaatctcaaaattgtcctacaaaatagcaggtatctattaaaggcaagtaaactgagttacagagtaatttgcttaagagtatatagccaataaggagcagcaattggatcagaatctagattttccaaactttgatagacatatctttactgcctggttaacaaaggactgttgactatgctgacatctaaaatggtcctgggattgtggacggtctctttcaaaattaattatattttgatttttgtactttcaaattaaaaatgaaagtaagtagagaatggtcaatgactcagtacgttgaagttagatttgggttcaaattttgtacagctgctggttatccctatgactttggaaagtgatttgatcaactggagtttactcattttccaatgagattaaatgagagaactacagggcttagttacgcataatgactgatacttaagcacaatatataatagccactattattgtaaaaattgaaacatgggaaaacaagattcgatctcagctgttatttaggttctatccctggttctccatgtcactgacttctgcattaccctaagcaaatcttacctctagatattatttttgtcatgtgttacacagatatataaaaccaccgttatagaatccacgttaagataactgattcatggagaggtccttccatccagagaatgttggggtcatggagataactttggaatcccgacccagaaataaaaggtacaaatgaggctgggaagaggtgacaagggagagcgtgttagttatccaaaagactatgtagagataaagggagcctggggatactcttacatccagatgtcacaataacaaagacaaagctctagggtttaaaagtttggactataatttatcctctatcactaattttctgggtagcctcaaaaaatgtcatttaactcctctgagctttaatgctttatttgctcaatgaagatgttgaagtacatgacatgtgactgtggtcacctcaagcactaaggttctatatgtctctacattagatgagggcatcccaaaatatattccatttaacagttaaaaatgttcccatagtgaattgtgcatatgccttgtaccatctaaaatttcctagtaaaaactctgagaatattaaaacactgggaagtccattacaacaagaaaattattaaccattcaattcccaaatcccatagcctccatggaatttgtttaatacacttttataaatactgaaatagacaatataaaagctttgaaaagtatgtttaggtcaaatataagatattattattatcaccattctcattgctgtacaccaccaccatcaacaccactcgtcatcaacatcactatcatcttacatttatgaacacaagttctatatgctgcattgtgaattgtgacatgtaagtttttttctgggttttctttttttttttttttttttttttttttgagacagtctcgctctatagcccaggctgtaatgcactggcatgatttcagctcactgcaacctccaccttgcaggttcaagggattctcatatctcagcctcctgagtagctgggattacaagtatgtgccaccatgcctggctaatatttatattttttgtagagacaggatttcactatgttgtcccggctagtctcaaatttctggcctgaagtgatctgcctgccttggccttccgaagtgctgggaatacaggcatgagtcaccatgcccgcccaacatgtaagatttttagaactcatagactaagatagcatttggaaactgtatacatactcacataccacaaagatgaatgttgatcatgaatttcaatattaactcagtgcgaatgtagaatttaaatattcttagataatggcaattgaaatagaaggcatatgagccatatttcagttaaatttcatttcagttctgaatgagttttacttattctatcttctcatttcttagaataattaataaaatgatatatgaaaaaagatttctattccgtgaatggaaagtatatactggagttgacagtcttataatttaataatacatagggttcaaagcattgtacatccattattttattttatatttgtaacagtcatttaaaagttggcgtgacagatattattttattcattttatgcacaagcacactaaaagtaaaaaaggttaaatgccttcttcaagggtacagataatcttgaattttcaatgatacttaatatttttaactttatagcctattttgttttgctatcattcccttcaattacattatgtctgtaataggcatctatcaaaaaaaaaaaaactggttcatgtgaaagaatgaagatttcaaatgagagtagatcaatgtttcttgagtttatatatataatatatatcacagcacacaaagaaaaatcactgggataggccgggcgcggtagctcacgcctgtaatcccagcactttgggaggccgaggcgggtggatcactaggtcaggagatcgagaccatcctggctaacacggtgaaacctcgtctctactaaaaaatacaaaaaaaaaattagccaggcgcagtggcgggcgcctgtagtcccagctactcgggaggctgaggcaggagaaaggcgtgaacccgggaggcggagttggcagtgagccgagatcacgctactgcactccagcctgggcaatagagaaaaaaaaaaaaaggaagaaaaatcactgggataaatgaaccagcctgcttatggctggtgaggaatggccatgagagtggcaagaggtccatgtctaacacacctgaaacctctttgcaacacaccattgtgttgctgcctatcagctggaaagctctgaaatccataaaaagttgattgatttaaccaaagattagaaggaaactctatcactgtcattttcatagagcaggttttattttgtatggcccattaaaaaatgccctttatttaacatacaatcttaacagacactcaagtcgaatactctatttcaggatctgaactaatctggcttcaaagagaacaaagaaattccatatgcaggaaataaatgtgctcaccaggagtttgttttgttttttctctctgttaatgaaggccatgtcattagtagttatttgttgttgatttttcatctactttagaaaccagtcatttttctctcttatttttattttttatattcaaaattcataaattgtttgagccattgccacttacaactgctcagggattttttaagtggaatgggcagcaagcattttctctaaattcttctcatgaccctaatcactttcttcttattcgtattatatttatttgtatgtatttcacctctttatctagtggaagaatctatgcctgcttcagcgtcagagctctcagagagcttactctaatatcttgcatgtagcatcctaactccatgacccaagccattcatttttggaacacttaatttggaattaatttccaaagcctgtttgttgcaggctctgagaattaaaacaaataataagaagaagatatggttttgtgagtacctaatgtagtgataaaaactaaggttatataacaatttcaacatgttgcaataaatgttaagatttaaaattttttaagcataatgtattcacttgtggtagagaaggagctagtgaggaaacatctcaccaaagaataaaattctgaagttattcttgaaggattcttagatgttcagcaagtacatatggggtgatttcaggagtaggaagaaggaggtttctagcatgtgcctaccttcatgatctaaaagagatataagaaaatcgaagcatttggaatgatctggagaggagatgttacatccaagtagaatgcaaattaggaaattggtggccgtgtattacatactaaaggtcatagtatggtttttcctgttgcacccttgacttgtacagattacataactgaatgtgagcactgcctgacattcttcatgttatatagtaaaagaccgtatgtaatctcaatattcttctctataatcttctagaaaggcaataataattggtattctatctctagctaaggcagaggacatagaaaaaaaaagtcagtggaatatgcttttttcttcgtgcatagaacatgtatggttaaattaaaataaaattattataaaagtaatacatgtcttttattgaaatctcaaataatagtaagtttagtagagtaaaaattgaatgccttcttttacccacagcacatcatcccatgattcatcctttcagaagctaccattagagttttgtatgtgaatttccagacccacttctatgcatttctaaatgtacatgtttcttaacatgataaataaaatctttatatgtaatgtattttctacaatttgtttctctttcacttaattatttgatgtagacaacatcttctacattatgcataggtttatctcactctttttaaccacttcaaagtatctcatagcttggattttttagaatttatttttaaatcccccttgtcttaaaattttgtgccaacctattagactggctaaatagtttcatttcacatggatataggaaagctgtttcatgtgcccaatcattctatggacttacattggggttgtctattctataacacatgctattgttagagtctttaaaactgctccaaaacaagagtttctccctggaatgactacagtattactatacaacttacttagaagctaaactagcttcttaacttagaaagtgctctgggaatatttgcctgggacccatcactttaagatttacctcaatcagaatttcccaactaacttctgtagaatactagtacatcttaatatgtgttcaacccaaagaaattcctttgtcacataataaaattctaccttattttcccttatatactcatggtgcagtgacttatattaaagaccagaaagttcctgtagtaaagatatttatttatctttgtttttaagaggagcgctaagctcccttttaaataatagctatattttattaaatactgctattcacagtttgaaaaccactgatatagatgcttaaatacctcacaaaatgtccattgacattaaaaatagcaaacattgacaaacatccaaatatcacaaaaatatagagcttgaaataaaatcagaaatgtaaggttgttttaagggttaaatgagatgatgtgaagcaatttacatggcatcaagtacatagcaagtattgaaaaaaagtactgacttatggccaggtgtggtggctcacgcctgtaatcccagcactttgggaggccgaggcaggcagatcacaaggtcaggagtttgagatcagcctggccaacatggcaaagccccatctctactataaatatctctactataaataaaaaaaaaaaaattagctggacatcgtggtgcatgcctgtaatcccacctacttgggaggctgaggcaggagaatcacttgaacccaggaggcagaggttgcagtgagccaagatcatgccactgcaccccagcctgggtgacagagcaagactctgtctcaaaaaaaaaataaaaataaaaagtactaatttattactagttccacctggtcatctcataaattcatttattaatttgactcataaaaaatatttaccagtgacccactttgacttcttaaagagtttgaatttaaccctatggcattaagaaacaactggagatctcacaacaagatatgacgtggtcatacttgagttatagaaaaatatctctttctctctctctctcagcagtatggagatttaattgacagaggagagttatgctcccaaaaggtaaagtttaaacctcaaaaagatagtttcttggccaagttatcacaacttaaaagccttggaactcaaacataattgactttgaatccaggcttcactgctcacgactctactggctatattcctgactcttgctataaggaggcccagcactgttatttgaccctcaatatatctgtatctgcagaacaataggccttgttatgttagccattcactccagtaagctagtagtctgcagctttcaaagttctgtaagttatgtgccaggaattaccttagagcaagggaaattcaagttcaacttgaataatacctttagagtcaactgggtagccttgtgtgtgccctacagttggtaatacattgagagttcaggccaagcacatatgctcattatttctgctgctttggactggtaactagtgacagcatttgaaagaacaaaagcagcaagttctgtctgagagccacttgaccttttcaactctacttgacctccactctgtccataggtcctaagtggaatgaatgttactaggaatattattgtctacagcagcattttattttgagattactgaccagacacatttccacccaatagggtgacctgtgctttgtgtaaaaatgctgtgtgtaaagcacagggcaacattgtcacactgggtccacatttgtattctagacaagttggcaagtatatgaaattaattagctaatgtaatcagcaattctggcttgagcttcaagtagccttagaaattagttctaaactagacttccagcacaggaaaataagaaaaataatatttgctccatagctatgggcatacaatttcatttggaatagattcacttctggatgcttgaatatccagttctcatcactgaattttttatcaaaaaataaacaataagttttaactttcaagttcttatacctccggtagcttacacaatgagaactatatacccatatattaaagcgttcatcatttaacttacataggattttatggggacaaaatcgtaaactagaatatactaccagaacatatgtttctaatttctttactttgtagagctgagcctacatgagcatataaatatgagaaactgaactcactattcttgcacttgtcattttcttctgtaaatcaagcagacttttctgcctctaatttacacccacgctctcctccatctattcttttacttcatatatgtggaaaatttttccgtctttcctaagtaaagacttctctttctgctctttgaaattccttctcctttggactggctttcagtcatactgtcttaacataccctgtagagtttttataaaaatagataataggaaaaatgagtaaacgtatttcccaagcccaatcatattgcccattttcgatctctgtaaaaacatagtaagttgttcaatgccatccgcatctcattattttcccccgtatagcagataacctctttgagatcaacattttttcacataaagttttaacccatttggaagactggttttctgcatgttatctaagaggctgagcatgaaggaaaggcttaataaccataaaataaaaatggcagggtcatacaaaggaactgtaacattgctgcacactttcttgctttaactgaaagacaggttatgtcctctgctagctgaaaatccaccaggatcccttagtcttttattatcttctacctagagggggagattatttttttccacctctctgatgacattttcaaaataattcttgttctgtaataacctcttcagggagaaggaaaaaatgcagttgacgcagcctcatgatcatcatgtggcaaatttgcccttcagatttaacaatgacgttgtttttaagccaaagcccagagctagacctctcaaagaaaagatcatttgctctggtttttccctcacatggaaaatcatttcctacccttgcttaatttatgggtttttaattacagagagaagatgaattttttttttctcattcttagatccactatacctatctatgccgatgtttttggttgtcagacatgtacaaagtcaatttgtttcagcagcatgctatttgttaataaaaataaaatgtaataataaataaattaataaataaaaatttcctctttaaaatgagacaaggagaaagcttttttaagatagcaagcatatgtgcaaatatcagctgatatatgaacatatcttggaaccaccaagaagaggatgtcaaatgctatcagttatgcatttaggtagaagacaagtgaaatgtgaaaccatggatgcttaatttaaggtaaattcacctaccacgagatttctggcatagactccaactcatcaagattcataattgagaatcccaaagcaaagagcagagagccatttgcatgcaggttttggagatgaaaaccagtgacaaaggcagaaaaattaatggccaccagagtagcagaacattgggatttgttgctggtgaattacaaaagagacagccgagagcccatgcatcgtctgtggttgtcaaagatttctgcctgggagttcatcaatgttgagtctgtagtcaagaggctgtttttgttgttgttttgtttaccttttgttttgtttacaattctgccttggggtttcttccctggtttggaaacattcccttcacagtcccccattctcatagaattctttctatcctcttgcttcatagagtcataaatacatatttttttcttccaagcagtcatagtgtattatctttctgtggaagtctcttagaatgattactccctttcatatattcccgcttccattactgaagctcttgcttccatgcctcatacactggtgaatatcatagccggcacccatttaatctattctgcctataggtgccatattaatcttcctgtgaaactgtagtggtcatgctttaaagctcaagaatctgcagttatttctaaggcttccttcactaatcaacacatctgttcagcttttagaacctcttattaatatatcctatgtacttcaactgcctgctcctccagatacgttgatgcatttcaagtcttgtatatcatcataaaccattgtgctgtggtctgaattgtgttctctcaaatatgtatgttgaagccctaacctccagtgtgactctatctagaggtagggtctttaggagataattaagattaaatggggtcataagggcggggccttactctagtaggatggtggccttttaagaaggggaagaaagagagatccctttctgtgagaatgttcccatctacaagccagaaagagagacctcagaaggaaccaaatgtccggcattttaatcttaaacttcccagcctctagaactgtgtgaaaataatttttgttgtttaagctacccagtctatggtgtttgctatgacagctcaagctgactactatacattgtcactggtatcattgttactgctctgttaatagctaccatttattgaacataaatccactgaatattcctccattcaaagatatttcttgagcacctgttttgtacaagcctgatactaatttatgggaatacattggcactgataaataaaatcaccatagtccctgttctatgggagagattaaaatgaaacaaatatattatagattatgtatatacacatatatgtgtatatatataagtatatatacatatgtacttacttatatacatatacttatatatatacgtatatatacgtatacacatatatacgtatatatacgtatacatatatacgtatatatacgtatacacatatacgtatatatataagtacatacttatatatatgtatatgtgtatatacatatataagtatacacttatagtatatacttatatatttatacgtatatgtgtatatacatatattacacacgtatataaaatatgtatgtatattatgaatgagctaaatgctgggatgaagaaacacagaattttatgggagcatgtaacaaaaggaccaaatttagcacggaggttcctggaatcttttctgagaaagtttaagctaacacttgaaatttgactgtgaattgaccaggcaacattagaagggccagcagattgaaagagcctgactcaggtgcaggcttgggacacttgaagaatgtaaaaaatgctagtctagctgcagaatattgagagtgcatggagaatggcatgagatggagttggaggaatattcaagtgccagattataaggtagcattttaggcaaaggttgaggttttttatttgtattctaagagcaatgaaaagccattctaagagcaatgaaaaggcttaaagtttagatatgatcttaatagattttcagatttgaaaagactttttgatgactctgtgtaggatgatctaggtgaagaaaaagaaagtaagactcatttaatattttagcctataggccatattggcttacactaggttgcagcaggggaagataaaaagttgaggtttgatttaaaatatatttaagaggaagtcataaaaagatttcatgattgactgtatatgagcacaaggaggtgaagattatcaaaaatgatccctagatgtgtgggctgaacaactagccagatggtggtgctgtttacaaagctagagggaagtaaaggagaaggagtttaggtgggggagctgtgtgatacagggagttcaggtgtggacatactcttcttaggatactggtaagatggtcaaatggagatactgaataggctgctgcatattccagttcggaactcaaagagaggtcaaagtctgaaatattgcctagtgagttggcagaatatacatgcacatgtcatggttgtacatgagattgtatacagagaaagtatacggtgataaaagaagcagataaaacttggcactgagtcccaaaagaaaccaagagtattcaagagataggaagaaaacttttaagattgtagcatcccaggccacaaggagtgaggaatatttccagagagtagtcgtcggtcactttgtcagaaactactatgcggttaagtcataaaaagaagaaaatagctgttaactttaacaacacagagcttctactttagggcagacatcatgcaagaccttttacatctaacttttagtctcacagtgcaataagtaatattgtcatgttgcagatgaagaaatgagcatctgagtgcaaggtcacacattgagaaggagtggaggcaaatctgtgttcacccgggcatgatgctggaaagaagaagccttatactctgtcactgccactagagccttcacctttccctttcttgaactggatttgctgtattgtcactgtttctttgtttgtttgtttgtttgggctttaaaatcaaggccacagaactagtttctgtttattttcttattgctttatgtgtggtagccctgtctctcccattagatttatgagttcactgagggcaagcaccagaccatagtgtagaggaaagaaaatatactttgcaacctgacagacctgggtcatagtttaaaaattataatgtccatgaagtgtctagaggagtgacaggtacagatgatccaagtgttgaatggatgtgacttttattatttctgtatattccttccaaccaagtgcactgcagagagtaagattaaatatttatgtaacttaattgttaggataccatgtgtggtaataaattcttcctcagttaattgttcccatcattattgttaatatagtttaggagtcaattcactctccatatcaaaacttgccttaacctgggactgagaagagaatataaaataagatactgtgcctttccttaaacctgtgcaaatgccatattggaaaactagacccttgaaaatcaccaactactggaggacaacttctgtgatttttctaagctgccttttccatgtacctaatctagcaccagatacatggtatttacacaatacttactaaaaataaataaataaatttgttgttaatgaagaggagatttcttggctcccaaagacattagaagctttttttctgaactacaaaatgtcatgtgctagcatggcatgctaacttcttaactattgctctaaactctattggtaagatagatagttagatacagtttatacacttgcacagtagggtatatctcaccattttttccaaaaatgtcatggggataatatgattttataggttatgtttgacaccaaaagaagctaaaaatgtttcctagactgaagctgaggcttaataaatatttttaccatcatgactcatcaagcttaatatcttggaatactgtgtgagaaatcttatctaaacagtttaatcatgcccaagtgtgtggtagtttgataagatcaagtaatgtagatatttagaaacttctaaattatctgtattcctctcctttcaacctttactagtagagtggaaccatgtgatccaagggtgtggttattttctattatttaagcattgtaaggacataatattttaaagccacttgattctatgttatcctgttgttattttctggcagattttttactcgtaatagctaattcttttgacatagtaacaatagcccctgcattttttgcatcaggtgtagggctctgaaatagtaatactccctccttcttcccatattcctgccaaactcgtctcttcaacattcttaaatgtgtcggtcatactaccttcacctgaaatgtcaccctccccatgcatcctgctgtagaaactcctctcctgtcaaggttcagttccaatactaacccttcaaaaaaggtacacgtagcaggtacttaatagaggcttgagttgagtgtaataacagctggcaattttcttcccaactttatccttcatgtattatttgaaatgcaataagttgggtccatttaaggtctctttctagaatttgggtgcacactgaaagtatattccaggcatcacaaacacaaatgtttatagggacaaggcagttaaaataaattagtatagtgagcctggttgtctgaatataatataggggtggtgggggctatgataaaactaaagtacaaaaagctgtgtacagaagcggcttctgctagttctagctgatttttgccactttgttctgtcattttctcaatgtgtacaaaagtgcccatctctcaatgagaatttgttgaatgagtcactgaatgaatgacttaatgctaaatgagaaaccattgctacgaaacctcctaattttccaatacataagaggaatatgaaatttttattggaaacactctcaatttttaattttgatagtcccctaaaacaaaaggtcttttttgaccaaatagattcacacgctaagcttagcctgagagccagcaggaatgctacctatcctacattcatttttaagaggtaattcatttctaataactttgtaaaggtgtaataatttaaatttgacttccagcttccctccagctggagtcatgaaaaatagtaaaataataatagaaaagataatatgtgggatagataagaattaaattttaacgttttctgaaatattttcatttggatccttacttgatccttacaacggctcagttgaatggaaagaaagtagctttcgcctccattttactgcctttgaatatatccagtctctttactgctgttctgattgaatggcgattatttactgacccattttaaaagcagccccaaagtccatgtagttctcatctttgtacatttagtccaagtgactgaccttagacaacccatagtgagggtgcttttaccttctcagttggtagcttgtaacttgtccatttcgggacaagctatttcagtgggcttcataaaggagacacctgcctggacattcaggaaggctgggttctttagatatggtgctgcataaagcaacccgaaaagaacatcataaagcctgtcctgattatcaatcaccctcctcactgcttcatctggaaaatgtgtctgcctgccaaatacagcaggcccaggaaatcaaaatagaaatgggaaacaaaggaaattagagagagaaatttctcatcagaatgcatccttgtcctgtggagagcagaacgttgcatctgtttgggtcattacctggacattataggtaacaagcttcaattaaaacatgtccaaacatgtatggttagcctgttgtcaaatctggagataagagccctaacacaagcagataagtagcgtataaaagccttgtcttgccactccttaccaaaccctcatttggtttcagaaatatcagtcggctagggaaagtttttatcctctacattcaagacttagaagtgttgaggcccaaacgatcaattttttggctcataatttaaagaggtaaaaatctcgttttgtatggcatagatgaataaatgtgattcaactcaccacctgttgctatatctatctccccccacccccggtttacaacacacacacacacacacacacacacacacacacacacacacacactcattcattcattctacagtatctaggaaaaacatatgaagtggagctgaaaaaatttacaatcacaatctatgtttatttttaggaaaagctcagaatttttcaaagttcactaaaggtgaatttattagtcaaagtacgtacgacatttgggttaagatggggttgttagatttttttgagggcgttgactttttcaaaattgtactggttagactttagctatgctgctgagggggataccccagccagtgaaacagtatagctttatctttaagcctagggctgggaattaagtccttatcattgtatatgtgaagggaaatttgtatttaataatgttttttaaagtatgcaaagttaaagtaattaatgtgccttataaaataagatacctaaatgtaagtaaaagaggttgcagtgggtcctaagtataatttttcaccctctgatctaacacatttgtcactgaaagttcatgtgtaattttcaaatgaacaatatctttacatttactactgataagacgacgttgttcattgaatccaaacttctcttgtaaccattaggatctgtaagagcctgtctgttgctagtttgcagaatgcagctgcagaccacactaggaaagagactgaacttcagggcagggagcagatagcactatcctgagatcaaatcactgtatagaaggccgggcatggtggccctcgcctgtaatcccagccctttgggaggccaaggcaggtggagcacctgaggtcaggagttcgagaccagcctggccaacaaggaaaccccgtctctactaaaaatataaaaaattagctgggtgtggtggcaggcacctgtaatcccagctactcgggaggctgaggcaggagtgtcacttgaacctgggaggcagaggttgcagtgagccgagatcgcgccgttgcactccagcctgggtaacaggagtgaaattccgtctcaaaaaataaaaaataaacatcactgtatagtagatcgccctcaccccatgcctccaaaccttggtccagtttccaaaacaaaatttgttccttgcctgacagctctaagtcctcgagaatctaaatgggctgggtgtaatataatgaaagaaaggaataaaggcattcatccctttattcactccacagagttttaaggacctatgatatatcaggcaatatggtatgcaggagacacaaatcacaaacagatgaactttttgggagatgatggccaggagagaaaatggcaaaggtgtagcaggtgacgcagacaacaagaataaaagcaaagggacagaattgttcattgggagagttacactcattaatgacggaagaatgagtagagtataaaggggagggaaatgagagaagaggatgaaaagtggggtctaaaatttgatttttatactgaaagttaagagcatgtagatcattcttcagttaatggcagaaactacttgctagcaattgtgtactgcactgtctgccattcagttcctgccaaatactcacagtgacaataaaaaaaattgtcacagggatataaacttttttctgtgaaagatcctcatgtgattcttactcatcatacccctttcctgagaagagaaaaaatagtgtaatgaatgtatcaattatctatttattaaatttcatctctctagtaagccaggttacccggaagtcctaaagcatcattacacactttaattcctcatgcagatactatgatgcccttgcctttctccaaggctaatgtacgaaatacatggaaaatgagattaataattatagtattaatagcaataataagtaacatacctattattttatctgacaataatagactttttatgtatgcactactctgttaataagtgtattgtccataacattgtccaaaatgatttgtataaacgttttcacacatagtccttagttccctgtgttcttctattagccataagaaagctacataaccacgatgtttctctctttattgtggatgatgagaagcccagagctgagttctgattcacatggtggccacaaagttttttctacattaaactctctgaacttcagttttcttgtttggaaaatgaaccttataatgataatattaatagcaataataagtaagtcacccattatgttatatgaagataatatactttttaaaaaactttaatataaacagtgtagtgtgtgattatatatgtctgtttaagtaaactataatctattccttagcattgaaggactcaaatcaggacactacctttcagggtggctacatgagctattcaaatactattagtgaaattacaccagaaagcttgccaattagctcaaaagatattagaaatctatatggtaaaatgacaagtgtttaaaatttgtcaatggctagaaaggttgtattgatttcactgctctttcttaaatgaggcactagaatataaaatctcaacaggttcatactttcagaaaagtgttcacagtctggatgcctatttggtaccatgtgtctcatttcatggcctgcagctcaaacactggctggcttcaccttgtttcatctgccttggatataacagaaaaggaatttccattcatagttgttattcttcaagagttctgaggacagaaggtgtgtgttcccttgaatatacaaggagacaatttatgagaatatttgtgtctgcttactaatcaacctttataaaaatgagagtttgctctaagacttgctttcactttaacataatacttggcagcctggagaagtatagaactccacatgcttctgattactaaaggctaaagatatttacaaaacaactagacagttgagggtaatgtcatctcagaagattaaataaaatagccaaaacctttccataaatatttgacatcctgattgcatttgcaaacccatctccgaaaggtaggatattgaaattttttctttcatgtttcttttcttttaataggatattgaaaatttttccttcatgtttcttttcttttaagactgcttcagaaaaaaatcagtttgaatactcttgtaagtctggccctgtcttgagggatttatggattttttcagtctgtttataacctcctgtaaagcttctgaaaccttttggattaatcatcaataaacatttactaagcacttcccagagttcaaggtactcgactagtcacgtgggcttaagagtgttcaaggtagactcagtcactgcctcaggagtcagcaaaatgattctgttctttatccagtaatgagattattttatatgatcgcaacaaggacattcaatccaacaaatgattgagtatgtcccagatataagactcagtgctctccaagggagtgaaagagattgcataaagggcatccgaattaaaagagccatggagaatgtttaccaagcgagtaacccaaggatctactagggtcactctgtcctttggccagtgacaaattaggcttaaccactaatccatgatttctggacaatccaacaccctccccaaagttgctgtgaaatcttgagtgtcattgattccacctcagcctcttctaacctactgccagtaaactaaaaatgatcagttatagatcatctctctatagtgccttttggttcttgttccttctatgtccatttagcctcactccttgatttttgtgtgaaaacacaaggatatttggcacttattagactttcctgagtggtcatttggtcagtaacattacagtgtgtaggaaggggagaaatgtaaaaccaaagaaaaagtaaccaagaagttaaaaccttcacatgccattcattccttcgtagaagtctccagatcctaacctgttttcttgtcttgagcctcacttggaaaatatcttctaatctttgacatctaaatctccaatcatctttcagaaaaaactcctcccatttaatctttccttcgggatccattcctctttttcccaacagtgtaagtctggagtctaagaaattcagtattaattaacgcctgggttaccagccagtcaatctttggaggtattttgttctttaaatcagatacaattttggcttttgttgggaagggggtagacagtatgatgacaaggaggttgaggatgagaaagaggctttgacaatccgagttacgcaaatagtacaaggtaggtcagagctccttgtctagtttccttgaaggtcttctctccataagagctgaagatcttagttattcctctgactgtaagagcaaactcgcacacttcccaaagacaagcagtaagtttttggaggcagattgtcggaagtcccataagataaaacctttgcctagctcccttcttaattagcaagattatctttctcacaatggagtatttcttatcatacaaaacaagatgtgctttttctttatctctcccccaccacaccccacaaaacacacacacacacacacacacacacacacacatattttttacttgagcctttttaagatttagaagcagacctgaataagttattctaatacctggacaaagctttaaagccactgctaataagattttagactgttaataagttcataggcaaggtcttcctcctcctcagctttaatcttgaaggtgaaggaaaaagacaaattatattttattgtacccacaaaacgaaaagaaacagttgcgattaaaggacagaaataggagaattactgacttaagtaaacattaagaaaagaatcaaaaggatcattttagaaaatggcagatgggaaagccagtttgcaaaacattaaggagtgactggctgccggggaattggtgaggttaaaaaccaacagcgcttttgtgagatcttagggtgaaactgagagagaaatggaaaagcagcatgacccatcttatttggttatcaattcaacactttcatgtacatgaagcaatttatttagccaaaacattaaataaatcatctgggggagctttataatttaaattatatctgcatttaacacattacggatgaaaaaaagtctgtgtttctttccaaatctgaatgagatatactgtccccttccagactttatactgaaggactaagaaaccagtctcatggtgggtgcccaaaatgacattacatgaagaggctgaagcatgtgaagtagtgagagaaacttgattcttcttggtatttctacatagccccccaaaagcctgcaacttcaagataaatgacttgaagctggatagtgtggaccctggcaattctgaggaaactctcgtatgccaccaggaaagtaaggactggatcaatttctcatacacagttaaatgcgacctgaccagtggagacacaagtgggtgcccaggtaaaagcagaggcgaaggtctaattccatattcccagatatccagcaaatttttggaagcatatgcaagaaagattaaggctgtgcctttctactgtattcctggaggagctggcaccctgtctgatatttatgcttccttttcagaaacaattgtaggtacttctgacatagaaaaaaaccccgcaatttagtgttctgccaaagttctgagattattaaaaccattttcctaatgtctttattataatacctatcattctgatcatcccacgtgtaacactattgtttcttaagatttctaatgcatcttaatcagacatttggtatcctaaattaaccattattgaggcaatttcatggaggttgtatttctcagaatctttattttaaatagtttattaggtaaatgtctgaaaatactgagcaaactgataaggtaaaaaacatttgtttttattttttgacaaatgaaattgtaagtagttagctagaacatacgatagaattgtttttggttacatcctaatgataggcagaggacataaaggtgtaacatgtttcaaggtaaacagttaaatatgctcgaaagggagcagtagttgtctagagaatatgtggcttaaagcaaatatttttctaaccctcgagagatgttaatgattcctattaataacacagataaatctttgaaataacaagcttttttattcactctagtttttagtaaatgggtttgaagtgctaacagttttgacttttaaaagaatatttggttatttccagatcttctgtgtaacagaatttacatatttacagtagttgaaatatgacctaatagaataccagggaatacaggatccagtgctggaatcgtcactgtggtcatttgatacttagtttaactaaaataaaaattgaattttatatactgctatgtacgtgagacaaaatttaccgatcaagaactatcttgactaagtaattccttattattttaagctagtacttttaggaaaagccatttttaagattcagacccagatcaaatctggtgaaataataaaatgggaactattattactgtagcattgaaaattgagattcaataagtaaaaagtgactactatttgcaggccgctgttattaaattttaaaattctacctctcgcttcttctttctgcctgaacatggcttaatttatcttctaatatgtttaaagccatgcatgcttgtggagggctttgatctttgcttcctctggaaataattttgaaattgcaagattggaacagtcctcaatttctgaacatctgcagcaggatacaatagatataggttacaaaagatgtttgtaagttccaaaaatacatatctgatatattggtggaatgttcacattaatattaagaacaggaaaataaaaggcacatagcaatacatactattgggtgtttgttacccccactttcagatactgtaggaaataactacatttgaataaatacttcagcctgtttccatgaccctatccctaaactgatacgcttcagtattattaaattgggacttaggtcattgttttgtgaggtcacaaagccatataagatataggagaaaattgacacttactgggtgggcagagcaacattgttttgacagtgaaaattaccaatttataattttttaagaaaagcatgcctagcacagaccacctgattaccaagaggaagctgaagaggagattctactagaggtaaggaagagatattgttttcttgactctgttcattaggttcagggtaagcaactctatttaccaagaataagctagctctctttcatttgaaaatatgtctgcccaggtaggcctgcagacataacaatgttaaaaacaggtagctttattgcagcacttatcagtaccttgactattcaaaggtgttaatatgccaggtttcccaaagtaattaatttttatcttacagaatatttgttccatttacatagtttgggaaacacagccataaatgttacagatgctccttgactaatgatggggttgcatttcaataatgccatcataagttgaaaataccgtaaatggaaagtgcatttaatacatctaacctaccaaacatagcttagcctagcctatcttaagcatgttcaaaacacttacattagtctacagaggcaaaatcatctaacaaaaagcctatatatatgataaggtgttgaatatctcatgtaatttattgactaccgtgctgaaagtgaaaaacagaatggttataaggacactcaccattaacattcgcagttgaaaccaccattgcaaagttgaaaaatcataagtggaaccatcctaaattgaggactgtctgtattttcttggatatttcctgaaatatgtttctatgtgtttccatctaatagaaaatggaatataccagcaagcaaaatgtctaaatatttatttcaacccctgcgtggtttcctaaggctgtttaaaccttaaattctaatattaggattggatatgacataattttatagtaaagattggtttagaagtcactaatctaggttttaatctagactctacctaattaactagccatatgaccttggaaaactaatgtcaaccttctgaaccttagtttttcatcttttatatgagagcactaaaatctactttggcaaacttgctggattgttggaaatctcaaataaggtcatggtactgaaacaattttaaaaactctcacatcaagggattatttttatgctctaccagaaattatatgtgtcatttaatgcctgaggataagaaaagactgtaaatatgcataatgaatcaagacagccatattaattttgatatgtctttgtgggaaaatacctatagttctatattattttatctgttttacatgtgggaaaacataaatctgaaaaggaaaatcattacttctggtcttattaggtagaaaggggcattactatctattccagctcctgatttctgggaataaacaaaaacagactttatttgcacatatggtgcctaaactgttctagaaatcatttatctggtaacatttggcaaagtgtcactctacttgttaacatcattagcatagaagaaattgatcactccaattgctctgctaatccatttgactcgaagttagaaatgacactattttctagcaattctgtttgttattctataagcatcattccaaacatttggaggcttcaagtcccctaatataatgttttagatgaactgttaaaaacttggcattggggtaaataaatagtttaatagcacgtttggtctcaaaggaatttacccgcatactatatatatagcagttatttgaaatttggcatagaaatttagttcccaatgtttaaggtctcttggtaagtcaattcaagttatcagaaaaaaatgttggttgccacaatgtatgcaaattattttcaataatgttgtttttaccctctcaagccttcattttagttgtaatttagaatataattgaattattttgttataatttactctacattcactagtactgctttctactattctttttttttttttttttgtgagacagaatgtcgctccgtcgccgaggctggagtgtagtggcgccatctctgcacactacaagctccgcctcccaggttcacgccattctcctgcctcagcctcccaaatagctgggacgacaggcccccgccaccacgcccggctaattttttgtatttttagtagagatggggtttcaccgtgttagccaggatggtcttgatctcctgacctcgtgatccgcccgcctcggcctcccaaagtgctgggattacaggtgtgagccaccacaaacagcttctactattcttaagatttagttctttatgcacagctgcataattctaggtgtttttacaagatattgagtatattgctttacttatcaatctttatttcctcatttttggctctttgcaaaatgggaaaaaaaagggaaaaggtggtgctgaaggtaaaaaaattaaattatctggtttaattaagttcaggcagtaaacttaaaacttctttaaatttaaacttaattctctggttgttttataatcatggctaaagaatatagaagccaaacatacttttaatacccagttacaaaatattttgtagtaaaattaaaatctatgttgtactaaaactaagtatattgcacatcttgcacaagtgatgataattgacacatctttatcactcagagtccctggtgtaccttagggttcattctcggtgttgtacgttctgtgggtttggacaaatatatattgacatatgtacaccattgtagtatcatacagaatagtttcaccgtcctaaaaatctgttgtatctgcctatttctaccttcctcctaatccctggcaatcactgacctttttactgtctccgtagtttggggatttttccaggaagacatataattggaatcacacgatacatagctttttctgattgtcatatttaacttagtgatatgcatttaagtttcctccatgtctttttatggcttgatagcttattttttttttagcactgaataatattcccttgtctggatgcatcacagttgatttatccattcttctactgaaggacatcttgcttacttccaagttttggcaattatgaataaagatactatatctcagtgcaggttttcgtgtggacctaggtttccaactcctttggataaataaaaaggggaaaaatgctggattgtatggtaagagtatgtttagtttggtaagaaacgccaaaatgtctcctaaagtggtggtaccattttgcattcccaccagcaataaaagagggttcctgttgtttcacatcctcaacagcatgtgatgttgtcagtgttctggattttggccattctaatagatatgtagaaataccttattgtggttttacttagcaattccctaatcttttcatatgcttacttaccatttgaacatcttctttagtgaggtgtctatttaagtcttttgttcattttaaaatcatgttgctcattttcttactgttgagctttgaaagttctttgtatattttagataacagttatttatcagatgtgtcatttgcaaatatttctctcagtctgtggcttatcttgttcttctctttaccagatgcttttcttctgttgaaatattagctgtacttttagggggatttgctatatattatttatttaacacctttaaaaacatttgtaatattagacaagcaaaattttattataaggctttaaacatagagttcatctgtgattttttttgccagataaatttatatactagcttgaatatttctagaacagtttctaaatttgttttagatgtgttcattacctagagttaggttttagtagatatcttttaacatattcattatttatttcatgcagaacttgagttagataaattaatctttattcttaaagtttcatagtttgggtaaatggtagtaatatttattgagcatatattatttgctggatgtattttaagtattttatatgaattattttattcagtcctcaaaaccctaggagacagggaatattattttcatccccattttatggatgaggaaatgaggcaaaaagaaagtaaatttctgaatgtcatacaacccatacatgagtggaagagtagtgtccaaatccaagcaatatggttcagcaatgggcttagccattactccacgttactatatgtcatcttccaccttctggaacattaaaattcttgaattgctcttggttgacaatatcctctttagttttccatgtcatggattattttttaaaaatcagtgatttttacaaagattaaattttgaagaaggagctgggtgaaagttatcatttcaattaggctattcttttattaagtgttcacaaattttatagccaaaagttgaataattttgtataactctatgattgggaaaaattatattagttaatgactcaattttgggaattgatgttagaaatttatttttaatctctatattaaagtattatcatttgttatttctagaatagttaaaagccaaatagtgcaatttcagttaaaggaaaattttaaaatgcttatgttaaatgttgtttaatggcttcttagctcatcttataattgttacacttcacttaacatttttctggttttctttagtaattaagtacttcaggcttttccatgccatttaagtaatagtttttacactgttttatattaagaaattaacaagaaaaagacttttttttaaaatgcaagcaaatcatttttcaggcagttaacaggaataggattatatccttcaggaaatttataagtaattttcctatccagtaataaaataaatgagaggaggttgctgaagtgtttcctaatctttcatcttgtcacattaggattcatttaaatgccaaaattcaaaatgtctcatgtgaagaagaaaaaaaatcgcacatgtcaatgaccaaatatacaaggaagaacagtgggtgcatgtatgggaaatttggtttgataagaaaatggtttcattcactgaacatacaatgttgaacaaatgtaattgaaatctaagatacttaaggaaaagatccatatgtacctgaaaatgtcttcctcatagtactctggagctatatttgtaataaatatctgctggtggttcattaagtcaacaaatatgtttagtacctactaattgctagagagtctcctatcctgagctctcaaccacagaagccacgtgccagctttgtgaagcctgcagtctgctagagaagtggggagagatgaacaataaatagatcagcattaaattaataaggtcatttcaggtaattgtaagttatgagaaaataaaacaggatatgatacagaaggactaatggtttatattttagtttttaaattaaatgttaaacacatgaaaaatgttattatttgatactacatttatattatttatttcatgtgtatatcacatatataaaaccaaaacacacggcttcttaaaatctagtgaagaaatcaaacatttaaatcccctatgtacccttctaatctcaactttccccctaccctcacctctagaagttgccaccatttttacttttgtgtttatcacttgcttagtttccctaattattttaccacatatacctgtacctaaatatatagtatcattttgtatgtttaatatattgtataaatgaaagcatactcttgtttaataactgccttttgagggtctacattttgttttagacattcatctatgttgatgcatattcatttgtttttcaatactaggcataataattcactatatgaattcatcagagtgtatttatccattctttcttgattggcatttagtttgcttccagattgtttgtttttctctttaattgccattacagctgatgcagctctgatcctttttgatcacacttttgacctgatacatatgtataagtcgttctcaatgggtatgtgcctaggtgtagtttctgagttaaaaggtatgttagtacaaattttctaaataaattttctggtttgtttcaagcagcagtactgatttacagtagaaatgtgaacttagaagcagaatgctctccacagagaatacaagcaaaggccctgaggtagaatgagcttggcgtattctaggaagagaaagaaagacaaagaactaaaacatagcaagacatctaaaagccaaaaaaagggttaaatcagggcattataggacatttgaaataggaatcaggatgaagaacatataattttatgcacaacactaaattattggtacaaagacatatgcatttatattatatgcgtgttcttgcactgctataaagaaatacctgaggctggataatttataaagaaaagaggtttatttggctcacagttttgcaggctgtacaggaggcatggtgattgcatctgcttctggtgaggcctcaggaaacttacaatcatggtggcaggcaacaggaagccagcatgtcacatggcaagagaaggagcaagacagagaacgaggaggtctcagactgtttgaaacaatgagatctcatgtgaactaattcagtgagaactcactcatcaccacagggatggtgctaaaccattcgtgagggatccactccatcaatccaatcacctcccaccaggccccacctccaatactgggaatcacaatcccagagaataggagaggacatccaaaccatatcaatcagtaatattatttatattaaatagtacataaatactgtttaataaggaatttatgggctactgcagattttatagagcaggaagacaagtgaagccactgttagccacagggaaagttttatttaagaacttcattcaagttatgaaaccaaagtgaagagaatgacagaaaccaaagatgctatgattattatttggtcgtaactttacaattatcacctcgacaaagggcatatctggtctccctcaagatgtcgcctttcataatctctgtattccaagtggaatcagtaattgcatagcctgagcagcagtttttgtgctaaaaagcagccagcaaaaaagacttctattacatgaaagcttagccttctatatttacttcagtttgactttatgacttgctgatggagatttggtgggggggtatacagcatctccccacaatgcactctttggcaaaaccacagagaaatagtctatgtataaaattacggtcagtcacttcaaccttcaatgtgtttattttcttccatcagacacaagtttaggattggttaacaaattcttcatagcaggaattaattactgaataaacaacatctatgaagctgaataatgcaatgttgcttgattaattagtgtaccaattttttttaattttagacttagatgctttcttgcattcttgtttcaattgatagtttttttattattattatactttaagctctgggatacatgtacagagcatgcaggtttgttacataggtatacacgtgacatggtggtttgctgcacccatcaacccatcatctacattaagtatttctcctaatgctatcctcccctagcctcccaccctctgacatgccacagtgtgtgatgttcccctccctgtgtccatgtgttctcattgttcaactcctacttatgagtgagaacatgcagtgtttggttttctgttcctgtgttagtttgctgagaatgatggtttccagcttcatccatgtccctgcaaacaacatgaactcatccttttttatggctgcatagtattccatggtgtatatgtgccacattttctttatccagtctatcattgatgggcatttgggttggtttcaagtctttgctattgtgaatcatgctgcaataaacatacatgtgcatgtgtctttatagtagaatgatttataatcctttgggtatatacccagtaatgggattgctgggtcaaatggtatttctggttctagatccttgaggaatcaccacactgtcttccacaacggctgaactaatttacactcccaccaacagtgtaaaagcattcctatttctccacatcctctccagcatcctttgtttcctgactttttaatgatcgccattctagctggtgtgagatggtatctcattgtggttttgatttgcatttctctaatgaccagtgatgatgagctttttttcatatgtttgttggccacataaatatcttcttttgagaagtgtctgttcatatcctttgcccactttttgatggggtcttgtaaattggtttaagttccttgtagattctggatattagccctttgtcagatggatagattgcaaaaattttctcacattatgtaggtggctgttcactctaatgatagtttcttttgctgtgcagaagctctttagtttaattagatcccatttgtcaattttggcctttgttgctattgcttttggtgttttattcatgaagtctttgcccatgcctatgtcctgaatgatattgcctaggtttttttctagggtttttatggttttaggtcttacatttaagtctttaattcatcttgagttaatttttgtataaggtgtaaggaaggggtccagttttagttttctgcatatggctagccagttttcccaacaccacttattaaatagggaatcctttccccattgcttgtttttgttacctattttgtatttacagaaataagatgtttaagataagacagacggtcaggaacagtgtctcacgcctgtaatcacagcactttgagaggcagaggtgggtggatcatgatgtcaagagaccgagaccatcctggccaacatgatgaaaacccttctctactaaaaatacaaaaattagctgggcttggtggcgcgcacctgtagttccagttactcagaaggctgaggcaggagaattgcttgaatccgggaagcaggggttccggtgagccaagatggcgccactgcactccagcctggtgacagagtgagacttcatctcaaaaaaaagaaaaagaaaaaaaacagataaaatagacaaaatagttaaacaaaaaggcattgaaaaacatatattacacctgctttttaaaaatgaatcatcattcttgtctttgacattgctacttgcattttgcagcacatttgattgtattccaatagaattctcctttttaaaagactagataatgctctgaaagtctaggacatggctatcattcttgattagtaaaattataatacattttaataattttatgcactgtaaggctaacggtgcatatattttaaaagttgtttaaatctaaacttcacttttacctaaaatatcaacaaaacttaattaaatattacaaactccaataggagggagcaatgtgccatagtgcagtagtttaaaactcttttgaccaaatttctgttagaaaaaactattttacatcatgactagtgtgtgtgcacacacttgtgcctgctcacacgcattcacaaaccttgtaactgcatcaaaagtttaagaatcaaaatttactattaatatatgcatgtaccttaatataacctattaatctattctactcttttccttccttccttccttccttccttccttccttccttccttccttccttccttccttcctctctccctccctcccttcctctttctttccttctattcttttacacttctgaagtggttaagaatgttactcggatatacaagacatatgtatagcaaatcatcatgttgtacactttgagtatatacaattgttgtctatcaaatattttaagatttttaaagaagcattgttaggcaagttgttttatctctaggtgtaaaatgaaaatagcaatagcacacacaatatgatttttgtgaggttaaataagataaagtatataatcagcacaatttataaccactaataactgctcaataaatgttaatgatcagcaaacgtgtttttagttttaattttaaagaaaagcaaattattttaaatgtttaaagatcattcaaataaaattctttataaaatatctgacatgaatctttttttttttttttagacggagttttgctcttgttgcccaggctggagttcagtgtcgcgatcttggctcactgcaacctccgcctcccgggtcaaagcgattctcctgcctcagcctcccgagtagctgggattacaggcacccgccactgcgccgggctaatttttgtatttttagtagagacggggtttcaccatcttggccaggctggtctcaaactcctgacctcagggcatccacccgcctctgcctgccaaagtgctgggattacaggcgtgagccactgcgccgggctgacatgaatcttaattacaaagtagacctttaaaaataatttgtaatatatagtataccattcttcttagtagtgtttacataaaacaggtttaagagaagaaaattccgttcataaaagttatacttgaacaagaatgtaaaacatcttttgaagcagaatggaaaacttttgttcaagatggtttatcggtatgtagatacccagtgaatccctgatagctgagattggcctcccccgtcatccccagttatagaaaaagcattctagttacggccggtattttttgttaatgccaaaccacagctaagcctagattacccaggtgaactagggtttgtgtaaggatgtcataggtagcgtctgtaaaagttcccggctccaggagaccaatgaaagtgaggctacctggagtcagagcgcacgggccccacctacaggtctaccgaacaagagcaaattgttgctacgcggtgtaggtccattgttgccagtgcttctgatcttgcaaaggggaatgaaaatctgaatttttgtgtaatggctcatggctttttttttttttttttttttttttttttttgagacagagttttgctctttttgctcaggctggagtgcaaaagagcgatctcggctcactgcaacctccacttcctgggttcaagtgattatcctggctcagcctcccaagtagctgggattacaggcggctgccaccacgcccggctaatttctttatatttttagtagagacagggtttcacatttttaaattctggaaagtaatttttgaaaattaaaaaccgtgtgggccaagcaaaacacattgctcactggatctggccgaaaacgtgctagtttaaaacctgtgatataattcagcctaaagattcacacctgctgaaatcagaggaagaaagggtgtgggaattaattagattattgtgaataagagtttcttaatatatttggaaagacctccacttcaaacactgcatatgaataatacatgataatgacatgaatattattatactttaaacataaatgaactaccacattaaaatagcttctaaatcctcctcttgttcttagttgcagaacaaatttgcatgccccaattaccaacattctggtgtgcattttgcagaagaacacttctacaaaagaatgtgtgtcattcagtgaagaacatggcataacagtttcaagctactaaactgaacaatgaattaactttctcagtgacaaacatgagctgttctccaatttgattaaggagtatgggtattttcccatttgtagatgttgcactgtttttctggtttaaaagaaaagaggtccttagaaaaatgtgttacttgtgaatgtgttaggtttctgttcagttttagtagcttagattacacgtaaaaggggacacaatatgtcctagataatacaatcctacagaagtcatacatttcccagaagaaatgatagggtgttaagtaattacaactctatggtaagtacatctccactttaaaagtgcttaaataaatataaatatacattcccctctgctaatttagaaatacataccaaattgccataaccctatagctacacttgcattttttctctttcctactctcttgcctatctttaaatctgttttcagtaacatataattaatactcagcagcataacccaatttactagcacttaatcgtctcctcctaattaagtatataaatctgtttaataaatacatcatatacacttttgcatgggttagaagaaactttacttgctctaaatctaaatagaattattaaatagaaatcaaaaatagttggccattaaggctctataataactatttgtgtgatttctttccttcatattattcatcaaatgtttacttagcatttactgtgtccctggccctagtatgtgcatgatacagtggtaaagtaaagcatttattacttgtactccacatttccacaattatattattctgctattgcaggccttccacaggcataccaaatgaagtacaaggtattgcagtgtgtcattcaaaacctgttaacaataggacacatttttttcttacattatttcctactcctcttttatgtgtgctaatgttctggtcacatctgattatgttatcaattaggatactttgatttgcaaaacatggtgaacaaggaagttcttagtgggtagaaaagaagttcctaaggcaaaacttcatccaacaggcatgacttcattaagctctcatacatttacatttagtgaggagaaaaaactttcagagtagcattaaacccacctttgatgtcccccaaggtttcattggccagaattgaatcacacagtcataactagccagcactgtggagtaagctaacaatactatctaccaaaaattcttactgtaacccaaacctagccatttctcatctccacctccctccatggcattcctttgaaatgctttcttcttctgacttctgcatgtgttaaaattctacatttcagcagcccactttttcccaaagctttaatatttctctgcttcacaaagaaaagtgacttcagcattctgtacacttaatctgtccctatcttctctaatgtttatgctttgttcaatagttgttagcatgattttctttatttcatatcaaattataaacatccttgaatgtaagggcagctaggttcttattatttatggcctttaaaactatcaccactttatgaaaataatgtagccattaaagaaatattgataaatttaataaaactctaaaatgttaacccaaagatctctaaaaatatttgaagtgatttacaagatatgatagataataataacacagtagagactaaagaaaagaaaattgagtagcatagaaaacctggataagcacatcactgaggttgggtattaaattggtttgagagcttttgaataactaggtgaaaaaaaggaaaacaagctggattaaacagatgttgcattctggtaaagtgtgacttaaaaagtcatattttcctgtaaagaaactcaagatgtgtatattcaatacatggataaattacaccacttattgattcataatctccaacattttactacttttccctgaaagaatcttaaaaacattatttgtccctgtccttatacgctataattggaaattagcaaaccagtcacagtgtagttaccactgtagaagttgccattgcacagctagtaacatggacaatatatagctattcaatagaaacttagttatttctctaaaatatcagaaatatgaccacatagtgggcattattaatattttaagtgtaaatatatactggcacctacaaaaaataattctgcatcctctcttttctgtatcaaagttaatgtatttcagaaaagttgttacaaaaccacaaatatttctagtgcagggtttctcaacttcagcattattgacatgttgtgacaaataaattatatgttgtgggggactctcttgtgcactgtaggatgtttaatagcattactgatctctgcaccttctcagttgtaacaaacaaaaatgtccctaggcgttgccaaatgaatcctatagagtaaaattgcccctatttgagaaccactgtcctagagccaaccctaccttcctagaattacatttggacctgcagttaagcccaaattaagaaagttacacagcataatcgaataagaaaccatatgaatactgaagtctcttatctgatcattgctgcagctatcattaaaggtcatacccattatctagcagagattcaaaaggtaaatattaggaagaaatgataaatcactacttctatttggagcaggaagtacagggatggagagtagaaagccgtaatgttggagaatacagtggcataggaaaacattaaataatcaaagattaagttattgataataaacattcctaaacaaaaattagtcctgtagcatgctggtcattgtagtacaataattacatcaactacgtcctctcaaactagccatactctatctagcaggccatttgtcttaatagcatttttctcattgtggacaccctcctctgcctttgaattatctggttcatagactttttttttcccccaagtctgaaacatctctacagctcacataatcccctctttctcttctatataaatgtgtatacctaacagagtagagctgcgatatcatatattgatgagtggtgtcttttacacatagaaagccaaaaaaaaaatactccttcactttgaaacattggattatataaaattagttaattcctcacttaccctcacttttacaagcttaataacatgtttttgtatagtaccttataaaaaagatgtttattagtgaaaaggttgctatctgttgatgaattgatcaatctgtatttgttaatagtcataatttttactttctaccttcattatctcctaatttcatcagagtatttgaaatagttgctgtaatattgaatatgctgattatgtgcatgatgtttaaaatttcttctgacatctttgccataatatgggcttgcatttctctgaaatgttgaattgtcctgaggcctctaaattagaatgtatttatcttttttaataaagttctaataaaaacgtatgacagacagattaagtttctatgaatctctagaatgtttgttctttgtaaacctttacatagccttctgaaaacttgcacagcttgatacagatttactcagatcattgtgttatgttgatgggtttcctttgtgtaacctagttctacaaagttttctgcattaagcgctgagtgactgatctagaacaaatgtgctgcctgaatcacttgagtattaaatgagacacagatattcctaaagtcttcgaaagagttcctcttttgctcttcgactgatttccacactacagatggacaaaaaaaattattttaaaactccatttctgagttaaaagtttgctgagaaaaaaatatatataccatgaacttccatataccaatttttgaacctcataatgtgaatagaaaaaaataactgttagagaaagaatacagataccaaaacacctttgcgtatctgttctaatatcagaacattatgaaaaggccttacattcaaaagttttcatccagaacaagtctgatatttgtcttcttctgaatttcaaaatataatggtgagaaataaaaatcattaactaaaactttagatttgaagagaagtagagctaaacttttcatctagaattatctcaaatgtaccacataatattcaaataggaaaaaagtttatgtctatatctatatgtctatccttctatatatatgtctatccttctatatacataaatatatcatctaaaccatatttagtgtattttagattcttcacaaggaaaaacaaacagatgttcttaatgtcaaagaaatatttaaagatttaaaaatacaaaaaaacaaacaccgcatgttctcactcataggtgggaattgaacaatgagaacatttggacacaggcaggggaacatcacacaccagggcgtgttgtggggtcaggggagcggggagggatagcattaggagatatacctgatgtaaatgatgagttaatgggtgcagcacaccaacatggcacatgtatacatatgtaacaaacctgcacgctgtgcacatgtaccctagaacttaaagtataataaaaatatatatataaaataaaaaaattaatagtactttgcttattaaacatattaggtttaaaggacatatcatttaggctgacacatagtattcattgagcatcaagtgagtcctataatgttatgtggaaacattttttatttaatctccaactaagaaaaccagatacttaatataacacgataatcctaaaccatccacatctgtcatctattatctgttcagcacctagtatgatgactttttaaagtttatcaaatcattttattcatctacttaaaagtctttactatcttttcatgcacttagaataaaatgtacattccttgcctgtctcttctaaattctgatctagcccttgcctacctttctgactttacttcctgcctcccatctccatcactatgctttgcagacataaaataccagttcaggtcctctacatgggaaaccagcctcttttattgactgatttcataggcttcaaatcttagttcaaatggcacttcttgaagaggcttagctataatatgtcactcccttattcgacttttcctcaacacttcatagaatttaccacaatttataatattgataaattgtgacagttgcattcattggacaatgctcagtatgatgattatactaatgtaagcaaggtaacatttcaaggacaatgttaaactcaattttccttaggtttgaaacaaacgtgaaggtggacatgatattcactttcccacatacatttaaaatacctataggtatagacagatgtagaattttgcttacagagaaaattgcagtgaatatatcatattgtctgtccagaggtcttgagcattatcttggtttctaacatcaaccctacaacttaataatcacatttgtatatatacttatgttttcatgattttaaaacaggaaacatctttgaaatgtttatgattctattgaatttaaattgagttaaagttggctcataattaaaatcacaatatgttatagtataactttttttcaaaaatcagctacatattgagctctgaagattctgaaattggccagttacagtggctcacatccataatcccagaaatttgggaggccacagtgggaggagcgcctaagcccaggagtttgagatcagcctgggaaacataatgagaccttgtctctacaaaaattttttttaagccaaacatggtggtacatgcctgtgctttgagtgaattcagctgaatttctctcctttgacttagttgctatttttccaaacactagccaattcaaaatggctgtgaatttctctatttgtgtattttattgtctttggcattcacaaaagagtgaaccacaatgtaaccaaaataaaatgtaactgtgattcacttccatatgtggttaatggcccatggcaaaattttgatgataattcatctttattgaattatattaggttattatggaatcaggaagacatctagaactatcatcattctttaagaatagcatttttttcttctcaaagttgacgtcagcagaaggcatcctggacagaaaatgaatcaccaaagagtttatgcttcattttataaagaacttcaataccagatttttaaaaataaattttattatttagggtgatagtataaatatacttttaagtgctgtaatggaaaaaataagattgcatttccgtggaagagagtgacaatatttcccatttaatctagggctccctgttctcaaataaattgttccgtaggtgacacaaagtaagtgatttggtcctttctacacaagatttttcacatcaagtttttatgaaggaatattactacaaggaattttactgaaccggaaagtgtaaatgaaggatcattgatgaaatgtgttacaatgagagcaaaatgtgaaatgttgctgaactaaaatgaactttgttttgtctccagggcagtcatgacttaatgaagtacagctataagcaagataagtcagactttgtgcagaaaactgacaatgaaagtgattacataggaaaaatgccccctaagtagattgtgtgtgtgtatatgtagatggttgtgcatatgtttgtatgtatatgtatttatatacatgcatgtgtatttatagtatatatgttgtagataaagatattgtagatagatatatagatattgtagatagatatattgtagatagatatagtatatatagtagatagatataaagattttcattttcattttatattaagatatttatatttaatttatattttatatataatatataatataatatataattatatataatatattatattatatattatatatatttatatattgatataaatatataaaattataataatataatttatatattatttaatataaaatatttatattattttaaatatttaagatgttttatcttaaatatttggaatgcttttgttacacagttgagagatctaaagcccatcattttaacatcaaatagcataacttgcattttttttattaaaaatacttgcccttactatgtcttttctcaaagacaagacgttgatactctaggtggaggctgtttatgtttttttctttcaagagatgcttgacagctgctccctggagaggaactcagactccttaaatttttattaggctacagtatttgaaatttggaaagtagacattagtctttgaggtacagtgtttgatggtatgaatcttttaagctgtagtactgcaagagaagattgcagagattagctacagaccatttgtcaggggagactgaagcattcgtaacaatgtatagtgaaaatatacttgcaaacttttcattagacaatatagggaaatcttattgtgtgtttttcaggtttcaatgttctatcaaataacatagctactaaggttgtaatggagttttttttttcccatttggttctcattttcagacaaaagaaatgtcttcctggctaaagatgccttatattgcagaagtagcatatagcataaattgctttaaaaataagcaagaacatgcaaagtgaataaagaaatatcgaaatgagtagggaaataagggtaccaagaactggagtgtgtatatgctaacgttatttttttgtaattttaaaaaataaaaggcttgtggtgttttcagggagcaaagccaatcttagtgaaatctattttgtaagccttagagcaaggacataaagttattcctttaatttgtttccttacaagtgtttctgtcttcatttataatctagctacaatactttgaaacacctttacataataacataaactgtcaggaggctaaatttaaggcacatattggttattttaagtacctaggctgtgagaagaacatttactacatttaactagttaaggtataaagagcagtggtacaggtcttggtagaaaacgttctttttaaacatataacatcacgccctgcttcttttctactttaacgcatgtatggagtaaaggtggctgaaacttgttatttgctagatagtgactttaggaataccatttaagccagttagctgacttaatactatagtaaatgtttttaactaacagctatttccggaacattgtatttctctgggaaagctatctaggagatatttctggcagggtcagctgggctccccgaagtatgttcagccttgttgcctgtgttttctttttgacctaatgttttgcttcgttttgtttttttaacgctgcccattctcgaaatgaaagtaagacgatgttatttgaatggaacacttggaaacacctttcacgcaatgactctgtataactagtcatttgtcagggaaaagtgagatttttctctaaaattaatagatttgagagtaagattccatatttagtgtatcaaaggtattgttttaagaatgatatgaattttaaaatagtctaatataaaacataagggggttctcacttaaggaggtcttcatatttaagaggtaaagtacagtttgtagtgtgcaaatctgaaaaagtatgatattgataatattaacaaagtctgacttttgcccaaaatttgtgattaatgtcaaaatgtaaaacaaaacattatcaaaaatagcactattgcaaagctacgtggcaagttaattgtaaactacatttactatatttctgcactatagcaacacttactctagaaaatataaatatcccactatcatttgcatagattcattttaaattgcgtgattttaaaaattaaactttgtctttctacatagtcttatttaaggaatatatgtatatttatatatataatataaatgtagaaaaaaatatatgtatatatattccttaaatgaaatgtaaaaggcctgtattttaattacatattacactaatgcaagaatttcaaaggcacttggtgagtggtggacctgaggatgtgtggatgtgttggaggaaaaaacggatgtttcagtgcaaagccaagttgaccaaagtgctgtgaacaagatttttagatcatttatattcaaggatgcttcttaataagatgcttatttaactaaaaacatacacacaaaacccagtgtaactggtaaccttagaacacgtttttccccctctttctcatcattgcgtattagcatattaaggaaaataaacagtgtggtatatttttatatgacatctccacttgtgcttattaataagtattataagtcactattaaatatgattgatgaaaggtttttaaaaaaattcatcaatgggtttagataattcagatattcattttttttaatgtgctttgaatttttctaccaacgatagttgacgtaacccccctccacccaaaaagactaaaaggaaacaaaatgcctaacacaatgatggtcttcagtaaatgttagaaatttgtagtaaagagaatttggacgacatacttgcaatgtctctttaaactctaatgatgctgggaacttttacttgcaaccttaacctcttcgtctgctggaaatagattgtcttgatcatattttcagtgatctcttttccaagcatggggaagaagcaaggaaagagttctgcaaggagattgaaaacagattggggcagagagagataaaagtttagaagcagcatcataagtgtatataagatatttccttaaatctcttcctttccacccttagaacactcactcccactatttttctttaatactttttagtcttaaacatcaaccaggattctaacaccacttacaaaaattacttattttcttctgccttaagtagaaagtacattgtccagcccactagtcccttctattatggagcttctggagggtcgtaagtagaagagagtattggtgacaaatgaaatgctatgtctaaatgactttaagatcggacgaaagaacagcagtatgctttgtgtttacttaccttgttaagtgtgttttcactcactcctcaaatcaattacagtttttagtctccttttattttcatgtgctaaccaataaaatttcacacgtttctcaaatgcgaagaagaaaatttgtgttcaaagactttgtaaagtaatacatttaatatagaatttatttgagcgtgtattccttgaatgcccactacgtatctgaaactataatgtatattatgtggaaataaaatataagtagaaaccaaaccccaaaagtttataaatctgggtgaaagaagagataacatttctaaccatataaacattagagacaatataaaatagaatatcattgaaattccctggaaagtcattgtgatatatagccttactactcagtgttgtctatggatcagaagccccgggcataccttggtgctgttataaatgcagaatctcagaccctgttccaaatctactgggtcagaatttgcattttagcaaaattctcaaggtgtttgtgtgtacattaatgtttgagaaacacttagttggaatagtgttattttgtgtgggtataaatgtattttagagagtgaggggctggaggaggtgataaggggaggcaagacaggatatatgtaccatagtttgaaaaagccattaatcaaacaatcaaggcttagtgtagatgccagttcatcatgtcctggctcctgaactccaccttgttatccaacagtctgcattccttaggcctttcccttcactttctattttaatccaggccatggtaagctccttactactactgagtgcactcaactttttttcagtctcctttttcaaaaattgtgtttttgcagtcttcgagatgtacaaaatgaaaagatacaaaaaaatcttctctggttattagagaagaattctttactgagtaactcctgagtcaactcaggaatagccaggctgctattcatccagtataccctcggtagtattgcatctgttgtaaaatacattcaccagctccctaggaaatggctactaccatagaagcaagactacttactctgaattctggcactttgaaagccaattatgaaataagatatttgtgaggttttttttactcttaatatctatacgtctgtaactaaggttaaattttggtccatttttcaagtgttacttaactacagacaaattagtaaagagccaaatcccaggaaatatcaatttgtgggcaatttttaattgagagaaacatttgaaaaactcagctctaagtataatattctaagtgtcatattatattcactaaacccaacaactaaattttataaaatacaatttgctctgattatacagtcagtaatggatgaaaaagaaaatcaggatctagtaaataggtgggcaatggaaaagagaaagaaagcccaacaaggtaagagattttctaaaagaggtggagagacaaagaaatatttataaagagaagatcacacagaagagaaaaaactgagacaagcagcaagggacaagttccctaggctatgaggctgatgtgttaatcaagttaggcggctggttggattccacagtttatttgtactatagtcatcaaagtaagttatcacctgctatccctaacctttgaaattccaatgagcttttcagcaattatccactagccactgctcttcagctattattattatgcttaaccttcgctaggcatttaacaagatgccatgacagcctccatgggggattgatttcattctcttagttgcagcattaaagccacagcagtatcatttcatgagtacttgaagtgggccagatgaaatcaatttcttacgagattttctttcttatgcaaaatagacattccgtttttaaatatattcctgatttttagcatgaattcttttccttttattcatctctagaacgccaaaataaagacacacaaacacatacacacacacacacatgctctataaacagaagccattacttttttactctttcagtttttatttcaaatagtttcacactcacagaacaattttaaatattatacaaagaaattcatccagattttcaaatgttaaaattttgccacatttacattctatctcgtttggtttttttctcagccatttgtgaagaagttgtagacctgtagatcctgattcctctctcctaaatacatcagcattcctcttcctcccctgcccaaaataggaaatccttttacataaccatagtaatgaataacttaaacttttttttcattattacaaatatttggcattctctaacaatgaatttcttatttacaataaagaatatgtttcttatttagcattgttctttccacaagagcttttcttcagttgctaacatctcatttcttcatattcatccttatacttctgtaaagtattttgtaagagatgactgcaaagcataaaattttgagtgtgaacacttttctttctcctctaaatatttatcttgtctccttcctatataatatataggaatatatattattccaatataataattgtatattttctattataatagttttatcatattgccaatataatagttttattcatccccccaagcatttatcctttgtgttacaatcagttcttttaattattttaaattgtccaattatattattattgaccatagtcactctgttgtactatcaaatactaggtcttattcattctttctaactatttttttgtacccatgaaccatacccacctcctgccctcaacccctctactactctgcccagcctctgataaccatccttctactctctatctccatgttttcaattatattgacttttagatcccaataagtaagtggaaacatgtgatgtttgtctttctatagtcatttctgttttcatagagaaaatattgatcaaactttaaacaacttaataatatagactgtgttttctttaccttttccttttttctatcaagttgcataaagtactgtgaaatcagctccaaatctgtgatggaaaacttctttatgaataatatttagcctaatggatcatagcctagaaatgcaatgacagaaaaaaaaaatcaccatataactgttactcactgaatttcacatgtcagagctacaacatctcccaaaggaaaacattattttatttgcactccagatagaaggagcaaaatatttaattcatgctatgtgcttgtataaaaatttgttttattgtgattcaatattttctatgattgtgttaccaaaacactagggtttagtttacgtcttgctgcttgccacacagaaagctaatcactgagacaactagtattgccagtgaagaaggctttaatcatgtgctgcagccaaggagatgggaaatcagtctcaaatccatctctccgactgactaaaattaggggtttctatagcagggaagaaatccaacaatgtataggaaaagaaggaattaggcaggggtaaggaagaaaggttagtcaacaggaagcaggtagcaagtgatacaatcatgacaggactagcgtctcattttccagttgcagtgatctggtaagtttcagctccttaatactatccacggggtctgatggtagatttcctgagaatggaactgatagaagacaaatgtaactttctcaagttttaagactgggaggatcaatttctatatgtattgaaagaaatcataaatgtcagttctgtggggcaattggactggtctcaattgtgagcctcactttccacctgcttccacaaaagcaggaattctagggttggaagagcttaacatggatggtccaaatcccatctaatataggaatcgtcaccattagctcaacaaacaatgacagttaactcctggggtagttacataaaaatacagccaaaactagttttggacaatttagtttctaaattgaggaacaacctgaccccccagaattctgtactcatgtgtgttagatatgattttttgagcaatataaatgtagttatatcatacctttcacacacaaatagaattaaaaactctcatattcttaggtttttttctccttctctaggctctgtttaatcagttcttctgtctcttactaatatgaaatggtttccagatggtaacgtcattctgtattttgtatcaataaaacatctaggagcaatcagtgtaatccagttatggattgagtttggagggactataacctctcactaatcagaaactattgccattggctcaagtttgagagcagttgcttcacatttttcattcattaatacaatgatcgataaaatcattatgtttgttctgctttttaagagcaactgctatcaactgcattatgtacaattctgtactgtgcaattgatttcttgaatttaatcaagattttatattcattattcattatatatattcattatattccaacagctgaagaagctgttggattgccctcaattagagaatgactatggatcctaaccatgaattagcactaagaaatgagacaagtttaaaacagtcctatgactgttctaccatcttgtgaaatgtgagcttcccatggattcctatctagtgtgttgtcatagcctataattcaaggaagagtcatctgattaaatgaggatgagagaaaagaaaaaaaatcgctttaattctatggctactctctgtcaggcacaggattaggtaaatgaaatatcagtttttattgacacctctgagaggaagatatatacagcctttgtacacagccagatttaaagcctagagacttagactcacatctttagccactactttttagctctgtgttcacaagcaagttccctggatcttcattttaaagtggagaacagatgaaattaagctttacaaagagaattttcattaataagtactgtttatattaaggttattattaactacaggataccactgtctactagactagatttcttttttctaggtagaatcgaaaatattctaagaatacgagcatcaaccttattcttcaggttaggaagttacccactttaaaaattttttctcctttcatgagattcactgcccatggatatttctaaacttaatttctctcattgaacttttgttgtttctttaacatacaaagtaaatttccatgttaactggaacctagaaaacttttgttttcccttgtattacaccttgaaggatttttttagttgttaatgtttcatttaattactcttttccaacttttattttagactcaggggtacatatacatgtttgttacctgggtatattgtgtgatgcttaggtttagagcatgagtgatcccatcaccccggtactgagcatagtacccaacagtttttcaacccttgctttcctccctccccgcaacttccagcagaccccagtgtctctggttaccatctttatgtccacaagtacctgatattttgcttccacttctaattgagaacacacagtatttggttttttgtttctgtcttatttcatttagaataatggccttctgctgcttcaacgttgctgcaaaggaaatgattttgttcttcttaatggctgcataatattccatggcatatatgtaccatgttttcgttatccagtccaccattgatgggcacctgaaactgattccatgtcattgctattgggtatagtgctgcatttaacatacaagtgcatgtgtctttttggtagaatgatttgggcttttaaatatgtatactcagtaatgggattgctgggtcaaatgatacctctgttttaagttctttagaaatctccaatctgcttttcacagtagctgaactaatttacattcccaccaacagtgtacaagtattcccttttctccacagcctcatcagcatctgttgttttttctttttgactttttcataatagccattttggctggtgtgaggtagtgtcttattgtcgttttgatttgcatttctctgatgattattgatgatgataattttgtacgtgtttgttggctacttgtatgtcttcttttgagaggtgtctgttcctgtcttttgcccattttttaatgaaattacttagcttttgcttgttcagttgtttaagttcctggatattagacctttgtcagatgcatagtttacaaatattttctcccattctgtaggctgtttactctcttgatagttttattttcctgtgcaggaactctagcttacttaggtaccacttgtcaatttttggctttgttgcgctttttcttctactattcttacagcttgaggtcttacctttaactctttaatctatctcgagttaatttttgtgtattgcaaaaagtacaggccattttattcttgtgcatatagcttgcaagctaatccagcaatatttattaaatagggagtcatttctttattgcttgtttttgtcaactttgtcgaagcatagatggttgtaggtgtgtggttttacttctgggttctctattctgttccattggtctaagtgtcttgtttttgtaccagtaccatgctgttttggttactgtaggcttatagtatagtttgaagttacatagtgtgatggcgctggctttcccaatgctgtttttttccagtgctgtgtaaaatgacattccaatgctgtgtaaaatgacattggcagtttgataggaatagtattggatctgtagattgctttgggctgtatggatattttgatgatattgattcttccaatccatgagcatagaatgtttttgcttttgtttctgtcatctctgatttcttacagcagtgctttaaaattctcattgtagagatctttagcctctttggttagatgtattcctaggtattttttgtgtgtgtctattgtaaatgggattgcattcttgatttggctcatagctttaatattattggtttatagaaatgctacttatttttgactttttcttttattatttgaatgctttttctttctcttgtctgattcctctggctagcatttccagtactatattgaataggaatggtgagaatggacatccttgtcttgttccatctctcaaggaaaatgctttcagttttttgcccattcagtatgatattggctctggatttggcatagacgtggttcttattttgcggtatgttcctttaaagcctagtttcttgagggtttttatatgaagagattttggattttatctaaagctttttgggcatctgttgagatgatcatatggtttttgtttttaattctgtttacatggtgaatcacatttattgatttgcatatgttgaaccaacctcacatcccaggaatgaagcctacttgatcatggtgaattagctttttgatgtgctgttgaatttaatttgatagtattttgttgaggattttcatgtctatgcctatcggggatattggcctgtagttttctttttccactgtgtctttgcaagctttggtatcatggtgagtctggcctgatacaaagagttacagaggagactctactcctcaagtttctgaaatagtttcagtagaattggtacaggctcttccttatatttctggtaagatttggctggtctgtgaatccatctggtctggggctttcttagttggcaggtttttattactgattctatttcagagctcaatattggtctgttcagtgtttccttcctgattcaatcgtgggagatggtgtgttttcagaaatttatccatttcctgtagattttgtagtttatatgtgtagaggtgttcataatattctctatgaatcttttgtatttctgtgagattggttataatgccacgtttgtcatttctgattgggcttatttggatcttctccttttttttctgctttttattctagttagtaatctatcaatcttatttatcctttcaaagaactttttgtttcactgatatttgtgcagattttgaggtctcaatttcattatgttacattctgattttagttatttcttttcttctgctagctttagagttagttttttcttgtttttctaattccattaggtgatgctaagattattaagttgaggcctttctaactttttgagataggcgtttagcactataaaccttcctcttaacactgctttttctgtatcagagaccttttggtatgttgtgtctctatttttatttcaaagaagtttttgatttctgctttaatttcatcgtttacccaaacggattaagttgtttaatttccatataatggtatggttttgagagatcttccgagtattgatttctatttttacttcaccatggtccaagagtgtggttggtatgattttgatttctttgaatttattgaggcttgctttatggacaaatatgtagtcaatcttggagtattttcggtgtgcagatgaggagaatgtatatcctgtggtttatggttggagtattctgtagatttctattatgtctagttggtcacatttcaagttgaagtccagagtttcactgttagttttctgcctcaatagtctttctaatgctgtcagtggggtgttgaagttccccactactgttgtgttgctggttaagttattttgtaggtctataagtacttttttatgaatacgggtgctctatggttgggtgtgtagatattttgtatagataagtcttctcattgaatataaccttttgttaatatgtaatgcccttctttgtcctttttttactgttgttggtttaatgtctgctttatctgatataagaattgcaacccctactcttttttgttttccttttacataataaacatttctccaaccctttacattgagtccaggggttgtcattacttgtgaaatgggtcttttgaagacagaagaaagatgagtcttgttattttatccaacttgtcactctgtgccttttaagtggggcatttagaccatttacattcaaggttaatattgatatatgaggttttgatcctattgtgaagttgttagctggttgttttgtagtttctattgtgttttattctatttttgctttaaagggtttacaaactatgtatttaagtgtgttttggtggtagcaggtatcatttatttgtttgtatgtttagaacccccttcaggatctcttgtaaggctgttctagtggcaacaaattcccttagagcttggttatattttatttctctttcatttatgaaattagtttggtgggatatgaaattcttgtttggaatgtcttttcttttagaatgcttaaagtattctcgcaatctctcttggcttataaggtttctgctcagaagtctgctgttaccctaatggggttccctttgtatgtgatctgcccccttttttttttttttttaacctagttgcccttaagatttttttttttctttagcattgaccttgggcagtctggtgactatatgccttggtgatattcattttgtgtagtatctcataagtgttcttttcatttcttctatctgaatgtctacctttctagaaagattagagaagtttcttttattattccttcaaatatgtttttcaagttgtttgcttttttctttctctctcagaaatgccaataattaacaggtttgctaactttacaaaatcccatatttctcaaacgctttcctcagtttaaaaatttttttttaaatttttttgtcagattggcttagtttaacagacttgtctttaagcactgaaattattttttctgttttttttccagtctattgataaagttttcaattatattttgaaattccttaagttttttatttcagaaattagtttctcaattccagaaactgagatttatttctttttaagatgtttatctcttccttcatttcctggattgatttagaggatttctctgtgttgattttcaactttgtcttggatctcattgagcttccttgcagccattctttgaattcctctgtcatttctgagtttctaatttggttagggatcattgccagagagctagtacaattctttggtggtgtcactacatttagatttttcgtggtgacagagttcttatgctggtcccttctcatccagagatgctggcacttctaatttttgtaattatttctatgcaagtaggattttcttcttcttctataatattgttttttaattattatttttctttctctttctattttccccctccctaggagatgtgactgtagagaatgctggacagggtcatttggcattgtttttatagctctatgcacatctttcagcaggctttatattggctattgggctgggcagttcatcctacaagcccataaatgtcacttataggtaagagctggctgcagccaatgtgactgggtatatacttgattcttagttatttgcagaagctgtctgttgtctcaggcaatcagctgatttgacgactgtacaatggtctgagctccctgctcagccctaggtggtgtgggcagggagccaaaacaggaggggatgaccggggcacatccacctgcaggttccctgatggcaggcatagtattagcaccaagaaagaagccagtgggtggcctaagacactcagaggtgtgacaaacactcaggagaaacttccttagctccaagttctctgcatggggatagggggtggtctaaactcctaatccaagagagtgagtactccagatgccttgtggacctgactgagtgtggaacagggaaggcctgcctacacaaaaatctccacacaggaggggtggggtgactcagtctgcttcaccaggcttggagcctacctgtcttgaagaatggttggagatctgcctgggcatggagcagagaggggtctctgtacaggaagggtggagtgactcaggctgttggaccaagcaagcaagtgctctgaatgccgagagatattgctgagcatgtagcagagagggtactcctgcacaaggatctctgcacaagaagagtggggaagttcaggctgctgagttaggcaaacaagtgttctgaatgccagaggatctgcctggatatagatcagagaggaccttgatgcaccacatctatgcttaggaagggtgtcgcaacccaggctggtcaaccaggtgatcaggctgctcctaatgcttgaagatctgcttgggcttagaacagagagagtccctctgtaccaagatctgtgcacagtaagggtgaggtggttcaggctgctgaaacaagtgagccagttctctggatgcccgggcatggagcagagagagtcttgctgtaccacaattaatgtggtaggaaggattaagaaggatgggtggctcaggctgctggtacaggcaagcaagtgctccagatgcctgaatttctgcctgggagtagagtagaaagggcctagcttcaccacaatctcagggagacagagtggggcacccagcaatggcacacgcagatcagttccaggtcactaagctggcctgggctacgagtctcaccacccaggagaaactgtagctgtagcagctctcttcttgccccaggcttacaatgggggagagcacaattccagtgcctactgcatctggggaaatgtctgcagcttttcccagtgtctttccctcacagcattttcaagcctctccctaagtaaattccagggcttgggagaggcaaagtcctgtccctcgacctgggttgctcggattcccagtgtaaaggtgagtcacaaagggagcttctctgtctctctcacatactggggcttcactcactttgaacaaccagacaccatcatgggggctgtttgccagtgttttcctctcaagctttggggtatccttcaagattccagtggattcctgttgtctttcttgaattaaagcccacagagttgatctttatgtactatcttgctgttgctaggtggttgaggtgtgctgaaaacctctaatctatcatctttgaaaaaaaaaaaaacttttaagttttgttcaattagtccatcaaacatttcccacctcctacaatctttgataacactttaaaaaaattctaaacaaagcttttctaggaagttttagttttttcaaagctgctttgcttttgtgtctcagtaatggtgtattacagggcccagcagcacatggatgatccactgctgtaatccaccagcagggatccctggctccgtgatggattattgcattacatcatcagcccaagggctgacaggaaagaaagtacttcaaacagtcctccttcgtaaattgttttagtcttaatgaaagaaaagatatggttttgaatgggtatggatgagtagaaaaactgactatacctttcagctctgtattgaattacatacatgtgagagcagctaccaaaatgctcttggttcacaagatggaattttctgttcattttaaacatatggcactagctaatgtgcataacagtgaccacaatgaatataatattccataaaataatgaagagatttttagatcatctgaatcaaagaagaaatttaagtagtattagtataggttttataatatgtgcattttagttcttcaataatgtgtgctattgccctattaagccaaatgtttgtttaaccacatactacatttcatatccttgtcagataacagaattatcgctgaacttgaatgtatccatttacatatttttacatgaaaaatgtgaaatgaaaatttacattcatgtcaagggaaacaaatcacaaactctattaatcgtcttactcaatattttaaatttagtaaggtggtaagtttgttgaaagaatagataggcaaataaattaatagacctttaagttcacttttttctttttaagaaatcagtttcaaatgtacagtgatgttatgtttctgagagtaataaatcaaatatttttgcaaacaaatgaaatacatatcttttaccactctaaaataacttaaaatcaggtgtctaattggttgttattagagaattgtatggaaaacatagatttgaaagaccgaatttttattttaatttgcctacatttctcttctttattaaaagaaattaaatagcatcacgaacaaaattaactataggacaaagcctgttatttctattattgtgaatatgccccttctgcgtcattttccaaatgtaggatttgctcgttaaaaataagtagtggcacactttatgatattggcaaagaaaaacatgatctagaatatgatcttgtaaaatagtttctacccttttctaataactcatttaatgtcttaaagagatctttaatgttgaaaaattaaatattaaagtctttaatttccttctgaggctgctaataaaattgggtaaaatgaattcataagcatttttacagagttgtcataataccagcactacaaatcatatgatagtttggaattttgaatctttaggtattttattacactctacctgtgaaacatttagttatatcaatttaactcttctttaacagtcccacgaccttttcctcgtcaccaatttcccacctctcaccccaagtttgggaccttgagaagctcatgattccacatgtcagggtcaccagcttggatgacaataactatcctcttagtcctccctcagatttttatgtatctgacagattatttattattttggttattataataatcatttcaatatttacttactgagacccaaattctaatataatccttagatagaatttagactcaaatttttggatctttgcatgccaagagttttgttcaaggttttctctatttctccagtttgctaagtatctcttctgaagttctcttgatgtttttaaatttttttaatttgtatgggtttttaaattttcatatgatcatagtcatatgtcatatgtcatagatcatatatctatatgggttacattagatattttgatataggcgtgcagtgcataataatcacattggggtgaatggggtatccatcacttcaagcatttatcctttctgttaccaacaatccaattacactcttagttatttttaaattataattaaattatttttgactatgatcaccctgttgtagtagcaaatactgggtcttattcattctttttaactattttttgtacccactaaccatacctaccctccacttcatattttaaggtcttagttttaagtttttcacccaatttgatgtgatttttgtatgtggcaagagatagaggtctagttttattcttttgcatataggtgtccaattttcccagcaccatctattgaagagtctgtcctttccccagtgtatgttcttggcaccgctggcaaaaacaagttcattgtagatgtatgaatttatttctgggttctctgttattttctactgggtctatgtgtctgttctatgccagtacaatgccaatttggttacaatagctctgcagtataatataaagtcagggaatgtcattcctccagttttgttctttttgcttagaatagctttgactattctgggtcttttgagactccataaaaattgtataactgttttttctatttctgtgaagaatgtcttaggtattgtgatagggattgcattaaatccatagatggctgtgggtagaatggacattttgataacaatttttcttccaatccatgaacatagaatatatttccatatttttgtgtcctctgcaatttcgtgcagcaacaatgtttgaaagtttttattgtagagatctatcacttttgggggtaattcctgtgtatttaattttatttgtagatattgtgtatggtattttttttatctctttttcagatggttggctgttggcatatagaaatgccactgaattttgtttgttgattttgtatcctgcaactttactgaatgtgtttatcagctctagttttttggtggagtcttaggttttttcaaatatgagatcatatcatctgcaaacaagaatggtttgacttattcctttccaatttggatgccctttatttttttctcttatctgattgctctagctaaaacttaagtattatgtcaaataatactggtgaaagcagtcatccttgtcatgttctagatcttagaggaaaggctttcagtttttccgctttcagtgtgatattagctatgtgtctgtctcatataaatctgtcgaatttggattataggagggtatgttccttctatacccaatttttgaggatttttttattatgaagggatatgaattttatgaaatgctttttcagcatcagttgaaatagtcatttggtttttgtccttgattttgttgttatgatgtatcacattgattgatttacatatgttgaaccatccttgcatcactggcataaattccacttggtcacagtgaagatcttttgtgtgtgtgtgtatgtttgtgtgtgtgtgtgtgtgtgtttctcagttctttaatttaatcagcaaaattaattagcactctttccaaagaaaatctacatttttatgttcttttatctaatttctttctttctttctttttaatttccaaagcttattggggaacaggtggtgtttggttacatgagtaagttatttagtggttatttgtgagattttggtgcacccatcacccaagcagtatacactgcacccaattagtggtcttttatccctcacctctttcccactctttcaccctgggtccccaaagtccactgtgtctttcttatgcctttgcatcctcataacttagctcccacatatgagtgagaacatatgatgtttgttattccattcgtgagttacttcacttagaataatagtctccaatctcatccaggtcactgtgaatgccttaattcattcctttttatggctgagtagtaatccattgtatatatataccacagtttctttatacattcattcattgatgggcatttgggttggttccatgtttttgcaagtgtaattgtgctgctaaaaacatgtgtgttcaagtatctttttatataatgactctcttcctctgggtagatacccagtagtgggattgctggatcaaatggtagttctacttttagttgtttaaggaaactccacactgtttttcatagtggttgtactagtttacattcccaccagcagtgtagaagtgttccctattcaccacatccatgccaacatctattttattattattattatttgattatggtcattcttgcaggagtaaggtgatatcgcattgtggttttgattcgcatttccctgatcattagtgatgttgagcattttttcatatgcttgttgaccatttgtatttcttcttctgagaattgtctattcatgtccttagcccactttttgatgggattgtttttttcttgctaatttgtttgagttctttgtagattctgggtattagtccttgatgcatcatcaggttatttaaagttttctctttttttaatatataagcacttatagctgtaaactcctcccttagtacggcttttgctgtgtcccacaggtgattttagaatattgtgtttccatcatcatttgtttcaagaaatttttcaatttccttcttaatttctgaattgacccccaatcattcagaagcatattgtttaatttccatgtgtttgtatagtttataaaattcttcttgttattaatttctagttttatttcattgtggtcagagagatgcttgatattgtttcaatttttttgaatgttttaaaacttgttttgtgacttaacacatagtctatctttgggaatgatccatgtgctgaggagaagaatgtatactctgcagcttttgaaggaatatctattaggttcatatattttatagtacagattaaatctgatgtttctttgctgattttttttgtctggaagatctgtccaatgatgaatgcgggggagtctccagctattattctatgggagtctctttctctcttcaactctaataatatttgctttatatatctgagtgttccagtgttgagtgtgtatatatttacaattattatatccccttgttgaattagcacctttatcattatatagtgacatttttgtctcttcttatagttttgtcttgaaatctattttttcctgaagtaaatatagctactcctgctctttctgggtttccattggcatggaatatctttttccctccgtttattttcagtctatatgtgtctctattgaagttttcttgacctttacattatccaacccctattttagtggcaagaatattgcatggaaaactgtcattcaaattctactcctagaaccctctgatatctgttgattccatctcacacacactgagtgctatagcatttataaagtaccttaatgtgtaattatttttaaaaatttgtgaggtacaatttttttcaccattttcagaatgaggaaaattagactcagaggagattaaaagatttccccacggtaacatgatcctggtatttagttaagagctacaccaatcctgtaggtctttatgctagagatatcacagtaccttcctaataactcttccaggctcattactggcatgatttccatctagaatatcttcaggatatttctctcttcacatttatagtacaaatattagatttgtccttctcattcaccacaaagagcatatgtttttcatattaaatctgcctacttaaacataaacaactcaaaacatacacaattgggaggacttttgtacttaatatccatccatgagttctgttttcaggtcaggtttctggccctgaaatcaggcttgttgaatactttattttactatgtaatttacaagtcatgttgggaagttggaccctataattatatgtatttttagtgcaaaatatcatcaatcttttacctttagaacacctaatttagatctaatgaaatatatttaaatgaaatgtagaaagtactcaaacaagtctccccaattctgttacctataccaatatttaggatttttacaataaaaatcttcaaaaagtattaaatttttactgtcattggttaattctagttttttatagatgcaaaaaaaaatcatcagtggtatttttaaaagttccagccataatgtatgttgcaacagaactttgcatttacagtaaacagcttttctgcaggccatcagtggtgagactccctttctctactaagcagactgcctccttggaaaagagagagccattttagcttagcgcttcagttcagttttgttttgttttgttttgttttgtttttctagaaggatgtaaattgttctgtttgttcaaatgcagaacagtgaatgaacagtgaatagtaactttgtagtagagattgctgtccaaagggaacaggggaaagaaacgtcattttaattgaactcaaaaatcaagagtgtatctttaaatacaattgcatgtatgcaacaacgcaaacacttacacagttaatatcatttggcttcatctttagtcataatttatattcattacatatgggtaatgggtatgacttacctcaactgaaaggaacaagtaggggctgcctcaattttaatgactctgagttaatctacacatacttgtaactgtgcagtgctaagttgtgtagaacacatcaaataaagagttacctggttcagcgtagcataggagatgtttataatctgacaaattgaacatttaattttaaataaggctatcataaaactaagttaatgatttagaagagaaaatatacaaatattatttatgtgctcctagctgtgcacaatactcaaaatttggaaactatctcagagatttgggctgtatagacattctaattcaacaataaacattttcttattaaaatattcatggaaaagttttgaaaagatatatggtaacccattatttttctctaacagagggtattataggtactttttctcttctttctacatttttatttttctcaatttcctatgctgagtacttatttcatgagctttgaaaagcttcttcagaaaatcactagagatcaaaattgtaatatttacttaaatgtttaatgttaattaatattctgattagaagcgatgaccatattgtttggcaataaattctgcttgattcctctgtttggaagctccattattagttttacattaagtatatattacatataataaaagtgaaggaataactaattataagtcagtgtcttcagcaaggaagaacattagttaaatttatggaatagagttcttttcagtttaacagttaagagtaattgtcatttggacgccaactaaagaactgttcctagattagcaagtcctagtataaagaaaaatatgagattcttatattcaattatatatgcatatagtcaaaatacaattatttactcatggcctttcattatgttatattctccttaagaaatatgagtggtcttgacaatagacataaaagcatagtcataattaataaatttttgatttattcttcatgttggaattagtctttcaccataatgtaacaacagcctagacagcaatactgccccggatgtacctgcctcatcatgggaaggcagaagagtgaagtgataagagcatcagttccagggtcgggtgtgagatgaattcttagctgtcccactcactagctttctaaaattgggcaagctctttaatctctctttgcctccgtttcttgatctgtgaagtaggaacaaaaaaaggtaaagtggcttaatagtgcttggcacagtaggaagttcatgacaaagtttaactatttagaagaataagtgggaaggaatgcacactatctagtgaactagggcagaagctttttctcttgatttattcagataactgaccccagaagtatgctttctgttttcatttgagttatagtcataattttcgctattcccaatacagtgtgtgtagtcagcctaggtgttattcaatagacctgttccaacatctactgtgattgatttatttagaaatacctccaggccaaaatgagaatgaaaataaatggaacagatgaaagtgccctgctgcaagcaagagctacagattgaggttaagagtaattgctttggcataattgttatttgtaatcttagaacaaatgcaaatctcccattaggagcagtaaatccggtgcttaaagtagaagatgagtatttcactgcctagcaatgggaagccataactgaatgctaagtgcaacgacataaaaatttcctcaggcctttcattcagactaataatgcagggaatatggtggacacaggagtaccttcagaaaaatgaatatcaaagatgatttatttctcctgtgtattttttttccaagatacattaaaaaaactttgtctttagatttataaattcgtgctgtgctctgcttcataaatactttatatttatactgagcctgacttccagaaagcctgatgtgctttttatggttattagtctttacaccttcattactgaagtagataataaggtgaagatattagctttactttaaagagataagaatagaggcatataggaggtcagtgactttctcaaggttatgaaatcattctgtggtaaaaagaatacatgattcaaattcattttaactaccacatcatcttttttcagattactttttaagtcagtagttattattaccagtgaaattatgataatcatattgatgagccaaaggttgtcattagatttctcaaatatccaacaattcctgggccaagattactacataagaaatgttgtatttatttttaaatgaattgtttgccttagaatagaatactattttaaactattaagttaaagcctagataagattaaattgagttcttggccacacagcaggttatcttattatcttgatttaaaaaaaataaatgaaattccaaggtccatgtgtacctgtagaaatatttagaaatgtaagtagttgaagaaaagagtagataggtaaagttgaatatgtgtgtttgagaaagtgaagggcacaataggatagaaaatatattgcagtattgcaatagaataatgaaaaacatcagtattcagacagcttctgatgtatacatagctgaggtcaaatatcaagcggattttttttgtctcccagactgagatcacaccgccttaatattgtttgttagatattggcagggaaaaagtttagtatggtataaatgtattttttaacttaaattatttcatagatttttaaagaattccatgttaactctggagaggaaggagtacaatatgtagtctgttgcaaaaccagagtagtatatattttagataaatgggtatttttgaactctagaaaaattgaatatttctgggggttattaccccaagactgaaatccaaatgtcatctcagctttctcacaaggcccttaatagttgaagaatagaactttaatttaaaatccatctctaagaagcagcatccacaagactaccctctgataaactttttaacctgtgacctgttcctatagatctcatatggtgatacgttttgatctgtgatcctagttaatcgttaatggtgccccggatttcgagggacattctttgcaaaacagtgatagaattatagcaatataatcccaagctggttcagtaagactgtctatttttctttagtaaaataaaagagctgtcaagcactatttatgcccctagctgctatttctgtaacagtcccttccttcaacttgctaaggaggcgaaagagtcacagaagagttacaaatgaaagaaaaattaaacacaatacaaaagtgagagtgccttttagcctacattagggaggtgggagtaaagtatcaaggacacagatatcaccttcaatggttccctcacaaaaacaaatggccagtaattcggagctttgtagcttcctcactttctgtctctttcctgtaggctacaatgtgttgtccaattttagtgtgagactgacctagacaaataattgtatttagataacaaagtgaataaacaagtgcaattttgtttttgagctgtttctagagaaatgtcatgtaattattgcaaaagcaaatgtggaatttagaaatattttaatggtacaaatggctttaatgaggggcaaaggttgctagtctcttctctcttaaagccagttctgagttattaatgacttatatatattaagcaagtttggggaaacaattcacttttgacttcattattttaaagataataactctcacttttaccactaattatctacttatttcagtaattaggaattcagttaattctttggagatgatagatgtgttcttgtgtgtctactctgtgccaagcatgatcaactgaaatgcttatataaatgagtaagataaacattttaacttcccacagatcacaatcaagtagaagacttagactttaaagaaggaaagataaatgcatgaaaaatgaggtacaaacaatgtatagaactatagacaggagagaatggatatggacttgcttctttgggggaaaaaaaagaggtatttaaatcagttttgaaagattattaagattctaacaagtgattggaatgcagagaaatcagatgtaaatttgatttacatcactgcaggcaaagagcaggggtaacactaaattgccatgttctccatgtcagagacctgtgttgcagaaaatactgtgtaccttgatctgaaataaccacatccgggacactttagtattgtcctgtattcttttcagaatatcagaactcctcctggccctgcatactgctgtcacatggaataatataaattcatcaaataaatcatatatgtccacactctcaggccttctgtacctacctgtgtcttttatgtccataagtctgctttctccctgcctttttatccacagaacatacctacatttacctggctatttattaggctttaatgactcattgtgggagttctgtcttctgagaagcattgtccgatgctaccatctcaagtttaaattaagtacccctcctcaggggcacagagcccatcgctgttacctctatcacagcacttacttcatgctctctcaatccacaggtttttcagatctcctcctttagactataatcttctgatagcaaagacaataatatcaaacacctggaagagagcctgccctgcagaagaccctgattcaattaatatttgttgactgggaaacattcagatataaaaatgtagaaaaaatgtctatagtcagccgggctcagtggcttaaacctgtaatcccagcattttgggaagccaaggcaggcatatggcttgagcccaggacttcaagaccagcctgggcaacatggtgaaaccctgtctctccaaaaaataaaaatacacacacacacacacacacacacacacatatgtatgtacacacaaaacttagccagcatggcggcatgtgcctgtagtcccagctacttgggatgctgaggtgggaaaatcacatgagcccagggaggtcaaggctgcagtgagccatgacagcaccactgcactccagcctgggcaacagattgagacttggtgtcaaaaaaaaaaaaaaaaaaaaaaaaagaatgtctccgaataaacttggactatcattttcattgtgcagcaaaatgagtaggtgattgtacacacctaacccatacattctgtacttgtctctccccttcacttttcatatccttaattagcagagcctaccaatctttttttctaaatatattttttattatttccacttccattttatctccactatcattgccttaatataggacttcatttttcacttggacaatattgcaataacctcttaactcgtctcccagttgcaataaatgtctattaaatttaagtggttgaaatgcttaaagtaacactccctattttgaaaataaatcaactagcaagtacctgctgcccacctacaatatgttccaaacttattatgtgctatgagggagtcaggagaagcagagcatacaaacttccactttacccccaggacactataatgtgggcatggagaactgaaactgtgcttctcaaagtacatgatgcatgcaagtcacctagggatgttactaaaatactgattcagtaggtcttgggtaaggcctgagattttgcatttctaacaaatccccaggagacgtgggtgccactggtctgtaggccatcctttgagtgaaaaaatattaaaatccattaaataccatatgacatacctcatagtgaagattctaagtgcaggcagacttcatgaaagtagtaaatgatacaatggaaaactctccatgtaagagaagaatggacactgagaaaatgcaagcccattccctgttcctactcagcttataagatgactcacttctcatcttctctctaaagcctttctgacacaatctcaccttcctggcacaatctcacattgccgctgtctctctacccctttctattcatgctctaaagtattaatacattcagaaagatctttctaaaatacaaaaccgactttgccactcttaggcttaaagttctttaattcctatcacctgccatttaaattccacaatggaaggcccttcccaattggcccctttcctgactctctagactcaatttccaccacttctaccacatgtcacctgcattcgcccagcttcaccacactctttcttacctctgcttgtcataggccattgcctgtgcctggcacctcccgtccccattgtctactaggcaacagtgcatccattcttactggaagctcaaaagttccctcctccacagggcctgccttctcctgccaggcagagttatgtatttcaacgcctttttgagtccatagcatataaaacattattgagttctatttatctctactgatttcagtactcccaagagagcccctattttgcaaggatctgaatctcatctttctttataccttctacccatattcaagatgtgaaagatgttttaataactgttggttaaaagaaaaaataaataaataaatccgaactagctatttactcaaacatccctttttaccaagaaataatttatgatggcactaataaacaaaaccaatgtgttctgtgatgagatttcagtacacaacagaagtaaatgttagggtgaagggaaaggagaaaaagaagacagaggaagaaaatgctaagaaacactgcaatgaggaaaatagatatttactacttacatgttaagtcttttctgagaacacacatgtgcacacatacacaacattcataatttaaactgccctaaaaagtccaaccaaattttagctcattcccagaaagcagtagacaagacaggaaagtgtgttaatactccttcttttccagtcattattcacctaggtactggaagttgtgtctcagatattggattgaatggaaatgaaagagggtctcttggtgagagcagtcaatgttcctcctatttacagatggcatggctgtgcttacggacaatgtatgtgaattattatttttcagttgaaagcaaaactcaaccatgaatttcagggagcaattaaaagataatcctgaatacaaataaatcatgccccacaactcataagaaagccacataaatggtcatttggtaaaagagaaggatatctttagaattttctttagaacattgctcaataaagaaatacaaaagtcaataacactagacaaaaaatatgcagtaaaaccaatgaaatatttaaaagactgtcatttatactgaaaaaaatagaccatcaacattattgttactcagaaatctcacattcttaatataaaagaaacttggcaatgagtaaaatgattaaaaattattcagtgtgtcaaaaaacactcagccaaatattaatgtaaatagaaatatcaataaaaaagtactcattataaataataatgtcacattacataaagattaacttcagtattacatcaaatcattcttctaaagctatttatattaaatgtcatttaattctcccaaaattttaatacttttctatatcatcttttgtgtccatatttttaatccccagataaaaagtgagtgcctaccaggttataagttcaatatgtgttgaagctgaataaaagtgagttatcatcagccactatatcgatcagtcagccatattttccagagcatctgcctacatgctcagcactgctctgagagaaatagaagaaacagggagcctgaagttggtctcctttcctgggcattaaggtgtagtcaggagacaatactaaatgctaacagtgggatcagtgagaaacggtggaagctagtttataagctatatcatgtagttcatgataaaattgctgtataggattcagagtagaaaagttctacccagacatggtctcatgagttggggatggaaagattaaaaagatgtccaaagtagcaggcatggagtgaagtccagagtggacagatctgaggagatgttgcactcttcagattcaggaaaaaatatgaccacagatccaagggcaggaataataatgcacagccgggcccttgtaacacaactaatataggaatgggaccctatagagctgcaactgcacagcctgcacagtatgcaaaggccctgctatacagctttctcaacctgttgtgctgtttttggcttccttgaacccacttgattccatcctttgagactcaaatgttattgtctctgtgaagcctttccctttcccaaccttccgtcacactctacatgtattaacaatttatccatatgccataattacatatcaataattgcatgtaatctttatcccaccagttcactcctcctcatcccacacattgtctaaatcagcagtgaccaacagaactttctgtgattatagaaatataatatctgcactgtccaaaacaagatcctctagacaaatacggccactgaacgcttgaaatgtggctgatgtgacagagaattcaattttatttattttagatttaaattaaaatttaaataacagcatctggctagtggctactgtactggacatatggttttatactatgaacttcttgaaggcaagaatgatgtattagcatccatatactttagtatagtcaatcatagtatgtactcagtaaagttttgttgaataaatggccaaatatgaatgaatcttagtatatagttgacaaagtaatgaatataaagatcagacatatgaaaaagtaacaaatttaatggtgtctaaagataattattgaaagatgagaagagaaatagtgtgatttgaatgtagtctgctttttaaaaaaatgtcagtaaaggtaccctaaaatagaaattaaccaaaaaaaaacaaaaacaaaaaacctgttgaaatgctgatactctatcttctttatatgtttatgttttgcactaactttttccactattttatactgtcttaattatatctaagtcttcaaacactagactgtgacctccttgaagcaggtacttttattcccactgtgtacccagttccaaatgtaagcttagaccacaataggtacccaataaattttacagggagagtgaaatgagtgataagacaggaaataaactattttaataaaactagcagagttgatgttcagaaagaaaagatagctgttagaaaacatcctaagtgactgtgaacaataaggcattctgcaacatctacttcatgtgtgcatttatgccttgtgtttgagaaacctgtgttatttcaaataatgttttcctaaaacaaacatgactgtcttattctccctgtctcctacctgccattctataaagtcccattgcttttagctttaaatttggtttcagcctctttgactcttttactattttcttttagtatttccattaccttaaaagagtgagtacagttgtcttcactttctcgtggtagaaagttaacagtatagaagtatgaaaatgtcaccaaagactaatcagaacaaattgcaagagtttttcctaatgtctctgcttcagacctaccatgtagattagcatatcagatttatcattctgatacatcagagtctggtttatatttgccagccagtgtcacttctcagagcactgttttttactctgagtcagaacaggtttctgtgatatctcccttaagaaatgccaagtttggccaccatctatatctttttccctttccctgggtagctcagaaatcaataaaagagcaggtttatgattgctgatgcttaaattatacttgtcattctaaagatatttattgcacacttactatgcaaaactgtgttctaagtgctttaaaggaaattgagatgaatcatgcatgaacctgacctccaagaatatggtcatcactgaaagataagatacaggtataatagataaaaagtagcaattgctaagtacaattatccctccatatctgagtgggattagttctagaactccctccagatactacattgccatgatgctcaagtcccttatataaatggcatattatttgcatataacctatacacatcctgtatactttatattatctctagattatttataataccgaatacaatgtgagtactatgtaaataattgttatactttattttctatttgtattatttttattgttgtattattattttttatttattcattttttggaaattttcaatcaatgattggtagaattcacagatgaagaaccctcagatatgggggtcctactgtagagcatatggatttagagcagccttggatttgtattttgacccccatattaggagttacatgacattaaacaaaatacattaacctctctgtgctttactttcctcttttgcaaaataataccaggttttgtctctggattattgacttataatctggatgaacccaaaacccctggtggaggatgagagagaccaagcatgtcaataccttaacattgttttgtccctggcacacacatgaaaatgcttagccaatgcctgattataagcaaaatgctttcagagtttagagagataatgcttttgctgtatggatgacgtggattctgtctgaaactgaaagattgttggatttagacatagaaaatgcaaagtcaaaatctgaaaagaagagtatcaactatccacaataattcacaaggccaggagatcggaaattattaattttcttcacaattatgtttattgaaacattgtctaaaatctatgaagtaccatgctaggtgccttagggaagaatggcacaaaataaatggtctctactctcacaggagtcattgaactagtagaggttcctgggggaatcacgccacctttaacctacagcatgtttttctcattggtagaagtaatattgtgggtttgttgggagggtggactgctagatgtcagggactgtgttttagttaactttgcctccacgttaagcacaactcttagcacatagtaagtactcattacatgtttattgaatgaatcaatcaacatattttgcatgaatatgttctagtgcttacccaatagtaaaattaagacttttataataattcttaaaaatagctacttgagttctacactgttaatacctaaatgatgtttatcaaagagtgtagcgcttcaaaggcaaacttaacaactgctgaatgattttaatcatgaaataacattcatgataatattaccacatttgtgtaacactttatacccttctaaaaacgtcttttggataattttcctggcttttggtttttgtaatttgtacgtttatgaaatgtgatatgtttgaatttgagtaaactctgctcacctagaatgtttagacaaatgaaaaagtataaaataataaccaataatagtaaaaatcataacattgatgacaaaaccaggagcttccattcactgcgcagttgctgtgttccagagcctaactaccagtgctttacaggtgtcctcttatttagtcctcacaataatcctacttaacaggaactactgcaagttccctgctacagtgaaggaaacccagagttataaatcttagaaagaatgtcaaagatcataaagcaaagaaatagcaagaccaggattgaaacccaagtttgtcttctcccaaagtccaggctcttcacaccctactactaaactgctacctactcctaaataatgacaacagagactatttataaactcaccctttttttccaggtattagacctttagggaatcatttatcctcaaaataacactagaagaatataggttttgatattctattttccagatgagaaaactgaagcttaaagaatcttggctgcttgcccatgtttacagaactagccatggcaaatagagaatagacccaaatttatttaagaggcaacagggtccttaatcactatcttctatcaatggtaattaagtgttttggttaggaaaaaaatcattgtatttagagtaagttcttaccatagttaaaatgaaataatgtacttacacttaacattaaagtcacaccaaatataatttcctcttttcacaatgattagaaaggcacttcagaatcttgaagtgcctcattatcatgcacataattagcatataataatatttttaaagggtgggtgtttgaacctttggaccatttagcttctggacatgtgggagtttgtttttaatgttttcctttactaaacaatttctagctaaattatctggaaatcaggtctgaatgaaagacgcagagcaaagtatactcttaacccaacccctatgccctcagatgagagaaataaacccatctttcctcagtggatagaagaattatggaagaaggtgagcatagctccagtgttttcaacatcttaagttactcatcaacatctatttcatttcattaataatgaattcaaccaccaaccaatttgagtaattgtcagtaatcagagaatgtttccccaaccttcaaatctatgtcatggaagtgaaaatttccctagcgccataacagaggagaaaatcttaagttatataatgtgaaaatatttgccattttatttgaggtactgggatataaattatatatatgtccatcattcttcagcatgtttccaaatctgcagtgtattgtattttttgcaactaatagaactcattacactaatagtctagtattatgtaaatgcattttatccaaatatctagtatccataagtagtttgttctctatatccctaatgtaatatatcaaacaataactcatttgtcaaagggagacagttcattaaaattcaacaactgtttggccaggataaaacagcaacagtataaaaattgatgttgcaaaacttaacaaatgagggaataagggaagtgagaataaggaaattgcaggcctgccctccagggccatttttgggccacttgtctgaattttaatattacaattgttttacaaaaagtctccaagttattaggctgggagggaagccaatttacagctaggtgacttgaatatcaggggcattcaataaatgagaacatgatatcacttaggacatagagtggaaaaggtacaacacttgagcactgtgctacaattcagtttttaaaagtgagttattatatgacttagcacatatcatcccttgttgagttgtatttaagtagcatagtgaataagagttttagactgttttgtttgtgttttcaaatgtagtatttgctccatatttttttaaagcaaaataccaagcatagaaatagcacctaccagaggtttagataatttgaaaagcaaagaacatgaacctgttgatgagctgacacccattctatcgcaaaacagttttaggaaaggtgaaaaaaataaaaacatgcaatttttgaaggtgcctggagaagtacatttatcatttgggatgtatctatgaaatctgcttaaaattaaaaataaaagatttttaaatatttttaaaattaaacttattagacttattgtaaaaatattacacttattgatacaactatgttcactgaaatcactttattcaaaaattactatattaacatatgcatgtatattaaaatattagacttattgatataactatgttcatcaaaattgccttattcaaaaattactatattaacatatgcatgtatatacatttaagagggaaagttctttatgtttacatgcaagtgctgctttgtacttatacattatttacttattagctgtatataacttaactgaataacttctcatcactttaatattacctacatacttctagaactttttgtttctaaacaagtttttctccatatggtgttatcaaggaacatcatgtttgactcttcatatagccaacaaaaaccctgattttcaagaaatctgtctttccaaaggcaaatacgaagggtttgactgggggccgagatctcttatagctgaggttttatactattctctcctctttctaatggcagtagtgtgtgcgtgtgtgtgtgtgtgcgtgtaactttcattttcccacatgcacccaatgtattaaatttattctttcagttagcagaagcctttccataggataaaaatgacaagcattatgaaaggcattcaaagttcccaggcttcttaggcccattcgaggatcaagtattccttcaaaatccactttcaagattccacaagtttattgcaagatattcatatgtaaattaacagacctgtgtagtgatctccctaacatatttttgctctatcaaagttctacttgctgttagaaagtagcagttaatgtcacaactactgttctgttatgcatgcgagggaatcaaagtacagtaatcaaagtacagtagataattattttttagtacatagtagagtggtataactaagctttcttttaagctgttagtcaaattacacagctaataagcaaaagacaaacgagcaaagctatatttgctacactgtttgtctcttaacggagatcaaagaatgaagctggtttgcaactctgtgacctgtcattctgtgaaaagtgtgtctctcgccaaaaatgaaactacaaatcacatgctgtttgatggtgtgcctgtgcttgtgtgaacaggccaccacattcaagctatgaagaagctgctaacaggtgtcatctgctttgcaaaattacagtttccacaaagcaccacgaattgggatcattaagaatacccagatgctgtatcccaggcttcagggcttaaacatgtacttcagattttcaggttgttttgtttgtttgtttgtttgtttgtttgtttttgtctttgttttcagtttcaatgatctatctccaaatgagatactctgagtgtttgagctttgcacctatctatgaaatttactttaagtaggttccttattcaatgctgaaaattaggtcagctagaacttctagtccatttgacttcttatctattaaaacttcttgtttgacagaagtctatgaaaagaaatgaacaaatatgaatgtgacttatgcaaagccaataaaattatactttaatctattaagcttaaacccctgaaattccatcatattccgttgtatatttccggatagccagggcagatacatgttttgtttttgatagtgttaaaagctgaaaaaacattgatttgtttgaagaaaaaaaaacataaaaggcatgctgtaatgagatttttgaaacacattagagaaattttaacttaaaaaattcaaaatattaaacataaaactcatttactctaaatttattatttgaaaaatgaatggatttaatcaagtaaccaggattttttgcgtgcttgatggctaataatttctttgtgtgcaaattacctttcaactagttgcttcggtgttctaagatataattaaagagattaaatgcttatagaaatcagagattctatgcagatgttattactcataaattttgttttcaacaagttaacagggcaaatacttttatttatctatgcattcaatattcattcagtaagtttccactttgtgcttagcattggactggctcccagagaaatgtatatgtaataaaaacaatgtaggtcctgtcacgatttactgctgcttagtttgtgtgcgtgtttctgtcttgtcttttctattggcctataagctcttggggctagttatatagcatcatgagttccccaaagtgcttctcacaaagagctcaattaataaatagttttatttgcctatgaaaagcatctgttataacttactttccttgcctcattttttccccaatttccctccctagcaacttccactctgtccacactgaactgttcattattccttggagtgatttgcatttccatatatctgggcctttgctattactaaactcctgtgtgttttgttttgttttttaatgtcgtttatccatacacttaactcctccttcaaaccaagcagaagtagttctcttctgaatgtaccactattaaagcacttattacattggtatataactaattgtcagctcctgtcactaaactactaaaagtttggtatgattttattttcctctttgtatctgtagtgccatgtaagaccttttataaaggtgacatataacagttggtacaaaggaacaaaataaaatggcatacaatagttttaaaaagtttactagagctttgtctaacaattagtcattgcttactattgagcaggataataatgccttgcgactgcttccaaatccctctttctctgatctctctgcccttcaacttttcaagagtaccttttccatatactctctacctcaaaagcttttcacttaaaaccctcctgccaaagttgggagagggattattggtgtagtgatggtactttttctgggagtatttgaatccaaacaagaaataaattaccttaaaccaaaaaagtaggttttgaactgcgaggtttcaaggagtatcagaaacaaaggaaacagttttgtcagaggccacacacacaaatccaaaatcttcttacgactccattgatcttcgtcctgtgcctcttgatgttttcatgaaagatggaggagttgctattacatgagaaataagctgttactaagattattccattctaccatggcaaagtagtgcagatggccatatgggaaagctgaataaataattattttataaagataaaactaaaaatagtatccatctctcattcctgaaagtagcatcactgtgctatcttgtgtaagattacatttttaaggcttggtttaaaatattttcattacaaattcttctctgacattgtttaaaatattttcattacaaattcttctctgacatttgtaaaacattttctatttgttttacaaattttatttttaaaaattaatttaaaagccaatagtcactgcagagcttagaataaatttcatcatttttctttatctacaattaccaagggaacaccatagcataccattgctaaatggtgttttcattcactagatgaccatcctcctctacttatgttattttactactaaagaaactgcaatatttttttattgtgatataatatttatttcccacatattttccaaaagaccaaaattttaatcaaaatttaagaaacaatctcctggccaggcgcggtggctcacacctgtaatcccagcactttgggaggctgaggcagacggataacgaagtcaagagatcaagaccatcctagccaacatggtgaaactactactaaaaatacaaaaattagctgggcgtggtggtgcacctgtagttccagctactcagaaggctgaggcaggataatcacttaacctgggaggcggaggtttcagtgagctgaggtcgcaccactgaactccagcctggagacagagctagactccgtctcaaaaaaaaaaaagaaaaagaaaaaaaagaaacaatctccatcattcttttgtgacataatccacctatatacacttctaactaaatcaagatatttagattatagtctaagttaaacaaacccagatgtacaaaaatcatcaggctatttgtagagaaagtattgttttgataaatatagttatctcaaaaaaaagcaaaaaaatgaggatatgtttaagaagtaaataaacatttgtgtgtgtgtgtatatatatatagacatagatagttacagatataacattatcttttagacccataaggaatgttgggataaagaaaatataacctattcactaaaaaaaaaaaaaaaaggaaatgagacccagaaagaaagtttcagtgaaccattcaagatttttttttcttttttcttttttctttttttttgagatggagtttcattcttattgcccaggctggagtgcaatggcacgatcttggctcaccacaacctccgcctcccgggttcaagtgattctcctgcctcagcctcccgagtagctgggattacaggcatgcaccactacgtctggctaattttgtatttttagtagtgatgtggtttctccatgttggtcaggctggtctcgaactcccgacctcaggtcatccccctgcctcggcctcccaaagtgctgggaatacaggcatgagccaccgcccccagccaaagatcatgttttttactcacagtcatagctagacccaaacacagaagtcttgacctttaaactagttcccttcccatcatatatagtaattgttgaagagttatgttcaaaatagaatatacaagcaagtttaagatctctattttagaaaattgaatctttgaaaaatatgtttgatgatatttcagaggcattattaacatcaattatcactgtattaataaaatttacatttaaaaagtccagtaagtagacttatgaataatgaagagtttattaactacactcaaagagacgatctgaaaaaacagactaataaaccagaaaaataattagattaggaagctaatctgtgtatgagattgctcctcaaaccaaatccactctgaatttggacttggacttagtgagggattagagaaatctctctaggggccaaattcataatccatggcagccaatgcagccgaagtgtctgtgcacaagaaatattcttgcctgacttgcaatattatcttgctgctacatgcttcactaagttggaagagatgccgctaaagagcagggggcacaggaaacctgattcaacttttggaaaccattagagaagcatgctgaagtttggagaaaaaaaaactgccttcttcaggggaaattaagtataatcagaggtcaaggtagaaatttactaacatagattgggcaaccatttacatggattagggcatggactcactccagtttcaccaaatgccacacctggagagtaaacgtaactcttaggcatcagtcacctggagtccccgggctccttaatgctctgtcaagattgatgaggataaagcaggaggggcacagatttaagcctataaattgaatcttaggtaagcctatagtcttagacagactatattttagaagacagaatctggcacactttaaaatctgatttttagaaatgtttttattagtttagtacattcacttaacaagcataattttattcacaaatgcctatcatgtgcctggcaatagggtctgaattcttcataacccagaactttgtcatactcagtttttagcctcagaaactgacataaatttatagttattgataaatcagaagataattctgtacatctattttttttctctttttttcgctgcattgatagtctgaagatcaaatttcccaagctctcccaatagtcatgcaaaattatacttacttagattttctattacatttatttgtaaacttaagttaaaatctattttcaaaagttctcattttgagttttattcgtcttgtatacactctgcacgtaatgtcatcaattaaaatgagaatatgcttagaaaatctttataaccatctaccatggctaatgatcttaactttaatgcacaaaatgttatttcattggaaatttggtgcgttcttagagtgacccttgtttctgtaacattttcagcgatcttagatcaaaaagcaccaacaaatatttctagatttgttttctataacaagtactcatatggcacttaactatttgaaaaataaatcagttaaattttaaataattgctaacaatcatgctgtcatgatctacaatgtatagaaaaaaatagctaacacaagtagaactttgcatacgccaagattgtacttgaaatgctttacatatattgactttattcatctttacatcaactctgtaagaaccattattatccccaatagtaacattcccaaggcctttcagcttgcagtggtagaagtagggcttaaccccagatggtcaaactccagagtctgtgctttcaataaatatttaattttgtcaatttataacaaagtcatttggagcgtctcctgttgctgggatgcatggatggcaaaaatatctctatcttttagctatcacctttgctgaaatgttgggtggtccatgcccacagaaggtgagaaagttttatatgcttatttttaacaactagaacataggatttaaaaagacaagggtaaatttcaacaatgtagtgtatatgttgtcttctaaggagcaatagaagacaactctgactatcttaagcaaaaggaaatgttttggaacaatagtggaaagccacagaattacaggaaggctacagaaccaagcttaaaaactaacaggaaccaagccgtcttggtggaagaggaaaaataactataggtatagtttatatcagatacagagtgaataagtgagccgtactaggataaatgaattccaaatattttcagtctatttgctgctctactcaagactttataaaaggagaatggctttcttgagctacggtacttaacctcaaaaaaaaaaaaaaaaaaaggagaatccagttagcctggcttgggtaacaataactcttccttgactaagagagggaggtgattggaacgcagccctgccagtctatgttcaatgaggacaatacttttctaaatgcaactgaggctgctcttagaaaataaaaataggtacgggcagtcaaaaacccacagacatccatggttgtgactttcaaaataattcccattatctcgtgtgtgtgtgtgtgtgtgtgtgtgtatgtagataagttaatctgtcctaaaaactgctttaaaatcatattttgttaagatttatttctgattataacagtaacacatatttactgtagaacacttggaaactaaatgtgaaaagtcacttacaatcccaagaacgatctagtattgacattttgatgttattctttttgtctttctacaagtagttatacatacacatatatctatatactctatactaaaatttgagatggttcctgtacttttgtgttgtacatttgtcacttagttgattgttactatgtttatattattaatctctaagaacatgattccatgaaatcgataatcatctataatataatcattctacattgttgtacctttaggttggtaagtaataatagtagtaacagagaagaaaataaaacagctaatatttatcaggtatgtattgtaggtcagatactctgtggcatgctttacgtgcagttttattttactaaagcagaaactaaagctcagggagataaatttccccaaggtcaaagagctagtgactatagagtttggatttgagcccagatactctggatagcctgtgttcttggtagctatatctttgtgttattactaaatatattgtgctgtacatccttacatataaatatttgcacagcttatttactttagataaattccaagatgggagattgctgaatcaaagtctaaacatttacaaagcccttgatacattttgcctgtacaaatatacaaatttctattttttctggcagaatatgaggatgcttatttcataatagtcccatcattggataaaattatttaaattttcaaatttgaaaaagaatgtaatgggatcttatttttgttcgttttctttttttaattgataatgagactcactatgtttcaattcattatttttacctttatggtaattaagtgacattcactgaaccgtatttatctgagtgcccacacttctctcccctggggtattatttaatgacaaaggtaatgtgcatgaatctcttttgatctggcctcatgactagattcttttttttttttttttttttttgagacggagtctcgctctgtttcccaggctggagtgcaatgcactgtctcagctcactgcaacctccacctcccaggttcaagcaattctcctgcctcagcctccagagtagctggaattacagccatgtgccaccacgccaggctaattttgtgtttttagtagagacagtgtttccctatgttgaccaggctggtctcgaactcccgacttcaggtgatccgcccacctcggcctcccaaagtgctggaattataggcgtgagccaccgcgcccgtcctgcatattcttatattcattttatggagcagcttttctgggagtcaatctaaccttgctacgctgagagtatgcaatgctttgacaaaggatgtaaacctcaggttccgtatttgtaaaatgataagaataacacataccccgtaagtttgttatgatgatttaataaaacataaaggatttgagacaatgttcgattcattttaagtgtttgatcaatgttggctactatcagtaataatggtaatagtagtaagagtgagagtggatatgtggccaaggtgatcttttctaaaaagcactattttctaattcttggggatgtggactgccttacagaggggagtaagtctgaacagtgtggaagagttcacctagagctcacaatctatgagggtccttttcaagaggatcctctcaatgggcagctatctgcatcagtaaatgaatacgatgattagataaggtttgcctgaggtaaggacagaggtggaggaacagtcaaatacatgctccgaaaggctcagggaaagaaactttctcctcattatcattttggtgccataaattccattttacttctgcagaaattcaggttagaatggcatttattagatgcctatcatgtgggaagcacagttctacaagattttcaaacatctcatctcaaccttatataaaaagacacccaatggatgtgaaagaagtattgttacttacagagcagcattatgtgcagaggaggaaataaataccataggagcttagtaatttacccaaagcccacagttatagccaagtttgtctgtcatttttttcctgccaatggccatttctggacatctaggcctggagagctctctctggagagtagatttaacaggaaagtttcatagctcctcgtgtgatcagcagtgggatgctggggtctaataataatggaccaggaaccctgagtttgacttcagctcctttgcctctgccgtttactcattttatcactttggaaaaattacttaatctcctgtttcctcatctgtaaaatgcaggtagtgactgctaccttgcagtgctaatgcaagaagaaaaggtaactgctgtaaagttcctagcacataataggcaatgaataattaataattataaataatggctcagaatattagctattcaacttctaaggcttgaacactgtgttctcaactctataacctcaatattaaaacccaaagcttgagtcttcacattctgacttagaaagacttccttcattgttcctgtcatttatacaccaaatgtaaactaagttcttactgtgcatgaagctctttttaaatgctttgagaggtaaaagattcatcagacacagattgttcactggagggccctacagtatagcagacgaggtgaagcatggccatcaataactagtatccagagtagaaagtggtaaatgcttcaataggatagatttcatagaaagtgctatatgttgcagaaatattaatttcaactaataaacatcacaaagcaataatattaacaatcttttcttttatatgcacttttacctaagatcaaaatttcatttcaacctccctgtcagctattgaatggggcaactttatcttacttgaccctaaacagaccagttattcctcctccactatatattttccttaaccatcagacacaactattctaattacatggagcaaaaatcactgctaatctttttctctgatcctagagcagtagtgtccacagactatacaagtgtgtatagcctgggggtagaaattgagccctgtcagggcatggttgttcacgcccgtaatcccagcactttagaatgccgaggtaggtgaattgcttgggcccaggagtttgagaccagcctagacaacataatgaaacctcctttctacaaaaattacaaaacagtagctgggtgtggtggcacacacctgtaggcccagctacttgggaggctgaggtgggaggagagcatgaacccaggaggggaggctgaggctgcagtgaactgtgattgcaccactgcactccagcctgagctacagagtaaaaccctctttcgaaaagaacaggaacaggaacaggaaggaaaggaaaggaaaggaacggaaagggggagggagggaggaagggagggaggcgggaggagggaaggtgggaggaatgaaggaaggaaggaaggaaggaaggaaggaaagaaggaaggaaggaaggaaagggaaagaaagaaaaaagaaattgggccctgtttgctcttggcctctcctaatgtcctatttacttagaggtactgctgggactgattctgggtctcccaccttccagctctgccttctctttcctgtacagcatcaccccctctcagcaataggcaggttacaaattacagcctagtgatctagaaattgcaaactcaaatgaatgaagtccaatgagaagcaaggatcaagatgtcagaaaatcctcaagttcattgagcttaaatataaaaggagagggcaatattgaaacaaatttcttacatataaatgtcacccagcagcattgccatctgctcccaaataaagcttgtgtctagataaggaaacctcatttatatggacaatataatgaatctaagtatccataatagtgttccacagcacttatttccctctcaccatggttctcctttccctaatttgccctgacctttttaggtgaagtttcttattgaaggcagatttttttccttgtgttctctttatcattcaaattttctttcatgcatttctctgtgtacttcttattctttaatccttatttctttttcttatgctttcctctcttcccatttcttcctccttctttccttttttctccttttatgctctcaattcacttctttatatctcaacatgtccccgtctctctaagtctttatgtctctctacctttcatcttatccctctccgttgaaatgtgttttctgtgcacagtactatggtacttgaggaattgggaataaaatgacctggatccaaacacaaaccctcttgcccaactaagctaaacacagaagagttggtattttattcttgttccctgctcctcttaaatagccatgtctatttccaaatgaaaagtctgctaatgacctagcaggttcccagtgtagataggatccaattatctgctatttggcacacaatggcctttctgtctgccagccatgtaccagggggtgaaaatagcatgtctactttattcctgagcgtcagggtgtttttctactagaaaaaaaaaataaaaccctgaaaaatagttttgaaactcagagtattttactcaaaaggtcaaagattcattggaatttaattttctttttcttgttatttttaagttgtcatttttctgtaatattagttgtgctgtgtgtatattttcagcctgagttttctttgttccttactactagattttgccttaaactcataatcctgactgcttttcacaatgttcattttcccatggcaacagagatgcaaatgaataattctggtgttactgtggggaagaaaagaagaacctgtgtgtgactcatacaagaaaatctgttattcaagaataaatatcgcagcagtaataataaaggtcagcactcccatctcacccaaggaagtcaatgagagatacacacaggtggttgaggacaggctgttagtcctcagtgagtggtgaatcttgttggtcaagtgaattgccctcatttttctgttagaggttgtggactatttttctttacaagggaagcactttatttatttatttattcattcattcatttacttatttatttattttgagggtagagcgtgtcattgaaaggtacctgacccaaaaagataagtctatctaatgtgcttgcttactgaagcacaaacttaagctctctcctcctatgattatgagagttcttcgccatttctacccatcagctcacattcctgacatcagcagaagttcactgatgcttcaatgatctagacaagagcagtaattttctgccctgtgcagtctctcaaaggttaaaaattctaattgctactaaggatttcctgcaaaaagagatgtttaaaatccttatttgaaggtccacttcaccgtgcacagaggaagtgtattcgtgcacagaggaagtattcattccttctgtgaaacataaacactcacccctccagattagcccgtggtacatttgttcttgggcagttcgatgtggatgaatcttgtgagacagggaagccatggtaagtatgctgtcctgggtgttctgtctcaggactttcttctgctgcccagggcactgctattccatcatctagcatgctgctacagctgcagaaggcagacagagatctgatacattcagggcacccacatctatgaggaaaatggatgaaagatcaaagaacaccctcccatcaccacgcttccagcatcaccaacataggatgccatcttatgtgaatatcgactagggtttgtgtaattgtagctcataaagcaggatcttttccatagatacatatttttcataaggtatatttcttcagaatttctagatttgaatgatatagctgtggctattctgttattattagaaacttaatccaatcattccttattaaaaaaagatttccatagcaacacagacacaaaacaaatttcctgggtagatattataatttgtttcagataatatagaaattctattggagtcattattttaaaattacaattattatacagacttttttatcatagcattaatattaacagttttaaaatgaattcatgccaaaaatacaattttatatctttctattagacataagagacaacagacttgtatctacataagtaaaattaaatcagatggtgatttttaatgaaatatgtgtttttctccaaatctttttcttttggagcagtagggctttttgttttgttttgtttttaattttacaaaattgacctattattaccccaagtattttcttgataacttctaattccagagcaattttgttgttctttaaaaacaattaatcagaatagattttaacattgtacaacactgtaaacttgtttccagaggaagaaatattctttgcatatcaaaaaaattttaacctaaaatgtgattagcaaaagcatggattaattgtgtttccactgatgtaaagaaatcttcattgaacattccagccgatcagccactggattagtgcataggataaatgcatccacggatgttaactgaagtcctacatgttctcagtagagtgtgtcagattctgttggtatttgctccactaaacatagggttggggttttttgataataaagtttggggtgaaagtcttgagacagcataagctcatgaggaagcaaaaatgtaatctgattagcaggatttgtatctatgcatggtaaattatagaagattgtggtctttccgtgactaatgccctagaaaagcttcacagatgaaaactttgatcgttaacacggatactctttcatctctaaaacagcttagtatattacctaccacaacttttcaactttttaatttctaggcaagtaaaacattaaaatgcatattaactaaacttcaaacaggttttttttttagatgtcacctgaaaatctttttggattactcatttccagttatcatatcctagtctgcaggggcttattaaagaaggatttaaatgtaataggcaccaatgagttggcagaaatagaacacagaaaactagtcacatgatcacaggatcgtgaagtctcttgatccagaaattatgtaactgtactgaacacaaaatagttagcaaactattgtggcatttttattaatttgaatatgattcaaaattttaaaaaaaatttttatatgttcaactaatatcttaaataacatgaaaatacattgtggtttttctaatcttaggaatccactgaaatttcctcttaagaaaatttagatattcaaaacaatacacttgaagatttagcattgattgtatcatattctgtttttagaatacaattagcttgaggttaaagttaaatattataacattgcaattttcaaaaagaaaatggagatgtttagatttgcattactcactcttacttcagcacctcttctacacttagtacataaaactctccaaatgtaatataaattaaaagttttaatttttgttaacatttaaaaatcaaagtaattattgttattgcagaaaagaatatgcatattatggtagtaatttttaaggttttcaactcctcaggacttttcagtgattttgctgtcatagtatctgtatatgtgttggtcttttgtatatatttttaaattgcgttaatatagacatttgtaagttatgctttacaatagcaaaaatgaactaaatcacctgtaagtatgtcccttatctaatttctgtgtttttgtatctgaaaaggaaatacctagacagatgactaatttgtatatattaaataggaaatacagtggcacttaaattctgattagacaatgtgtatcttttttattttaatatgtttccacaatatatactagagaaagcctatttttaagtatgtcccagaactgctaagttcaaccttataggattctcgtgagtatcactgaaataactacatgtaaagtgcttcaattcagtgcccagcaaccagagcccagtaggcatggccactattatttgtattaaatattttaatcaacatagatggagtggacatgaaaattatgtgattaatttgttcactgtagaacccaaaatcaaatttagcaactgagaaaatacttcaattattaaagtccagatgaatctggtaaaaatctcccaataagatgacaacgtttgtttcaaaccagcaaataagaacatggactctgattttagatcaagaaaatgcagcatgtattctcaaaataatcacagataatcttctaagcaggtaactccaaaatccctgaggaggcattgtgttcctttcttcacttggtctcctctgcatgcagtgacaggggcgaaatcagatactgggctcgaggatcacaccaacttcaagccaccaaggtcaaggaggcaacatcaggcaccttggaagcagatcaatccttggcaaaactgaatttcgttttagctagagcacctttttatcttttacctcatactacaccagggggttcatagcccaccccctcttatttgctcaagacctctcatccctgctgtccaccaaggcccccagccaagacaaggaaagagggcctgtgtcctacactcagcccccactgctgttcattttaaactgctttgcaaacctatcagtgctctatagaagttacctctcagagtctccctcggcttgcttttcagctaccggtaaaataatttatgataagttcttctttgatgagaacagtctgctgtgcttcccagcataactggtattctgaagacctgtgtggaatggggaaaagagcattagaacctagggagtaccacatgttcctgtcattgtgaaactgatagactcttggaagcaagggtgtgcctttgtttacccagcaaaacccagcgcagggtctggcaaaatgtagacagactctcaattggagtgagcctcttgggttcaagagtaagtacttctggttgaaagtctgaagtatgatatcctccatacttgccttattccccctggactggtctcaggattaccatggaaacacacacatcaatcaaagatccacaatgagtaaaacaaccccgcccagccacagagactgccagttgacttgtgggagaagtgaaggaatgttaaaagttctttttctttttcttcttcttccagagtggtgagattttgaaactgaatggtgctcatgtctggaggtgttttatagattgtttttttgtttagctcattcatgaaaaaaaaaaaaaaaaagacaagcattggatacaaaaagtgcaatattgagtaaagataacatgcttggctggtgtaccgctctctccccattgtatctcctggtgtaatggccctgcccagatcctacacaaaataagaccctaacaggttcttcagccacaggcacaggatttggcataaagtaggcactcaatacatttctatcaaatcaatgcacctgtactaagatacagacagaatgcagatttattctcagctcaattagaaataaaatgaatatgtttttcattacaaagaaattgattcatgtcatattgccaagccaaatgtgtgaactgaatggactttatgatagtcaaaatgtatatggcttctatatacagaggccacaggctatgagaaatttccccaacaggaatattttgtactctaggatatttttcttatctcattcttcaagtaagacagtcagagacaattgtccccaaagatatttgcttgtaccttttcatagctattaataattttttgttcatgtgtcttgctgtctcaacaaacgacaatctcttatgcctctttcaacccctcatggtgtcaagcacagaaatttgcacattctaggccttcagtagaagttgaattaatattcttgttagagatgtacaaatgaatttctcttaattgaaatatatgcaaactagaactgcttgccaagttctaattggtaaaaaatgcaaacgctgcatgtatttggtttgctttctttgaatactgcctgtatttttcaaaccccttgacacattataaagcaaacctttagcaaaaagcaaatcaatttattttaacagagactccttaagaatgccttttgggggcatgaatggatgatataaaatgggcatctgctccccattatttccaggtcatgaaaatatcattcaattccaattctatgcttcctgcgtgaccacccaaatcaaagcagcagtctgactttacattcccatttcaaacagagaatcatctgtgggaggtagggagatatggttgaattagattaggtcaaacttttatttcacttaagaaacgatgtaccaaatctgcaaagcaaagggcaggggtgaggataatctgatttgttactgtaacttaataagtttattcagacaaaaagataaaacagcaggtggtcactcaaatggcaggtgaaggtagatgactcaccattactgcagccaatatgacccccttccaaacacccaatttagatctgattggcattactttagaaagctaagtctagggtcagatatagggcaggttctcactggaattttctagtgctctctaatattactggtgcatagctggcctaagtagcttgtatttataaatctgacagcctacttatatgttgccttcaaagaggtacaactattgcaagatagcgccattatagggaaaaaaaaaaaaaaaaggagaacaataatttatcaatcatgaggcccagaaggtaaacacaatgcctagaacctcaattcaatcagcaaaggcccaaaggatatcatcagcagacctaaaagaactgaatgtttatctttctattcctttgtttgtgagggtgtttagtattatatgatgcagggagcaatgtgtgtaacgtggtgatataggcaggtggtaattctgtattttattttcttttgttttccttttctgttgttgttgtttctttttttagacagggtctggttctgttgcccaggctggagtgtagtggcatggtctaggctcaccgcagcctctgcctcccaggctcaacatcctcccacctcagcctcccgagtagctgggactataggaacatgccaccaggcccagctaatttttgtatttttttaatagaaacagagttttgccatgttgcccaggctggtctcaaactgctgagctcaaacaattcacccgcttcagtctcccaaagtgctgggattacaagtgtgaaccaccgtgcccgacctaattctgtatttcctacttaggcattgctacttttgttttgatttgttaaaacctacctccatccttccttctgactgcactataactctgcttctttcttattgtattttatcactatgcattatatacactttagatcagtgtatagagcatcacgaggtttgttgcttgtcagtactcgttagcataaaaataatattcatcccgtattttccagtgggtatctccatcacacagtggcaagcaaattcctgcaggtaaatgcctaacaaagttgtgaggtcagatgagaatatgtatttattggagtagacttatattgtcacttgagaaaagatgctgttcaccacattggtacatgcccacagcctaccctggtgtctatcaacctttctttcttttttttttttttttttttttttttgagacagagtcttactcttgtcacccaggctggagtgtagtggtgtgatctcggctcactgcaacctccacctcctgggttcaagtgattctcctgcctcagcctcccgagtagctggggttactggcacccaccaccacatccggctaatttttgtatttgtggtagggacggggttgcgccatgttggccaggctggtctcgaactcctagcctcgtgatccacccgtctcggcctcccaaagtgctgggattacaggcgtgaaccaccgcgcctggctgtctatttacctttccacctgcatcctctatcaccctcatccaaaccacaatgtcctgggcaccttggcattatctttctttctaggcacaccaagatcatttttatcttacagatgttttgatgccttttcctggaaagttcttaccccaaatcatcacattataggttccccttaacacgtaagtatgagttcaaatacctttttcataaaattcacatcatctgtatcctccaactccatcctcactcacaagcatcagtttttatttgtcatatccccttgtttgaaagtcttcatatcacttatcactatctgaatttaccacatttactttcttatttgttctcagtgtatttgtgtctccccattgtgaaagatacaggggatgaaggctgttgtctatattattcactggtgtagttccagcaccttcaggtatatctggcacacaatatttatacaacaaatatttgttgaataaataaatatgcccttcaaagtgtatagtaggccagattaatggaggcaactggtgttggcaatggtggcaggggatggaacaggactgcctattgtccacgatgactagattttctgaggccctgaaatgtcacagaatttaaaagctgcaaaaagcttgaggcccaaagaaaacaagatcttccatctctttattaataattggcagaacagagatagctccaaagtctttctactgtttttcttctccctaccagctctcaccttcagagcttgggactctaaactgttcctagctttatatcaagtagcagttaaaaaaatacagttacatgccacataatgacattttatcaacgccagagcaacaggacaaatcttctatatgagggtggtcccataagattataacacattctttttactgtaccttttctaggtttagatacacaaatacttaccattgtgttgcagtttccttcagtattcagtacaataacatgctagtgtgtccggaattggtgggttcttgctctcactgacttcaagaatgaagccgcggaccctcgcggtgagtgttacagctcttaaggtggcgcgtctggagtctgtcccttctgatgttcagatgtgttcggagtttcttccttctggtgggttcgtggtctcgctcgctcaggagtgaagctgcagatcttcgcagtgagtgttacagctcataaaagcagcgtgaacccaaagagtgagaagtagcaagatttactgcaaagagcgaaagaacaaagcttccgcagtgtggaaggggaccccagcgggttgccaatgctggctctggcagcctgcttttattctcttatctggccccacccacatcctgctgattggtagagccgagtggcctgttttgtcagggtgctgattggtgcgtttacaatccctgagctaggcgcaaaggttctccaggtccccatcagattagttagatacagagtttccacacacaggttcttcaaggccccaccagagcagctagatacagagtgtcggttgttgcattcacaaaccttgagctaaacacagggtgctgattggtgtgtttacaaaccttgagctagatacagagtgccgattggtgtatttacaatccctgagctagacataaaggttctccacgtccccaccagagcagctagatacagagtgtcgattggtgcactcacaaaccttgagctaaacacagggtgctgattggtgtatttacaaaccttgagctagatataaaggttctccacatccccatcagattagttagatacagagtttcgacacacaggttttccaaggccccaccagagcagctagatacagagtgtcgattagtgcactcacaaaccttgagctaaacacagggtgctgattggtgtgtttacaatccctgagctagatataaagactctccacatccccaccagactcaggagcccagctggcttcacccagtagatcccgcactggggctgcaggtggagctgcctgccagtcccgcgccatgcgctcgtactcctcagcccttgggtggtcgatgggactgggtgccatggagcagggggtggtgttcgcccgggaggctcgggctgcacaggaacccacggaggcgggggaaggctcaggcatggcgggctgcaggtccctagccctgccccgcgggagggcagctaaggcccggtgagaaatggagcacagcgccggtgggccggcactgctgggggacccagtacaccctccgcagctgctggcccgggtgctaagcccctcactgtccggggccagcagggctggccggctgctctgagtgcggggccctccaagcccacgcctacccggaactccagctggcccgcaagcgccgtgcgcagcccgggttcccgcccgcgcctctccctccacacctccccgcaagctgagggagtgggctccagccttggccagcccagaaaggggctcccacagtgcagtggtgggctgaagggctcctcaaatgctgccaaagtgggagcccaggcagaggagatgccaagagcaagcgagggctctgaggactgccagcatgctgtcacctctcactaggctgtatcatttaggtttgtgtaagtgtatcccatgatgtttgcacaatgatgaaatcacctaaggatgcatctctcagaatgtatccctgtcattatcaacatacagagatgtttattagttttctatagctgctacagtaagttaccacaaatataatggattaaaacaacacaaagttattttattacaattgcacatgtcagaattctgacactggttccattagattaaaatgaggcatcaacagagatgtgttccttcctgaaggggaatccatttctttgcctcctgcatcttctaggagctacctacaatccttggcttatgacctcttcttccatcttcaaatgctgcaaggctggtcaggtccttttcatatcataccgctctgaccttctcttctgcctttctctttgacacttaaaggcccctgtgattacattagacccacctggataatccaggatactatccttatttaaaagtcagttaattaaccatcttaattctataagcaactttaactctcctttgccacatatggtagcatattcacaaactctgaggattaggatgtggacatcatcagaggccttttttctgcctatcacaagaagcattatgaaaataattgctatgtttccctctttcaaaataactatggtttaaattttggagcatacggtaccatttgagttgtgggcaattttgggtgctaataaattctgctataatagttgtccatagccatagtcaaatgttttgttagagtataattttctgaaaattaaaaataggactttccttgaaatttaagataaacacatgtcaaatatttcattcaacttattaattattaaagaaaccatgattctaagactggttcaaaggaatatatgaggaacagagatgtataatcaatcaaacaatgttgaaataataatagtaagcaataagtaataacaataagaagcaaaactgtttaatgtcccatgtgataataaaacaataacctttgtggttattcttttctaccaggcagaaatctactagttaaaatgtagcattccagtgtctgcactttgcattcttttagacaattttttaatccatggaagaacctgtacaaacaattacattgaaaagaactgcattcattcccttgctttccaagttttgaataatttttcttaatattttagaataaattctgaaaggagaatcatgggattaaaagtaaaatttaaattactgaattattttaacgttataatttacttttgaaaactattacatttttaggtgatgatttatagcatttgtcttccttggatttaagattagggataaaacactggtttcatgatgctattttaccatatttaatttataattatttgccttaaagggcttttatctcccaaatattaacataacaatatatgtgacatgcttttttagcactttaaaaataaatcacttaggacaatgttactcaaagaattttgacttaccgtaaggggtttttttgatgttactctgagggtattagctgtagttttgtatatttttaatgtctggaattttaaaggatacaaaactacagccaatactataaattgtgttgcaattttgcaacacaaatcagagagtatcagaaatgaaattaagcaatgcccattatgttctcagaatttaaatttttccattatttttattgtttcttcagaattatatttgccatgtattgagtttctgaattatgcagtcattttcctggatttcattagcttttctgaaatgcttagtaaattacagtgaaactagcttttagaagcaattactagtgaattcttagccttctttgctcatgcaacaacagtgttccctattaaatatgttaataactactttacctatttataggcacatattttagtgttatcttctgaaataatacttatacctttaagaatggacccatattcacaagtccttttggtgcctttttttggttatccatgatggtaggtaccaaaacattcagttacttagtttttagaaagacttctgggctttgtttgtttgtttttaactatggcaataatctgtgtgcagttaaaattctccatattatagtatagaaagctgaaaataaaagtggcttttaaaatagctaatcatagtctctaaagtaaaaagagttcacagatggtcagtagggtgattggtggtcatcagggacccagcattccataatcctaccctgagttccttcttcaaggccatcttattgtccaagatgctggttcttaggacagtccaccaaaaacttaaacttatatgttattgtctaaaatttacctgaagcaatgtaattttttttggttagttacattattgctacccagaataaaatctgtaaaagaaggggaaaatgggtattcagtggcaatgaacagtttctgccacacttatttaattatttaaataattagaaactgtcagggaactgacagggaactcaaatgaaagtcaaaatttctgaatatcaagtccacctactattaaccaggagtttttctcggttgggttacctaaactttgagtttcagatcatcacctctgacttaattatttctttggtttcattcagttcagaaattcaataatcttatactgcaatttatatttagtctaagacacaaatggtgtttagatttaactgctatcatataggcctctggtatgctcaagacataaattgagaacttcttggagaaatatttgagcacacagagtgccacttgctgtctcactgacaaaaatgtgacactttcaaaagcctgtgggtaagcctcaaagcagaaatatctatttaaaattatacctcctgcctattattgagctgagacactgaatgcttcccttcatctgaaactttagggactatttgcatattagtagcataaatcttaactaatccagcaggagggaaagtatttattttgtactgagaaaactttgtttcaggcggagagaagatattcgagtgatgattgtcatcttttatatgccttgtaactgtgatagatggtcttgagcttcagtgattcataatggcatttggaggcatgcaaaaaaagcagctaattcaaatgaacgagtcagtaaaacatcacagcaaatgtaggtcgcagaaaactgtggaaatctaacagaagggcagtgtgttgccaatgaatatatttgaggacagtaagagaaaactatttctacactcgtcactggctccaaataaaatggtgattttatcttttctactgcagcctcccagtgggacaaccttcctctctccattccttttacctcctaaacctcctctccccacagagccaaacggctttatacttgctccctcttcaacagtcaaatcttcttaacattcagaggaggaaaatgtgacccaaaggagattcatgacaacccaaggggtaggttattggcagtacagagattagaaatccaattttactggatttccaatccactttcaattgcattactgtgttctttaataattcctattaaattgtgcgctttacaaatttaggtgttgcattagtagctaacctgaggccaggatctggactcctcccactgactctttagcaccaccctctgtacatcttgtcctcacaaatgggttttcattgtaaggacaaagaaggcttcacagaatgtgtgagagagacaaatagagggacataggactccccagaaaagaacccacgaaattacaacatatggtgacttcttgtcatgaggataagccagttcaggctttatggatcaattattatttcattctttctttcaaatagcttttgaacacatactatgtaccatcaactatgcaaggtgctgaagattcaagggaaagaaaatcagttcttcccatctttcagtcgtgttagtcttgggaaactgagtagatagatgtgcccctttctgaaatagaaaagactgtatgaggagcaaaaatgcaggacaagagcaagtatctaccagagtgagagataccctagactctcaaccaataactacctcctttgccatgttccttcctgtctttgcattacttaggaagtgaagttccaaacaggatagtttagatgtcaggttgtaatgctaggtcagctcagaaaaccctggaatcaggacctgtcatgtgaaattgatgactgccccagatccctttccatctcaaaacacctttcccattgacctgtcagttacctgagtcacatcattagtggtattgcttctgcaatgtcattgtctactgaaggccttattataataaacatatgtaagttattcagaaaaaaacatttgaacaagttagtctctgttctagtttcctagggctgctgcaacaaagtaccacaaactttgctgcttaaaacaatgcaatttcatatatcatagttctagaagttagaaatctaaaaataaggtgttggcaggtcatgtttcttccaaaacccctagataaggatctttcttccgttttccggttctggtagttgcaagtggttttcagcttgtgacagcataactccagtctctgcctctgatgtcacatggggttcttcccttatgtatcagtaaatattctctttttataaggaccacatgctgcattgtcatgctacatttattgcccattctaatccagtctgatctcatgttaactgattgcatctgcaaagaccctatttccaaatgaaaacataatctacagtaatgggctgtcctagtcagccagcctgccctgacaaaataccatagactgggcagctcataaacagcagaaatttatttctcacagttctagagactgaaagtccaagataagggtaccaacatgattgggttctggtgagagccctctatcaggttgcagactactgacttattgtatcctcacatggcacaaaaatcccatgagacctctctgtgggatcccttttataagagctctaatccccttcacgaaggcccactttcatgacataattacctcccaaaagctccactttgtggggaacatgaaattcagtccataacatgagtgttagagcttcaacttatcttttggagagaaacagtttttatgaagtgtaggggcaggatgagagagaaagagtagggtgaaggcacctagaatgaagtcgatatagcaggctcaagtaaggcgtaacgacagacaatccttgttcaaataggggactatatacatacatcaggcattggagggaagcaccaaaagaataccccagaaaaagtactgagggggataaagaagacaaacttcacctaactcataagtttgcctgagccagaaaataaatgaactttagaagtagagttttgcaatttaaagtaaattaagtcaatgaataatttccttggaaaattgtctttggcccactcacagctcttttatggcttataccagctttttcatgggaaaaattaacgctttagacaagttgaatccataccacttaagttccctttaaataatcaagcaaggttaaaatgaaagtattcatggtaatagaatctgccaccaggggattatagcttactaagaaaactatgactaataccattcattgattaccctttaccttcccaagagtaatatggtaaaattgcagtagggaggatttaaggcagacaataaaaatgttcccagtacaattttttttttccagtattgctgcatcatcttttcttcagtgaggttaaggaattggaaggagattatcagaaagggttgaagtaaaatgataccttacttcattcagtcataaatatttcttgattcacccaatatctttcccaccatgaatattcttattctttgcttctcagcacaaaccgatagttgctttttcaataaatagctcttacagccttgagaacctcacctcataatggtattatagttaaggtccgtgcagcagatccccttcaagacaaggaatcctcttctttgggactctcttagatgagggctaaagtgaccctttaaaatgagaaccctctctggaaaattgcatcaggacagcatgattgaggccttgtttgttgagccgaatatcagataagtaagctatatttatcaagttatctttcccctcatgagcttcattgtacttttgctttcttggctcttgacattctccatgtttcccactctgttcagggatccagctgacagtagcccattttctattgtttgggagcatgtcttgagtttcccaaagtgggaggattgcctccgggctgttattgccatttattgagattgggatgatgctctagttctgacagaacagtcctgatttatgttcagctggtgattcattatgacctagatcattttctaccatatttgttcatattcaatcttccctcattttaaaataaggacaaaatacccaagtgtatttcaggcaacttgtcaggatatcaaaaaaatggtttcctattttctgaaattctggcaaatgatgtcaatagcaccagctagtgccataagtatgtacagtttatctgggagaccaccctggagtaggaaccaggaacccatggaagatattgctaaaaggttctctgaagcagtaaagtggggatggcaaggattttcaagccacataaactgggtttggatcctgcttcttccactcttcacttgggaaagttacataactttccagtcctcagtatcttaatctggaaattgtggtttattaaatctgctgcattgagttgttgttagacagtattcctcaagacatggtcctcaggctgtcaatggcataatcacaggggttgcttgctaaggcagattactagaccccagagctaaagatctgattgataaatctggaatgaggcctagaactctgagatattagcatacatttcagatgattacctgctaagcttagagaactgcagcaaggagacttaagtgtaaactgcttagtacatcgtaggagtacaacaaaatagatctatccctggacagataatcagttccttgaaagcaggttggtgtgtgttcaccgttgtatccccaatagtccaatgccttggcacaaatcagatgttccataaacgttcattgatgtgaatggttagaaatcactagtcagagctgaaagcaaagaccaaagaccaaaatggtcagggaatgtttggttcaagtaaaataggaaacagaagcaagatacaccatcagaaaataagcaagattgcgggctgcagttcagtttttccagatatcagcattagtacagaagagcagccagcaggtgtcagacagagagaagctgttgggaaggcagcaaaaaataagttagagaatataatgaagactgtagtgggaagggaccaggcagggaggcaatgtaaggctctggcaatcaggacaaaagtgtccacaaagtctaaagagagagacaacactaacgaaaacagagaccttgccctgagagtccaaagcagaaagtttgagcacctggatgagtttgggactatgtgagcagattctggtagaaaaatctaggtggtttcaaggatggcactagacaaagtcaaaactaaaaacataacaaaggaaagtggcagaatcactggttctgtgatgaaatcagataaactgagtggaccaataaaatcaaaattttggttctaaatcagtatggagatctcctacagaagtgaacctattaggactgtttcatacactctggtataggcctagagatatataattaatattttataactagagctaacgtggttgttattggaatcataaacagcaattacatccttatgtgcaacatttcctgacaaagatattctttggctacacacacatacttgaagacaaatttagaccaagacgacattatttcaaaaataataatgaattgggcatgtgaaaattaccttacatatttgagaaatacacttgatgtgtgcatatgtaaaactttattcctctttcatttttacattgattacctcagacattatgcagaacagtgtgtagatccattttttgaatcctaacataatatagttttctagggcattatttacacatggttgtgctttccctgtacctgaattatagccttatatcttattatgcatgtgaaatatgtagacagcaattagcccagcaattctgtgtattaattacttgccttttagaaagcaacacgtctgcaatctgcaaagagagccacaaaaggaattctatggcagtacaagcatttgtgtgtttttacagataattccattacatagagtcattcatgaagaataaatggcaagaaaaaataggatttatcagggtaaagccctaagggttgaagaaaacacaggaaaatccaattagaactgcagggagttggttcaatctcttaatcggcactgcagcacagcagattaatattattgcctactatttaaactttattactccatttttctgtctgtggtcctctgttttgccagcccaccttgaaaagatggcaggcagaaccatataatactttttatggccttggcaacagcactgttttgtggtttgaaaggtaagtaccattctagaaatgatgaggtgaggaagcaggcgacactttagcttgttttataagccagagggtaaggctgtttgccctgcatactaatcacaaaaaccatcagcaccagcactttgccagcttctactgactgacagcaaaatttacagcagtcatttttctatagaattatcctcataaagttagaggcatctggagacaacgactacagcaaagactccaaataggtcttggtcttgggttccagttatgacacagacttaccagatgatcttgagcactcaatttttggtgtcatgaacaataagtttattaaaagccagattcttagataagttatacttaaataaacatacattaattttttttttttctaaaaactggggcatatgagtttcctagggctgctgtaacaaattgggttgcttaaacaagagaaatttattctctcaaagttctgaggctaaagtccaatgtaaagttgcttgcagggccatgcacccttttaagcttctaggaaagaatcctttcttgcttcttcatagctttgggtggcttccagtaatctctgctgttccttgatatgtagctgcgtcattccaatctcttcctccattatcacatggacttctctgtgtctctgtgtcggatctgaatgttgctcatgttttttgttttgtttttcattttataaagacatctgtcattagattttggccctcttctaatccagtataatcccatcttaatttcactaatatctgagaagatcctatttacaaataagtttctgagtttccttgcagatataaattttggggggaatctattcaaccagcttcagtgggaaatcacatagccctgtatctttgagtattttgagataagtagctgtgagcattcaaataacttaaatcatgagtgtttctattaatgagttattgcgtgtatatactatacacaatcatgcggtctgtgattttatggtatgttaatttattccacaaacatttattttacctgaaacctcttagatagttatagtaaaagcatgttgtatattattttcctgtttattttgcaaatacttcaactaacaaaataattctagaattaagagtttattttttactttatatagatatttggtaggcaaatgttaatcttggttagaaaagttagaaactaaacgtaagttttccaaacttttatccccaccacaaatcaatgcacactttattttatatagtaaatgggtgttgtatatttcttacaaatcaaatcatctcttatttcacaatcaacatggttctctgagctaatcatttttagaatgaaagattcctaggttaggtttggggtttattttgcattgacacaaaatctcattagattcagctcagtcaatatatctggcaaaataagattcctgtttgggcaagcaaagttttcttttctctgagtttgcagttctcttccagttttcagattcataagacacatgtaaatgtaatctcccttctgcacaccactggctcatttatttcatttgtttctccccaggtgttgattagaccattccagttgctatctgtatctattttacagtatagagttgttcaattgatataaatggaagtgtttgtttgaaaatataacttttttctttctacttctactcttctgaggttgtactttacattttaaagtgtgctactaatatttttttcacattttcaaaatcaatctcactttatctaatttatttccctagatgcttatatgctttgtgccaccagagaggaggtcagacaatctcaactccgtcagggattttatatatctcttctgtaaatcactgaagatacttcaactctcctaacagagttctcacaatgatcagaggagagctgacaacttcattttgttagcccttgtagcacctcccacttcacctcacgcccctaaatatgtgctttatctagctcactctccttttgtgccaaattaccgtgccaattctgctttttatgtttattcttactctgattaatgtctttttggtccttcatgagaagtccctacagggaaagctcaaatctttgtaattttcttggcatgaaagcaagcaaagtatcaaacacgattaagtttctgacaagcttggtcttctccctcggatttcagtacgcctttttcattcatttttctacctcttttactctgtctgttgcttaatattggtattctctagcatttatttccttctcacttttcctttacctaatctcacccactcacctgccttcaactaacacctgcccctggcaactctcaaatcagtgtgtgcagctgaatgtcttttcctgacttctaaatgtgtatcctagatccagaataacaactttgttgacaactgcacttgaatatcttatatgtacctttttaataaatgtttttcaaactttatcgcctgctgctcacagaaataaatgcatatttgcatctcaaatcaccaagtatgtccaaaggccccaaatcaccacatgacttggtgcctacagtagcatgaccaaaatttaccaaatcattaacttccaaattgctcctccttctgcattttctccctgagttaatgagactgtattgtagaaatctgaaagttattttagactcctccctcttgtatttctcatcaagagccacaaagtcctacacattctacttcctaaatgtctctctagtttaacccaaactttccatcctgcttcatgaactattttgtatgataaccctgagagttctgcttatctcttttctatctcatgaatatttagtccatcttctatactggtatataaattatttttcatcactttctgtttgcttatctttctcgttccatagagcaaccactttcagggttctagaaatggccaataaagaatgcttcttctgagttacttacaatccaatagaggaaacataattataaactaattactatatcatacagaaaatgttcttattttgttgagcataagatattcaagtgcagttgtcaaatgttctcaaattgttgagcaatttcaacatctcaaaaaaggaatgacatgggaatcaaaaagaaccacctaacatggcttaaattttctcacttaaaaatggaaatctggccgggcgtgatggctcacgcctgcaatcccagaactttgggaggccgaggcgggtagatcacctgaggtggggagtttaagaccagcctgaccaacacggtgaacccccgtctctaccaaaaacacaaaaattagctgggcatagtgtcaggcacctgtaatcccagctactcgggaggctgaggcaggagaatcgcttgaacccaggaggcagaggttgcagtgagccgagattgtgccattgcacgccagcctgggtgacagagtgagactcggtctcaaaaaaaaaggaaatctatgcactcacctgccatcaccacatccacctttcctgctaggaggtgcatcaagctaaccgaactttttttgcactaggctttcatcttgagatggtcactgaaatacttttccagaatccccaggatttcaataaacaagctttgcataatgctgatgtagtccaacacactcagtttagagataagccaaagaggtcaactgatgggtctaaatttagaagcttgttaggagtttagtccaaaggaaaaccaaagtcttccaaaagacagtccaagtttttatctttatgtggactctttcctttccctcctactcttccctcccaccactagaatggaaaaatacaagtatcttaaatatctcagtaatcccttactttggttgggaagggctacctgtgaagactgagatattagtcacagcataatattctcacgaaatcccaataccaaagtttttaatcttgtttaaaatatcaataaaacatatggccactttcttcagacaaaaatatgcctgaaaccttaaagtttctcagatcccactaaacgcttccagggatctcatgtaaagaatctctgccctaagggcttaatgggcatttactttgtgtggtagaaaaagaaaatttagcaaccggtatctggtccagccagcctgtaacatgaatatccaaagtgatataacatgtcttatactatggctttattcctgtaatattagattattctggccgggcgcggtggctcacgcctgtaatcccagcactttgggaggccgaggcaggcggatcatgaggtcaggagatcaagaccatcctggctaacacagtgaaaccccatctctactaaaaatacaaaaaattctctgggcgtggtggcgggcgcctgtagtcccagctactccggagcctgaggcaggagaatggcgtgagcccgggaggcggagcttgcagtgagcggagattgcgccactgcactccagcctgggggacagagcgagactccgtctcaaaaaaaaaaaaaaattagattattcttgcaagtcagagaaatgctaagggggaggaaaaatattatttataattaagaccatgaagcacctttactatttggagtatttggggggttttgttttggttttgcatcattacaattaaactctagagtagcaaggtttattaaacaagtcaaggaaaaatttctagagcagaaatacccatataacatctagtaaaatagcagaaagatctaattttattaggagttgtgtggtcatgatcacagatttccatagttttctcttttgtactgaaggtgatgttctctttatgaaccaacattgaagctcactaatggccaccaagaccagttatgcctcagatcatcaaaatgtattcaaagagatgattaggaaacatatggctggaagtgcctcatctatgaagaaagcatggaagttctttatgagcacagctatgaaataattatgagtgccaaaaaagtacatggtttctaattgaaggcatatgatagtcctaggagcaagaggtagaccattagctactccccctacccccttacccaccacccctggttatctaggtttgcttttgaccatccatttcttatactgtgccaaaggctggactagcttagtataaagagtgagcctaacaggtcataggttgagagggatttttccagttgttttgggggttgtttgcttggtggcattattgcatttttcttgtacaagtagcataacacggaagtaatgattttaagttctagtctggatatgcctttccatattgctgcaacgttggggaactattgaagactatatataagatgcttttaggctagtttttgtcaagctcagcttttaaaaagactcatgatgcactgaattttattgttacttcctctactttttaagtattttacaacataagaaccaggtgctatatgtctgttaacttaattaaaaagggttatataccatccactaaaatttaaaataacactaaattttttttaaaaatgacttgctgaggtgttcctttgtgaatactctccccattccttgggctgccttattatggccattctatccaaattggcagttcagggaattattcatttctggggttgatgactttttccatttgccccagctacaaaggagtacatgtgttttaatgaagtcatatttaaagacctggatatttattactggtatacaaaaaatgaaagcaagtaggcatacgattgttgacttttagtgattctaatattaaacataattttaggcctggtctagtaaggtttatgtaataggtgagtttttaagagcaatgaggaccaattgcataagctttgcatgaattgataaatggagaagagaaatcattgtacttaacctgccaggttcacatagtcttcaggtataaaacacaaagccatgtttattacctgtacagttagctaattaaacatctacggcaactttaaatattatgaattcattacgttaatccaaattcctgtgaaatataagactgaaaaacaaaagcaatccaagggaatattcacccttgccacatagtggggaaaacatatttaaaattttactgccttttccatttcacacatgagggatctgagactcagaaaggttaaagagaaggccacagaggttgtaaaaaagttacagcaggattcaaacacaattctcttcagtttattcatatcttttttatttttccttagtacccaaatagccatgtcacttagtataactattttgtttttacttcaaattatttcataatttaccaggaaagttatatttttaggtagatgtagttttcataacacaaaaaggccctcataatttatctaatttagaccttttattttacagatgagaaaactgtgatcaaaagaggcaaagaaaatttcctaaagattcataaatgtctggtggcaaatgtgtcacctagatttccaaaaatctttcaaaaatgtttgtgaaatagcattacttaattaattcaagtagatgtatatttcaagtacaaataatgaagaaagaagttaatgttagcatcatctaatatttatttgacttatgaaaatatgtggtgtattaaatagataatttgactaattgcctttaaatttggccactgtatgagcataaataatagaatcaaatctgatattatttgcatattatatatgcttaagtgatttttaatatatagttgtacatattcttaggaaaatttgtgtatttcatactgagacatattgttattcgctcaggattattgtgtttttctctctccattttttttttacattgaaattgtttatcaattggttcttccaaagagaattcttcagttaattatgtaggtatttattaagataattgattcatgaaattaagattaccttttgttcatttgattttggaggagcactgctgttacaaataaacaaccttgttatttgccacttttttccagtgactgctcatgaaagaaattaaaatgatacatcatcagtggatcttcctgtagagtaagatagaacaacttttgcaaatcaaatggcatgcaacttcacataaaagagatttggctcaattatgagttcaatcatagttctgttaacataaatcatttttcttcatccccaaaggcacgtatttgcagaatacctgctaagtggtaggggctacagaaacaaaactacagacatcagtgtattttctgtactgtgcatacaagtgtagagggtcataaaatatcttttagaaaataggttagatatagacgctattcagcactaggtaactatatagttgtcattttaattctatgttaatatgcccctgcaaataaaattccatttgcgctttatctaagttgggtgaaaaaaagttttatttcaaactacagcaataaatgtgcccttccttttcataactcttcttcagagtattccctgcccacaaacaagcatttttatagaaatctagtgacaggacaaaaaagtggtgtttctattctattaggtttctgtgggaaccaagaaatagtacaaatattgatcatgtaagtagactattatatttattataatatagacattgattacttcctggagagtttttaccttgtaaaaactaggctacagtatcatattcccactgaagacagtatggattccatttatttccaaagcatgtcaagagatgccacagtgttgtatttcaaggtacagacttaagtctcaaattgcctgggtttaatttccagctctgctacttcctggctgcgtaaacctggacaaattcttcacttctcagtcttttaacttcttcactgtaaagcagtggtaattacagttttcattatatagaattattaagagaactaaatgcactactatttctaaaggacttataacaagatcaagtatgccaaaagtgaaaaagaaagaacgtgaactttggtgccaggcagaagtagatttgggttatgaatctgtcatttaactagtggtgtgatcttgtgcaagtttttttaaaatgtgcaatctcagtttcctcatatgaaaatgaggactggtagacatcaaacctcactcatataatatacattcatcctcttctctttccgcatctccataaacagtttacaaacattactgcttatgccaacatcaaattatgccctccccaaattaataaaagtgaaatgttagatttgttttcatttacttaatttgactttacttaatttcatttaatttgaacattgtatgctttcatgtctttgtcttaggcaaaattttcttgctaatgaatactaaaaagtaaaagaaaaaaactggcagatatatgtatttgcaggatttgctcaacttccttaaaacatgattagaattttagtgaattaatttaaggaagttttaattcggaataaagcaagaggacataacaaaattccattttactgtaattgcgactatgtgatgttgcttttgaaataatttcttttggtgggaaggtaactgcaatttcttagccttgttttacataagcctcttgctttttattgactgtgtgtggaatctatccacttctgtgtgaatagaatacacttgagcctccagttcttacgtgctgctaatctgacaagaaatatactcatcccaaaatgattaattaaacatctagagaaatccttacattccttctcaaccaaaactatgcttttccccatttcattgtagtcttcagatgcatttttaaagggaaatttcctacaagtgaaggtctcacaggtccatatatggcagtgtggtgaaatgcaataagactctcacactgatacattgagcactcactatatgcagagataggtgccccatgagacctgacccgggagaggaattacaaaattgaaaaagcacaacttgaaactttaaagggtgactcagaagtgagatgaatattttcctaggaaaattttaatcatgaactcttaaacttatttgtgaaaaacatgtaatttcattaaaaattaatgatatacaaattaaaatgagatgtcattttccccaatgaaactattaaagatgaatacaaaatgtataatacccagtgccaagagtaatacaatggtatgtatctaacattcactattattggtgtgtaaactttctgagaaaaaaagttgtaatatttacctatcttaaaatatgaatagattttccttcagtgttttcattatcaacaattaaaaaatgagaataggaaaaaagatttatgcacaaaagtattcaccttggcattatgtgttttagtgaagtatcagcattggtctaatgtacagaaatagagaaatagcctggcatggtgacacaagcctgtagttccagctactgagggggtggaggggaaggcaagaggatcgtttgtgcccaggagtctgaggccagcctgagaaacatagcaagatccttctttttatggataaatatttaaaaaaaatagagaaataaattaaaaaattatagtacatttataagagaaactattatcctctcattacatactatattgtatattgtaaatggctttaatggtgtagggaattgttttcttgttttgttcaaatgataattttgaattttgaatcttgtgactaatttgttagtcctgcaaaggcagtctagtcctcaggcaggaagggggtttgtttgaggaagggctgttactgtccttgtttcaaagttaagctataaactaagttcatcccaaagtgagttctgtctacacccaggaacgaacaaggataccttggaggttagaagcaagagggagtcagttaagtcagatctctttcaccgtcataattttctcagttataatttttagggcagtaataagagaaaaacttcagccgaattaaatttaagaagttaagtgagtaatgaatgatttgcgaatcggagagtcccagaagcacaggaaattcgccgagactccgggtgtgcctgctggtcagaacacatttatagataaaaaaggtaaagtgacctacaggaattggaagcgaggtacagaaacagtgagattggttacagctcagcgttggacttctttgaatgcagtttgaacattcagcagtctatgagtggttaatgtacggtcgctgggattgcccaacactcagctattgttacaggtgcatactactaagctaggttttcaattttgtctgactattaagctagggtactgcttatccacaaggactcaaatacagaagtacgcagtccttctcaggccatatttagtttgcggtttcaatgtggataggatttggtaattcctaattctctgcatagcagcccttttccaaatctgaatgtccctgggctcatgatccctgatctccagggctctcattcctgttcccccagcccagaatcttagcctggcatgttgctcccaagtcacgccagcctagctggtgttgacacgctttcaaaattgcttcccttttcgtattggctctactctgcaaggttcctctcctaggtggttgtttagaggaattattttgcctttctaagtctaggttttctcctctatgaagttacatatcccttaacttatgggatagtgattgctagccatttaaatagtcatctgttctgtgaaaggactgtacatgcaaagcagcccccggaataatgaaggagccaagaaactgtgggagctttcatgcgcgtctgtgtgaagacaccaccaaacaggctttgtgtgagcaacatggctgtttacttcacctgggtgcaggcgggctgagtccgaaaagagagtcaacgatgggaggtagggatggggccgttttataggatttgggtaggcaaaggaaaattacagtcaaaggggggttgttctctggcgggcagagtggggttcacaaggtgctcggtaggggagcttttgagccaggatgagccaggagaaggaatttcacaggacaatgtcatcagtgaaggcaggaacaggccattttcacttcttttgtggtggaatgtcatcagttaaggcaggaactggccatctggatgtgtacgtgcaggtcacaggggatatgatggcttagcttgggctcagaggcctgacaggagccataggctgttggccctctaaaggtttgctaaaaattactgacatgaagcagattgattaataggagaaaacacatacaaatttaacatgtatacatgggacccttcagaatgaagactcaacttcccaaatacttacagaaatgaatataccatcctgaggccacagtaaataatgtaggctcataatgtggccggaaacaggtaaatcaagtttaatggcaagacaggttgaaagagagagaaaggccgaaaacaggtaaattaagtttaatggcaagacagattaagagagaaaggaagattttggctagcaaaagtggccttgtcatgtagatgaagcctccctcagggagaatagatggtaaatgtttcctttcagattttaaatggttccgactctcaaaagagaaaggaacaagcctgcattaatggagattctctacaaatgcaaatttccccaacttcggacagctttgcaagaccacttctgtcaggctggccaagtggcagccatttcaaaatgtgacaaagaaatatattttgggataaaatgctttaatttccttcaaaaccaaagaacaaggtagacaaatctaatttctcagtaaaggatgttttattgaggggacttacagacagaagggtgctctggggtggcagcaagacaggaagatctttgcactgttacttcccagattctgggtttatgtaccttaaggaaagtgtgtatgtgctccagtaaaaaaagttcaaggtgccaggcacagtgactcacgccagtatcccagcactttgggagcctgaggcgggaggagttcgacctgaggttgggagttcgagaccagcctgaccaacatggagaacctcgtctctattaaaaatattaaaaaattagctgggagtggtggcgcatgcctgtaatcccagctactcaggaggctgaggcgggagaatcgcttgaacccgggaggcagaggttgcagtgagctgagatcacgccattgcactccagcttgggcaacaagagcaaaactctgtctcataataataataataataataataataataatataaaaaataaacagttaaaggcaaacctcttgaacagacaagaatgctatatgtgtcatacaatttgtgtgataacatcaaggttgacatattcttacactagggacagtcatcaataaagttgtaatcgggaggcattctggggactgaggttaatcagaagtcaccatggtgtattagcattcaagatggagtcacttttgtctccacagcatcttttttgggtcaaagaattgacttaaagatgtggaaacttcaacagaactagttcactgaaggcatataatttaatggtattattaagtccacaaacgtagatattgccacaaaatattaccatctttgccatttaattctttagtagtgataaaaatgcagtatttattacatactaatttctaacttattttttgttgtgtctattatatgttgacatacagtttctttttcttttattctttatatgggcatttaaactttagttttctatagctctttccattaacctattttaagttccatgtgaatagaagtgttttggcagtgaatctatttgagtctgcagcaacctcaattcttgcttcctcagaagaaagaattcaaccaaggggcataaggcagaatgagaaactgaggcaagttttagagtaggagtgaaagtttattaaaaagttttggaggaggatcaaaaggaagttagggtacacttggaagcagggtacacttggtcaagcaggtgacttgagagatcaagtgcactgtttgacctttgacttggggttttacgtgtcggcatgcttttggagtcttacatcccttctcccctgattcttcccttgggttgggttgtctgcattcacagcatcctgctagcaattgggagggaagcatgtgcagtgtgtttactagagttgtatgcatgttcacttgaggcgttctttccttaccatccagatgttccaagaaggtcatgtaacagttaaactccacgattttgcctcttaatgcacatgcttgagcccacttgcccaactcctgagatcttaccatgaagctgatgagcactagttttaggttttttctatctattgggagactgccttttcttggagctggctgcaagcaattattttagagaaacaatgtaacaactgcctatcacctgatggttgcctgacattcctggtgggagttgggggagccctctcctgctctgttcatgtctgactagctacctagtgaaacaaaagcatatgaaatttagtcattccacactaaatcattcagttatgcttttagcaccaaattaacgtaaaacaaaattatatagtttataacctctattttaaaatatataagaaaatcctctttttccaacattttattttgaattttttgatactccctttgatgcattttttatatatatatcatccttctgagctttgtaaaataaaggaatcaccttttttttttttttttttttttttttttttgtaaataagagtaccaccattctagtgacagccagttttttttagtattaccacagcatcaaaccaacatgtggagcatctgacctgcattctcttaactttgctgctgacttgggctgagaaatcagatttcatatgtccaggagtttgcagttgtctcttccaaatttatttagaaatctactcttgataatgtttaacccaattacacaggagattaaataagaattatctacctccttacccctccttcatatacaccaagtctgtaactcccactcttaccatctctcttctcctgaacttttcctcttggctaagacctcagtcctagagagtaataattaatttcagcaagcctggtgtgaggaaaaaggaacaacagaaagcacataattcttaatacagttgcttgttcacactccagttctactctatatctgtgtgagataatgtgattctagcttagtgatttagcaaaccatttttagtacatgtcatccagtgatttccttttaataccctgggcagacgcatcttacatttagattcctaagacatagaaaaagtaaaacagaggatctgttttaatacaacacccttctcaactggcttgatattattttatctatttatgttgtttgtgattacaaataggacatatagttgcactttccttttaaaaatgtggatttgttaacatattttctgtgttatagatttagtaaaatcataaaaggcttaaatctaaggagactagtgtcttctaaaagagtagaactaagaacagaccaaattcccagtaagtttgaggaacgtgacctaaaaaaggcaagaaatagagttaagctctttaaaactccacaactccaattcccctcacgcttctttattatctctatagcatagtcttctatctgatataaaatatatttgctggcttatttatttactcctgtcttcctccacctaaaatgtaaattccaagtagtcagggagttggactcttattcactgctctttcttcaatacttagattgtgctggcacagagtgggtcctcaataaatatcaataagtcgtgatcaaatgaatgttactagtatgcttttttggaatctataaagatttgaggcctaccatacaatcagttttgataaatatgcctcaggtgcttgaaaagaactgtgttctctataggatacatgtggttcaataccagtatgttactcgaacctattatccaaaaaacatgtaattcaaatgatgaaatccaaattctctatgcctatatatatttttttcctacctagtctgttaaatgctcaaagcattatatgaaattcctataattgtttttccagatgtttcccttttattattaatatttaaaattactgtatttctaagagtcttatgttacatgttttaatgtaacatcagagacatgtaaagattggtgacaactattttcattgtagattgtaactctgatccaaaaaatgtccctctttttaaaaaaatttaagttgttttatattgtctttcttgaattttactttttctagatttaatgctgttcttagtgcttgctttgagtctgtgtttacttgtgaagttttgtccattcattgatttttacatgtctttaatatgttacaatcaatatgtatttggattttgtttcttaaccagtcacaaattcttcaccatttaaaagtagaatttataacagttacatttattgtaactgcactctatttagtcttatttgaacttttgttattttattatttatcactgttggtagtttattttcctagtttttattatatagattctatggcttacttttagtttcccagttagtacacaattttcaaatctgtaaaagtaagtacatctatatacactctgcttctaaatctaaagttcagttcatcaattcattaatctactatttattgagcacctattatatactagaaaatattctaggcagttgagatacatcaacaaaatacacaacacatggaactttgttctagtgagttgctttaaataaattagaaataattatcatataattaatttattgataaagtagaaaattaaataaagtcttttttgcttttctaatttagtgtaaggaatttcaaatactttatcctcacttttattccctgccatcccaatttaaagtcattgtcaaaacaatctatgtgtttagacctgaaagcttacattaatatttatttacagcttacacagattctattccaatattacattttgttttgttcatttgtctatccaaaaactacaatttacttatactgttaattatgtttaacaattttatatcacactaatcctttaatgacaccattttcctatgttaaaattcttgcttttgattcatcattcagtcagctgcaattcaccttcaagtaatatttgcaaaatgaacataactttctgagccaagcatatctgaagttagcattctattgtttttatatgtaaataaatatttggttaggatacatttttttttcttcttgagacagtcttactctgtcacccagctggactgcagtggcatgatctctgctcactgcaacctctgctgtatgagttcaagtgattctcctgcctcagtctcccaagtagctagaattacaggcacccaccataatgtgtggctaatttttgtatttttagtagagttggggtttcaccattttggccaggctggtctcaaactcctgacctcaaatgatctgcctgcttcagcctcccaaagtgttggggttacagttgtgagccaccacgcctggccaggataaaatttttaggttgtaagttgatatcctcccctgaaaactctgtagcaccttttctattgcctccagatattccatgtggcaaagaagtcagttgctaataagacttttaattcctttgtggacaacatttttacctgtatagttgacagtaggatgtgctaaatatcttgatgaatcaaatattttgttccagtaggtatctatgtagatttgcatattttcatactaggccactggaataaggacagttcttttcacctctatactcatttgtttttgttttattttgccttcaaactcaggtaagtgtcatccatgtactttctttttttccttgctaatttgtacttgctaattgcctcctttgcagctgccctaatgtcttcctctggaatgtgtgtctaaactcttaaggttaaatagacatttcttcaatctctactttctgttttttcttttttatttttttttatcatttcttcactattatgaagttcttttttttttgttgtttgtttgagatggagtctccctctgttgccaggctggaatgcagtggcacaatctcagctcactgcaacctctaccttcagggtccaagcaagtctcctgcctcagccttctgagtagctgggactacaggtgcgtgccaccatgcccagctactttttgtatttttagtagagatggggttttaccacgttggcccggatggtctcaatctcttgacctttgatccgcccaccttggcctcccaaagtgctgtgattaaaggcgtgagacaccgcgcccagcctatgaagtacttcttatgtttttttctccctcttacagtttccattttcagttcaggctctaatttatccttatgactttgaacccaatttcatagacagaggatgcaaaatagtatgtctatatttgttttccaattcttgtagtaaatcagttttaaagataagcactcactctcatttgtacagataataagatgatatcaactgtctgtctctctctttctttaattttctatacttaaacaaaaggtcatctacactgattatatgtttgctactcaatggggttggtggaatgtcttggctttcattattgactacctgggagctcattagacatccatttcttacctacagctaaaatgcagaataatatattgcctagttctttctttcttttttctttctttttttttattttttatttttgatagagttttactcttgtcacccaggctggagtgcagtggcgatctcagctcactgcaacctccgcctcccgggttcaagtgattctcctgcctcagcctcccaagtagctgggattacaagcatgcgccaccacactcggctaacttttgtgtttttagtagagatggactttcaccatgttggccaagctggtctcaaactcctgacctcaaatgatcctcccacgtcggcttcccaaaatgctgggattacagacataagccaccgagcctggcctatattgcctaattctaagaacttacatgtatgcatctagcacgcttgtactgtatttctcttggcccctttcatctagaatttatgcaagagaaggtcctgttagtaggggttaaacatttggattcagctattcctaattgcattttagttattacatcatgtaacccaatacatttcttttgttgttgttactcttttttgcttgattcatttttaatgtttccttttgtattaattttttaaatcctggataaaacaatagttattatttcttcatgtgttttagcatggcagaaagaagggtagtcgatataattgtaaatgctaaaaactgagtcagccagagtgtacaccaatcagctatccagccttagatctaagaagagggtttggctcttagacaaattgactgagtaggaccaagaacaagtcaaactcatattttgaccaactgcagggatggaaaccatgctcaaggaaaataaagaaaaagaaaacattaaaagtaaaataatatttttccttttaaaaatattatccagcaaaaacaatggattatcttagtaaaagaaaagcagatctctgaaaatgatacaggaaccccagaatataatttttagaaattgacactctttatagaatgtatactacattaactctgaaacagaggcataaatcagagaaaatagatttaataaaaagacatgaggctgatatttaacaatgggtgtgtataataaggaaggataccaagagaattaaacagtaatgatagattttaaattcacaaaaattgatgctaataaagagtggaatcaatacaatagaaaactgattcattgcatgcaggtcatacttaaaaagttctcttgtaatatagaagaaaaaacaaagttgaaatgaagagaaagaacataatacatatgatattaaacatatagatctaactttagaattttccaaagaaagatataaaattggaatataagtataataaaatgtaatatggaagaattttcttgagttgaaaaattggctcaattatccaaattgaaagagtcctccttataataagcaaggattaaaaagaaatatctacatttagataaatcctgaaaaatttttaaattaccaagaacgctgtcattatacaggccagataggaaaaaagtccgtaagaaaaaacaaaaccaacaataggatatctagaaagtaacaaaaaatcgcacacccagtctctctgcaactgtatttcagaataggatagagcagcatccatagagttttgggagaaaacatcatgacccatggatattacacttaagaaaatttcttttctggaatattcaagggctcagaatatatagcacccctgaattcattttgaaagcaaagtaggggttcaagcacatgttatatgtaagagaatttgtgggtcttttcattctttgtttgattccaactcaggaatccaggtggactgcttcctgtcaggggaattttgcaacccaggggatatacatggctctaccatattcctctgctgtttcttttctgcttccacatttccaccaatttccaaaatctcttccttgtgccacgtcttctactttaccattgagatggcctcttgtaacttacttcatagtcattaagtaagtagtcacttaaaataacaggtgccatcctcatccaaccccttctaacaatgacaaaacttagtttcaagagtttaaaatagctttgaaccctacatttttatttatttccctactagaaaaacagagaagataaagtctctttatactcattttaactgctaggaaattttattataactctctgtaactttttaaaattcttattcataaccggagtcattgtttttttctaatatgaaacaggtagtttatttttgcctgttttatatattttttctttttcaggttttaaattttattgagtgtactgcttttatagtaaatatatacttgattaaaatttttaaaaatagctttcccacagtagagatatggatgcccaattaggtgtgttgaccttggacttctgagccaggattcttagaagccgagttttctagccatcatttagacctgcacttatccaccaattaaaaaaaaaaaaatgagcaccttcctaatacttcgtatatatagaagaacaaaatcaacacagtctttattctcaaggatattacaatcttttgggcacacaggtagtaaattgataaatccctaccccccaacatccaacatatctttttttttttttttctttttgagacggagtctcgttctgtcccccaggctggagtgcagtggcacgatctcggctcactgcaagctccgcctcccgggttcacgccattctcctgcctcaggctcccctcccgagcagctgggactacaggcgcccgccaccacgcctggataattttttgtatttttagtagagacggggtttcaccgtgttagccaggatggtctcgatctcctgacctcgtgatccgcccgccttggcctcccaaagtgctaggattacaggcgtgagccaccgggcccggccccaacgtatctttatcaatgtggatgtgtgccagcagagcacagtagctctgtttcatgaagcacttcttaacttattttctcacagcaaccgagcataacggttttgagcatggactctggagtcagagaatctgggttcaaattaagaccctactactacttaccagcagtgtgattttaatgtgttgataataatactggcctagtagagtgcatcgggattgaatgagtcaacagttgtaaattgtttagactgcttggtacaccataaatcaggggtccccatcccccaggccatggaccgtgccagtccatggcctgttaagaatcaggccgcacaagagaatcgcttgaacctgggaggcagaggttgcagtgagccgagattgcgacactgcactccagcctgggcgacagagtgagactgtctcacaaaaacaaaaacaaaaaatcaggtggcatagcaagaagttagctgcaggcaagcaaatgaagcttcaaatgtatttacagctgctccccattgctcacattactgcctgcgctccatctcctgtcaaatcagtggcagcattagattctcataggaacctgaacccaattatgaagtgtgcatgcaaaggatctaggttgtgtgcttcttatgagaatctgatgcctgatgatctgtcactgtctcccatctctgccagatagaaccatctagttgcaagaaaacaagttgagggttccactgattctacattatggtgaattatataattattatgtattacaatgtggcaataatagaaataaagtgcgtaataaatgcaatgcacttgaatcatcctgaaaccattcccgcccccatccatggaaaaattggcttccacaaaactggtccccagtgccaaaaatgttggcgaccagtgccaaaaatgttggcgaccactgccataaatgatctaacggcgttaaatgaaatccagcatgataaactttataattacttctagaaataaaagattcttgccatagcttaactccctgccttgattttcattgtcatttcaagctttttattttttctatgtcctttttctgaatttgaagcaaagatgaaaaatgatatgttggagttattcagtcagacaccatttttaatcacaagtcttggaaaactgaatagattatctgagcaggcccaagccactggtgtatttaaatgttcacatatagacatttctaatacccaaaaagaaagtatgccctttgcctattgctttgataaccctttgctgtaaggaaggagatcatatttaaattcctcctttcaaacatgtctatcttcccagatccagggctcacaaaatgacttaatgtggcttgttaggctcgtgggtgggcaggctggagactcagtcactatggcaatgacaggtttaaataaacagtgctagtaatataaataagctgccgccacaaagcaacacttttaaaccaaacacagaaccacattttaatgacagtaagcttagaaacttttagttaatattaaattaactaggtctctatgcttcagctttctctttcttacaaaatcttaaaaattcccctatgtaattccttttctattccagtttctttttatacatttctaatatttttttctggaagtcccataaggttggttatattgcagtttctcgtcaattacagtatacataattccttactcttaagaaaagggctgcagaatacttgttacagagagataaaacattttagtagttcttctgacattctatttgaatagtatgtaccctacaaaaacgacaactatcctgagtatacacaatcaacacatgttgacacatttattccttacaacttgttgagatggtgcctcatgctacagagaacactgtttcacagaagtcaaagagctcaccccaaattcataccacttttgggtgacagaactctcatttggactcagatattctgactttttttaggtccagggcctctgacacttccatcattatagggaaagaaaaaaagctgaatttgctttacttctgattcatttttgtgtttcatctctaagaatacataattcataactgacagtagactcttttctttcctaataaaataaatgtggatttctttatatttcagtgtgctttttaattcagctaatggctaaagaagggaaaagaagtaatagttccaataaagctatttttatttattaaaaagtttatgttcttagtcatatgttctagattctgaaagaagaaagtattcatttaagaacagataaacaagttataaccttcctgtttaatttgtgggaagtttaaaaaggtcaaatatgatgcacaaaattttctgcatgatgcttgttatctactaagatgaaattttaatttgggaaaacagtaattaagaatctttcctctctttactacaaacactgcattttcttattgttgagagttatatatgctcactgagatggaaataccatacagaacaatgtttttcaaataaatgtcttttaattattactttattgaagaaaatgccctttaatactaagtacaagagaagaattgaaataaaaggaaacagtgtaggtaaaataatttttaaaaggagatgattaaaattgactattactacaaacaattgaggttggggaaatttaaaaaggggaagtcatggatgtgtaaaataggtatattgagtcttttaaaaggcaaatttaaagtgttgctagtttctgaccagatattaggacaagaggtgacagagagacccccattaaaatgcttggtgagcactccagaggccgcctttgagttaatcggtaatttttcacagacgacatctaatctgtgagtataaattactttgcactcttattattccttaattgaagtgcaccaatgtgaaattgccatagatgtcgcaggaatgattctagcctcaattaacttgggtggaattgaagcccttttttcccttaactgggattattgtctgacatcttgtatttatttaaattgttgctagaaattagagggagactgtgtgtgactaggtgttttataaggatgttctggagccaaaagagcatctgtgcaatctatttctattttaatctgtacccattgtatgctgctgttttgtgtaatagatgtactgctagcagtagcttaacctccctagattccatttgggaagtggagattaatagcactcatattttttttaaaagtggcatttacagtctttgtaatttttagttcaaaaggcaatcaccctattaattttttaaactaagtctcctacatagctatttttgtttaatatataaaacatgatttaggctttctttctagattgtggggaagggcaacatgagtgaactctactgtgtatcctactttacccatcctaaaaactattggaaaaatattttaccgatagctatttaacattaataagtaactgaattcaaatatcttcttctgttttttcctaatgagtatcatttgggaaaatattcttggtttgttggttttcacctggaattaaaaaccatgaagaaaataaacccggtgtctaattacacagtaaccaaatagatacatgtaaaattatctctacaaagactataacatgctgataaaattactcccaattctcaacattactaataaatattattgatatcatagattatatataactggaggtgttttctaaaagtaaattttatgaggtctctgtaataacaaattgatcaatttgcttcaaatattctgcccacttactttacacattcttaagacctataaccagccttgaatgttgtctctgaaagtctcctattagatggaaaggttacctaatatggcaacctaataacatattgtggaagttaattggcattacctggagactgacatcaaaggtgattttctctagcttcgatagaattgtacccattgtcaatttgattcaatgtacgtttattgagtttctattatgtgacaagccctagggagacacattacatgatcctttttcattcaatataatttagcataagttcatttaacagattatttagctagtctcaaacaaatattctaggaatgagaattgtagtactgtttccagacgtcactggatacttgctgaggctagaagaaagcagaaagacttaaaagaaatttagaaatggcaagattcccactacatttttacttacctattttgagtcagtcaaattcaatgaaaatcattaatttttcagtatattggttgctctgtatatgatcttatctttaaagccaactgtttattattccaaaaccagctttctatacacatgcaagatttttgagaagaatagacaaggccattattcttgaggaaaaacttactaggatgaccctaattccatttttttaaaaatagagacaggttctcactctgtcacttaggctggaatgcgtggcctgatcacagctcactgcaaactcaaactcttgggcttaagtgatcctccggcttcagcctcccaaggagctaggattacaggtgtatgccaccacacctgattaatttttcaattttttatggaaatgaagtctcactatgttgcccagactagtctcaaactcctggcctcaagtgatcctcctgcttcagcctcccaaagcgttgtgattacaggtgtgagccactgtttttagctcctaattccatttttaataaagctatttttttttttgaagcttagaggaaatacactcatgaatgaatggatggttaaatggtttgcactgggggaaaattggtcttgataatctgctgatggtcacattgatggattggatcagcagaaaccaaagaaagcatagctggttcactctaggaatttgacaagtaaattaaactaatccaacctaaacacccattgatctcattgatccttagcctcattatgctatggtccatgtagacatacagagcaaaacaattcctaagaaccaatagcatagagcctatataattggagtatctccaaatcttaaggttgatacatcttaagcattctctaaattactatggctcatttctacctatcttaggaaagactgtgcatgcctcttcacaatgccaataacatttttgaggtattattattttttggtgttacttggagatcaatatcaaaggttcttcctcagttttgacagaactgtgtccattttcagttgaagtcaatgtacagtcgttgaatgactattatgtgtcaggttctgaagatacgtatcatctggaagctgtacaactagtccctgacctcaacaggctcaccagtcattgagcttccatttaacacaggttcttcattattatctggctgaaggtagtgtggatggctgtgaaagataaacctacctacgtttttctgttaagagtctgtctctcaaaactcttccgaagagccttttaacaggtctttcttcttcctgctgtctctcactctacctctacaccgtattcagacttctcatctaaatgattttgtcagttcagccagaagtctgtccaatcctttaactttacttacagttatctatagcctcttggtagttgacaactgtcagctggaccaacttgcattcattattcactcatcaagcaacccagcctagagatgagataaagagcccaagccaacaaacagtccattaaagctatctcaggaaaccaaaaacagccatctcagctggaaaccaccctggctgtgaaagaccagacgttttcaggctccacagtgatggctactgctctgctttgctccaatgtctgaccttatctgaacaagaactgaaagggtctgtaaatctgcctgaaagtttgcagatgtgtgatgtatattaattaggttcttgaaaaagataataatccataggacatgtttttagcctgtgtctgtattcaaaaaataagcagaccaggcatgactaattcattcatattggctgttagcaattgacatggatcactgcacaatcagtttagctttggcactgataggcaccagatttctagctccaacttcagatttgcaagtggaactcagctagatgatagaaaagtaaagggacatgtagagaggattacagtgctcagaccccattttcacttgggagaaatgatagccagattcactttttttttattctataaatttgtacatatggcatactgtgtgtagagattggcaggagatatatggatgatttcttttctttcccctcaaccttctcaaatgtttatcttctaatagggaacagagtcaggcaaatagacagttgtttataaagaatatccaccattaatatgcatagtcaccaattcagcatttattgagcacataatatgtgtagaaagtgtgctagggatgcattgcataataaagagcactaaatatggactgtataggctgggcacggtggctcacgcctgtaatcccagcactttgggaggccgaggcaggcggatcacctgaggctgggagtttgagaccagactggccaaaacagggaaaccccatctctactaaaaatataaaaaattagctgggtgtggtggcacgtgcctttagtcccagctactcaggaggctgagacacgagaatcgcttgaacttaggaggcagaggttgcagtgggccgagatcgtgccactgcactgtagcctgggcaacggagtgaaactctgcctcaaaaaaataaaaataaaagactgtatgttggagctacagctctataataaagaactctaaataaagactatatagtataggaaatcaaaacaaaagtgggcattataatccaatatacaattttcatattcgagttttttaatactacttccatcctgtcatcctctccactcctgcttctctgcttcctactctgtggcttccccacatccaggaaatctgcgatgctgctatatttaattaaaagtttcagatgagatttgttaggaaccttagaggggatgtagcaattccattagtgcccatatatttgtctcttaatggtacagccttagactctgaataaaatgatgcacatcttgagtcctattttgtagatattaaaaacataccttttataggtccttcccttcccccatcttttctatgatgtcactgcttcatttatgtatagccataagctgagaactgcatttattcctacattttcattttcacatgactgctctaattcacaagttacttatttcccatgcctctctacacttggtgccttctgtggtacctgtcacatgctgccgataaattttcttttgaactgaactataagatatgttatgaacgtaattaagagagttttttctccctcttagaaccatatagtactaaacaggagatgcaaagaatggagctcacagggcaaagatccaatgtcagtctcttcacattgcatgataagtgaatatggtcctttcttgaaataaggctagacagttctgtccccaggagctctgacagaacactttctttgagatgagtgctcatatcaactgaagctagttcacatttcctttaaaattaatgtaaagttgaatgagtactttatccacttacctactttgtaaaaagtgagtcctattctacttaaatgaaagctaaagaaaccacaagtcattagcctggaaatacttttgatgaaagaccaattttctattgagttatgtttaaaaccaggggagttttctctcactttccttttttgcttagttatttttctcttctttgattgtgcctttgtattataagaaggaggctgctgtgtttcattgtcacaaatgggtcatgcatttgttccaatgtgtgacctctggaaaggagaagattatattatcaaggaatagaaggttgtagcttggatgatttgttaaggaagaaaaagttaagtgttcagcagagagatactgagaagagtaggaaatcttttaggttgttacagcagaggaatattttgttcaaaaaaaagatcatacataaagccacacttcattattaaaatattaagtgcacacttttttttcaggacaaagcccttaagtattactctgtcattaactcactagggaacctaaactcttatcttctaatcagggctattatatcaattaaacgaaacatgatatgcaagtacttagccaagtgcctagcacagagtaatggtctcaataaattctggtgatacaacataggattagtcaccattattattaattgctatatgatagaatgggcattactaaaatataattagttcatattctggaaagatcagacaaatatatgtattcaaatgagttttttatttgaattgtatttatttgatttcagttaagggggtttatttgtttctggggaaagcattgcaaaagacaaaattattgcttgaagagcgagcatctgttgcagaggaactttaagatggcaaaggaaacacaactagaaggacgttggcatcactgaaagcctagaggaagactctgaggtctggaaaaggaagaaacaaaagcctgcactgcctgagtcaaagagacagaggaaaaaagaagggagaaggaggtcatattagtgaagcagagttggtgctgggccttgaagctgagtttgagaagttaacattctttacttctgatcataaacaatttaaaaactatggcccatctcgggggaaagaagcagctgtgacccagaatatatagataatcaaatattgatcaccctttctacccttagagccttgcttgttcctttgagtgaggtttctctgggcagaatctgacatgctatttttaataagaaaaagccttttttgttttgttttgttttactgttgagcacaatatgactacaccagcttagcctaatagggaatcaaggtttcctctgattgtcaaacgtgcacctataactggtgctgatcattttttatcagtcagtgcatcacatgtgctctggtggaatccatcttccatcacagcaagatcaatcaactctaattttaaaaaccaaaaggaaactatgtacaaaaataggaaaatgctatatttataactgtaaaatattcacagaaatggttaatacaaaatgaacatttttcaaataatgtttatttattattggattttcagttcacaatgtatcatgagtaatgatgtaagaaaattctttgtaagaaatggttggatagccttccttaatatttaggaaaaaaagtctaagcctgtttacgttcaaatctaaagctgaacacctggccagagcttgttgtagaccttttggtgagctgccgctaattcataaagtaactttgtgcaaattagaaaaacatacctcctggaggcagactgtcttgtgccattacaatctcctcaaccaggaggtagccctgttacatgggctaccttatggcacctgggcaaagctggacaattgcaatataccagcaggcctttcctcttagataagcttggaaaaaaagttagcttgttgcatgatgatatttcttttggcatggataacaggtaaaaaccctaaagagcacattattttctgtagaatttataacattgattttgttacaattaactttatttaaataaattgcaaattaagctactataatttggctctgatcaacaaatatccatctacattatgtatttatacacttacataaaagttggagactagttccatgcaacacagacaaaaaaagaattagattgctttgcctgaagagtaaagaaagtattttctttgaatatcctgccagaggaacctgccagatgttttccatcttttctgagtgcagaaaaaaaagaaaactggcttaagctacgtagatatttcagctctggaaaaagtttcctgacaaagagaataataaaattagtttataacaaaacctttttttctcaaggtagatagaattttaaaggcaagaataagcattttattggcccacattttaaaacccagtttttcctttcctttagaaatataaggataatttctagataaaatcagcatttttaactgtaagaaaaattaataaaggtatataaaacaggcctcacatattcatttcttatcataaagaaacggatttttgcctggaaaaatacccctacttgtctaaaatagttaagtgtggataaaatgtagtctggaggaaagggcaacagagtaggtagtttcaattactagatttttgccatcatgtttctataacaaaaaacaccattacataaaaatagtagattagtaaagcgaaaaggagaggaaatgtataaaattcatattataacaaaatattgttatctagaaatagtttactagtaaagcaaaaaagaaagggaacatacacaatatagtgagttgtttgagtaaagaaatccacaacctatttttttttccttgactagcactggactagaaaacagaaaaactagggtcctaaccagctatgtgatatcaggcaatttacattccctctctgatcctcagttttctcatttgaaaaattatatggtcacactagttactgaaggctcttccagccctaatatttttgttggaattctttacattctttatctttaagacatcagagttctcaaattttaggatacatcaaaatcacctgggaatttgataagacagcagattccaccccagagattctaagcccctctccagaaactctgattcagtacataggctccaaagcatcattttccacatactgtctccacggtgagattgcaggaaggtgcaaaagagagaacaggagacatgtcttattaaaactataaattgagtaactagcagagtgtctggcaaagaatagatggccaacaaatgttgatttaatgaactatttttcattaaaagattcctttatgttcatgatattaatggattttcatcattatctgattctctaagagaacgagggcttatttctaacagagggaaaatagtctaggttgctcagtagctacaaattgatgtagaagtgctttgtaaaattagcaaatgttttaaaattatttctttttttcaacatagctcccctccaatcttcaatgtaaaagaaaaaaaaatgaattctgtacttgtatactttttgtaagtggcataataacaatatgctctttttattctgaaaaaggactcactctttacagtaaagtgctggaaaatcaagccatcacttcaacccacagcatctgtctcttgcaccatctctgccaaatgtcacccttcctctcgggtttgattgtgctactgtatctgggagagtatgcctcactgcatagcttgtaatatcagtctctgtgccttccggtctcagattccctctcatttcacctcatgtatattaatacagagattagtttcactttttttcttgaatagctaatcacttggcagccaacatccaactgtggcattacaggtcaaatcagctgaaaaggacagtgacttcaagcaggaaaatataatgcttagtgaaaactgcacccagaacaggacctcagacttgtcacccggacatgaaagatttattttcaattacaaatctgagcttaatgtgagggcaccctgggggagattcagatcactgcctcttctaaattgaccttctacttgttttaatatttccttctctgctgaacagcattccatgaccctctgagctgaagatccatattagctgctgtagtaattccaaccctaggaaaacttttgaaaaatttctctaactgaaggccaagttacatgaataattttctccttggtgagccttcactggctaacacagcaatagattgggggcttcagacagtacctccagaggattgcggaagccaatatcaccatgttgcttaaatttgagtggaatccaaaagccaaaaattattccaattttcaatattaggtggattaattgtaaacagctaactcagaactatcatatatccccttggcgttggtaaacaagattccttgaggctagctgctgatactgctacactggctgctggaatcaggagtttgcctcaggatatttcagttccttgttttagtgcatttatgcgcacttaccagatgcaccaaaatacataccatatggccctaatatagggttcgcaaacttgtctcttaaaaagtactgattgtgatttcttaggaaaagtcctttttaatttttttttttttttttttttttttgtaatttaaagtttgggatagtgagaaacttgaattatctttcaagttttatcagagacctgattattgaaaagtagcttagtgtaattttctttcttctatagctttcattgcatctaacttgagacttttctctctacctgtgtttctagatcatttgttgtagaatacttacaccattcttggttgtcacctttgagtctaattattatgcccataatcatggataattgtgttagatgaaaataaacatattaccttcacttagttaatcttatcgatatttaggttttccatagtgattttatctacgtaatgtcaggaatggtagatacaatctaccattgtgtctaccaatacaaaaaaaattgggtccagtttttcctttcctttagaaatataaggataaaatctagataaaatcagcatttttaactgcaagaaaaatcaataaagttatataaaacaggcctcacatattcatttctagtttttgtaaacacagtgtagtctaactatatttgtatttaggctatgcataaaaagaaatcattaactaattctcccttgttatatatattttaactactttttttccagaatcaaaggtgcttagaaatagccacctttaacttcataagtatttatgatacacctactatatgtgtggcactttgccagatatagggatggtgttaaacaaatttccaactcagtgttggtacacagctacaaatgaacgtctagattaaactgggtgtttagaggaaggtaggatagctatgtttgaagtactcccaaaaaacgtttaagcgaaaccttagagacagaaggagttgaccatttaaataagtcaaagattgggaggccgaggtgggcggaccacaaggtcaggagatcgagaccatgctggctaacacggtgaagccccatctctactaaaaatacaaaaaattagccgggcgtggtggcgggcaccttgtagtcccagttactcaggaggctgaggcaggagaaggccatgaacctgggaggcggagcttgcagtgagccgagatcgtgccactgcactccagcctaggcgatagagcaagactctgtctcaaaaaaaaaaaaaaaaaaaaagcgcaagtcaaagagcagtggtactttgcagagaggaatctgtgaatgagagtgacagtgataaaatcagccaaactccttctgactgcaaagactagaatattttgatcaattttgagatttaaagagaatatttaggttattatagaactaagtctttttctctttctttcttttcttctatttatttatttatttatttatttatttatttatttttgagatagggtctcactctgtcgcccaggccggagtgcaatagtgtgatctcggcttagtgcaacctctgattcctgggctcaaatgatccccccatttcagcctcctaagtagctggaactacaatcatgtaccgccatgcccagctaatttttgcagtttttatatagacgatgttttgccatgttacccaggctggtctcaaactcctgggctcaagtgatccgcccacctcgccctccccaagtgttgagattacaggcgtgagccactgctcctggccttcttcaacagaaaatttttattaaaaaattataaaggaagttttaaatgtattgagcatagtgtatgttaatgttctcccattcccagagtatcgtgataagtcaaaggccaagttcattaagttacatgctccatcaggcaagagagtatagtaatagaagtcctatcaggaagttcattcatttgttatttatttattatttcatgaaatatttattccatggaaattaagctaggtgtcaggaacacaaagatatactctgtttattcaggggacataggccaatacacccagtgacaacttgtcaagagcgccaatggaagtaaatccagagattggttgcttaatcatcttctctacatctctccaaaatgctgtcccacttctcagacaatatttgaaatgttcaaagaaagctgattccttgccctgctcattatctttattttttctagtgacataatctacataactcatattaccatgctgtttccataatctatgaaatttaagccattaataatattttttagctaggatgaattatagacatgagtgctttcaatttttatttggtgtgtgcatgtgtgtttgtgtgtgtgtggcggtgtgttggtacttctatgtgcaacgtatgtgagattatttagtactgttctagattgtggttttaccccattttatgcctcttttttggaaatgaaatacccctatactccaaaacttaggaataagcttcagtttctgtttcctgtaattactagaatttttaaataattttcatatgcaaaagtcaattcaagatggattaaagacttaaatgtaaaacccaaaactgtagaaaccctagaagaaaacctaggtaatacgattcaggacataggcacaggcaaagatttcatgacgaagacaccaaaagcaattactaaaaaagcgaaaattgacaaatgggatctaattaaactaaagagattctgcacagtaaagaaattatcaacagagaaaacagacaatctatcaaatggaagaaaatgtttggaatctatccatctgacaaaggtctaatatccaacatctctaaggaacttaaaccaatttataagaaaaaactacctcattaaaaagtaggcaaaagacatgaacaggcacttctcaaaagaagacataaatgcagccaacaaacatatataaaaaagctcatcatcactggtcattagagaaatgcaaatcaaaatcgcaatgagataccatctcacatcagtcagaatggctattattaaaaagtcaaaaaacaacagaggctggtgaggttgtgaagaaaaaagaatgcttttacactgtcgatgggagtgtaaattagtttaataattgtgaaagagaatgtggcaattcctcaaaaacctagaggcagaaataccatgtgacccaacaatcccattactgggtatatatccaaaggaatattaattgtcctattataaaggtacatgcacacatatgttccttgcagcactattcgcaaatagcaaagacatgaaatcaaccaaagtgcccatcaaagatagactggataaagaaaatgggggtacatataggccatggaatactatgcagccaataaaaggaatgagttatgtcctttgcaggacaggatggatctgggagccattaccctcaacaactaatgcgtttgtttggtttcctgtgtcaaatacatgttgtattaatcagagttgtctagagggacagaactagtggaatatatatatatatatatttattcagcttctgtttcctgtaattactagaatttttaaataattttcatatgcaaaaatcaaaacgcatgtgtgatggttaatactgagtgtcaacttgattggattgaaggatacaaagtattgatcctgggatgatctgcgcagcaactttatatctccttatatatatatatatataaagttcgaaaaatagtaatttttataattaccttttgtaattttaattcacattcattaaattttttgtaaatttaattaatttgataattactaaatatttaggaattatatatgagaagaccattcaaaaattttaactagacaaataaaggaaagccaaagtcccctaactactagttagaggtttcttgtaaaattgctgtatttattgtgccaaagaaaagatgtgttcaaaggtaatgggtacatgtcaaaatgacataggaaccagctttgaggggctcccattagccatatgtgggacaattgtagcatcaaaatatggcagtaaaagattataaccactgaaataaaataagaacccacgagtccataatggtataaacaaatgaataagtgaataaaagttgaaaagaagaaaaagcttttttaacagccaattccaactaataataaaacaaatgataacattaaattttcttaaagatcatcaacagacgttaagattagtgtgtaaaagtgatgaaaaagaaaatgttcatagtttcaatgtatctatatactttatacttaccccatgcaaagggaaaatagtaactttctaatggagtaatggcaaaattaccaccctaaccaaacggtcaatgggcaaagcaacatcatgtgcctcctgttgcagtgcatggagatgatacaacatttcttcactaatcttttaccagaaatctgtaacctgaatataattatgaagaaacatcagataaaccctaattgagagacattatatgcaataacagacctatattcctcaaaaaatgtcaaagtcaagaaaaataaagaccaacgaactgttcaaagttaaaaggactaaatagaaaactaaattcaacatgtgagttcaggtttgataggagagggagagaaaagaaagggaagggaggaaaaggaaggaaggagagggtggaagaggggagagtaaaaggtattatgttgaagatatggttgaagtttagacagtagctctttccaccattttttaaatgtttctgtaatactgaaagtattgaaaagttttaaaatcactaaatcagtcagaatagcttttaattgagaagattataatattatcagcatgtaataaataccaggttttcctagtcattcattagggggacatttatcctctcaaaaaatcttaagatattagaaataaaatatggaaaataatctagtctagccaacattcttgctaaattatcttgtcatttttatacattacccagaccttatcttatatatttctctttttattatttgtgtctgtctcagggatcagctagtgtggaattaaagaccatagcatccctctttcccactcagacccagctattttcagttaatccttgctacctcttttatgatgatcagatttctcacacatcacctctctctcttgctctctctctctccctcattctccctcaccctcacactttttttggaggagatggctttttttttctactctcttttttcgatagcctaagaattacatcaattatgtgtattagcaattaaaaaaaatctattctaaagtaatgaattgccagcaaatcaagacacaatgtcctctatttcatcatcatcatagtattttggcttacaaaactgtttttattacaatacaattaaatgtttggtttcaattctaagaaactacctacagtgaatacaaacatgtttcttacccttagtagaattccttttttttttaattatactttaggttttagggtacatgtgcacattgtgcaggttagttacatatgtatacatgtgccatgctggtgcgctgcacccactaaatcgtcatctagcattaggtatatctcccaatgctatccctcccccctccccccaccccaccacagtccccagagtgtaatattccccttcctgtgtccatgtgatctcattcttcaattcccacctatgagtgagaatatacggtgtttggttttttgttcttgtgatagtttactgagaatgatgatttccaatttcatccatgtccctacaaaggacaagaactcatcatcttttatggctgcatagtattccatggtgtatatgtgccacattttcttaatccagtctatcattgttggacattggggttggttccaagtttttgctattgtgaataatgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatgtttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgacgatgagcattttttcatgtgttttttggctgcataaatgtcttcttttgagaagtgtctgttcatgaccttcacccactttttgatggggttgtttgtttttttcttgtaaatttgtttgagttcattgtagattctggatattagccctttgtcagatgagtaggttgtgaaaattttctcccattttgtaggttgcctgttcactctgatggtagtttcttttgtgtgcagaagctctttagtttaattagatcccatttgtcaattttggcttttgttgccattgcttttggtgttttggacatgaagtccttgcccatgcttatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaagatcagatagttgtagatatgcggtgttatttcttagggctctgttctgttccattgatctatatctctgttttggtaccagtaccatgctgttttcgttactgtagccttgtagtacagtttgaagtcaggtagtgtgatgcctccagctttgttcttttggcttaggattgccttggcgatgcaggctcttttttggttccatatgaactttaaagtagttttttccaattctgtgaagaaagtcattggtagctttatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctcttggaagcaattgtgaatgggagttcactcatgatttggctctctgtttgtctgtttttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactattgaataggagtggtgagagagggcatccctgtcttgtgccagttttcaaagggaatgcttccagtttttgcccattcagtatgatattggctgtggggttgtcatagatagctcttattattttgaaatacgtcccatcaatacctaatttattgagagtttttagcgtgaagcgttgttgaattttgtcaaaggctttttctgcatctattgagataatcatgtggtttttgtctttggctctgtttatatgctggattacatttactgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctctttttttggttgtgtctctgcctggctttgatatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggtttagtcttgggagagtgtatgtgtcaaggaatgtatccatttcttctagattttctagtttatttgcatagaggtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaccagctcctggattcattaatttgttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatgtctgttcttttacatttgctgaggagagctttacttccaagtatgtggtcaattttggaataggtgtggtgtggtgctgaaaaaaatgtatattctgttgatttgggagggagttctgtagatatctattaggtccgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttattgaattgatccctttaccattatgtaatggccttctttgtctcttttgatctttgttggtttaaagtctgttttatcagagactaggattgcaacccctgcctttttttgttttccatttgcttggtagatcttcctccatccttttatattgagcctatgtgtgtctctgcacgtgagatgggattcctgaatacagcacactgatgggtcttgactctttatccaatttgccagtctgtgtcttttaattggagcatttagcccatttacatttaaagttaatattgttatgtgtgaatttgatcctgtcattatgatgttagctggtgattttgcttgttagttgacgcagtttcttcctagtcttgatggtctttacattttggcttgattttgcagcggctggtaccggttgttcctttccatgtttagcgcttccttcaggagctcttttagggcaggcctggtggtgacaaaatctctcagcatttgcttgtctgtaaagtattttatttctccttcacttatgaagcttagtttggctggatatgaaattctgggttgaaaagtcttttttttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattgggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccatcgctgataccctttcttctagttgatcgcatcggctcctgaggcttctgcattcttcacgtagttctcaagccttggttttcagctccatcagctcctttaagcacttctctgtattggttattctagttatacattcttctaaatttttttcaaagttttcaacttctttgcctttggtttgaatgtcctcccgcagctcagagtaatttgatcgtctgaagccttctcccctcagctcgtcaaagtcattctccgtccagctttgttccgttgctggtgaggagctgcgttcctttggaggaggagaggcgctctgatttttagagtttccagtttttctgttctgtttgttccccatctttgtggttttatctacttttggtctttgatgatggtgatgtacagatgggtttttggtgtggatgtcctttctgtttgttagttttccttctaacagagaggaccctcagctgcaggtctgttggaataccctgctgtgtgaggtgtcagtgtgcccctgctggggggtgcctcccatttaggctgctcgggggtcaggggtcagggacccacttgaggcagtctgcccgttctcagatctccagctgcgtgctgggagaaccactgctctcttcaaagctgtcagacagggacatttaagtctgcagaggttattgctgtctttttgtttgtctgtgccctgcccccagaggtggagcctacagaggcaggcaggcctccttgagctgtggtgggctccacctagttcgagcttcccagctgctttgtttacctaagcaagcctgggcaatggcgggcgccactcccccagcctcgctgccgccttgcagtttgatctcagactgctgtgctagcaatcagtgagactccgtgggcgtaggaccctccgagccaggtgcgggatgtaatcttgtggtgcgccgttttttaagccggtccgaaaagcacaatattcggatgggagtgacccgattttccaggtgcgtccgtcacccctttctttgactcggaaagggaactccctgacgccttgcgcttcccaagtgaggcaatgcctcgccctgtttcggctcgcacacggtgcgcgcacccactgacctgcgcccactgtctggcactccctagtgagatgaacccggtacctcagatggaaatgcagaaatcacccgtcttctgcatcactcatgctgggagctgtagaccggagctgttcctatccggccatcttttttccgaattccttaaatttgtttattgtataacaaaatactcttactctacctaaaactaagaaggctatatatatatatatatatgtatatatatatatatatagccaaagtatttttatacaacatctatatatatatgttgtcctcttagttttaggtaaagagtattttgttataatatatatatacgtatatatgtatatatgtgtatatatgtatatatgtatatatgtgtatatatgtatatatgtgtatgtgtatatatgtgtataagtatatatatgtatatatgtatatatatattgccctcagtgcatatatatgtgtgtgtgtgtatatatatatatattttttttttctttccaacttttattttaggtgcagtggctatatgtgcaggtttgttacatgggtaaattgcatgtcaagggggtttaatgtacagattattttgtgagcaaggtaatgaacatagtatctgatagttttttcaatcttcaccctccccctagcctccaccctgaagtaggccctggtgtctatagttcccttctttgtgtccatgtgtattcaatatttaacctccacttacaggtgagaagatgcagtattctgttttctgctcttgtgttaatttgcgtaggataatggcttcaagctccatccacgttgctgcaaaagtcatgattttgttcttttttatggctgcatatatttccacagtgcatatgtacgacattttctttatccaatccaccactgatgggtatctatgttgattccatgtctttgctattgtgaatagtgctgcaatgaacatacatgtgtatgtgtcttcatggcaaaactatttatattcctttgagtatatacccggtagtgggattgctaggtcaaacggtatttctattttaagttcttcaagaaatctctaaactgctttctacagtagctgaactaatatcattccacaagtagtgtataagcattccttgtgattcacaaccttgccagcatgttattttttgaacatatgtattttgagatgctttgccaactcttttccatggaatagtttaaaaatgtggtaaatttaaccctattttgtatattataaatatttaactttttgtaatttttaaaaacttttttcttttaattcttcttgacttcatttttttcagtaaaaatggataagtggtttattctacttaatgaaataggtgacaataaagaaaacgtcaaatttgttagttgattatagccacagtatttttatacaacatatattaagccccctgcatactaaaaacattatctcttctaataatgataattttatggggtgggtactattactgatattgtctattaggaaaccaaaactcagagggactaactaattgacacagtaatttgctcacaaacctgtgttagtctgtttgtgtcgctataaaggaatacgtaaggctggataatttataaagcaaaaagatttatttggctcatggttctgcagttctgtacaagaaacatcacagcagcatctacttctggtgagagcctctggcttccactcatggtgggaggcaaagaggaaccattgtgtcatatgaggagtggaacaagccattcatgaaggatctgcttccatgacccaaactcctcctaataggccccacctcctacactggggatcaattttcaacctgagattgggaggaaacagatatccaaactatactaacatcctggttatcctaagactggctgtctttttaccacactaaatgttgggggaatctcaagagtctctcaaactttaggaccttggcctgtattctagaccagtattctgggatagcctactgggccacatgtcctcttatctcatctcggataagccccacccaggattgtcctattttcctctcttcaaaactaatgctacccacactgcatcttagagtactttccctcaagattggctgctgagagggatttttcctaagttctcacttcattgctgccatctaagaaagacacatagacctctttcatttgaaaagtttaattattagtcttcatgtgttaatagaaaattataacattaatgctgtcctttattcagcaaacatgtatataatgactatctggggacaattacagtggatagagcttctagtccagaaaaaaatggaatatgaattacataaatagtacattacaaagcacacacacacatagtttacaatgggaacacttaagagagataaaaataaatattgaacagttagaaaattgcaaaatttgtatagtttttattgttcctgaagctacatagtataattctgaagtatatagttcctgaggacctttcttatatgatagacattgtcgtttcttcaatgtcatgcttcgaagtgcactatgtctttaaatcacaagacatattcccgcacaatcaaagcaattagaaatgaagaatatgatttcctttgattcaaaaggccttttagaagagatattcttcttttttcacttctttgtgaaagcagttattcaaactgcacaggaacttcgtgaactttgaataccaggtttgttgtccagatgcatatagacaggaagtacacaatagcctaaatcagggagtgctggataaacttttcttaagatgcaggcccagaaaacgctaacagccttaaattgtggtgaagaatatgtggttggtgatggggactggagctgggggttactttctccctagtatcttggggcattcttgaaatgggaatggtattcatgattcagagctaagtaaattagggcccttttttctaaccattacaacctaaattgggaagaaatttggttaaaataaatacttcggtcttatttgggggaaagagttacaagatgttaacattgagtgtaacatagaaggaacaatctcacctctttaccttgtagatggtgaaagtttggaatttggaaactgcaaaccaaagaaatagctataggtgttttctttccaggcatctatttacagtcatcttcttctttcccactgtactcccccgtgtccagctgtcggtaatcagaagccatgaccagcaacacagtgtgttatttctgagacaagtcattaaagagcaaattgtcttagaacaaattgataaatagattcaccaaaacataaaattttggaaataccatcaagttgtttgatgttaagatattaacctcatttcagagccaggtttttttttttccaaaggatacacataaaaaggaaaatatttttactttatccttcattgctttctaagaagaatttagacagtaaccttcaagggaacccaatagcaaggaagccagctatatatggtgaataattaaatgctgtgtgtgtgtgctttaccctcacacagaacacaagttgtccaatttggagaatttttttattattatagtaaaaaaatttaacattaaatttatcattattaccatttttacatatactgttcagtaactgtattaatatattaagtatattcacattgtttagcaacagatctctagaactttttcatacaacactgaaactctatactcattaaatactaattcccccttcccctttctccacagctcttggtaaccacctttctaatatctgtttctatgattgtgactactttagatatttcatatgagtagaatcctacagtatttgctttttttgtgactggcttatttcacatagcacattgtcttcagaggctcatccatgttgtagcatgtaacaagatttgcttcttttttaaagctacacaatattccatcatatgtatattttctttatctgtattttctttatacattgatctgtcaatgaacacttgggttgcttcctcttggctattataaatagtacttagatgaacatggacttgcaaatttctcattgggatcctgctttgaattcttttgtatatatacccagaagaacgatgctgaatcatatactaatcctatgtttaattttttgaggaatctccaaactatttttgataagggttacatgttttacattcccaccaaaacaagggttgcaaatcttctacatcctttcctattttgtgattgatagtagtcatcctgtgggtgtgaggggatatcacagtgtgggtttgatttgcattttttaatgattagtgatgttgaatatcttttcatgtgtttattgtccatttgtatatcatctctttgaagaaatatctatttaagtgctttgcccattttttaattaggttatttgggttttttgttgttgttgtttagttgtaaaaatttctggatattaatactttatcaaatatataatttgcaattgttttctcccattctgttggtttcctttcttttttttttttttttgatgtgcagatgttttgaagtttgatgtagtcttatttgtttatttttttttttttcctgtgcttttggtttaatatccaagaaatcattgccacatcgaatttcctgaaattcttaatctatattttattttaggagtttaatagttttgggttttttcattttgagttaatttttatatggtgtatgctaagagtccaacttcattgttctatatctggatatccagttttcccagcatcatttgttgaagaaactgttcttttgccattgcatagtcttggcacctttgtcaagaatcatttggccatatatgcctaattgtgaggatttaaatacattatattttaaacaattttgaatcaaacagaaataaagagaaactaatcatattctagcatgaggattttatttctgtatagccatgtcaccccattagaagagaatatttttcataggtgagtagtgacagatagaagggatacttgcttgctgaaagtttggaggttaattgactaattagaatgatgatttcaagggtctaagaagaaaagaggaggacctggaataagtccgtgacatgaagtttaaagcaggagacagaggcagaatgcagaggaagacatgactgaacatggcaactgaaaagataaggagagttagcacataggatttcgagttggatttttacctggaagaattcaaggttttatttccacagttttaaatccttttatgtttaagatgcaaagtccttaatgagctatttttccgatccatattcccaagtccctagaaggacgtctcactatcattcagagtctcatgtctgcaaggctggctctttaatactcagtatggtctctattttgaaatacttagcaatgtgactcaaagaacaaaccacagtcatctgtatccaggcaacagcattgataaacactgcaaatttcttttctaccttatagcttgagctacataatgtggactaaaaagaatattgtattctattcagtgtttctagaaattaacaactataaacataggcactcaaatatgctcctaccttaaaaaagaaggaagcacagctacagtacagaatcactgtcatcttaaatttctgacattctagatgtcatctcaaatgtaaacagtctgcatttttttttttaacattctaaagatatttgtacatgcttgtttgattgtattgtaagagacctaagtataaattgagtcaaccaataaaccgcagggctactgcctgacaatttaaattagctcctttcacactccttagggtctgcctgtcagagagttatctgagttccatatacaacagtagcccaagcccataccttgatcacagtaattatctgtttttatttattttccccttgtccggtttatttcaggcctggttatttttccattccaagagcctatgcacccatgttcaattacctggtttctctctagcacttgagactaactctagttgccagatcaggtaaacagaaaattcaagctaagcctgctcagtagatgtaatcaactagtagttccatgtaggaaccacaaatggacatgttttttgatgatagactgagtttttaagtgggaagactggtattaaataaattctatttggacaaataggtgaatgacaattgtaatagacacgtgaatcagtcaaataatttttagcataattgcaattatgaattttgagagttagccttaactctaaaattactaattgttaaagttttacattcctgagtcaagtaaattaagtagttgaatttttggggggaaaattttgtgcatttttctgaaaaggaaaagagttcgctttatagtcattattgttctattttacaaaaataataatatgtcaatgtgttacaataataattagtcacacatcccaggaacttaaaatgagtgtcaagaaaagtgagataaaatagtgactatctgttaagaatgatttaagtgacattaaaggaaaagccttcttctccaaagtaatcatgaagtgaggactctgcaaaattgagttcccccaatgactggactatagttgagcacttcaatgtaaagtttcggctagggtgatctgaaatggttgtgctgttaaggacataacagctaagtcaatttaaaaagaactttaaatgactacttcactagatagcaaggtatagaatgctgtcaatgtacatcacttgagtaattagcaaactgtatctcttttgagacagcaatttatttaactttcctcattttgtgcctttaacttacccacaggatgttgtttgaatataccgtcagtaatcaaaaagtgtatgcaagtatatatctctctaccaggtctgaagacatgttatttgcttggtcagttggccttaataaagacagctgctatcagtttttcctaatataaaacccagcgtcgtcctctaaattcactctaatgatcagttagtttcagatgatgatatggatggatggatggatggatagatagatagatagatagatagatagatagatagatagatatagatagatagaaagatagatagatgatagataacatacacatgaaatacactagaatcaggagtaagagaaattcagtgctgaagggcaaaaatggagcttgactgagtaatcttggacgttttgaggctacagcacaataacttctacccaatgatttactctactttctatgctgtggtttaataatgacatttttgaactgaatttattttctttaaaactctttcttgaatatattacaagacttctttagactgtatataaagtagaagttacttttcagaggaactttttttttttttacagcactgttgttatataaacacaaagctatttgactaaagagtgcatctataactggaattacagtggggatacaatttagttaatgtagaaataattgtctgataccgtggttctctacatgctacacattgaatgatgattattttatgagtaagtgaattctgtatggatgtaaagattcatttgaatgtaactggagtaatttgaatgtaactgcaattacttttgcaccaacctcataacaagagtattatgttcttattctttcattcactctctctctctctcacacgcacatatcctttttccttcaagagtttttctatctaatgtacagtaatgcttccataatattgttttcagagttcatgccaatagtctgtctttatagaccaaaacatttgtaagagaatctttcagaagtttaaactaatgactctgtcttataccaaagttcatgtgatagcaaatagagttaaaagaattcctgccatgcttctattttgtattttattatcctctaatttatatgaatattgagtatttgcaaatacttctatctaagaagataccataaaaatttccttaaattattatgcaaattcaaagagaatgggtatgaccagaaaaatttgtttatttgaactgtattttttacaactttagtcttaaggaaagttaacattttcaggattccacaaacacagacacacacacacaatgagttagagctgcagttttatttcttagaatttttgatcttgtaggaaaagaataactaagcactttcatttcttcaaatttttcaaaattattcaggagaatttgtcttcatctattcttttctacaatgatcctagagaatttcttatccatatattcagtttggttatggatttatttgctaacctgataggtagtgttatcatggttttgttttcataaatgtaatcgatgtcctagcttattttataaagagatatatttcaaattgaataaaatagttgttatcacaatcattgacccattatgttgaatttctataagtctccaataagagagaatgaatttttaaaaattagttctataaacttgttgaaattggaaattatatcccttaatataatcaatttatatctaataggactctaaatattttctacataatataaaatagtccataagatggagtattttatgaaacactttctaaattttcatttatattaaatgcaaaaatatattagagaatagatgtttgttttacaagttataataaacacactaactaactataaaagctatcaggtcagctaaatgagtgaatatgtttaagatattgctaagtaatatgtttgactctcccttctacaactttcatatgtaaaacagttactcagatcttaatgccacaatattttttctatccatcatctttttttcaattgcctttgccattctgtcagttcagatccttaaactctctcccctacctccgttttctctccccctcattttcagattcacctcattttcctactcattttcagatttactacaaagcagagctttgagcattccagaaatatatgtctgaacttttcaaaaaccttcaattattctacaccatttcctaattaattgagtagctcccctcagtttggcatttaaagtagtcctaaatgtggcctcaagtcatctctgacacagtaattctttcttaatcattgatcatcattgataaaaatgtacatattcatatatatgcagagttctatataatttcatggagtttacaaaatctttctctacaagtcttacagaaatacccgcctgctctacacatgtccatcctgccattctgccacacatacatacctaacattccaaccacatttgacgacaagcaacttgaggacagacatggtgttttctgcaagatacacgttcacatgaaccctatgatactatccaaatgtctccactgagtagcttggcccctggaatgtcttccctgaggttttcagaatgtttgccttccctttatctgtccctgttatctgttacctggataagttgggaggcatttggggaagataaatgtcatttttcagatttcagccactactaactattcttgctaaagtaaattcttttgttatagtggaaaataatttttactaatgaacttggactgtccctaccttgattaatacaggcttcatttgtgtttaaatttgatgtctatttgattcacgtcagctcaaaacgtgttttctaaatttatatttttcaggtttcttgagtacaggcgatcaggctgcaaaggggaactatggactccttgatctcatacaagctttaagatggactagtgaaaacattggattctttggtggtgaccccttaagaatcactgtttttggatctggtgctgggggttcatgtgtcaacctgctgactttatcccattattctgaaggtaaccgttggagcaattcaaccaaaggtattatgcaaggttgcaaattttgacaattttggtgtctgcatgccaccaccatcagtagtatgtgatgctctgtatatttctctgttcaaactgagtgttaggttgaactcaatagtttaaagctttgtttcttcagtttttctgtgcatgtttaaattttcgtcaaactcttttctttgtctcctgtggagcttggtaaggatgccctttcaagcacacttcagaatagttagcattacagttactcttctttcctttaaagggtgatttgaagaaaaaatcagacaaagacgttctacagttttgtcatctttgtttattcagtgatcaaaatcaaagatgagactttttacatgcagggattgtatataatctattttcaagacaatagacattttaaaccctttattagtatgaagctaacgaagcggtcataagctagtttgtctgaaaacatgtgatttcacttgttgtctgagtacagaatggattgttgattatttcgcatgcatgatccaaaattgtcaaagcatcaaggtcactggtagagcttttgattaaaaagaaaaatacatttgattcagtgttttttctatttttaactccaaaagcattatttttccccctaaacttggcaaggcagcatggagtattgaggctgctgaaatccatgaaatatttttctcgtttccattttctggctttgacatattttttcccaagtgcctgtctgtccaaggcttaccatgttgttctttatgaactccatctccattttaccatgcatagaatcacccattccaactgcattattaatttgaaatttcacaagaacagaagagtattgttggagaaatttgcaaagcaaatactttttctgcattatttatgtatgataggaagacagataatatataaaaacgtacaccatctttcttttaatttctgatcttttattgtcattttatatccaagaaaaaagtatacactgtcaagtataattcatgaagtgttttaatttgtaaggttgagttttgtgataggagcaccaaacatatggtatttgttttcagtatcaaaaacacatgaatgttgaatttcaaaagaacagccagtcattaaatgaatccatgtatttggagaatcatatatagactcaatttattaacatagtttacataacatttcatttatattagtaaaattctgattcaaggtgacaaaataacacagatgaacatttccaagagagatttcatctgtaaagaaatggcttcttttgaaataataaacttagtgtttctttaattaaacagattagattgttctaatctcagtatttttactaatgccactatgtagctaaagcaacactaagccacctctataggtttctcagggtcgcttgctcaaaaattgacgtgaaagccacctttagctagtatcaaacgggcattggtttaagagatgagtcagttagttcatcagctaacactgccagtcatcaactgatggcatggtaaacagtaggaaatggttatgcaaacagttgaaaatacaacattttattatacacttcagggaaatctgtctatccctggaaaaagacatcaacttaggtttggcctaaacctgtctccaaactaagctgcctgattttaccaggagatgctgaaaaaaatctcttgaaatcatcaagctgattctgcctccaatggagctataaactttaaaggcaataaatcccacaatgctcaggcctggatataccatgagtcaaccccatcttgcatccacataagaggcaatttcactaatatgataaaacaaacatacatttttcccatattttaggaatctaggtggcatattttaggacatattggacatgatgtgcctttccttctcaatctttttcggtatatttagttaatgttgagtccctgagatgggaaataatattatagaaatcaccaggtgcattttagttacacaatttttatttattaaaatattttcctgagcaaatgttgataaacagctacataattttaaaaattatctgtatttgtatcatttgctctagcatactttgttctagtaaactaaaaaatacttataaagatgtcagaaaaccaaaacaaatgtatattaatactgttagatttttttaatatcttcagaattatataggaacatgttacagacatgttgaatatataggcatattaggttaagaaaaatctaaaactttccttctaattcagacagtgcttcaacacctttgtgaaaagagtttttatctcattaatacatatgaataattaagcatgtttttaaataactgaagcacaaagctgtatttggaaattgataaaattgataataaatttaaatatgtaaaagaaaataaactatatttttaaaacaggaattttatccgaaaaataccttaatgagaagataaagtgtgtttgtaaatttgaatgacatgcagcacttaactgcatatggaaccatcatttacaattcttaaatgcaattaaaaagcagtggaccatgtgcttttcatcttttatgataaaaacagtagtgtacattcaacagcggcaaaagttaaatcaccccacactaaatctttctgctgatggttttttctttaacctagtgaaaacacttcaaaggttatgtcttcttctgaaagatgaatattcagaatactatgtctgacatgaagatctggaaagagtatgtctaaagtgatattctgttttgtgtgaattcagggccaaccccagggtataaacaaacagccagccccagtcattgtatgagccttcaagaattctttttcaaataacatctgtttaaaacaaatatagagaaccattttgaaggaagatggacacagccaaactggaggaaatattccaaacagacaatgtagagtctgttggagagttaaataggagaagattggccccatctggttaatgttgatgataatatacgtatttacacactcattgaagaacatatttgggactttttaccactacatcgtctccttttcttcttgcctactacctctttgaggcttcttgatccctaaagcaggtgccactcaaagcacaagacttagatccacctctctaatccattataccctgcggttggctttgtgtacttcccttaagaaaaatatctctaactccctgtttcttgagctgtatctgggtttttatatacatgtctaaaatatcagatgttattgttttaccacaacattacccaaagatcatctaaaattctttgttgattttcccataggactttttcaacgagcaatagctcaaagtggaacagccctttccagctgggctgttagttttcaacctgcaaaatatgctagaatgttggccacaaaagttggttgcaatgtttcagatacagtagagttagtggaatgcctacagaagaagccttacaaagaacttgttgaccaagatattcaaccagctcgataccacatagcctttggacctgtgattgatggtgatgtaataccagacgacccccagatattgatggagcaaggagagtttctcaactatgatataatgttaggagtgaaccaaggggaagggttaaaatttgttgaaaatatagtagatagcgatgatggtatatcagctagtgattttgactttgctgtttcaaattttgttgataatttatatggatatcctgaaggcaaagatgttttgagagaaaccattaagttcatgtatactgactgggctgaccgtcataaccctgaaaccagaagaaagacattactggctttgtttacggaccatcagtgggtggcaccagctgtagccacagcggatcttcactcaaactttggttcacctacgtacttctatgccttttaccatcattgccaaacagatcaggttccagcttgggctgatgcagcccacggagacgaggttccctatgtactgggaatccccatgattggccctacagagttatttccttgcaatttctccaaaaatgatgtgatgctgagtgcagttgtaatgacatactggacaaattttgctaaaactgggtatgtacctaaggaatgaagtttatttttaataaaaatgttattttaaccattttaaaataatagatatttatgcccagataatgtcatattggattaatacctgcaagatattacattcctttattcaaaattaattctatattatggtgtttttaaaagtcattgctttattatttctggtgttttagaagcttgttaagaaagcacatatctcaattgcattacttaattacatctgcttttggtttttgaattatacaagacttgttattgttcagcagtaataaatattattttatagtgctttgtcattcacaacactctttaatccttccaactacctttctgaatctcgcagatcaggtactattaatcccactttacaagaaggagacctgaggctctgtgagtgtcatagagatgttcacatgtctggtatatagcagagcctaggctcaaaccttcatctgctaatttaaaatcaaaaatcctttccactattccatgtcatctctgctagcttgcctatgagacaactcatacgtatgtgagtatttaaataattctttaaaatctttgggtagatagcagcccatctcaggataagcagagagaacaagaatgtgagacttacttgccttccattatcacccatctaacaatatgcctgctaggagatttatatttctaaattgacccaaattaatgttaaaacacaatctaaagcattgctgagtcatctatttaattattagatgttaaagtagtgtgattttaagtaaaaaataaaatagctttattctcataatttatcttttccttcttagtgacccaaatcaaccagtccctcaagacacgaaattcattcataccaaacccaaccgttttgaagaagtagcatggaccagatattcccagaaagaccaactttatctccatattggattaaaaccaagagttaaagaacattacagagccaataaggtgaacctctggttggagttggtacctcatctgcataatctcaatgacatttctcagtatacctctacaacaactaaagtgccatcaactgacatcactttcagacctacgagaaaaaattctgtacctgtcacgtcagcctttcccactgccaagcaggatgatcccaaacaacaaccaagtccattttcagtggatcaaagggactactcaacagagctgagtgtcactattgcagttggagcatcactgctgtttctgaacatcttggcctttgcagccctgtactacaaaaaggataagaggagacatgatgttcacaggagatgcagccctcagcgcactactaccaatgatctaacccatgcacaagaagaggaaatcatgtccctccaaatgaagcacactgatttggatcatgaatgtgagtccattcatccacatgaggtggttcttcggaccgcctgtcccccagattacacactagctatgaggaggtcacctgatgatgttcccttaatgacacccaacaccattacaatgattcccaacactataccagggattcagcccttacacacattcaatacatttactggaggacagaacaatactctgccccatccccatccccacccccattcacattcaacaaccagggtatagccagataagagaaacaaactattttttttgatggattgcagtaaacgatcactgaagattccttggctttcaacctacaagacttactatttaaataaggaggaatattatgtgaatatacatatcaagaactttgggggttttgaaaaaaatgaattgtatatatacaaatcaactttaaaaacaaatttcaattgcttgaagcaattgttctgaatgatactttttcattcacattcaagaattaattttttgaagatttaagttacataatggaattaggcatgtggaacaccaaacaggaaagaactatgtctgaaatataaaaaataaaaataaaaaaacaactatgaatatgcacaagggacacaccagtggaatgtcagataattttcaccagtttttatttggagccgttttattgtgtagaccatatttacatatttggataagtacacaaagcgtcaatgctgttaatggccttagcaaaggctcatgctgaaatttgccagtaaaacaaagaagtttaaagactggcaggtacaccattatcacataagtgctgtcagtataaagttgtggggataaaggaaactggatatttttagcacgatgtgcatgataatttatatgcttggtggctgtgctgctgattaagccgtaattaaaattcttctcatcccattggagtttttaatagaagcttcctccatcaattggcagaacctaaagaagattttaaggggcaaaagtaattacaataaaataattcacagtagtttcaatatagaaggaattagctattaaaggtatttgaagaaactataggtatagtggtgaatactcgctgatatgaatcccagaaaaaaatttcctgtttttaatgttcttttcaatcccatctagataatttatagaaatataaccctaattggacatgtggtacaggatctataagttgctgtgtttttttgttactctgtattttgttccttttggtaaggtgaagtgtgtccaaagagttacttgcaacagtctttcatgatatgaggatgcccccgtattaccactctgattatagttctgagttctttgatttactcatgctgcatgacaaaatgtttactaataacaattcattataaagttatatccctctttacatcacttatctttctcactgaggttcattcactggaatttactcacgcaatctcagtagagtacaacgtagatacagaacctaggagagtcaacatctggaggattttagtctttcttacacatatgtgtgattttaaacgaatattctcagaccacaggaaactcttcatccccctgttgtttaccagtaacagtatatcacagacctttccaaatgtttgtatatgtaatcagatgtacatttatattgaaaaacaaatgagatggacttaaagagcacatcctgataaatactttctctctcacctgtactatatttctattagactaaagttatgtgattttttttttacattttttcagatgactagcaattttgatagtttataagataatgcaaagaactttctctgacaaactaactgcagtaacagaaacctttcttttcagttactctttttcaagaatgaaagattattatacaaaaaattgtatactacttgatggaaccaactttgtacatcttggccatgtcactggtcattgtgtgaaataaagataatctggataatgactattagtccaatgctaagaaacatgatctttgctcattaaagagctaaaatgtttattgctgttttgtctttcttttttctaaaaaaagaaaaaaaagaaaaaaaggaaaagaagaacaaagaaacatgactgtctcaaagagtaatttttctagattagaccagtcaggtttttgaagacatataggtaacttccacagaaaacacaaacatgtatttaaaggcaagtctcatctaagatgaaactcataaaaattatttaatgtttgttatgaatttaaaag

SEQ ID NO: 698 - DNA, 7192 bp, Homo sapiens
ccgtgggtgcaccctggaccccaccatggctcaccggccccccagccctgccctggcgtccgtgctgctggccttgctgctgagcggtgagtgagccacgtgcccatccatccagcctccaggccccggtggattgtggggaaatatccaccacgaggtccatccaaagcccttctggcacagctggggaaactgaggcagggtcaggggagactccactcactgctcgggaccaacgcttgcaggggtggggaggacaagggcaagggggagccctggccatttgactcagttgcctatctgtaaaacgggcaaaacccagcccttccctcctgaggagctgttttgggaattagctagtaacaggcgaattcctggacagcacccagccttcagcaaatgctcagtgaatatgcatgaatgaatgaatgagtgaatgaatgagtgagtgagtgaatgagtgaacaaatgaatgagtgaatgaatcaatgagtgagtgaatgaatgagtgaatgagtgaatgagtgaacgaatgaatgagtgaatgaatcaatgagtgagtgaatgaatgagtgaatgagtgaatgaatgagtgaatgagtgaatgagtgaacgaatgaatgagtgaatgaatgaatgagtgagtgagtgaaagggtcgaggagttagtgatgctggaatcaggggaagaagagagcatgggccccctcaggtccctatcctgagggtgattttctttttctttttcttttttttttttttgagacggagtctcgccctgtcgcccaggctggagtgcagtggcgcgatctcggctcactgcaagctcagcctcccgggttcacgcctttctcctgcctcagcctcccgagtagctgggactacaggcgcccaccaccatgcctggataattttttgtaatttttgtagagacggggtttcaaggtgttagccaggatggtctcgatctcctgacttcgtgatccgcctgcctcagcctcccaaagtgctgggattacaggcgtgagccaccgcgcctggccctttttttttcttttttgaaacggaatcttgctctgtcgcccaggctggagtgcagtggtgcaatctcagtttactgcagcctcagcctcctggggtcaaatgattctcctgcctccgcctcttgagtagctgggattacaagcacacaccaccacacctggctagtttttgtatttttagtagagatggggtttcaccacgttggtcaggctggtctcgaactcctgacctgagggggattttcaatgcctcagtttgttcatctgcaaaatgggtctctttgttggctgatttttttttttttttttgcttctttttttttattttgttttgttttgtttttttgagatggggtctcactcaggcatgagccactgcgcccaggattttttttttttttttttttttttgagacagaatctcactctgttgcccaggctggagtgcagtggtgtgatctcggctcactgcaacctgtgcctcctgggttcaagcgattctcctgcctcagcctcccaggcagctgagattacaggtgcgaaccaccacacctggctaattttttttttttttttttttgagacggagtgtcattctgttgccaggctggagtgcagtggggcgatcttggctcaccacaacctccgcttcctgggttcaagcgattctcctgcgtcaacctccggagtagctgggactacaggcacgtgccaccacgcccagctaatgtttgtatttttagtagagacagggtttcaccatgttggccaggatggtctccatctcttgacctcaggtgatccacccacctcggcctcccaaagtattgggattacaggcgtgggccaaccgcacccgaccaatttttctgcttctttaaaaacatttttttaaattttgttttagagacagggtcttgctctgttgcccaggctggagtgcagtggtgtgatctcagttcactgcagccttgacctcctgggctcaagcgatcctccctcctcagcctcccaagtagctgggacgacaggtgcacaccaccatgcctggctaattttaaaattttttgtagagatggggtcctcacaattttgcccaggctggtcttgaactcctgagctcaagggagcctcctgcctcggcctcccaaagtgttgggattacaggcgtgagccactgcacccagccacctggtctgcgtcttaaaagccttcctgactctcaggactgaaagctgccaccagggcgcctttggaaatcgtcgtaattataacccccccggcctgggcgctgagtccttcccaccagccagcaggcactgaccgggttgcagatcgggagacggaggctcggagaggcccaggggctgctctgccatcccccctttccctgcagcctgggggctccctgacgcctggactccccccctgcaggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacatgtgagcggccgcctccacacccctgtccgcccgccccgccctcttcctccagccctggcccggccactgtccctctgcccggggaggacccagctaagccccgtctgcagaccccaggccccgcgcgcgtgggcagttctggggggaggcccggggcagggtcgccgagggaggggtctggggctgcaccgcggcctcgggaagggccggctgtgggcggcggcgagtgtccagggcgccgaggagtgaccaccccacccccgcagaccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccaggtgggcgggcagggccgcgagggctcggaggggcacggccagagggctccgggacccccattcctgcagccagcattcattgagcacccactgtataccgggccacgaccgaggccgctgcagcctgggtccagtggcactggccgggggagaccgctccttggacaccaggccactcctcctccccgcctctcccccgcccgcgcctctcccccgcccgcgcctctcccctgcgcgcctctcccccgcccgcgcctctcccccgcccgcgcctctcccccgcccgcgcctctcccttgcccgcccctctcccctgcccgcgcctctcccctgcatgcctctcccttgcccgcccctctcccctgcccgcgcctctcccctgcgcgcctctcccctgcccgcgcctctcccccggccgctcctctcccccgcccgcgcctctcccccgcccgcgcctctcccctgcgcgcctctcccctgcctgcccctctcccctgcctgcgcctccgcccggtgtgctgttcccccagaaagccaggtgccctcgcctcctccggcgcctcccctgacctcactggaagtggcgaggacagccacagccctccccgattcactgttctccactgaaccgcgtgctcctctcattcatggggccctcctagcctcctcccacccagaaagatcagctccccagggcagaggatttttgtctgtgttgttcgttattggactcatgtggcttagaacgggactgggcatacaggtggtgctcagtaagtgcttggggttgggcactgtggctcacgcctgtactcccagtactttgggaggctgggatgggaggatcacttgaggccaggagtttgggagcagcctgaccaacctagtgagaccccatctctataaaagacattttttttttttttttttttagacagagtctcactcagtcatccaggctggagtgcagtggtgcaatctcggctcactgccacctctgccttccaggttcaagtaattctcctgcctcagcctcctgagtagctgggattacaggcatgcaccaacacgcttggctaatttttgtatttttagtagagacggtgttttgccacgttggccaggctggtctcgaactcctgacctcaagtgatctgctctcctcagcctcccaaagtgctgggattataggagagagccaccgcgtccagcctacaaaagaaaaatttaaaaatcaaccgggcatggtagcacacgccaagccactcatgagctgagatgggaggatcacttgagcccaggaggttgaggctgcagtgagctgtgatcatgccaccacactccagcctcggcgacagagcaagaccccatctcaaaaaaaaagtgctttgaagatgaatgaatgggccaggggcggtggctgtaatcccagcactttgggaggccgaggcgggcggatcgcctgaggtcaggagtttgagaccagcctgatcgatatggcaaaccccgtgtctactaaaaatacaaaaattagctgggcgtgacggcaggtgtctgtagtcccagctacttgggaggctgaggcagcagaattgcttgaacccaggaggcagaggttgcagtgagccgagattgtgccactgcactctagcctgggcaacaagagcgaaactccatctcaaaaaaaaaaaaaagaaaagaaagaaagaaagaaaacatgaatgaatggccgggcactatggctcacacttgtaatcccagcactttcggaggctgaggaaggcagatcacttgaggttgggagtttgagaccaggctggccacctcacccaatgggatggctccgggaggttccagtgagccgagatcacgccactgcattccagcctgggtggcagagcaagactccatctcaaaagaaagaaagaaggaaagaaaatgaatgaatacaatagtgacaaatgggacaaagggggtcgtggggcccaggcggagggagcggcatccgcggcgttttgaggtggtgggtgtggtgggtgtggtgggagggcggcccgggcggccaccgtgacctggaagcagcgtctcaccgccgcctgccttctgccccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcgtaagtaaccgtgcccccaccccgggcaccgggctgccatgaggggaggagggcggcggccagggttccacgccacctcttagctgtgtggcttcatgctgtgcctcagtctccccacctggaaggtgggcacacccaacacccaacgggcaggctcagcggggtgggggcgctcacattgcacctggctgcttgggtgggtctgggggttccctgccccccactcccctctaggaccacaggaaggtgtgggagacccatccgccctcaccggcggccccttccagaatccaggactccaggtatccagcgggaggcccataaatgcccagttcctacgaaagacctcagcccctccctgctcacactttttgtttgtttttgagacggagtgtcgctctgttgtccaggctggagtgcagtggtgagatctcagctcactgcaacctccacctcccaggttcaaggtattctcctgcctcagcctcctgagtaactaggtgcacaggtacctgccaccgtgcctggctaatttttttggtatttttagtagagatgaggtttctccatgttgaccaggctggtcttgaactcctggcatcaagtgatgcctggctggtgctcacacattttaaagaaaattccaggccagcagtggtggctcacgcctgtaatctcagcactttgggaggccaaagcggaaggatcttttgagtccaggagttcaagaccagcctgggcaacatagcagggtggcatctctacaaataatttaaatattagctgggcatggtgatgtgagcctgtaggcccagctactcaggaggctaaggcaggaggatcacttgagcctggggagttcgaggttgcagtgagctatgattgtgccactgcactccagcctggagaacagagcgagaccctgtctcgagagaaagacagccagctactcgggaggccgaggcaggagaatcacttgaacccgggaggcagaggttgcagtgagccgagatcacggcactgcactccagcctgggtgacagagcgagactctgtcgcaaacaaaacaaaaacaaaacaaaacaaaacaaaaggagaaagaaagaaagagatagagagagaaagaaagaagaaagaaagaaaaagagagaaagaaagaaagaaagaaagaaaaagaaagagagagagagagagagagagagagaaagaaagaaagaaagttccatattggaagcattttattctgaaacagctgtggctaccccagcccccttcctggctgcctggggccagcccgggtgactggctgtccccatcctcccgggagactcaggtggcccctgatgggtgactggccgtccccatcctccagggagactcaggtggcccctgatgggtgactggccgtccctgtcctccagggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactcc

SEQ ID NO: 699 - DNA, 167637 bp, Homo sapiens
agcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcaggtgagcgcggcgcgctttcccccggctctgcgcggccgggcggcctcgaagtgcaggcggaccgacccaccgacagaataccgagcctgggctgcccgacgcgcaggcgccctccccaggcccgcactgcagcccccagcgccccggggccccggcgccttcgacccctccgaggacagggggagagggagggcggcgctgcccgacccctcggccgggagagctgggcgcgctccctgcgcaggacaagccgcgctgcagccgccccggagtgccccgtgggggcgctgtggcacgcagcggggacgcccagaccccggccaccgcgacccagggaaagggagacctgttgagcgggtatgcagggtgattcctattccacggacagccgatggctcccccttccctcttcggaacctggtattttcatgcccgtgtcatctggattttgttcttgggtctctatggcagctaaacctccagcttccctatattgtggaagagggagagaaaggggaaggcattttgtggtagttgctagaaaccccagaacaatttggagccgtttggggagaggacagagaaatggggactgtccctggtagggtctccaggactgggggcacaggaaagtgctctcctcagggacactcgcgcccaccctgaacaaacccaattgaccaagtttcaatttgtcataaatcaggaagccacaatgcatctgcaccaagcacacttaaaatcggcctttaaggaatggggcagtcaagagacttcagggacccgtggtcgagagcagagactggggtcagcctgcttgggtttcaaccccagctgtgaagtttacagggttgataacttgaaggtacccaagtatgcctcagtttcctcatctgtctaatgaggatggtaatacccacagaactgtgaggattaaatgagatatggcggccgggcacggtggctcagggctgtcatcccagcactttgggaagccggggcgggcggatcacctgaggtcgggagttcgagaccagcctgaccaacatggagaaaccccgtctctactaaaaatacaaaattagccggacttggtggcgcatgcctgtaatcccagctactcgggaggttgaggcaggagaatcggttgaacccaggaggcagagattgcagtgagcggagatggtgccattgcactccagcctgggcaacaagagctaaactccgtctcaaaagaaaaaaaaaaagatatggcaagtaaagtccttagaacatttccaggagcattctaagattaggtgagttccatggcttgtctttgcagaaatagcaaggagctgctatgagcagtgaatgtacctcttccccagttcagaaagagaggctctccatgggtacgtgagggtggcagataagccacgtgtatgcaactggtagttccatgcaggagtccacacgggcgcagttctccctgcttgctcccaaagggccaacctcataaaaccatgtcaaaataccaacatgggtttatgacctggaatgtttcctctcagtccctgaaacttggcacttagaatcctctgtggagaatgagatacttatggctcttcaccttgcattttcctatctgtccacactttttacttttatttctgccaatagaattcaatctcaggcccccgagttaccaggacactgtcttctataaatcggggctctggggtttcttgttcccaggcaacccagggccaccaaggcctaagcttgcttgttggaggtgtcagagcagagtccaaatctgaaacaccctcgagcagctgtcatgccctaagctcttatcagcgagtgccatatgtccttgtttagcaaaaggtagttaaaagtgtggcctgagatttaaagaaaaggagagatgtttgctctttgaaataagagagccattggaggttctggaaaaataattctacagtttatttagaaacagttctgactggcacctaagagagggcaaggagtgaggtggggagactaaaagggggagagaccggcttaggcctcaggaaaagcaggccgaagagggtgtgacaggtctaacgctggcctgagcaaggtgttgggtatgaggctgggcaagcagtaggagaggtgagtggtttaagaccagtcaagttggcagagagcctctagtgctgcccctggcactcactgccctctgatctgtagcacctgcaggagcgtcccttccagggattccccgtcttctagggaagctatggaggactcccctgtttaaagcatatggcaagataactcaggagggccagggaaagagggaggctgagcatatgccaaggggagaatggggaatgtcattgctgttgctagtgaatggtgccagggaggtccttccaaggggccacttgccacttggagcttcagcccatgaggccatccttgaaccctgccatgtggctcggcagacagccaatactgcctgaagggggctcagatggaatggcagggctgggctgttgccagtaattggtgttaatgactatgacagtggctttgacatggatgagatggagttggggtacaacccaaagcacactgctcttggcacccgaaagacctgggttgcagttctagcccctcatacctgcaaagattttggaaagttacttagactctctgtgcctgacatctgtttcttcatctgtaaatgaagactggattttttgggagaattaaattagttaacaggtgttcagtgcctagctcagaataaatgctcaatatttgttagctatacttactattattgtctgagccttggtttatatcatctgtcaaatgggcgtgatactatgtcatagggttgttgtaagggttaaatgaaataattaatgtgaatttatccaacagtgtgtgaagggtgtaaagtactcaaagtgagtcaattgaaatggaaaatttcacaaaatacctgcatgtaaaaatcagcggctgagcaggtggatcagctaacatttttggaaagttattctaaaagtactgtcagaggaacctttatctacttatggaaagtggggctcactgcccatggggataccctgtagttattttatgttgttgtattagttgcctattgctgctataacaaatttcacaaacatagtggcttaaaacaaccctaagatgttatcttgcagttctgaagttcagaactcttaaatgggttttgtagagctaaaatcaaggtgtcagcagggctctgtggttccttttgtaggctcttgggaaaatgtctttcattttctgacttctaaaacctgactgcatttcttggctcttggttccttcttccatcctcaaagccagtaacagcatcttccaacccttctccccatcctgactctcgtgtctccctcttacaaaaccatacctagaaaatctgggctaatcactgcatctcataattcctaagttaatcacatctccaaagtccccccgtttttttttttcaagacagagtctcgttctatcgcccacgctagagtgcagtggcgtgatcttggctcactgcagcctccgcctcccaggttcaagtgttctcctgcttcagcctcccaaatagatgggattacagccatgagctaccacacctggctaattttttatatttttagtagagatggggtttcaccgtgttggccacgctggtttcgaactcctaaccttaggtgatctgcccactttgtcctcccaaagtcctgggatcacatgcgtgagccaaccgcacccggcccaaagtcccttttgccatgtaaggcaacacagtctggggattaggccatagacatctttgacatattattctatctgccagaaatattagagtattagattgggcatgatggtaagaaaaactatttagaaaaaagaaagaaatattagagtattagagaaaatgatctaaatcaaagagttttagctcacttctgtttagggcttctccctgtaccctcccagttaggtgagtttgttttcacatctctttttttcttttttttttttttcccagacagtttctctgtgttgcccaggctagagtgcagtggcacaatctctgctcactgcaacctctgcctcccaggttcaggtgatcctcctacctcagcctcccaagttgcaacaccatgccctgctaatttttgtatgtttagtagagacagggtttcaccatgttggccaggctggtctcaaactcttgacctcatgatccacctgactcagcctcccaaagtgctgagtttacaggtgtgagccaccatgcttggctgttttcacatgtcttaaagaccaaaagctcaagaccagaggggtcaaggctatggatcaaatgcttcttgaaactcagttcagaaatggctccttcctgtcctttttgggctttctccctccccttgagtaaccctcaaatttgtttcttttttagatttttgtaaaaactttttttttacagagacagggtctcgccatgttgtccaggctggtctcgaactcctgagttcaagtgatcctcttgcctcagcctctcaaagtactgagattataggcgtgaggcaccacgcctggccagtaaccctcaactttggcccttagaacagtcactgttgccccatcaacagcatttgttgacttttctagctgcttctcctcttccatttctagtgaaatagaaaaaatgccctcatgtccagagcaagatctctgtgaagcaaatcactctagtgacgtttgacctccctgagattcccagacggtgtctgtactagtttcctattgctgctgtaacaagttagcacaaacttagtgacttaaaacacagatttattatcttacagttctggaggccacaattctgaaatggttctcatggggctaaaaatccaggtgtcagcagggagaatttgttcccctgccttttccaacttccagaggctgcacgcattgctcggtttgcttccatcttcaaagccagcaatgtcaggctgcatccttctctcactgccacacctcagatctctcttctgccttcctcttcttcttcttcttctttttttttttttgtttgagacaaggttttgctctgtcgcccgggctatcatgcagtggtgcgatcacggctcactgaaacctcagtctcccgggtttaagtgaccctcttatttaggctcccaagtagctgggactacaaggattgtgccaccatgtctggctaaatttttttttaattttaattttttgtagagacagggtctctctatcttgcccggctgatcttcgactcctgggctcaagcaatcctcctgccttggtttcccaaagtgctgggattacaggcatgagccaccatgccctgacctcttctacttttttttttttgagacagagtcttgctctgttgcccaggctggagtgcagtggtgtgatctcagcttactgcaacctctggctcctgggttcaagcgattctcctgcctcagcctcctgagcagctgggattacaggcgcgagccaccatgcctggctaatttttctatttttagtagagatggggtttcaccatgttagtcaggctggtctcgaacttttgaccttgtgatctgtccgcctcgacctcccaaaatgctgggattacaggcacaagccaccgcccctggcccctcttctacttttgaggacgctcgtgattacattggcccacctagataatccaggatcatctccccttttttaaggtcatctgattagcaaccttaattccctttgccatctaacatcacatattcccagcttctgggaattatgatgtagacatctttggagggcaattattctgcctgccacaggacctgagaaggagttccaaatagtgtccgcctgggctgcctcattcttaataaccacccccttccagaatgtgcacaatggcccactcaagagagaacacctgttaaactcttcaaaatttctcccgcagctctcaggtctctcagtccctctgttggtggaaggatctgagggcaatagagcctggaactgcacactttatttgttaagttaatttttttcttttaaatcagaggaacatataaaaaggtgcacaaatcatgagggaaatctcaatggagttttacaagtgagcactctccactgtcatgtaactgcccccaagatctgcacccatagccccctttggaccccaaataaattatcgtcttcccctaaggcaactactattttaccttctatcaccataggttaattttgtctgctttatcttactttattttttatttttattttgctctctggatctgtgtagagtatttgcctgtttttttttttttttttttttttgaggtggagtctcactctgtcgcccaggctggagtgcagtggctcgatctcggctcactgcaagctccacctcccaggttcacaccattctcctgcctcagcctcctgagtagctgggactacaggtgcccgccaccctgaccagataattttttgtatttttagtagagatggggtttcaccgtgttagccaggatggtctcgatctcctgacctcatgatccacccgcctcagcctcccaaagtgctgggattacaggcgtgagccactgcgcctggccgagtatttgcctcctttttaagcaaacttctctttttttcttttgagacatggtctgactgtcgcccaggctggagtgcagtggcatgatcctagctcactgcaacttcctggctctagccaacctcccacctcagcctcccgagtagctgagactacaggcatgtgccaccacgcttggctaattattgtattttttttttttttttttttgagacagagtttcgctcttgtcacccaggctggagtgcaatggcgcaatctcggctcactgcaacctccgcctcccaggttcaagtaattctcctgcctcagcctcccgagtagctgggattacaggcatgcaccaccatgcccggctaattttgtatttttagttgagttgggatttctccatgttggtcaggctggtcttgaactcccgacctcaggtgatctgcctgccttggcctcccaaagtgctgggattacaagcatgagccaccgcgcctggacaattcatgtattttttgtagagacagggtctcacaatattgaccaggctggtcttgaactcctgagctcaagcaatctgctcggctcagcctcccaaagtgctagcattacaggcttaagccactgcgcctggcctacaaacttcttattgacgtatacatacaaaaaagtacactaatcaaggaagcagctggattagttttcatgacataaacccatgtgtaaccagcattttgatcaataaatagaacattgccagcacccagaatccccgctcaggctctttctgtgcactaacaagccaagtctaaccacaatcctgattcctatgattgtggatacattttttccatttttgaatgttattttgttcaatgttatatttgtaaatttctcatgtaattaatatgccgtaattaattcttttttattgctgcgtaatatcccattatatggccacaccacagtttttctgtactattgttaagggctgttgagattgtttccattcacacttctttttttttttttttttgagataaggtctctgtctgtcacccaggctgaagcacagtggcatgatcgtagttcactgcagcctcaacctcctggtgctcaagcaatcctcccacctcagcctcccgagtagctgggactataagtgtgtaccaccatgctcagctaatttaaaaaaaattttttgggggggccaggcacagtggcttatgcccataatcctaacactttgggaggccgaggcgggcggatcatctgaggttgggagtttgagacctgcctgaccaacatggagaaaccctgtctctactaaaaatacaaaattagccgggcatggtggtgcatgcctgtaatcccagctactctggaggctgaggcaggagaattgcttgaacccgggaggcggaggttgcagtgagtcgagatcgcgccattgcattccagcctgagcaacgagagtgaaactcagtctcaaaaaaaaaactttttttttttttgtagagatgaagtctcactatattgcccagactggtctcaaattcctgggctcatgtgcttctcccacctcagcctcccgaagtgctgggattacaggcatgagcttctgctccttgcctacttcattttgaaagggagtgactacctacccatatctcagttgtcataaatgcaattccacctgcagaaattcaggaagggaagattgtatttagcactggtgccaaatgcattcattaggagagacttaaaaacagtctactggttaggattaagttcagctgcaagttacagaaaaaatgaaatgacagtgggttaaagaaagaagtttatttctgtcttgtgttcaagaagtctggagacagtgagtgtccaaagtgtatgtggggtaaggccccatgccctgtgcctggttgcttttagcatgcatagcttccatttccatgcagtctcacccaggatttcgggatgactgctgagtactaaaccaaaaaacaaaaacaaaaacaaaaaaaaacaaaaccgatgttagagaggcaggtaaggcatttgaaaacattgttttatggaaaaaaaaagttatggaacatttataaaatgaaaaaagcagttttttctaaattaacacattattttataacttaaaatgttttaaatatgtatttgtgacttaactgatacattattataagtagatacttgatatttcatctatatcctttaaaatattcaagctgaccaagaaattgtatgtggggtcttccaatcaggaaaaataggagccaggcacagtgcctcacacctgtaatcccagcacttgggaggccaaggctggaggatcattgagcccaggagctcacggccagctggacaacatggcaaaaccccatctctacaaaaaatacaaaaacgtgggggtactggtgtagtctcagttactggggaggctgaggcaggaggattgcttgagcccaggaggtcaaggctacaatgagccattattgtgcaactccaacctgggcagcaatgcaagactctgtctcaaaaaaaaaaaaagaagaagaagtccaggcatggtcgctcatgcctataatcccagaactttgggagagcaaggcgggggaatcacttgaggtcaggagttcaagaccagcctagccaacgtggtgaaaccccatctttactaaaaatacaaaaaattagctgggcatggtggcgggtgcctgtaatcccagctacttgggaggctgaggcaggagagtcacttgaatctaggaggtggaggttgcagtgagccgagatcatgccactacactctagcctgggcaacaagagcgaaactccatctcaaaaaaaaaagaagaagaaggaagatgttatcctcctattacagtcgcctacattcaggcaaacatagtacgtagaggaagacatggacttgactttggtactttttggatgcagaaccagggccattttgcttcaactaatattttgttaattaatgaaagatcaataaatatgtttgttcaaattaataattttaaaaaaatttattcacacaatttggtacctagcacaagaagcaaacagaggtgacaaggtgcatgctgcagcagacaacaaacccattgtcaggggtctatgaagcagtcagttctcattagaaaaccgagagaatattttacagcatgagtgacatgtgagctgaggcttgaggactgaatgcaatttcgatgaatgtagaatgtagaaatttcagggtgagggaccggcatggatggaggcgccccgctatgacaagagtctgagttcttcaagccctaatggggaggctggggtggatgtgggggccaccatggtcagagaggtgggcagtggccagtcaaggagggccttgaatgttaacattgcacagtgaggccacaggcagattcaaaatcacaagggaagggccagtagatgagggacccaaggcagggagggcagttctgaggctcctgggagtctggctgagaaagggtgtgggtagaacattcgctgcagcagtgggaactgtcaggaggcctggacaggggagctgtgcagaggtgggaacaccagaatttatccactcacaaatgtgttgaggatacagaggacacgtggaagctggctcccaaatttctggcctagatggctgggcagatggggttagcatgaccatgaaaggatttgaggaaaagatgactttgtgtctggacaggctgaattggcaagcaggcctgcaccactgggtggaagttacagacagcatcaggtcaacatcgcggagaactgaggtctaacatttagagctgcctgaagattgtggatggccttgaatcctagccagaggttgtcttcccatttgctagggattccaggattaggtggaagacaggaaggtacagcctgaaattcacacagctccagtattgtatgattctctgtgaactcatagaacagttggtgtgcatacctggtatgctgacaaagagatctttggcaaaactattgagcctgatgtctaggaatttatcgttagaaaaatctttctttcttttttttttttttttttgagaccaagtcttgcattgtcacccaggctgcagtgcagtggcgccatctcagctcactgcagcctctgcctctcgcgttcaaatgattctcctgcctcagcctcccgagtagctggaattacaggtgtgcaccaccatgcctggctaatttttgtatttttagtagagatggtggaacaggaattaaaagaaattaaagaatatgtgtaagcagaagctcagttgtatataagaaaactcaattccccctgagaaagagaaagagctggagtcctttaaaaattaactgcctgtttttctgtggctagtgagccttatctctcctcctctcccaggcattgtgaagaccctgtttctctagctgtgcagctgcaaggttactagacagataaactcaagtcataaaacatgtttttccttggaaagtaagaaatgatgtaatgcatgtctctcaattaattgaattattgtctttgtttcttgctgtaatatgcttccccctgcacagatctccccacaccccacgaaatgcttaaaagctaacttaactctttgttcagggctcagtcctttggatgttaatccgactgggctgatgcacacctaaataataaatatcctcctcaaccccattggtctctctgattccttaaaaaatcctgctacaatgggatttcaccatgttgtccaggctggtctcgaaatcctggcctcaagtgatgcatccttcttggtctcccaaagttctgggattacaggcatgagccaccatgcccggcctgaaaatcttattcttaacaagtagactgactgcctgagaggtgccagggtagaatattgtctctgccagttaacaagttctgaggccttggagaggtctttccacctataaatcttagtgttccatccatcaaatttggaactcatccacctcacagaatgattgtggggatcaaatgagatgatactgtgaaaaatgcccagttcactggctgtcccatccagacacttaataaatattagtgtcctgtcccctttctctttttgtctggaggtggggttaccactggagaggggatcttgccaccttcttcaggatagcaggatcttgccaatggtctggtttagattgagaaacttggctcccaggccatgcctcttattttatggatgactagttaaagcccagagagttgttacctaggtgaggtcatgcaggtgtgcagaaccaggcctctggtctcaaggcccacaccatacagttctggctctggagggaattctattcgcctgtggatttacttgcaacagtgatgcttagaagaacccgtagttaagacagaataatcttctctctcttcccccacccccttggtgaagttaaatgaaaagactcattgtcccatggagaagagaaaaactgttaaaacaaaagtcaaagccgttgtattattttaaaatattctttccatgttcccaaatgcttcatggaatctgttcggactgaattaacctctctatttctcagcacagaaattcttctcagatgcccaaaaatgaaaggaactgttctcaaatatcattccattttccagttagaaatgggtcctgatcttcaaatgctgacagctgtaaatgccaaactgagaaacaaccattgagatggatacatgcactgacttatttttttcttgtttcactgccattgcagtttttaggaaaaaatctatcttgtctggtactgatattgccacactgattttatgttggcatctatatggtatccttttcccattcctttattacttatctttttttttttttttttttttttgagacagagtctcactctgttgttgcccaggctggagtgcaatggtgtgatcttggctcactgcaacctctgcctcccgggttcaagcaattctcctgcctcaccctcccaagtagctgggattacaggtgtgcgccaccatgcctggctaatttttttgtatttttagtagagacggggtttcacaatgttggccaggctggtctcaaacttctgacctcaggtgatctgcccgcctcagcttcccaaagtgctgggattacaggcatgagccaccatgcctgacccttattatttgtctttttcacaagcccacagttaacatcataattcctttttttaatgtattatttttaatttactttctttaaaaatattttatattaaaaatatttctacttaaaggaactttagaagatttcatgttagttttcaagtcactgtaagattttctttctttttttcttttttttgaggccgggtcttgctctgtcacccaggctggggtgcagtggcagtgatcatggctcactgcagctttgacctcctgggctcaagcgattctcccacctcagcccctccctcgagtagctgttctaagttttcttcctttgtgccaccatgtctggctaatttttgtatgttttgtagcgatgggatttcgccatgttgcccaggctggtctcctgggcagcatgacctgcttaccttgacctaccaaagttctgggattccgagtatgcaccaccgtgccgagccaaggttccagtttcttcacatcttcaccaacacttggttacgtcagtcttttaaaaattgtttttaaattttttcatattcctaggtcactattatactcttttcaatatactcttttcaattttatctattccagcagatttgttgtggcgtcttattgtgcttttaatttgtatttttctaatgactaaagatgttgaacgtgttttcatatgtttatttttcatccgtgtatcttctttggtgatgtgactattcaaatcttttgcacattctgaagtgggtttatcctcttctaattgagtgataagagtttacatagtcccggccaggtgctgtggctcatgcttgtaaacctagcaccctgagaggccaaggcaggcagattgcccgacgtcaggagttcgagactggcctggccgacatagtgaaacctcatctctactaaaaatacaaaaattagcctgtagtcccagctactcaggaggctgagacaggagaatcgcttgaacccaggaggcggaggttgcagtgagccaagattgcgcgattgcactccagcccgggtgacagagtgagactctgtctcaaaaaaaaaaaaaaaaaagtgtatatagtctggatagaaataatcgatcagatacatattttacaaatattttctactagtctgtaacttgtcatgccattgcactttgtttgtttgttttgagacagagtctcattctgttacccaggctggagtacagtggtgtgattatggctcactgccacctcgacctctcgggctcaagcaatcctccagtctcagcctcccaagtagctgggactgcaggtgtgtgccaaccttcccagctaatttttttttttttttttgagacagagtctcactctgtccccagactggagtgcagtggcatgatctcggctcactgcaagctctgcctcctgggtttacaccattctcctgcctcagcctcctgagtagctgggggactacaggtgcccgccaccacacccggctaattttttgtatttttagtagagacggggtttcaccgtgttaaccaggatggtctcgatctcctgacctcgtgatctgcccacctcagcttcccaaagtgctgggattacaggcgtgagccactgtgcctggcctaatttttgtattttttatagagacagggttttgccatgttgccctgccttcgcctcccaaagtgctgggattatgggcatgagccactgcaccccagccttttgccattacattttgataaaaagaaagttttaaatatttttagatactaatgtgtatttaacaattatgggtttgtatgtcattattaggataatatacataagtaagcataaaatctgtctaatatacattaagtggcttaatatgacaaaattagcagtgtatactttcttttttttctttttttttttttctgagatggagttttgcttttgctcttgttgcccaggttggagtgcaatggtgcaatcttggctcattgcagccttcaccttccgggtttaataaattctcctgcctcagccttccaagtagctgggattacaggcttgcaccaccatgcccagctaattttgtatttttagtagagacgggatttctccatgttgatgaggctggccttgaactcctgacctcaggtgatacacccaccttagcctccaaagtgctgggattacaggtgtgagccactgcacccagtcaacagtgtatactattgattggtttgattacagaataataccaaaaataataacagcaacaacaggccgagtgtggtggctcatgcctgtaatcctagcactttgggaagctgaggtgagtgaggagttcaagaccagcctgggcaacatgatgaaaccccgcctctactaaaatacaaaaaattagctgggcatggtgtggcgcaccggtagtcccagctactggggcggctgaggcatgagaattgcttgaacccaggaggcagaggttgcagtgagccaagatcgtgccactgcactcctgcctgggcgacagcgagactctgtctccaaataacaacaacaacaacaacaacaacacggaatagctaacacttaaattcagcactttctatgtgccaggcagtgtttgaagtgctttaaatatatctacatatgaaccgattgattctatataacaattaggtctactgttatctccgttttaaagatgaggaaactgaggtcaagagagggtaagtaacctgctcagggttggacagctagcattattttgctttgtttatttttaactcctcactcttcacctatcctcagtgccttttggttagcaatggtgacttgaaaatacaaacatttcttgaaatccacagtaaacccaaaccacatgcaatgatgtttgttttttggaaatgatcacacaccacatcatattccaagtgttgagtgcatatgcctcggagtggaagtgggccttgagagcatgttgtatacattttgaaacaaataagcctagactttttatctgctcggtttggagaaaggggaatagcaataaaatcataaatcacatataaatgatgtaacacactgaatagtgttttataaaataaggtgagggcatgatggtgcacacctgtagtcccagctactcgggaggcttgggtgggaggatcactggagttcaggagttcaaagagccagtgagttattgtgccactgcactccagcctagatgacagagtgagaccctgtcctcccaccactaacaaaaaccctgagatgataaatagcaaggcagcttgaaagtaaatagtaagtttaggatttgagaaaggggcaagatgttctaagttttcttcctttgttcagaaggaatctcagagttaaagctatgaaaagggatcaatctaattagtaaagagtttaaataggctgggtgtgttggctcacacctgtagtcccagctacttgggaggctgaagttgggggatccctcgagcctgggaggttgaggctgccgtgagccatgatcacaccactgcattctagcctgggtgagagagtgagaccctgtctcaaaaaaagagtttaaatggtttaaaaaggggggtgaggagagtagttatttgtaatgagctagtgcaggggtccccaacccccacccggaattagtccatggtctgttaggaaccaggccgcacagcaggaggtgagcagtgggcgagctcagcttcatctgtatttacagccgctccccatcgcctgtgttaccacctgagctctgcctcctgtcagatcaccagcaccgttagatccattagattcttttttttaaattgctgctgcacaaattaaggcattagattctcataggaacatgaaccctatcatgaactgcacactccttatgagaatctaatgcctgatgacctgtcactgtctcccgtcactcccagatgagaacatctagttgcaggaaaacaagctcagggctcccactgattcctacattatgttgagctgtataattatttcattatatattgcaatgtaataataatagaaataaagtgcacaataaatgtaatgcacttgaatcatcccaaaaccacccccacagctgggtctgtggaaaaattgtcttccacaatattggtccctgatgccaaaaagattggggaccactgagctagtgggttctggaacttcacctcttatgagcgatgtaaccttgggcaagttacttctctgagatactctataaattaaatcacttaatacgttgaaggcacttggcccagtgcctggcacataggagatgctgaataaacattcactatttttaatataatcttaatgcatagtaaaattatattaaaaagagtgagctagttcaatacagcaagtgtgaaaaactggactctgaaggttgacaggcccaggtccattcccaggtcaatttctggaagcaatttgctgaacaaacagttcgctgaaatagtgaggtttttttttaagttttgaaacatggtccctgccccacccctgccctgtccctgcctctgacaaagaaagaactatggcatttcatgacttgatttctggggattttcctttcagttttctactaatcaatgcattggaaaattgacctgctagtcctgggtttgaatttgttttacctttttttttttttgagatagggtctcgtgctgtcacccaggctggagtgtagtggtgcagtctctgctcactgcagtcctgggttcaagtgattcttgtgcctcggcctcctaagtagctaggactgcaggcacgagccaccacacctggctaatttttgtatttttagtagagattgggtttcgctgtgttggccaggctggtctcaaactcttggcctcaagtgatgtgcccaccttggcctcccaaagtggtgggattacaggtgtgagtcaccacacctggacttttttaactttttaaataaatttaaattttttttttgtagaaacgaggccttgctgtgtggaccaggctggtttcaaacttctggcatcaagcaatccttctatctaggcctcctaaagcactaggattgcagacatgagccatggcacctagacttgaccctgggtttgaattctggctctgacacttgctaactgtgtgtgaccttgggcaggccactgacccttcctgagccttatgggaatgtgggaataatattaggtaatggagcaagttaatataggtaaagaatttagaatagggcctggcacatggcctcagtctagtaccagagtccaagcccataaccactgtgccaacactcttgtaataaatgtatgtgggagacagggaggctgggaggctggatatgtgatgctactttatgtcaactacacatgaattttatatgtataatttatataaactaattgatgccatctactattattagactgaacaaatattgttacttggaactctcagatatgtaatagcttttttttattcaaatccaaaatgtaaaatgtgactatgagtaattgataatgaacttaactgataagaaacttcaggatagatttttctcaagttttccattcagtcttacagtgattaaagtgatgaaaaattccaactatgcatgccctgctcggagcgtccaagaagagcctaccaacgggggctacttaagctctcaaaggccaaacacacaaacggcattttgagtgcaagtggtctgtttgaactctgaaaaggcggggcagcgggcctgcagctcctggagttcagggagacccggaaatctcaccctgccctcttcttgtgttgtgtttgtcacagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctgggtgagtggtggtgctcacccccaaaagtgggcaggtgggggtggtttggggagggctcagggacagggattggtgactgtttgagaagctttcctttccctgggtccttgttggatgtgctgggcctggggtcctcactggtggtgaatgcatccggagttgagcacgtggttgcacacgagttttcaaaataaacttttctttgaagcctttaattgaatctgaggcttatggcttttctccaatattcagggcaagatttctcatctgaaaatgtccttgttgttggacctatctgagcaaaggtgttatgaaaattttttattgggtttgcccagctagatctgttaataatgcttccctgcatggcagcagggaagtaagagctgggccagaagagaggtggggacattgtgaactgaatcgaggtattaggaatggaaaatgccaggggtctattcatctgatccagtgaacatttttcctagaaaaaggaaatgtcatgaaaacacacggaaaacatgtaaatcagctgattctaaacaagggcattggtaagcctggcatgtggaggttataggaaggttgggcagtgccaagagaatgagttttggcattgacctgggttcaagtcctgcctctgctactttccagatgtgatataacctccctgaggctatagatgtgatataacgtaggtgatataacttccctgaggctcagttttatcatctgtaaaatggaagtgtgaatgccaaccttggaacatttctgagaaataaatgaggtaatatacatacattctaggtactcagtaagtaaaagctttaccacaactgtcattctattaagttctttgaaactgtatttgacatttataccttgttggccagccactcgaatctgaccccctgcaaaggctactaagagaactgcccagtgacctggtagcctcagtggcatccgaaattacaatcagggaccacagggacctaaagagccctgttttcagaggtcagaatctttattgatgttaactaagtgaggaccccagtgataggtcttccaggttcctgaaagtccttgtttccatagtgatgtaaacaacacttttgcaaatgtgaaaaggagtgggaagtgtttagtatgttaattgaaacgttttaaaaaagaaattccaagatgataaacaacatctctctctctctctctctgtctatatatatatatatatatatatatatataaaactgatgatgcacacaatcttggctcattgcaacctccgcctcctgggttcaagcacatctcccaccacagcctcttgagtagctgggtttacaggggcacaacaccacgctcagctaatttttgtatttttagtagagatggggttttgccatgttggccaggctggtctcaaactcttggcctcgagtgatctgccatctcgacctcccaaagtgctgggattacagacatgagccactacgcatggccaagatacctgatttctggatcaccagcagtaactgcccagttgggtttctgatggggctggtctcaggaaaagccaccacacacttgcctggaaaagcacactgcttctctaggctccaagtctctctctccctcccttcctccctctgatacacacacacagaccacatcacccccaccttccctggttgtcagcattcactgtcgtcctcctttgcctagaagcccattttgctaaaggcaccaaccctgcatccagcattgattccttcttctcatttttcaagagaatgtgtcagagacaaagaggaggatggggcacaacctatctttcccaccccaagactggaagtgggcatgggtgttttcactccgtgagctgtgcaagtggctgctcccagatatgctggagggctgcttggcttatgaaaatggtggagtgggccggacatggtggctcacacctgcaatcccagcactttgggaggccgaggtgggcggatcacaaggtcaggagttcgagaccagcctgaccaacatggtgaaaccctgtctctactaaaaatacaaaaattagctgggcatggtggcgggtgcctgtaatcccagctactcgggaggctgaggcaggagaatcgcttgaacccaggaagtggaggttgcagtgagctaagatcgtgccactgcactctagcctgggtgacagagtgagactctgtctcaaaaaaaaaaaaaaaagaaaatagtggagtgacaatcatgaaaccagaaagcaaacactatagctgtggcctggattctcaagtgcaatctgcttttttttttctcattttgatggggaacaaaaatggaaaagcatgctcattggtagtccttgccccgagggtatgaccttctcttcattcttagaataatgtagtgttttgtattttatgcatgtttgcttctcttggctcttggactatttgttcagaatatggcccaggccacatttcactttttaatggcaaatcattttggctgaagttatggcatccactggcatgatggattttactggttatttgcttgcaagtatgttcctgaaagtttaacagagtagaaacagcagaattgtttcttaggttaattttttttgaactttctgggttttaaaaatgtttatcttttatgtttaaattcaggtcagagtctcagtaacaacttgagtcagtttgaaaaaataacgcatgtatatatccaccatcctgtgaacatctgtgggctgttcactcggcagcctgtgatgtctgtccacatgggcttatctcttacctcattcatttatctggaatttctactctgtgccagatgccggttgggggtgtgggggtagtgtttaagatgaatagacaccatcaggaggtgcacagagtagtggaagagacaggcatgtgaaaagatcattaatttggtagaatcggtgtgcaaaagtagaggcatagctacattatagctcaactctgcctgctgagcaggcttagtgtaaggcagtggttctcaagctttggtctcaggatccttccttttacgctaaaaattatttttattttattattttattttattttattttgagatagggtctcactgtctcccaggctggagtgcagtggcatgatcatggctcgctgcagccttgacctcttgtgcttaagcaatcctccaacctcagcatctcaagtagctgagactacaggcacatgacactacgcctggctaatttttgtattttttgtagagacagggtttcgccatgttgtccaggctgatcttgaactcctgggctcaagcgatcctcccccctcagtctcccaaagtgctgggattctaggcgtgagccactgtgcccagccaaaaattattaaggatcccaaataacttttgtttgttttttaagaatcctgaggacaatcaagggagctttgtttatgtgggttagatctattggtatctacctgatcagaaatttaaaaataacaataataaaatcagaatgtgttaacaaactatatatgtataaaaaactatattttctggccaggtgcagtggctcatgcctgtaattccagtactttgggaggctgaggtggaaggatcacttgagcccaggagtttgagaccagtctgggcaacatagggataccttgtctctacaaaaataaaaaaatgaggccgtgcacagtggctcacacctgtaatcccagcactttgggaggctgaggtgggcagatcacttgaggtcaggagtttgagaccagcctggccaacatggtgaaaaactgtctctactaaaaatacaaaaattagcctggtttggtggtgtgcacctgtaatcccagctactccggaggctgaggcaggagaatcacttgaacccgggaggcggaggttgcagtgagccgagatcacaccactgcacttcagcctgggtgacaagagtgaaactgtctcaaaaaaaaaaaagaaagaaaaaaaaaaattagccgggtgtggtggtacacacctatagtcccagctaattgaaatgcttaggctgcaggatcacttgagccccagaggtcgaggctgcatgagtgagccgtgatggtgccactgcactccagcctgggtgacagagtgagaccctgtctcaaaaaaaaaaaaaaaaaaaaaaagaagagtagcaccgttttacagttttgcaaatcttgtaacggtctggcttcgtagaagacagctagattgtcatttcttgaccattcaatctgtcatgaaatgttttcgttagattatatgaaaatgcatggatatgtagttggaaaagggaagagcatttaaatagccttttcatataattgtgaatgttctttgatactacaccaaaacttgacaaagagtagtttcttaaagtttagttgcaatgtgaaatctaaaatcagatcaataaactttttgttctctatatacccacaagagaatgagagtatgaaaggcaaacattcatgttattatggaaatagttctgacctcatggatcctctgaaaaggcctcagggacccctagaattccccaaactacacttgagaatggctggtttaagagaattgttcccagtgaaggtcctgcccacggagagccctgtgggacagcaggtggcagaggcatgaggatggagtgtggcagtggggctccgatgtggcgctgggtctgccagacaggtggtctgagctggagataaggcagcaataatttaggacctcgagggctccaaggaaggagttttgagcttcattttgcaggggtaggagctgtggagggctttaagcagtcaacagtgggtgtcgctttgtctttgcacccactgtactctccggacagacttgaccttcctgggttgtggcaaagagcagggatctaaatagcaggctgcaacaggagaaggaacgagcacctgctctagcccaaagacccctccaggccacaacgctggcaggtagagtcggagaatctgactgtgctgtacccagaaccctttggacttggattcttccccttgaccagccttatcagtggcacccatccccttccacactcctcgctaggccctcctcaagggggcgctaactggaaggcatgctgccccactgctaatggccgcctgcttcgtttgtgcacactttttctctttgttaccccactttcctatgaggaggtggacctgtctccagaacaaccagtggggtatatcagcctttttggaaaccttaaccctccttgcccaaactcccagagtattcttatttatttatttatttatttatttatttatttatgatagagtcttgctgtgtcaccaggctggagtgcagtggtgggatctcggctcactgcaacctccgcctcccaggttcaagtgattctcctgcctcagcctccagagtagctgggattacaggtgcctgccaccacgcccggttaatttttgtatttttagtagagacagggtttcaccatgttggccgcctgcctcggcctcccaaagtgctgggattactggcgtgagccgccgcacccggcccccagtgtattcttgattccctccactccacaaactactctacagtcagccagcttgtggtctctggtggtggtctgtcttatgaggtcttgttgacatatgcattcttttctaaatttaccaaactggctcattttatttctgctaactaaacttgaaagccttttcttttcctattatagactctcctttggatcaatactacacactcagaagttatgtttgtgttttaagagagcattttgtggcaatatggcatcaattctagaagtgggagacaaagatttaaaaggaagttggccctgcagtctggtcaggggatggtagggcctgagctccctcccaccccacaccccaccacacacactgctggaagaattccagaggtgttccagggtagacaccacagcatttagtaaaatttactcataacagttaatttactacttaaaaactaatgaagaaaatctaagaattcacctttttttttttttttttttttttttagacaggatcttattctgttgcccaggctggagtgcagtggcactatcatagctcactgcagcctgagctcaagcgatcctcccaagtcagcttcccaactaactgggactacagtcatgtactaccacgcccaactaattgtttaatttttttgcagagacagggtcttactatgttgcacagactggtttcaaattcttggccttatgcaatcctcctgccttggcctcccaaagtgttgggattacaagtgtgaaccattcctcctggcagaattcaccttacacagccccaaattctgctcttggggaatcacagtgtattaagagacacttattttcatttttgcatgtatctctaaacctgacatcaaaatattcataaaattgcaatacgtttcatataatgagctgaaacctcctaagtgagcaatgtgaagttgttggctgcctggagaattaaatgtaagcatggcctgctctgtgttgctaatggaaatttttacctaggttgatatttattaacccccccttttttttttgagacagagtcttgctctgtcacccaggctggagtgcagtggcgtgatcttggctcactgcaacctccgcctcccgggttcaagcaattcttctgccttggcctcctgagtagctgagattgcaggcgcccgccaccatgcccggctaatttttgtatttttagtagagacggggtttcatcatgttggccaggttggtctcaaattcctgacctcatgtgatctgcccacctaggcctcacaaaatgctggaattacaggcgtgagccaccgtgtctggctccaacctacatttttaaggcttagctgccactcaatggatttctacatcccaaaacaatacctttaattgacttttattggcctcctctgtgaaggacggaaagcagatgccagaagccatgagaggctctggctctccgaccaacccgtggaagccactagtcttaaatttcctgaagccattttgccatgattaaaacttttgtctccttccctgagctttccagagctttgtccattctcttccttctacctggaatatccttccccagacaagacccattctcatccagggccaggtcaaatgccacctcctccctctccaggcaagacctccattgagggaccacacacattgcaggccctctgccaaagtgccaaccctctctgccttacattccaaggggtaatagtgatacttacctcagagggattcacattttagctatttttgcacttgtctcattttactactagactgtctcttcaagatagggactgaatatttttcatttctcatagcacctatgaaaggcaactctcatttactgagcccctgctgtgggttgggacgtgttatctcacctaatccatagcaggagcaaacactgtaaggtaattcttgttatattctattttcagacaaggaagctgaggctcagataggttaagcagttttggcaaatttgtcaagacttctgcaaacctagacagaaaaggtgctcaacccccagcccctttatggaaaggatgcatggcttaggggcagatatgcgttggagcaaagagaaagacacgcgtactcttgaatgtactattttagcccctgcttgctccttgacccagagtttttgtgtagaccatagaatgccctgcccatctgtatttggaggtgctgctgcagccggtcacacctgggttctactgacctccagccctggctgtggtcctgcccagggctcagtgtgtattgaacaagtaagtgaatgagacatgcagaaggctgatttcattcttatttgaatgatttcaatcttgattaaccttcttagcaagaggttattttcttctcctggacctcagttcattcatctctaaaagaaggaagttgaagtcaatgatctctcaggtctcatctcagatgtggtgatgtcaccaattcccctgacatcccttctatgtgggaaccctgatgaaatccgcagctttccctcactgtgtccaggtaggaaagccaaggaggaaccatattctggaagccaaggaaggagaagttttgagacacagggtggtcagtaggatcaggcaggacaacagggatggggcagtgggatcaggtaacacagcagggctgggcagtgggttcaggcagaacagtgggctgggcaggggatcaggcaacacagcaaggttaggcagtgggatcagataatgcagggctaggcaatgggatcaggcaacacaacagggctaggcagtgggatcaggtaacacagcagggctgggcagtgggatcaggcaacataacagggctgggcagagggatcaggtaacacagcaaggctgggcagtgggatcaggcaacacagtagggctgggcagtgggatcaggcaacatagtagggctggacagtgggatcaggcaacacaacagggctgggcagtgggatcaggtaacacagcaaggctgggcagtgggatcaggcaacacagtagggctgggcagtgggatctggcaacacgacagggctgggcagtgggatcaggcaacacagtagggctgggcattgggatatggcaacatgacagggctgggcagtgggatcaggcaacacaacagggctaggcagtgggatcaggcaatatggccgggctgggcagtgggattaggcagtgaagcaggggttgttaaacttcattgtgcatcaaaagctcctggaaggcttgttagaacacagattactgggccctgtgctcaaagtgtctgattcagtaggtctgggttggagcctgataagtggtattcctggaaacctcagtttgagaactattactgtagagaaacctacaaggttgggtgggaatgggcaggaggaaaagatactagaagaagatgctgtggggcatgagccggaaagacaatacaagatgagtaacatctgcagagaattgcagctgcagagtataaactaactgtaatctaggtccagcccttctgaagctttacaaataagctgctagcattgtccagccttatagggaattggcaaaaggtgagtttcaggcctacatgggagccagcctcttacagcacagcagttagcaatacacatctaaagaactaagtagctggcatgtgtctttatcatcagaatagattatacaaatgaaggtcgatgcattgagcttatcaaattgttttaaatatagcaacgtttgttttaaaatttttttttaaacctttgaagtaaaactgcctctttttcagtgctcagctgcagtgcatcacgggcagtacaatgacagctggaaacatggaccccatggaggcgctgtcatggccgccctcagcacagacctgctgttccctatcaaattcatcctctgtgcctatgctctgtttaatatagatttttataaactgtatgaagtaaaattcttcattcctatcttgtgattaacgctggaagaatccaaaaagcacagcgtctgacctccaataagccataaagttaaaagcttttctaggcaatgaatatataacctgatttttttctcctacagatcctctctctccccttctttctccctttctcctttgtgtgaaactctttctttatccctttccttttctataaacttccttgatctttccctctccagtaccccccttcctcattcccttcttcagttccaggatgttctctcctcagcttgcccatatattttgcacctgcaactcatgtgtgtgtcagggagtagaggtgagggattatcccttccgtgagtgacagtcacctttcttttctttgctggctggtgcttttaggagacaaggtgtacaaccttacccctaaggagccagtcctgtccttcgtctctctatctaatgctaataatgataacaatagtagtgatgacggccgggtgcggtggctcatgcctgtaatcccagcacttggggaggccaaggtgggtgaatcacctgagatgaggagtttgagaccagcctggccaacatggtgaaaccttgtgtctactaaaaatacaaaaaattagccaggtgtggtggtgggcacctgtaatcccagctactcgggaggccgaggcaggaaaattacttgaacctcggaggcggaggttgcagtgagctgagatcacaccactacactccagcctgggcaacaagagtgaaactccttctcaaaaaaaaaaaaaaaaaatagtagtgatgacaagccaccatgtgccaggcactgtggtaggcagctcacacttcactctgcatgtactattatcccttaaatgtctcatacaaggtcattcaactactgagcagccagaggtagaattcaagaagcgaacttgctgttttctctacttaaactcttttatcacccaggctgcagtgcagtggtgcgatcatggctcactgcagcctcgacctccaggcccaggtgatcctcctatctcaacctcccaagtagctgggattacaagcacgcaccaccatatccagcaatttttttttttcatatttttttgtaaagacagggtttcaccatgttggccaggctgttctcgaactcctgagctcaagcgatcctcctgctgtggcctcccaaagtgttaggattacaggcataaaccaccacaccccgccttcttgaactcttttctataaccccacccaccctgttttatccagttgaattggactcatctttcaggtctcagtggaagcgcttctaatcttctaggttgggatttaataccccaactattgcattcccatggagtgctgtatgtccccaaaactgcacttagcctgtacagcaattgcctgcttaattgtctgtgtagttcgtcactgtaccagcatagctgagcaaggtgcctggtacacagcaggtattccataaatgcctataggaaaagtaaattaacggactcttcctcaataaatatatatatgttctagaaatttgagttgtatattagtttcctagggctgctataacaatataccacaaagtgggtggttaaacaacagaaatgtattgtctcacagttctggagctagaagtctgagctcaaggtgtcggctgtgttggtttcttctgagccctctctccttggctcataggtggctgtcttctccctgtgtctccacgtggtcttttccctctgtacctgtgagtgtccagacttcctcttcttataaggacaccagtcacattgaattaggctcgccctaataacctcattttaacttaatcacatctttgaagaccctaactccaaatccggttacctcctgaaggcctgggggtgaggacttcaacatatgaatcgcgggcagggagagggacagaagtcagcccatgacaagctgctttgcttttcactttcccagtttgtggaggacagtgtgtcatctttcaacatgtttctaaatagcctctttttcctttctgattcactttatgttcccacttcagggtgatatgagaaacgctggggaagcatgttcaaagacttgagcagtgggtcacttattactttaccatggcatatttcagagtcattaaagcagctccagcaagcgcagtgggctgtgcagccggaatcccagggctgaagatgggacaggagtgcaatctaaccaggatgtgaaaccaagtccaagtaaggtttttcaaaagccaagaattagaacgactaactcagtcctgtttcagtatatccaggggaggctgatttatagggaaagatgaaaggaggacaatgtgtatattttggctgctcagaagaccatggggctagacatgggggaggaggaagttattataagcctacagccagccaatgagtaagaacatcaaagaggaaggctggttggccagatggaccaagagctggggcacaggcaggatctttgggagaaacaagatgaatggatgcttcggacaacctaagttcagagcccggaggggcctttagaaaggcatgatggattatgtgtactgtgggtcattgcgccatgagaagtcccatgggggatgagccccagaggcccttaaagtcagggtggaccattaagtaaactgcggaggaatttcttccaggagggctcagacttggcaaaggctgggaagggctgctttccatctccggctcttaatcccccagccctgacactggggctcgcttgttccagcctacttgatccatttattgaataaagatatactgagaaccagccgggcgtggtgactcacgcctgtaatcccagcactttgggaggccgaggtgggcggatcacgaggtcaggagattgaggccgtcctggctaacacggtgaaactccgtctctgctaaaaatacaaaaaattagacgggtgtggtggcgggcacctgtagtcccacctactctggaggctgaggcaggagaatggcgtgaacccagaaggcggagcttgcagtgagccgagatagcgccactgcactccagcctgggcaacagagcgagactctgtccccgcccccccaaaaaaagatatactgagaacccttttattccaaggtctgcattaggcccagtgaaagatgaggaatccttaaatctttgggacttggtggggtcaccggggatacatcctcctctcctaggtaccgttcatctgtttgcacccagatgtggcctgtcccatgtgattgtcccaccactgaccgaagcaggcctctccattctcctcttccagttaaagctgaatttgtctccaaagtgaagaagaataggaaaaccatcaattttatggagctttttaactatgccaaaatggtttcattctgatacactttttttttttctttttgagatggagtcttgctctgttgcctgggctggagtgcagtggtgtgttctgggttcactgtaacctccgccttttgggttccagcgattctgctgcctcagcctgctgaatagctgggattacaggcacgcaccaccacaccaggctactttttgtatgtttagtagagatggggtttcgccatgttggccaggctggtcttgaactcctgacctcaggtgatccacccaccttgacctcccaaagtgctgtgattacaggcgtgagccactgcacccggccctgatatactattttgtttcataatttgcttgggtaatcattgattcatccattcaacaaatacgtatgaagaagctacagtgtacaaggctttgctttgggtgccaaggatactgcagggtcaggccagggtcacatctggctcaccaccagtcaggctttagggtttggtacaaattccacggcctcaggcaccatgggtgcataggatcagcaaaataagtccttaaagagatggaaaactcactcataaaaccatctgggcttgatgccttttgtagaggggatatatttgacaacaaattaaatatcttcaaaatccatttgtgcattcaggtttttcatttcttcttaagtctattttggtcattgatatctttctgaaaagttttctcatttgtctacattttcaaatctgttgttataaattatagctcataatactgagttacgttttaatagggaacatgtattttataaatacatgtttataaaaaatagggtcccactatgttgcccaggctggtctcgaactcctgggctcaagcaatcctcctgcctcagcctcccaaagtgctgggattagagatatgagccactgtgcctggccaggggacatgtatttgttttttttttttttaacaaaaagtacacagtgttaggccgggtgtggtggctcacacctgtaatcccagcactttgggaggccgtggtgggcagatcacttgaggtcaggagtctgagaccagtctggccaacatggtgaaaccccgtctctactaaaaatacaaaaaattagctgggtgtggtggcgggcacctgtaatcccagctacttgggaggctgaggcaggagaactgcttgaacccaggaggtggaggttgcagtgagccgagatcgcaccattgcactccagcccaggcaacaagaacgaaactccgtctcaaaaaaaaaaaaagaataaaaaaaaagacaaagaaaaaaagcaaaaagtgcccagtgttttattctcatagatcacaaagctcttagcaaaaattctgaagaaacactgagacctgggggatgggtgtgtgttgccgggagaggagtcgctattgcctcttgggtttctccgataacacctggcttttgtagaagatcttcacagtttttcaaagcacccatcccttgccttacctctcctgtctcccttgtctgcctgatgcctccaacttctcagaagtgccagggccagggcactgctgggcccatggtgtgggtctacattgcagtaaaaggctcgttacccactcccctcaacacaggagtctcctgtttttaggcagcttaagaaagcagtcttgtctgtggaggaatgcccagccttcttggtgcagatgctgggtttggggacccagctgtttgcaggagttgtctaggaacgtcagtacccagggactgtgagactcctgggatgttatagtccccatgctagcagagggaagacactgggcccatgagaagttgagtttaggtagccagtcctgctgggagaaaggaaagcctcagatgccagcaagcttgctgtccagccattttctgacaaccctgcttattgcaccatgtacagtaatcaacacagacttgcatctgctctgaggggtgcaggtggtgctccatggaacacacacatgcacgccttcacccaccctttcctgtacctttggaattcgtggcataggaacactatatctattgcacttgggtgtggttataatgccagggtaaagataagtttctctgtggagtacctgaatgacaagatcatattttgtgtcagttccacatggaagggctcttcctcacagacattggaagggtaacagtagaatctaagctctaggaaggcagggtttttttgttttttgttttgtttttgtctgcacatgatagacacttagcaaatatttgctggatgggtggacaaatggaaactggaatgaaatggagatgcctaggtgagtgtgggaaggactctgcctctcctggtctttgccctgtagatgccaaatatcctaggcgggaactgggaagttggcagatgctgctgtgtagagagtcagtggagcaaagactggaaaaacatccagcctgtgtcagctagcaaaagaggggttttgggtctattttggggtcagaatattagaggaggtaacctgtaccctcaggcttcagagtgtggttgactaggaggctccaaagagtaagtgaaacccaaggggacggagataggaccacttgatccatccttgtaggttcagagctatgtcttatcaaatgttttcccttcatgtagtagcatgataatgaactcttcctactttggtttgataatgcaatggattatatggatagattttctagtgttgaaccaatccttgcattattgaggtaaactttacttgatcataatgtactttttaataccttactagaattattttgctaatctgtttttgtatttagattcataaattaaactggcagatattccctctaattttcattttttgcactctctggttttggtatcaaagttaagttagcttcatgaaaataagttgtttttgtaaagtaggtattagctattccttaaagagctggcaaatttgttcataaaaccatctgggttgaatcccttctgtaggggaaatatgtttgaaactaatttaatttctttaaaagccattagtctatttgacttttctatttcttttgagtctattttagtaattgatattttccttgaatgttagccatttgtctacattttcaaatctgttggcataaatgacagttcataatactgagctgtgttttaataggggacatgtgattctttaaccaaaggtgcccagtgctttgtttctgtaggtcacaaagttcttaggaaaaattctaaagaaacattgagacctgggggatgggtgtgtgtgctgcagggaggggagtctggattgactcttgagtttctctgataatatctcgcatatgtgaaaaagccgtacagtttttcaacacacgtattgcttgccttatctcttttgtcttctcaaagtccttgaaatgtagattttataatcagtctcaatttgtagataaggaaaggccaatcagacataccagtttatctataatatagatgagatcagaagccactcctagatcacaccattttaattagaagagagtttagagatcatctcattgagaaactcttaacctgggatccatgtccctcaaagtgctcttgggtagacttcagtggctccataatttggatgagaacaaaattacattatttttcactaaactctaagtgcagtttagcattcccttctattatgattgcaagcaacaaacaccagagtagtagcagtactgtgtctccagtagcaatcacagatattttcatggcacattgtagccatcagagataactcaaaatactgtttacactcatcactacttcaaaattacactagttagtagacccgcctcttgatcttgacatgttgtttttaaaagtacatgttactctataccaaatttttaaaaatattttgataactgcagttcaaataattggcctcctttctaatcctttgcattcatttacttgtttattgtgataaaatatacataagataaaattgactattttaaccgtttatagtacatgtttgatggtattgagaaaatttacaatgttgtgtaaccatcaccactatttccagagcttttcatcatcccaaatagaaactctgtaaataatgaagcaataactcctcattcttcccttccccaccccccagtaacttctattctacttttttctctatgaatttgcctaaatacctcatacaaatgaaattctatcatatttatcctttggttgttagcttttttcatttagcttagtgttttcaaggttcatccatgttgtagcatgtatcagaacttcattctttttgtggttcaaaaatacgctacattttactccattcacctgtcaacggccacaggttgttttcacctttggactactgtgggtttttttgttttgttttgttttttgtttttttgagacagggtcttattcctatcacccaggctgcagagcagtggcgtgatccgggctcactgcaaccttgacttccctggctcaggtgatctttccacctcagcctcccaagtagttgggactacaggcacacaccatgcctggctaattttttgtattttaagtagagacagggtttcatcatgttgcccaggctggtcttgaactcctgggctcaagcaatccacctgccatggcctctcaaaatgctgggattataggtgtgaaccactgtgcctggccacctttgagctattgtgaataaggctgctatgaacattagcacacaagtatcttcttgagttcctgctttcaattcttttggatatatactaaggagtagaattgctgggaaatatggtaattctatgtttaactttctaggaactgctaaactgtgttcaacagtggctgcagcatgttacattcccaccagcagtacacgagggttccaatttctccacatcctcaccaatacttgttattttcattaaaaaatattaattaccatcctagtgggtgttgcattttattttaggcatgtaaaaactttattctgagaaggagtcatgggcttctccagactgccatgggggtccctgatacaaataaaggttaggaagctaggatgagggaactcaagagctcagagatattgtcacatgtccaaggtgaggtgatggactagcagcagcccaggcattagaactaagtttcctgggtctcaaaggagcccttttccctcctaccagatggtctgttctcatgtacatgatccaccccagccagtggtcagaactgagtcagagctggagctaagccattgaccaaccagctactgaagctgaggccagcaccagacacagactagatagacataattaatccctgtttgcaaatcactgcaatgtagaactaccatgcaccaccacagctgctaaatccttatccagcctacaaacatccactgaatgcctgtgtgcagatcaaactccatattcagttggagtgtttgggggacacttacggggacatcaatggacaatttggtttataggtataaagttcaggagggagaaataaccctgtgtatgtttcatttaattacagaataggtgtcttgatctctcgtttctttgtggggaccctctatttccgcagaggcaggttcagatggcctcttgagtctcatcgcccattttcttactgagctctgtcagccttggctcctgaacctttccacacttgtcagctcagtttttaaaataaccatagctgactttttttttttttttttttttgagacagagtcttgctctgtcgcccaggctggagtgcagtggtgcaatctcggctcactgcaacctccatctcctgggttcaagtgattctcttgcctcagcctcccaagtagctgggataataggagcctgccaccacacccaactaatttttgtatttttggtagagacggggtttcaccatgttggccaggctgatctcgatctcctgaccttaggtgatctgcctgcctcggccccttaaactgctgggattacagaagtgagccaccatgcccagtcatcatagctcactttttttttttttttttgagatggagtctcgctctttcctccaggctggagtgcagtggcgcaatcttggctcactgcaagctccacttcccaggttcatgccattctcctgcctcagcctcccaagtagctgggactacaggcgcccgccaccacagctggctaatttttttttttttttttgtatttttagtagagatggggtttcactgtgttagccaggatggcctcgatctcctgacctcgtgatccacccgcctcggcctcccaaagtgctgggattacaggcgtgagccatggtgcccagcccatagctgacttttaatgagttttaattctagctctccactgtgcaaccatgaataagtaacttaaccaccctgaagttcagttgtcttgtttgtaaaatgaggataataatgatacctccctcatagagtggttatgaggatggaataagacaatacacatagagggcttggcacagagcctggcacagaggaagcatttcattagcgctgttattgttgattttaaaatttattattaaaagtcactttgacgcctataatcccagcactttgggaggctgaggcaggtggataacctgaggcgaggagtttgagaccagcctgaccaatctggtgaaaccttgtctctactaaaaatacaaaaaattagctgggcgtggtggcagacgcctgtaaccccagctactcgggaggtgccttgtggtaaaagatgggccaaggagtttttggttttaaagcgaaagcctgtaatcactgtgcctgctcacagggggattgctatggctaagttcatagataattgggtagttggctgaggcaggagaatcgcttgaacccgggaggtggaggttgcagtgagccaagattgtgccgttgcattccagcctgggcaacaagagtgaaactctatctcaaaaaaaaaaaagtcactttgtaagttgcaaagtatgactctactatgagatctttacaactaggaattaagccagttacgatggcccatgcctataatcccagaactttgggaggctgaagtgggaggattgcttgagcccaggagttccagaccagcctgggcaacatggtgagagcccatctcaaagaaaacctaggaatcagagcttctcatctctgggcctaaaacatctggtggagtagcttctcaggaactgtatactgaatgaatgagtgagatgacatttactaacagttttattaacttttatcttttatttacctatttgaccatctactgtactgacttaaatataaaatagcagtttttctctttcaacctttttttttgaggcagagtctcactttgccacccagactggagtgtggtgatgcaatctcggctcactgcaacctccgcctcctggtttcaagtgattttcctgcctcagtctcccaagtagctgggactataggtgcgccaccgtgcctggctaattttgtgtttttagtagagacagggttttgccatgttggccaggccagtcttgaactcctgacctcaggtgatccaccggccttggcctcccaaagtgttgggattataggtgtaagccaccatgcctgcaccagcccctccccgcccccttttttttttgagacagggtctcactctgttgcccaggctggagggcagtgccctgatcttggcttacttcagcctctgcctcccatgctcaagtgatcctcccatctcagcctcccaagtagctggggccacaggtgtgcaccaccatgcccagataattttttgtatttcttgtggtagagatggggttgcccaggctggtctcaaactcctcaactcaagcgatccacctaccttggcctcccaaattgctgggattataggtgtgagacaccatgcccagcctctttcaactttaaatcaagtatcagtcttagaatcaattctctgtagaatttgtcatatgagtcagtctgctctctatttctatgagtttggcttttttaaattccacatataagtgaggtcatgcagtatttgtcattctgtgcctggtttctttcatttagcataccatggggccaaggacattttttcttttgttttctttttcttttctttttccctgctccagctcaaaggatggggctggggaatctttagatgagtcgggggaaggcctcagtgagaaggtgactcttcttcacatacctgaaggcagtgacaggatgaggcaccagaataatgttgcaggcagagagaacagcaggcaggagtatgcttgaattgttcagtacagcagggaggccagtgtggctcttgccgagtgagtgaggggcccacggtaggagatgagatcagagaagtaacaagggggcctttagtggggccattgaaacagcttaggattttctctgagagagatgggagccattggtaagggaattacatgatttcactttttttttttttttgagacggagtctcgctctgtcgccccggctggagtacagtggcgtgatcttggctcactgcaagctccgcctcccgggttcaggccattctcctgcctcagcctcctgagtagctgggactacaggtgcctgcaaccatgcctggctaattttttgtatttttagtagagacggggtttcaccgtgttagccaggacggtcttgatctcctgacctcgtgatccgctcacctcggcctcccaaagtgctgggattacaggcgacttttttttttttttgagatggggtcttgctctgttgcccaggctggagtgcagtggtgcaatctcagctcactgcaacctccgcctcccaggttcaagcgattttcccacctcagcctccccagtagctgggactacaggggcgtgccaccacacctggctaatttttgtattttttggtagagacggggttttgccatgttggctggtctcgaactcctgacctcaggtgatccacctgccttggcctcccaaagtgctgggattacaggtatgagccaccatgcctggccgatttggtttttaaagaatcacttcttctgctggattgggaatagtctgcagagaggcgaaggcaagcagtgcttaggaggctaatgccatcatccaggggagggatgatggtagggttgagtaatccctggagtgtaacaaacactaaggattattttattttgtggcaaatgtcctaaagctttcttgaacagtaccaggttgctgggaatgtatagagacagcttacagagcaccctacagttttagcaagggaactttcacgtaatataaaggcatgcaggttgtactcttgtatagttgtgtgtacattggttgtttcctgtagcaaaatcatgaagagtatgaattctagagttagagtccctacattcaaatcatggctccaccagttactaactgtgtgaccttgggcaaataaattaccctaacttctctgagccttcagttttccctctagtaaaatggggacagtgggttgctatgaggagtaatgagttagtgcgtgtacaacatttagcattatactgatatataaccatggctcaataacatagtagctatcattatggatatgaatataaccatttgtaaaggtcaaggaacatctctatttaacttagtttatttatttattttttattttttgagacgtagtctagctctcttgcccatgctggagtgcaagggagtgaccttggctcactgcaacctccacctcccgccttcaagcgtttctcctgcctcagcctccagagtagctggcattacaggcatgcgccaccaggcccagctaatttttttttgtattttcggtagagacggggtctcaccatattggccaggctgctctcgaactcctgacctccagtgatccgcccgcctcagcctccaaagtgctgggattacatgtgtgaactaattaacttagtttatttagagccatagcatatggggctgaaaaagaactaagacacttcatttagtctaaccctctcattttacaggggagaataaaaactagagatagaaaattccatagccaaaataaaataaaataaagttatggtccgggtgccgtggctcacacctgtaatcccagcactttgggaggccaaggcaggcggatcacgaggtcaagatatcgagaccatcctggccaacatggtgacgccccgtctctactaaaaatgcaaaaaatagctgggcatggtggcgtgtgcctgtagtcccagctactcgggaggctgaggaaggagaatctcttgaacttgggaggcagaggttgtagtgagccgagatcacaccactgtactccagcctggtgacagagtgagactctgtctcaaaaaaaaaataaaataaaaaataaagttatgcggccagtgtcacctagctggtagcagagtggggactggaacacaggtctctggactcccagtctggtgctttctctgctatgccacattgcttccatagaaccctcagtgcagcaccaggtgggaataataataacaacaataaaggcttatttgactcttactttgcgccaggcactattctaagtacacatatttgctcattttatcctcatgacaaccctatgaggcaggtacaattattgtccccatcttgcggaagaggaaactgaaggagagagggataaagccacttgcccagggtggagaatgagtgtggtgtgggagacatgggcaggaggctgctgccccgttacactgcacgacctgcttctccctttatgtaacagggaaattgaatccagtcgttcaagtcctttttcagccttcaaatttgcagaccctaaatgcttttctattatcgggtcttgaataaataccattccacttcattaaaactgctgtctttttaacttgtcttcatcttaatgatcatctacaagaaagactatttgcagaagagcctagaaaccaagtcaccaagcctgtgagagattcctgaaatgttatttctggcttccatagcaaccctaacatagggcgttaagcttaacggagtcagcgagagcagctggagccgggcattgaagcgctgagagcgctgaggaaacaaatcgttggctcaatagttttccttttgtgtaatatactgtcccagtgtgtttagggagttacgacttctgccaagtaagaatggaggaaatgaagcattgtatcaaagtgtacagagtttccaagcaaattggaggatgagtacaagtctgtgtctaggggagtctctgcagaagatgagggtgggcctgcagagacgtaggggtggggaggaggggcagctctgctttccccaaccttgggtgactaggccttcaggtcagctttgtgaagaggactgagcatgcctggttgccttttctgttccaccccgtttgccgacctcagtagagagtgggggtgatacgtgagtgaggcatcaaagaggccaagatgctgaggatgacagaggcagatatgctgaggctgacggagccaccagggccagtgcaggaaacagagctctctaggtatttcaggaagaaaaagatttaacacggggaattcggttatatagttgttggaagggctggaggagtgggagcccagggaccaccacgcaagagcacctcactgggatcaggatggtgctgccaccagaactgacgtctgtgcagctgctgagcagacaccagaacacgaagtctggctgccgcaactaactggctttctaaaaccttgcttgctggcagagccaccatccaccccacttcatcctttgtgaatatattgaattggggttccccaattcttacccagaaccctagctgcctgaaagatagtctgggaaatatttgttttgtccttttagcttctgcaacgctggaagactcatggggagagttgggagttcatgccaagtgccaatggacatggacagcaatcgattttttttttttttttttgagatggagtcttgctttgttgcctaggttggagtgcagtggcacgatcttggctcactgcagcctctgcctcccgggttcaagtgattctcttgcctcagcctcccaagtagctgggattacaggtgcacaccaccacacccagctaaattttgtatttttagtagagacggggtttcgccatgttggccaggctggtcttgaactcctgacctcaggtgatctgccttcctcggcctctcagagtgctaggattacaggtatatgccactgcaccctgccatttttttttttttttttgagatggagtctcactgtgtcgcccaggctggattgcagtggtacaatctcggctcactgcaacctctgcctcccgggttcaagcaattctcctgccttagtctaccaagtagctgggactacaggcacgtgccaccacgcccagctaatgtttgtattcttagtacagatggggttttgccatgttggccaggctggcctcgaactcctgacctcagccgatccgcccgccttggccttctaaagtgctgggattacaggcatgggccaccttgctcagcctgatatttatttcatttgaaatttggattaaataggtagaggagttgaacaccaaatagagatgagttgaaagggcccatcgttgacctaaactatttgctccaccatctgaaagtcctttgggattaagtccagggttagataacagaggggcagaaactcaactcccagagacaaaggagtggccttaacattctctctggtgccttctctattagtatatacataaggaaacattaatttacacccaagagtaggctgggagcttggatgggaggggaagcagggttgggggtcaggcctggagagattggctttgggctgggccatagatggagaagactgaagtctgggctgtcaggaacccttagaataagcctaaaataggaagggcacatctaaaacccttcagtgctcctcgtttgtcctaataaaatccagaccttttttttttttttttttttttttttttttggaacagggtcttgctctgtggcccaagctggagagcagtggcacaataatggcttactgcatcctcaccctccagggctcaagccatcctcctgcttcagcctcccatgtagcgaggactacaggcctgcaccattacacccggctacttttttttttttaatctattgtagagagggggtctcaaactcctgagctcaagtgatcctcttgcctcagcctcccaaagtgctgagattacatgtgtgagccactgtgccctgcctgaagtccagacttcttatgcaggaggcacatgccgtccacccacatggccctgtcttccccaacttgtcctttaggacccagccttgccacatcacctgtggttacctgggtgcgtgtgcatcccactctgttctggcctccagcttttgcatacgctgcccttttacctaaatgcacaccccagcttgttgcctggtcaacacctgctcaccttataataacatcatcctattataatactcatcaccttgtccagggatcttcccccaccccctatcttgggactggtgatctactccaggctctagtcactcgtccttttttgttgttgctttgttttttgtttttagagacagagtctctctctgttgcccaggataaagtgcagtggtgtaatcatagctcacggcaaccttgacctcttgggctcaagcgatcctcccgcctcagcctcccaagtaactgggactacaggcgcacgccatcatgcttggcttgtgaaaaaacttttttttttgtagtgatgtggtatcaccatgttgcccaggctggtctctaactgctgggctcaggcagtcctcctgccttagccacccaaagtgctgggactataggtgtgagccatcgtgcctggcctgctcatattttttatgaatcttaatgaatctgtcttctctacagggttgtaagctcctcccaggctgagactggttctcatactctatccctagcacccagcacaaagaggggattcctgcaatgtttgtacaactcaaccaaaccaaaatgatgatagaattgtctccgaagacaaactttgcctttgctggcacagggctgtggaaccttgtgccctgttatctaactggccccttcctccttgtgtacctacacctcctcccctcctccttccagggaaaggccctgaggcgctgtgttttggggcctccacctccttcctctcctctcttgcagcccagccctgtgttgctatttattcacaggtctctgctctgctctggctttcacttgctgaattctcagaaagcagatgaagcaatttattcagttaaagtgcccctgtgggtcaaatgccagcttgctttttaaaaccttcctatgctgctttttactttgcagagagcagaaattacctgttttgtttcctggtgctttctgcactctcttgtattgagggatggttgtgtgtctgtgtgtgtgtgtgtgtctgtgtgtgtattacaattttaacgtacatgtcatttctcaatttgagaaaggaagaaagatagtgagggggtttgatagagaatatcaaaattattttgtatgtattcagtcagctcattttttaaaagaaaatgttttaatatcactggctatggtttttattttattttattttattttattttattttattttattttttgagacagagtctcactcagttacccaggctggagtgtagtggcgcaatctcggctcactgcaacctccacctcctgggtttaagcaattctcatgcctcagcgtcccaagtagctggaattgcaggcacgcgctacaacacctggctaatttttgtatttttagtagagacggggtttcgccatgttggccaggctggtctcgaactcctggcctcacgtgatctgcccaccttggtctcccaaagtgctgagattacaggcatgagccactgtgcctgacctgactattgtttttaattttaactttaattttaagttcaggggtacatgtgcaggtttgttatgtaggtaaactcaggtgtcacaggggctggttgtacagattatttcatcatccaggtattaaatctattacccattagttatttttcctgatcctctccctcctcccaccctctgatgggccccagtgtgtgttgttcccctctatgtgtccgtgtgttcccatcatttagctcccacttataaaaaccactgtttcacagcttatttgtacttctctttatcaattaagaaaaagactgtttgtatagcaaactccgagagaggacgtgaggggtattttttggtgagacttgagcaaactgctttacgttgcaaggaaattcaattcattggaaactttttcctccaggactaaactggggcagctttcattttggctctctcacaaagaaaattgtccagggtctggaaaccacagttgttgaacctcatatgacgtctcttttctttcagctcatgcaacatttactagaggagactggtgtgatgtggcgtgtttttcctttccttttttttcctttccattttgctggctcgttggtgcacacttcctgagggcctgagagggctgtcttcctggaggaatttatgacagtcagcagggacaactgaaatttgagctggtgtgaacccataatccctcagggccctactggctggagtctctttagggagcatccttgctacccaaagatgcacacccattccccagcaccttcataaaacaacaacaaaatcttaccatggcattgccaagcatattttgcatacaaacttcccaggatggattctatctccatgggcagatggaatccatcccgaaagcatctttctctgccagcacactcacctgtctctgctctgcaaatgcccttcttggtagtagcttgttcaagggtacgcagagcaaatttggcaattctgaaatttcagcttttgtttgtgaacttcggctctgctcaggaagaacttgtcagaatgaaggttgacattcagcctgtatgtcgagcattcttgagagaagcacacggtgcctggcatcttgaatggcatcagctgcttgctacccagttctttgggacaagtgggtccatgagagaaaatatacagagcagggataagactgcacccgctctggcaggacagggagcctggctaccccaacttccttttcccaagccatctgctacttttcttcttctgcaaccaggcattcaaagcagggtgtatgtgggggaagaccctggaaatcacctccatctgggtgtacattgttacttttatcctcagtagttggtcaagaagtagagtgtattctctatatatctttattgggttcatccccacttattcagaagtagaatctctaggccgggcatggtggctcacacctgtaatcccagcactttgggagactgaagctggtggattgtctgagctcaggagtttgagaccagcctgggcaacatggcgaaaccctgtctctttcaaaaatacaaaaaattagtcgggtgtggtgggtgtgcctgtagtctcagctactctggaggctacgttgggaggatcacttgagcctgggaggcggaggttgtagtgagctgagactgcaccactgcactctagcctgggtgaggctttgtttgagacccagtctcaaaaaaaggaaaaagtttttagaaagttttagaaatactaatttttaaaaaagaagaatctctagcgaccgttcagtgtgatctggagttaggctgttctggttaaacgtagattgtgcctatcgaataataatttctcttaccctgcctagctctacagtcgcctctatacttgtctcaatgacccctgcactgtgagcttcttgaggccaggacctgacgatacagcactaaccattgtattttgcctgtggtgccttcagtacagtgccttctatgtgccggccctgagccaggcatcgatgaaagatgaataagtccaagtcatgacctcaaaggtggcttatagattgatgggacttgcaggccagtaaataccataagtatttgtggggcgacatcactgcacattaagttactcattgggcttactgtcatcacgacctggtgctgagaaggcacatttgaactccggtaggtgcagcagatgaatcactggggcctgagcgatgcctcccagggcactggcctgggcagagggtgaagtggggagatttgcacttaggcgactgtgtcttgagttgagctttatctcctgggtcacattccaggctcagctgccagtcaatgtgttatctggtgatggggagggtaacagggctcttcactcttggccacctactgggagcagtgggtaaaaatgcaggtatgagagtcagaccaacttggggtttaaatccctgttctgccaccactcattaatcccctgactgtgcacttgtcacttaacctccctgagcctcagcttcctcatctacaagtggagggtaacagtgcctatcttctttattttctgaacctaattgaatgccagatatatctgtcatgcatatgatctgacaatggaacagaatatttgcatcaggagacaaaagagactccaggctgtatgattgccatattttcaaggccactcctggtttgggggaagaagatggcaggacatcagaatggggtgccctgccactatcttcttttctagacccttggcagatggtctctcaggctcacataaccctagagacagagttctcaaatttgttgtgcttaagaatcacttgtagcaattacaaatgcagattcctgggccttaatcccagagattctgattccctgggtctagggtacagctggagtgcagtggtgcgaccacagctcgctgcagcctctgcctctcaagttcaagcaattctcctgcctcagcctcccgagtagctgggattacaggtgcccgccaccaagcctgctaatttttgtgtttttagtagaggcagggtttcactatgttggccaggctggtctcgaactcttgacctcaagtgatccacccacctcggcctcccaaagtgctgggattacaggcatgagccacgatgcccagccgtccccacctctttctgatgttatcgagctgtcgagtatcccagctgcaacctgttctttattgtgtctctgctgaccagcgttcccagcccattccagctcatggcagggtatctgcaatctttctcttccctgccctcccaaacccccacccacaagctttacctggaagctcatgtacacaccaaagggaataagcaaggacccagacaggcagccaggtgcctggcactaggccgggtactagggattcatagaagatactgcttgtggccaggtagctgcatgtgtgagatactggtggaagacactcagacagaggtaagcagggagtgttggggctcagaggaaggccactgaggccagtggagaatggcccattaaggaaaggttttcaaaataggtgaccacagggctgagtcttaagctgaacagggagcagagggcatgcctagcagagagggcgctgtgtagggactacagacaggcagtgtgacattgtataaggtatagggcagggagtggtggctggtggagaaggctgagttcatgagttcattctcccctgaacatcagcaaccttgccattagtgacccttgggatggtggcttttgaagaaattgctttgatggaatagctccccaagactcatggatactgggagtttatgtatgtatgtatgtatttatttatgagacagagttttgctctgttgcccaggctgtagtgtaggggcgtgatctcgactcactgcaacctctgctttccatgttcaagtgattctcctgcctcagcctcctgagtagctgggattagaggggcacgccaccatgcctggctaatttttgcatttttagtagagatggggttttgccatattggccaggctggtcttgaactcctgacctcagatgatctgcccacctcagcctcccaaagtgctgagattataggcgtgagccactgcacccagcccgatactaggagtttaaagctgtcatttctggttcttgggactcagatcaatgaaactcactaaaatattcattcatgggaaagttctggtagaaaggggaagattaaagtccatttttgtcaggagagtctctctctgggaaagccattgatgagatgactggggcataaggtggtgtggtggtgtgtgcctgtagtcccagctactctggaggctaacttgggaggatcacttgagcctgggaggcggagtgattgggagtaattggaaagtgacatctggaagacaaatcggtttattttcataagctccctccagtctatgggtgatgggaaattggggtgctgtgtcaagaggaatcctgtggttggactttgattctgagaccaggactgattaggggtgtcggtcacagatgccagggctggggacatgggggtgacatgcaaggcttggacttgccatcctggctccatattttatcatgggaccagctgtctcccttcctttggtttatgcagttgatttcgaaccctacgtgcagggcttgacatttttaccaattacacttcatcttactagtttctactcattattccatccctcagaaaccctttctgggcctgtctgtgttactcagcttattaacagttcctcccagcatcgtatgcagtggtgtagggagaaccataaatgcctccagaatttgcaaaaatgtttggaaaatgttaccaagtgggaaatgatttgctaatgagttcacaatatgtcttagacccattaagtaatccagggtgtctccctaatatagtagaagcaagttttcagaatattccccagcggttttttcagaaaatgtgaatagagcacgactgagtcaaagaaagccctagctcatcaactgcattctacagtgtcaggcctcatgtgatgccgcagctggcgactgactaataagggaattggagaggggagaattgattatttcctggacaaggaccatggtgccttaatcaagtgccctaaatgcaggggactgcaggggaagtcgcactgtggtaaaaaaaaaacaaatatagtctaaattacatctgaagtagcctttcaattacccttaagcactgagagctggtcacagtctggaggcacacagggacagaagcacctgaggaggctcaggggccgcatctcaggtgtctgtggacatgcccctgagggagcacagtggtgggtgggatcccactgctgtgtcgcacggtcgtctttgctctcagtccatctgtctctctgtctctctttgacaagcccatgtagttcaagtctcataaataaaatgcgtacagccggggttcccaaaccccatgctgtggaccgatctcagtccgtggcctgttaggaaccaggccgcacagcaggaaatgaatggcaggtgagcattaccacctgagctccacctcctgtgagatcagtggcgacattccgttctcacacaagcgcaaaccctattgtgaattgtgcatgcaagggatctaggttgcacactccttatgaaaatctaactaatgcctgatgatctgaggtgaaacagtccccctcttccccactctgtccctggaacatttgtcttccattaaaccagtgcctggtaccaaaaaggttggggactgctggcttatcggatgcaatttccttgtattctgatgtgctagttttatattcttatagtggaggatccataccgctttcacggttttatgagaaatatctcttacaatctttctatttgttttgctctgaccccatgcccacctggcagccctccctcatgagtgcagttttacctggaagctcatgtgctgacccttcacatagccagccttgtctgcctgcccttatttctcactgaaaaagaatgttagcctttatagtcagacggtgtctcatatgattagctagtttacctttattcattttttcagacgtgggtaaaattgagtacttcaatctttgttgcagagcaccaggctctaagaccaggttggtagaaggattctatttcatgtgccagttctgacaaattgtttattggtactcaaagtgccatgttgaaaggatccaggctgagggggacagggccagaattgattaacaatgtctgccagggactgaaaaaaatggcattgttaagcttgccttagagcctgagacagtcaaccattccctctctcctctaccaaaaggtagtcaaccactccctcactgtccttctctctctcagcatgtatcattagagacctccttccagactggcttgatctgtttatatttatcaacaacagcacactgtatctttttggtctgcctgcttcattgtatcccgttattgtgtccttttcacagtcaggagtcttttccttcctctgtatccccaggccctggcatacaataggtatgttgaatgactggctcacaacctaagagttctacctaattgttctgcatgcagggaatctgccttattagggtcagtcgtttgccttgctgagatccatactacagagttccgtggatcctcttggtctgttccatctaggaataaaacgtacattttgcatgcccttttttttttctttcttaaactcctgctagctcattacgatcatggcttgctgtctctctctctctgttcttctctcatcataaaacagcttcaacttttctccccagtgtccctttgaaactgttggtgagctagttttttctctgtccctttaggaaattttaatcatgtttttaatcatgcttcatagtgttttgggtcacccttcggtaatttttaaaatcctctggttattcctagttctaagaacaattttagctcttggcttactgctactctgtccagcattacccttgtcataattgttggtgatttcaagatccacatgaatcatgaatcatcctttaatagctttgagattcttttctccaatattcttgtcttccaccagatctcagccactcacttctctctctctctctctctctctgtctctcttttttttgagacggagccttgctttgttgcccagattggagtatagtggcacaatctcggctcactgctatgtctagcctcccaggttcaagcgattctcctgcctcagcctcccaagtagctgggataacaggcgcctgccaccacggccggctaatatttgtatttttagtagagacggggtttcaccatattggccaggctgatctcaaactcctaacctcaagtgatccaaccgccttggcctcccaaagtgcggggattacaggcatgagctactgttcccagctagatttcagccaccttcttctcttatcttgaccctataattacagtaactttattcctgccataatttcagtttaaacctcctatcttcccagcttacctgtactagtattccaactccaacaattctgtgaccttatctggacttccagttaattgatcctgctattttttcactgtctttcacctcaattcctctatttcctgcttccccagcttcaattctatagggaatcactatagtcactgtcaactacctttgcccctttcctgattcatcgttctcgtttggctacatgataacccttgttaaattcaacttttaccagcctgccccccatatctgtgtagctgaatgtggctgtagcaaaacatgcaaccacctggattggtctcatgtaaatttcataattgcagcctttaagtaggcctttaatgtggcctggaaatcatactctagttccctaatcccttcactcttccactgtcctagaaactgttacagttttttttcacttgtgttattacatttttcatggttctcttgttaagtgcccacaaaccatctgctcgtgggaactttgctgggaattgatatggaacatcacattttctgaaatcaattttcctgggtatttgactactgtccagactgtagtccttctattccccacagcccctcaaagatcggtgacctctctctttccgtcacacctgtcccgtccttcattctccccctggcccttgaccgtactgaactctccgtaagcgcttgtcgaggagtaagaatgggaaccatcagtggcttgacttactgggctgctgctatccaggcaggcaagcatctgttttcatcatattattaagtgtttttttttttttttcagcacttggcaggaggtaggcaagtttgggccatagctttcaggccctgagtccaggcaaggaaagaactgaccccagagagccaatccagccctggtgcatcttgagtattctggaaatggcagatctaaaaggacaaaatcatttcatattcatcatgagtatagcttggtggttaagagtgcagactacggagccatcacgatgggttcagatcccagctcctctacttcctagtgataaaagaaaaaactcaaccaaattaaatttaaaggagtttaactgagcaatgaacaatttgtgaatcgggcagcacccagaatcacagcagattcacagagactccagtacagccacgtggtggaagatttatagacaaaaaaagggaaatgatgtacagaaatcaaaagtgaggtacacagcgggtggattggctacaggctggcgtttgtcttatttgaacacagtttgaacactcagtagtgtatgaatggttgaagtacggccgctgggattggccaagactcagctattgttacaggtgcatactcctaagttaggttttcaatcttgtgtacttataagcttggttgcagtttttccacaaagactgaaatatagaagcatggagtcattctcaggccatatttacttcacttttatactagataggagaactcaagcaagttatctaacctctctagactcactgtcctcatctattaaagaacagtaacaacacctactttctaaggtgtgttctttcctactttctaaggtgtgtgtgaagaataaacaagccaacacctgtaaaccattcagaacaaggcctggcactaattaagtgctcagtaaatattagctataaattacgattattttctcttttgagtctcacaacagtattgtaaggtattattatccctattttgcagaggaagagactgagggtcacacaggttaaggagaggctcaagatcatttggacagaaagtggcagaggctgggcttgcatgggatcataggactctaatactgtttcacttaggatttcagagccccctttggtctccagatgaaatgattttacccttgtcatggagattcatattcattccttctccaaatgtgtcctaacttccccatgcagatggcaccaaatatttacagtatgattacactgccatgattgaatttagccagaacgggagagaggctgattagtgacaaggctgcaatcttgagaggaggaaatagttctgatgttgcacattgtcattctgctggagtaggaatgttgcttaaaattgtcctggctcagttccctttctctggaagagtaaaagacactcatttgcccaatacatggactttggagtcaagctgacagtactggaagagctgttaacagagtccagatcatcactttatggttagagggatgacgttttattatgggcccacaaactgtcctccaactgtggctgaaaaccctgtcatgagaggccagaaggaagatcattgtatgttcttctcccaggccaaggagacaggatgtccttcatcagaaccagttgtcagcataagaagaacacacaccaaggaaatccatttcctggaaacatctctcaacagttcccatgtggagaaactgtgaagcttttcacagcaaatgttttagagtgttcccaggtatttgcaaagctcctatcataatgctggctgtactgataatttcctaagggtgcctgccatgagacgatggaaagggcatcaggtctgaccatggtgagccatgagggccttgcagagatagagtcaactctctgggcctcagttttcctttctataaaatgagtgacttggactctgttgggacccctctgcctctaagattctactagtctgtgattccatgagtcaaacttcagaagtggttatggtccctcataaaatggcaaagatttgggtcctagaatctatgactccattagcaggaccacatctcctctagaacattttggcttcgtgcttgtcatcatctttttgtactaactgctctgattcaatctctttccctgaagacttgcttccaccagaattccatttaattccacagatgttgaatgaagactttctgtgtttccaactgcatgcctacaaagataaatgagactagtttcctaaccttggggaattcccagtgagatagcaaggtcaagactttatagaacttcttttctccagagagctctctatttctttgacctgtgtgtgtccctagaccagtaatattgacttcaccagggagcttgttagaaatggaaacctacagaatcagaagctctggggttgtggtgcactggtcttagttttgttctgttttgttttgtttttgtttttgtttttgtttttgtttttgagatggagttccactcttgttgcccaggctgcagtgcaatggcatgatcttggctcacagcaacctccagctcccaggttcaagcgattctcctgcctcagcctcctgaatagctgagattatgggcatgcaccaccacacccagctaattttgtattattattatttttttttttttagtagagatggggtttctccatgttggtcaggctggtcttgaactcccaacctcaggtgatctgcctgcctcggcctcccaaagtgctgggattacaggcatgagccactgtgcatttggcctggtcttagtttttaacaagtcctctagagagttgagatgcacacttgagtttgagaaccattgaactagccctttcagggacaagctatgagactgtggttctgagccctcaagggacccaaggacacattttgaagaaaattcagttacttgggctgccaggacttggtgttttcaactcagaattacagctttcttggaacctccaacaacattttgaacctttgtggcgtttttgtacatgtgcaggtgttgtggaaactacccatttgttttgaagggagagaatccagtttagcacacaattctccatggaacttccaggcttccctttaaattgattgtgatgcttggatagatattgacaccatgactaagacccataataaaggcccaatccaaggaggctctgctacttccaaagatctccaaaggaagagagttctcagagtgcgagtcttgtgtgaatttccctcccttcaaaggtgccttaattaatatcctcctccatggcagggtctaagcctggcccctcttctcagcaggtaaagattattgggtcacactctccctgcagtaagttcagacatgaagggtcgggcaggtgtggctcttggagagggcctgcctgggtcttgggaatgctcccccttgtcctccttcctgggatctgcagatccatcatctactgccccaacccagggctatatgctaaaccacaggagccttcatgaaaattagaaaagcactcctgccttttttttttttttttttttttttctgaggtggagtcttgcactgtcacctgggctggagtgcagtggcgccatctcagctcactgcaacctccgcctcctgggttcaagtgattctcccgcctcagcctcccaagtagctgggactacaggtgcgtgccaccatgcctgactaattttttgtatttttagtagatttggcgcttcaccatgttagccaagatggtctcaatctcctgaccttgtgatcctcccgcctcggcctcccaaagtgctgggattacaggcgtgagccactgcacctggctgaaaagcaccccccttaaggtgcctcttagggtggctcagcccctggggctcagggcttggctggatttcagttcctctcacctccttgagcaggtgcctgtgtgcagcaccaaccacatagccatagctgtaaccctgcccctacccagcctggggctggacacgagtgagggctgatggaggggtggggagagcctgtacatgcagccagcacacgtcgggagttcccaagtgctggatccttcattacatcatttccttaaattcttacagctgcccaacgaggtggatattggttgcacctctgtatatttttttctttttctaaattatgaaagatttcaaactctcagtgctcccatgttctcatctatgcaatgggtatgatgcttcttgatcctttctcaaaaacttgttctgaaaatcaaatcacaccaagtgacaaagtgctctggaaatgttaggtttcatatagatcttatcgctgaaccctcaaaggctcactttctggggcctctgttttgagacactcaccctggactcacccagccctcagggttatgcatgggtatgtcagaacgttggtttcttgccaggctactggtatttgtgggtgcctcctcccctaaaatcattagacttgtgaggcggcaaggatgagttgtgtgtgcaggcactcagggacgagtcacagcctggcaagctggcctggacaggatgacttcatgggcctttcccacttctcatttttatgactagctttactgtttcattttggctttctctctctttcttgcagctgtggtgattaggatttagggcaagcatttgggatcccttttctaatacctttcaaatcctgattcagctgcaaagtccgggaagggagtagagaatgggggaggagggactcaccctggtgaaaggcagtagctcagaatatccgagaaactcccaacaggaatgcccagcctccacccactaaagctggaggcctctcatctcatccaatatcaccctcgtactagaaacgcaaaagggatgagtttgtctatggactcaaacctttacagtcttcttgcttagcagcttaaggcataattatggtagtcatggtggtaagggacttaacatttgcctttttccaatttaactgtgtcctttgttgaaatatttcttagtcaggtccccttttctctatttccactactgtcctaggattagatctgagtccccctctcaatgagattagtccagaaattgtgtataccatccatcttgcaaaccactgccagactctgttgacttttcattatgtaacttccctatgggagaggtgagttacataatatgatgctaagatgcccctcactggtggcatcatgtacatatttctcagtctgaaaggaaaggtctttttaaactggcttcaggccatctgtccaactaattcctgcctgcaactcctagtataccctctactacaaggtctcatcacttattctgttacccaccacattcattccgtcttgggctttggttcatgtgatccactcgatgtgctccttctctctaatccaaacaccacgcatctataaggtcagctcacgtcccatctccttgaccccagcccattcatatccctattctcttagcagctattgtcaggacgacacagttttcatgccagttattctttcatggttttattagttaattctccccaggtagattagaagctccttaactttggaccctgtcctaagcttctgttatattctctgcagtgcccagccaagcttatgtgtcatgcagtaaagaataaaataattttgaccctgatcaggtgtttggttacataaaaactgcattggcaactttctagaaactaatatattcatttatcttgcaaaaaggattgctatctgattatagccagtagtcatgatcttccagccatgcacaaatatacccttataactttcatgagtggggaggaaaattgatgaaggaggtttcaaaggtgatcatcagtcccaggatttccaacaatagccagtctgccctgggtccttaactctcttttaatgtttttattcttatttttatttttttaatgcagtctcactcttgttgcccaggctggagttcaatggcactctcttggctcactgcaacctgtgcttgctggattcaagtgattctcctacctcagcctctcgagtagctgggaatacaggtgccgccaccacacccggctaatttttgtatttttagtagagacagggttttacagtgttgaccaggctggtcttgaattcctgacctcaggtgatccacccgccttccaaagtgctgggattacaggtgtgagccaccacacctggcctctcttctaatgtatttgacctctcctctttccccagagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcagtaagtcctgctcctttgtcactcttctagaggaaccactagaattcattcattcatcttcaagtgttcattctgtgttactatgtcccaggtactgtgctggcaataggttttcaacaaaggccaagataaacacaacgtgctccaggggcttacactttggccaagagacacatgtttttatttatttatcttttagagacagggtcatgctctgtcacccaggctgtagtgcagtggcatgatcacagctcactgtaacctcaaactcctgggcttaggtgatcctcttgccttagcctcatgagtagctgggactacaggtgtgcaccaccatgcctggcttattttttaactatttgtagagacaacgtttcgccatgttgcccaggctgatctgaaactcctggcttcaagcgatcctcctgcctcaacctcccaaagtgctgggattataggcatgagcacccagctaagacagacattaaatatataattatacaaataagtaactatagttgtcacagtgtaatggaggaagaattcaggacatgaaggagtgtgcaaccccaggaccttatctaggcctggatgctcagggagattgccctggggaagggacacgtaagcccaaaccacagaatgaggaagagtagatagacagagtttttcttcagcacatggagctgccctggaattccctaagttggaattcatgagttggagtacggataggaatggaagggcagaaaaagtaacataatctctccttggatggtgtggaataccaaggcatttttgccccatggtggtgctggcaggggatgttttctcagctgacaaagaggtccagcgtatacagaggaccaaggtgtggtcctggcagctccccacctgttaagattgtaggggccactcctcacctgccaactctttctgcaggaagatgcctctcggagcccctgagctgcattcttctatgttggaagctttctttcctcttttgctttctaaccctcttttcacagggcttctctctcccttccttcccacgcactttccagttatctctacccctgctgctgcccccactcttctcagcaggtcagcctgcattctccccagtttcctgcctctgcggctgcctttttgttccttcctcctccgggagggcagggggccagccgcccaatccaggaaactcgcatcctgatttggtaaacaatgtcccaccctgacttgtccattcccagtggtccctgtcccctccagctaccatgaatctttggtggggaaataaagggaaataatctatttttaaatatctatttgtaaattatctatatgtaaatatctatttgtaaaatgtaaaatatcttcctagagcagagtggagaatgagctttagagccagactcagcaccaactccccaggagagggcacccaggagggggttctcagaatgtgacatattctagacctctaagatatagcccccagcgaagaacaatgtgcttttgatgtgtattaaacaaaatcccctgctgagaactaacttcaaaaagcacagagatctcatttgttcttgactccggaatcaaaagatttacttaagaaatcaatgccatgaagaaaaaaagaacctttttccttgccatgccacttggaaagtgttcagaagtgccatttccctggcactgcagaggctgtgttgttgtggtgtgttgtggcctaagtcagctggaacacttcaatcagcagaacacactgcaaacattttcaaggtttatgactttaaatgacttctgcagaatttatgtttcccctttcctgaaaatattaaaagggaaattggttctgtaaccattttgacagcttattcatttgtgttggaaaattttaatggaggggttctttttataagccttctgtatttatcagaaaatggaaagataacatgataaggctgaggagctacacaatgggactgaccgcccccctccccccacccccgcaatcctggtgtcgaataggatataccaatgtggacttgtctgtggaaaaaccatctctgtgtgctttctggcaaggcagcaaaatgaaaaggcagtttggacttttcctcccttcatcttctttgttataatctggaagctctaagaaaacattagcgttatcccgcttgttcctgtgcctgagaaatgaatcccctgtgagtccccccatccactctgcaggagacagggctgctgtctctcactgcactgcactgcccggctttgctcagcagactcagcagccgtcttgaaaggctgaagaggccccagggcctctttatcaacttcatggtaaagactgtagtaactaacatttataaagcactttcccttatgttatcgcagaaagccccaggaggcaggcagcacactcttgccactctctttttacaggttaaggaacttgctaagtgaatcacctgaaaaacaaatagccaagagatagttggatgctaattccaaacctcttgctcatttcactcctctgcatgttgggaattacaaattcctcttttaaggtaaaccattttctggtggccacctccacagtccagcctggccaggtaaacctactttgcaattggcattcacctaaaataggtgaaactctgaaggcagccttcgtaggaggaagaggagctgactctagttgtacaatcttgagcaaatcctttgtgctctctgagcctcagttgcctcatctgtaaaatggggattttatatgcagaaagtagatgagtgaacaggtgttgtaaatggtagagccctattcagtgtgcactgtgttatgtattattacaatcaaatacactgaggaccgatgggctaggcagatggcctcagttttgatctgcactcaaatgatcagacaaaaatggtgagcattttccaagttgcagatgacatctctgaggtttgggaagtctcatttgttccttaaacattcattgaacctgtaaaccaaaaagtatctgagacaagtcccaatcaatgtaaaagtttattttgccaaggttaaggacatgcctggagaaaaggaacacaaaatcacaggaacaatctgtggtctgtgcctttttccaaagatgattttgagagcttcagtatttaaaagggagagagggagggcatggtcacattactgaatccacatgttgcaagagaaaaggagcaggtaggggaacagtcaatcatgtattcctctagtgctcagtaaatcaacactttacataagataaggtgaacatagagtagctacttatgcagatatttaaccttttatctgtagctatctgcttaggaacaaaagcaaaggcagtttcttgcattactcagcttttagcttaatttttttccttttggcatagtgatttgggatcctgagattttattttcctttcacaaactgtaccccaataatagctaatcttgtcctgtgctaggtactttcaaatacagtattccacttaatacttaaaatagccgtttgagataggtactatcattatcttttttttttctttctaagagataaggtctcactatgttgtccaggctggcctcgaactcctgggctcaagcaaccctctcacatcagcctcccaagtagctgggactacatgtcactatacctggctctattatccctattttacacaactggaaattgtcagggtctgcctgggggctccaggagagctttaaagatgaggtgatactaataatcactaacatttcttgatattaatgtatgcatgtgttgtttcaggctattagtgtatgttaactcactttattcacacaacaaacctgtcaagtagatgctcttatagttcccattttatggaagaggaaattgagaaccaaagaggttaaataacttgtccaaggtcacaaacctgtaagtgctggagcttgtttttttgtttttatttgtttgttttattttgttttttgagatagggtctcactctgtcacccaggctagagtgcagtggcatgatcatagctcactaccgcctcaaagttccatctcagcttggactacaggtgtgcgccgccatgactgaataatttttactttttaaaaaagaaacaatgtcttactatgttgcctaggctggtcttgaactcctgggctcaagcagctctcctgcctctgcctcccaaagtgctgggactacagacatgagccactgtgcctggcctgtaagtggtagagttgagacgtgagcctaggcattctgcaggcagaactgaaaatcaatgctacatctgcagattgggacaggttctgtctgggtgtgatcaaggcaggacctttatcatacagtgaggaattgattagactctgcagccagacctcgctgggtgagagtcctggcttttttctctttggctgtctggctgtacaatcttgagcacagtggaggctttatacttgcaggcagggacttcccataccagccacagcaaggggaatcctgaggttgcattctcaggccacccttgagaccaccagggagaggccaggtgccctgtgaattgaggtcctgtctacaagatgaccaaaccccacacatcctggagtctgccatttttgccacccagtaagagaaaacatggaatctatgggctgaaaacgctgtccccagtgttctggtgattcttgccacctgggcgagattgcttttaattaacctctaggtgctgactttatcagcctcatctggtattttggagcagggagccaggctgttcctaccctaatagccccaccccacccaggccaggcacaatttaaggccctaatagtattcctaggacacacccttcatgaactggcctgggcagtctacactgatggcacccctttgaggtcctgatgtgaagtggggaggctggactgacttcacaaacgttgagtctactgtgcccagtaatacaagacctccagcccacctccctacactgaccactcctttagtcattcatacaatcattaaaaaaaggactgttcttatttcctagtcaacaaatccaatcccaccaatgacttaggctgctgattagttattcctccccgctgaacacaaggccttggctgagtgtaaacccagagggccttctgagaaatgaggctcataggactgtttccagcaggccggtggaggaggcaaggctgtggtctccccttggctctcaccgcaaaggcccatcccacagagggcaaggcatgaggcctggatgctctgaaagtcactcagcactcacccacagcattctacagatgggaaagttttattctagtttagtgaaggtgtttgagattcttttggttgaaagtgtcaggaattccatttttttctaaaaggaggggggagtgcattatattatccatggaaataaggatggcagttgtgagagtcctgctttcactgcatctcccctccactcctctccttctccagtccacagtcaggaagcatggccccaccagcccctgaggctcacttgttctcagtttgagcctccttttattcagttctggttcctaaatgccagtaaaggactctgattgtcaaaccctgtaccaaccaacagtggccaggagtgagactacctcagaccaccacggcagctccccgatgcaaggtgtctggagtgagaaggaagggcagtttctagaaaaaccaggtaccagattaaataataggtgtctgtactgaggtccctagaggctgtccatgcctttactctacaggtaaagaaatagcctacaagagctacctgatttcccagaacttccctcacttgttcgaggtagaggggaactagagcacagtcttctagctcccaatccagtgccttttccattacaccaagttataatcttttttagttccagtttctcttatggcacatggccaaaataagccttagtaacaagctgtcattctgaaacccaatgcaatagttcttttaattccccctccccactaactttttttttttttttttttttttgagatggagtcactctctgtcacccaggctggagtgcagtggcacgacctcagctcactgcaacctctgcctcccggtttcaagcaattctcctgcctcagcctcccaagtagctgagcccaccaccatgcctagcttatctttatgtttttagtagagatgggattttgccatgttggccaggctggtttcaaactcctggactcaagtgatctgctcacctcagcctcccaaagtgctggtattacaggcatgagccaccatgcctggcctaatttccgcaattgataggtgaagaaagtggagttcagagaaaccaagtcatttgcacaaggtcatagggagtggcgaagctgagccttcaggtggtctatttccggtagccatcctctccccacgatgctgcctgctgcccgccagatattttctctgcctcacatctcctgtcttcttattttgtctgttagggtctcaccaagaagacaggcaccaggtacatcacttgggcctcccactcatgacagtgggtgactgccgtgtagttggttgcctacacactacacttccttaattatggagagagacagtgacatgctgtgagtgccttagaaatgtcctctgcccgtgggtaatttgactccagcagtccaggaaaagaagagagtctttcaggatgcaaagcaaatgcaaattaaaagtgggataatgattacccctcaccatacgattgtcaaaacttgaagtttgataacaccaagtactgaagttttgaggggatgggaatcgttaggaccatcgttgctgacatgagctgtcttggaaggcaatcaggccatatctgtttaaagtgagacccagtcctagagaaaacatcgtacatgaattcaaggggacgtgttcaggaatgttcatcacaacactgtgaaagtgaaaacttggaaaccacccaaatgcttaccaatggggaaatggccaaataaaatgaggaaagtcatatgaccaatggataaaacaattgggagggataaactagatctaaggttttgattaaatctttaaatctaaaatacagctagttttcattattcacaataattatgttttataaagtcactgcaaacactgagttagagaatactaaaccattgctccatatattcctgatggaatatagggttaggttcctgcaatcctctggtgacaatattttttgtcaactaatcaatacgtagccttgttttatgtgtgtttctgtttaaaaacatcttattttttgtttgtttgtttattttttgagacagagtctcgctgtgtctgcagtggcacaatctcagctcactgcaacctctgcctcccggtttcaagcaattctcccgcctcagcctcccgagtagctgggattacaggcacctgccaccattcctgactactttttgtattttttttttttagtagagacagggtttcaccatgttggccaggctggtcttaaactcctgacctcaactgatccacccaccttggcctcccaaagtgctgagattacaggtgtgagccaccatgcctggccgaaaacatcgtatttgatatataccattgattcattaacatcagacccacagccaacggtaactcctgactgaatgaaacttacctaacacatgttttccctgtaaggcacatcgcagcctttctgcactgaggaacactagacggcgcatcaccattttaaaccgcaaaatcacttacagaaagcacagaaatgaaaaaacaaacaaacaaacaaaaaaaccacggtgctaagtagactgtgaaaaggatgcttgttcacagaatgaaagctgaaaaagaaggcagagtggctccttgttcaacctcagctgagaacatctgcaccaggcaacacatttttttgtagtctcagctacttgggaggctgaggctgaggcaggaggatcactggagccccggagattgaggctgcagcaagctgtgactgtgccactgtactccagcctaggtgacagagcaagagcctgtctcacaaaataaactaaatttagagatattttaaattgagtgctcatgcactctgagcatgtccactagtgaccgtgaaaacgctgtgagtattggtttgggcttacaaatacattttagtgagtaggcaaattcacaaatatggaatctgtgaagaatgaggatcaactgaacatgtcttcacagtttgatatctctgaaactggggtgcattttagattccatgaaatacagtacatgtatcaacattgatagaatctgtgattaacgttgagtgaaaactgaggtgaaggtcaatgtatataggatgaacctacagatgtaaaataagacaaaatgccaccataattctcctttgctataaaatggttagcaggtatcttcagcattccccaggcactattctcaacactctaccatctccattaatttaacctttttgaggttcttatgaggtaggtgctatttttattctcatgtcttataaagaagttaagaaaattgcacaaagggctgggtgtggtggctcatgtctgtgatcctaacactttgggaggctgatgtaggagaatcgcttcagctcaggagtttgagaccagcctgggcaacatagtaagacatcatctctatttttaaaaatgagaaaacttctattttatttaaaaataatgataacaataaaagaaacttgtacaaggtcacaaaaaaagctgtttgtttcaccctgaagtaaaaatgactgattggatctacaaactttcctagtgatatttgtatcctaacaggaaccaaaacacagacaatcaaactcagaacagtacattctaaattgtattgttgtgaaatgaaacagctttacttccctagttcatttattgcccaccatatttcttactccaatgtagagacataaacttcagatggatttaatcacagctgagttttcacaagcgctggattaatggaattgttctaagcttttgagagctccttttattttagcttcataaaaatatatttctacatatagacatcttttttgtttatgagaacacttgcataacttgttatgtttgtactgttgcttgttaattttaaatacaatcaagttacattgagtaaagtcataaattaggacattaaaaaaagagaatttttatgagctacagacagacttatgcaggaaccaatgtaccagaaagctgaggtacttcaagaactaaatgcagagggcaggcgtggtggcttatgcctgtaatcccagcactttgggaggccaaactgggaggattgcttgagcccaggagtttgagaccagcctgggcaacatagtgaaaccctgtctctacaaaaaaaattttaaaaattagccgggcatggtggcacacgcccatagtcccagctactcaggaagctgaggtgggaggatggctttagcccaggagtttgaggctgcagtgagccatgattgtgccactgctctccagcctggaagacagagcaagaccttgtctcaaaaaaaaaaaaaaaaaaaaaaaagaaagaaagaaagaaaagatgctaaataggtatcttaaattgagacataaagattacagaaacatgaaacgtgtgagtgcattttttactccaaaattgtgtgtatacttttgcatattaaaaatttacgttactcttgaaacatgattttgagaaactgttggttctttaacacattcttgcttatttaatagcttttcctccagccccattgctgcttcctaaaaatccacacttaagtcaaagtcccctctgatgctggcaaacttttctgattccccagcccaccacatgggtattattaagttgaattggaaatttcttgcttttttttgtagatcaaaaccaatcaagtatcagcaatttcatatagttcagcctaacactgtttctctttgattttccatggccctttatctggccctgtcttgtccaccttggactgtgagcccccttgagggtagggactgcagcttatttctctgagtcctgcccagaggagagagtaggcactgaataaatgcttgctggctggaatggagtgagaaagggcatcactgttgacttaccttcctgtgtcttccctttcagcggcccatatgtgcagcaccctggagcataactgtgcccacttctgcatcaacatccctggctcatacgtctgcaggtgcaaacaaggctacattctcaactcggatcagacgacttgcagaagtaagattgctttgctgatgtatttgtggtttcttcctattccctcatcctctcccttcttttatctgggctcattttattcatctgtgatgcctcacccaccccagttatcatcccttggggacagaaataaagtttggtattttctgttgaccccatcacagtgcctagtccagagctgggcacatagtaggccatcaggaagagttggagagataggtagaagcaccatctcagaaatagcctctttggatgtgtgaactggtctcctttacttccaagcttgttctttagcagggactactgaagagccttttcatccactgtctttattaactgtaccctaaggaactgtttccatattttattatcttctataaagtgtggatttaggaagagttgttaacctcggctgggagtgattattcaagttctgttttagaggggtgcagggacccagttgctttggtgtgggacactttataggtgtcctagattttaaaaagggggtaaacagatgtaagatattagaactcgcattctcttttttggctaagtgccaaagactagacagtatactgatatttgagccagcacgaggtagtctaccccttaaaggacagaattactcatacactgagtaccgtgtccttactttttaaagttatggataaagccactgagttaacctacagatgaccaggctaccaaaaacaagtcatgaggaagaccagcccacatggaagcaaataaaactcagctaatctgacacttagttcgtgcagtgcataactgttgccatgtgtaattgttgcagtgtgtcattgttgcaatgtataattgttgttatacctcatggcaagcaattaagcattaatggaaagcagtttgcacaaatggctgtaattagtgtcacatttatagaggccaaccacctttttcatgtttcttctcactgtttttcagttttggggttgagtggttggctggagttctccctgcccctcaagattaggtaacatctacttgaccctccgcttctgtgtggcctgtggaaacccaaagccctctggactctgaatcgcaggggtggggtgggcggtatgtgttcttagcctcctctaagaccccaggatcccaagttgagtgcagcctgaatcatcctcatcttccagttgaagatctgacgcttcctcaaaatccataacaaaaactcactcccaccgaatactcatgggtttcatagagtttcctaaagaactgggggagcctgggaaaggtcatctcacacactgctcagcaaacaacctagagatctctttagacacccccctctagacacctccacctcttcaggtgttctacctccccacaaccatcctctggaggcacccttcctcctcttcaggcatcctcccctctgccccggatgcttctctgtcccatctcagcttcccaccatcttgcccactcccttcctgccctttctccttctccttctctgtctccttctccttctccttctccttctccttctcctcctcctccacctcctcctcctcctccttcttcttcttttcctttgtttttttaagacagggtcttgctctgtcgtccaggctgtagtgcagtggcacaattatggctcactgtaccctcaaccttccgggttcaagcagtcctcccacctcagcctcctgagtatcagggaccacagctgcatgccaccatgcctggctaatttttgtagagatgaggttgctcaggctgctctcgaactcctgagctcaagtgctccatctgcctcaacccccaaagtgctgagatttacaggattgagccgctgtgcctggtgcccttctcttcttaggagcacaaggaattcctctccttgtctcatgtcccactgagtgactgggatctgggaatctgctgatatttattttccgtgggctggcctagccaagccagaggaattctgacaccagcaaataaaaaataaagtgttctttccctaattttatgagcaaggccttcccccacacagcagagtttgccagacccctgcctggtcctgccacaggccctgatgtcccccagatctcaagtactgctctggccttggattcctcctgcctagggatgtgccacaggagaatatgaagcagaccctgcctggacttcagacagactgaccagggggaggggcagggaggtccaggcggaggagggctaggagctcagggcaggctttctcaaacttcagtgactaagaatgagccaggaaactgacttctgggctcacccgcagagatgcagagtcaacaggtctggattttcaatgaaccgacgaatgactgccacactttgagattcactggcctcaggcagtgaggggtcccagggaagggcttagcagagctctgctgtcccgtctgacccagctctccagtcaccctgaagcagttaaaccatcttaaccttcagccagacttagcttaataaatgtgcagtgataaagaacagctctctctctttcagaaggggataatactaataactcttttgctttcccaaaattggtgtaccaggggccttggtggaagaacaaggccttcactgtctgcagatctgggcttgaacccgaccttatcacttaccaactatggctgtctcactctgagctggttatttaaacttcttgactctcagtttcctcgcccataagatgggacgggtggtaacaaatcaatacctgtctcactgattatgtccttgttaggccctgtttttggtctaggggacagttaaaagctgtgccaagtgaaggctgtgccatctactgacccctgctgatgagcagggacctgtgcctgccaacactgagagaaactcacagtgggcctggagaggaggcatgtactccacttctggaagctgtttccacttaatttccatgtcctgggcgtagctggataatctcccagatgaaaagccatgtgggtgacacctcctccccaaagcacctcttactctctaagaagtgcttgccattcattcttccatacaatcattgattggttcatttattttttcatttaacaattgtttttgagcataaaaatgtgccaggcagcatgcaaagtactggaaataaaatagtgaataacacagcaatattctttcttttttggagctcacatttttgcatgggagtgaatcaaataaacaaccagggtaattgcaaccaaaagtgactgcaatccacgtccacctcagtgtgcaacacatgaggtcaagcctaactatagccacttgttaggtgtttaccatgtgccaggagctttcctgagtgttttatatctgctgtctcatttaattctcacaatgagctcttaaagtgggttttatcactctcattttacagataagcaaaataaggaacaaaaagtttagacgatttacccaagctcacatggctagcaatgtgatcaaaccagaatccaaatcctgttatgtcctcactcttggccatcatttgagactgtcccatgaccctagaggaccccgacatggcagcaggacaacccttcaatcagaaaaccttctccaagccgggaagacagataggttcctcagcccactaatccaggggagacttagaactaattcaggactaacattcaacagattgttacttccccaagtccactgctaattgctgtggtactgtcatcacacaaaataatagtgggagggcctcttcagcaactgccttcaaatacacacacacatacacactatagaaaaaaaaaaaaatatatatatatatatataatctccccaccattgtatatttgtaatttgtgtggagagggaaagcagacacagttgatccacacattctttgaatggtgatggaccttggctattagacttctggcttcctctcttatggaacttcagaattctgtcccctcccagtgtcccagaggggtgatggttcttacagaatcaggttattacaaaacacctgaatcccatattcagacagcttggatcagcggttgagctgaaatcctacttgtctataatttccacttttatcctatttctgctatctgaagccatataccaaaaagttatttccttatccaaataaatagagaaagcccttcaattattatacagtgttattcccacacactgaccccattcctatcaattttctcttcttcaggggagaaacacatcttttgatgacctagttttgggtctcttcactgtccaggtaaccctcttctgggtggatattagttgtctaaaaagggcctttccattcgaagactagatcaaatgcattaaagaattttagcttccatcacttcttggccttttggctaagatcaaggtgtagaattttatcttccaagttgtgtctatatgggcaattttgaacatactggacctcaacattgtggattccttctgcctttcaaaaagtcttccctgtcaaataccattatatgagatatatgcaagagcatcagcataatactagaacaatggaattttatgttccttccttttcccatttaaaaaaaatggggggaaagaaaacctcatgaagtgtgcccgtcttcacatgctatttccccttatccttccccttcccagaattcctgtcctactaagaaagaactttatcttgtttctttttcttgatatattttcaaaataaggaattttccctttcttctggaacatttaatctatctggaagctgatgataatgcagcatttagaaaactccatttggcagaaaatgtagactttcttatccagcttaaattttttttcttctctcaagaacgataccaaatgcattttactgctttcattctttggaaatgttcccaacattatttttcccaagctacataagtgatttaatagatttatgttagagtttaaacaaggagcatgacccagaaaaaccactgaattattagagagagataactataaccaacattctttgtgaatttagatgtgaaaattcttaaaaatttagcaaatagaattcaacaatatatagaaagaacaatacatcaagaccaaatggagtttattccaagaatgcaagtttggtttaacattcaaaaatcaatcaatataattaatcatagtggcgaggtgtggtggctcatgcctgcaatcctagcactttgggagactgagttgggcgtatcacctgaggtcaggagtttgagaccaacctagctaacatggcaaaaccctgtctctactaaaaatacaaaaattaccctggtgtggtggtgcatgcctgtaatcccaattactcaggaggctgaggcaggagaatcacttgaacctgggaggtgtaggttgtgagccaagattgcaccactgcactccagcaacagagcgagactccgtctcaaaacaacaacaacaacaaaaagccactaaaactaataaatgagtttagcaatgttgcaagataaaaagtcaatatacttaaaaaattacttcattgtatttctgtacactggcaacaaaagtcagaaattgagattttaaaataccaggtataatggcatcaaaaatatgtaaattagggataaattttaaagatgtgtatgatttacacattgaaaaatataaaagatttctgagattaatttaaaaaaaacctaaataaatggagagatataccctatcatggattggaagacttaatatggccaagatgtcaattctttccaaattgatccatagattcaaagcaatccccttcaaaatcctagcagacctatttttttagaaatcgacaactgattttaaaatatacatgaacatgcaaaaaaactagaatagtcaaacccagtcagttctcattattcccagtagttatcatccataaaatatccataaacactaaattgcaaattctgaatcattgctcctagatgaaatacagagttgggttcctgagagcttccaatcacaacattcatcaatcaatacataaacttgtttgatgttctgtttaaacacacgtttttgagtatatactgttaattcattaacattgaaagctatcgttcatattttgaatgaagtacttaggaacaatagacagcagatcagcattactcttgggggccattttcaacagcaaaatctccaacaagaagtacaaaaaggcaaaaaatgtggcactgcatagaccacagaaaggatgcttgttcatgggatgagagctgaaataagaagacagaacgttgccttgtttgaccttacctgggaatatgtgtcctgggtgactcaaattttttgccactctgtgtatgtccatgaatggctgagaaagtgtcatgggtattgacttggggttacaagcaaattttagcaagtaggcagattcacaaatatggaatctgtgaatcatgcacattaaacaaagctttgaaaaagataaagttcatctttaaattttgtttaaactacctgatttcaagactaagtataaaacaacagtaatcaagacagtgtggcattggtataaagatgaacatatagagcaatggaacagaacagaatcgagaaataacccatatgtatgtggtgaaatgattttttgacggagtgggaaggcaatccaatgaggaaacaataatgtcttcaacaaatggtgttgcagcaattgaactgccatgtgcaaaaaagcaagcaaacaaacaaaaggaacatagatcttgtctttacctcataacatgtataaaaattaattgaaaatgtattctaagcctaaatgcaagagcagacactattaaataccatgatgaaatggtagaagaaaaatcttgatgacctcaggttggcaaagatttcttaaatagtacacaaaaagctacaaaacataaaagaaaaaaatcaatatatttaatcacaatgaaaacatttgctcttcagtactctgctactaaaatgaaagggcaagccacagattggaataaaacatttgcaaaacatatgtccaacaaaggactttagaatataaggaattcttagctcagtaccaagtaccaagtattcagtaccaagaagacaaacaccaccataaaaatgggcaaaatatttgaacagacactaaaccatggaagacatatgggtagtgaagaagcacatgaagagatgctcaatgttatcagacaggagatatcactatacctccactagaatggattttttttttttttttgagacagagtcttgctctgtcgcccaggctggagtgcagtggcgtgatctcagctcactgcaacctctgcctcctgggccaagcaattcccctgcctcaacctccaagtagctggatctacaggcacgcaccaccaagcctggctaattttttttttgtatttactagtagagatggggtttcaccatgttggccaggctggtcttgaacttctgaactcagatcatctgtccacctcagcctcccaaagtgctgggattacagtcttgagccactgtgcctgaccagagtggataaattttaaaagattgactataccatgtgttcgcaaaattgggaactggaatgctcatacatcaccagtggtcatgtaaaatggttcagccactctggaaaacagcttagcggtttcttacaaagttagatatttacctatcatgtgacccagccattccacttttaagtatttactcaaaagaaataaaagtttatgtctaaaaaaagatttgaacacaaatgttcacatcagctttacttgtaatagccccaaactgaaaacaactcacatgttgattaacagatgaatgggtgatacactgcaatacacgcatcctgtataatactcctctgcagtgaaaagaatgcactattgaaacatgcagtagcctggatgcatctccaaatcactatgctgaatgaaagaaaccagacccaaaaaaaccagaacataccatgtggttccatttgtataaaatttttggaaatggtgcctactcagtaatgacagagagcagattagtgggtgcttggggccaaggagtggggagcagcagggagagggattacaaagcagcatcaggaaacttgggggggtgatgactatgctcattatcttgattgtggtgatgatatattgataagcccgatttatcaaactgtacacttgaagtatgtacagtttattgtatgccagttgtcactcaataaagctgacattcattaatcagaacaaggtttcggaagtaagtagtggcgctggaccagactgcctttctggaatagtttgtttgtggcatcagtggaggatgagagaaggaatgtaagcagggataaagtatggagcaatttgattctcaagctaagttccaacagtgtcctttgttgagtaggggaattgaacacagggtgtcaagggcaaaaccaggtcattttagtaaattggggctggcaataatgtatgtgctgtattagaggtagagagtggggcagggatgccttcactcatccgctcattcattcaatacctgtggattcccctctatgggcctgatactcttatggggtatttttcttacatattagggacccaagaaacattcagatcttggcttcccttttaccccccacacagagagcagaatataaaagatggaatcagagaacaattctaatcagtccagtcaattcagtgtatgtttcttacgcccgcagaattaagtaggagaccacggcaaccatcccagccccagggaggagtttatgacatcagataggtgatggctggtgggttcagagtaattaagactgatggataactgcagagaggaaatctagttttcagggcaaacagatgcgtccaagagagagcccacacacgtggttggatgcagctggagatggagaattccagttcaaggaaaaggcctgggcagtatgtgtttggtggtggtcgttgaccctgaaaatagatggaatcttggagggagaaagcgagtgtggaaagtgaaggtcaggttgtgagctctggggcagcccacagtcagagggtgggtcaaagctagaagggcgagcaggccgcacgcacacacacgcaaagcagctgccttcactgacaatcaatggcagccacctgagctgtggctgagctgctgtgagccgaagcagtgggcttgctaaatgccgtcatccagcttccccttgaccctggctgtcaggcctgggtctgggagcttagggatcattttgtgcagtctgctcaccctctggctgtgccagggcacaggattttctacaaaagaaggaatctggggtgagtagagccccatgggagaactgagctgactaaatgtgagtggagaaatgccaattatgaaaaaaatgtacatatcaggggaacatgagcttgaaccttgcacagcttttcctccgcttggctgtttttatgaggacccaggcaagtggttctcaaagtgtggtccccccggaaaacaatatcagctttgcccggaacttactagaaatgcaggttcccaggcttaccctagacccactgaatcaggacctctggaactggggcccaggaatgtgggttttcccaagccctccaggggatgtcgatgtacgctgcagtttaaggactactgacttagatgttttaaataagatctctccctggcagcatccactcaaaagggggtttatattaagaacataatgtgacaacggtttggaaattgaaaagcactctacaggagtaggacattatttttgtttgtttatttattatttttgtcaacctcattcactcagatttcactgtattttagaacttgtttcagagattccccccttcctccttttcccttccccgaggaaaaccaaaatcttgttagtgaacaggagaattgattgaaaaaaaattcaactgctgcgggaaaggaggagactaggcacagctggagtttgcctgaaaggataattttctcagtgacattgggtttgttttgtttctttcagtgtagaagcacgaggctgatgactcatttaccattggaagacttcaaatccaaactgcagttgtcaaaataagattagtgctttcagacatgatgaaagagagggcatggtctcgaaaaggcaagcttgggttttgcctgcatttgtggagccctaactcatagcaagctttcctgtgggagtgggcagagaccccatcgtttacccagttgagtgaaatggcagccctaataacccacttctccttctctcttgctgtgataaacaatttctgatttctacatctcagattaaataacagcaagagctataaaaagtagagggtgtctcctaaaggtgttcatttgctttaactccaaagatgagattaaactgtcattggtgtcaacagcgtgcagtgcagcttgtctaaaattctgaaacgttggtgaaaccctttgatttagccctggatgatggccatagcctttgccccatgctccgtgctcccccctcagttctgcctccttccggtgtaagcagatgaaagtttccaagttctctggactgagatgcaggcgccagggtttctaaaggaaggcacttacatctagggtgcatgggagtctctggggaaactggttgggtttgagcacagctttggggctcttggcagcaaatcttcactaattagtttcacctgggaagactgagttatccctcttaaaattctccaggcactgaaacaagcgagcagattttgctgactgtcagatacatgctaatggtagctccctggcaaggtgtatctcaaatttggccaggtctttttgttatgaaattccaaattacctactttgctgtatcacttcaatttagcatagaactcaaaaaccaaacttggccagagataaattttagaacgttaggatctaatattcatgtttgtagggattttttttttttttttttttttttgagacaggatctcgctctgtctcccaggctggagtgcagtggcgcaatcatagcttactgcgacctggaactccctggctgaaatgatcttcctacctcagcctccctagtagctgggactacaggtgtgtgccactgtgcctggctaattttttaattttctgtagagacaagatgtcgttctgttgcccaggctggtcttgatcctcctgcgttggcctcccaaagtgctgggattataggtgtgacccatcgtgccggcccatgtttgcagcttttataggtacccaataaagtgaaactattagaattgggatgtgagcaaaatttggttgaagttcaactctctgccatgcttaaataggtatgtgccactgacacttttcttttcccccttgatttaggaaaggagaaggatgctaacatttgttgaatacttactgtcagccctgcacttcgggaggccagggcgggtagatcgcttgagctcatgagttcaagaccagcctgtccaacacggtgaaaccctgtctctacaaataatacaaaagttagctggtattttgctgagcgtggtggctcacgcctgtaatcccagcactttgggaggccaaggcgggcagatcacctgaggtcaggagttcgagatcagcctgggcaacacggtgaaaccctgtctctacttaaaatacaaaattaggcgggcatggtggcacatgcctgtaatcccagctactcagcatgagtactgaggcatgagaatcgcttgaacctaggaggcggagaatgcggtgagccaagatagcgccattgcactccagcctgggcaacaagagtaaatctccatctcaccaaaaaaaaaaaaaaaaaagttagctgggtatggtggtgcgtacctttagtcccagctactcgggaggctgaggtggaaggattgcttgagctcgggaagcagaggttgcagtgagcctagattgtgccattgcactctagcctgggtgacagagccagaccttgtctcaaaaaaattaaaaataaaaaaataaaataaaaatatcttctgtgagacagatgctttgcccatctagattatctcactcaaccctacaaataagatatttaacctttttatgaaaactgaatctctcaaaagtcccttacttgaagtcgttacccagctggggccaagtctggctccaaagtcgatattcttttcacctgcctgcctcacccctaccctttctgaggagacgtaactgacatcctgccctcccccagtggtggctctcttcatcatttttcatgtcacctctttcaggtccaaataaaaatttggagaaggtcaaaatcatcttttcagttcacactgttaaaaatggaagcctgctctctcaccacgctcaactcccctttcctgcttataacgtatcacagatttttacctatttgctttgtttactatcaatcttctatcaggtatgtgctgctaaatgtttaacaatcaggtctccaggagacaaaagctctgatttgtagatttgccaatttccatggtgtaaatactcccaccgtggacatttcaagctaccaacgtggcctctttgaatgcagctgtgggaagagatgcacatcattgtgtgagtcagtacgagctgcctctagcacatgactggcccctcactggaccatcagctctataagggtaggaatttttctgttgttgtccactgattcactgttgttttcccagcactccgaaccgttccatcgttgaatagatttattaattcagtcatccacaaatcagccacatggcagatgctagatatttgaactagcatgctgagcaagacaagcactgtggctgccctatgtggcaggtgaaatagacatgaaataattagttgcaaattaagcattaaattataattgtgttgaggattacaaatggaaactctgagggaggacttcacccctagtggcaggtcagagcttcctgagaaagcagactttcaggtgagtactaaaggaggtatgagagttaggtaggggaaaaggaggtcaggaagaggcttgagcattctaggcagaaggaatgacctttgcaaaggtcccaagacatgaagaagcttgatttgaaaatggagagggccatgtaaatggagcagagaaaataagaggaggcttgagataagactggagaggtgaaggggtgggtcttgtagcccccttgaccatcacattagagtttttggactccatcctaaagcagtgataagccattaagggttttaagcagaagagaggcaggagcagattactctggctacaggaggatgctaggctgggatgaatacaggaaaaccagttaagaggttgccacggctgttcagccaacagatgatagtggctccatggtggcaggggagatgaagagaagtaaatccaggattgactgggtctgaggggtacaggagagggaggaatcccatgactttcaagtttctgttcccatcttcgaccccagggtaaaagttagctattctaaaaattcatctttgctaaagagaaattaaagaatacttcagaatcatccccagctgtcccatttctgcccagtgacatttattaattgagacagagctctaggctgcccagcaagggaggctgtcaagtcaacaatagatggctactaagcaccaactgtgtgaagtgcatggcattatacaggcaccgtaaggaacaccaagacttagagacatggctctgtccttcacagagcttacaagagtaggtaagagagatgagttaggaacacctgacaaccctgtgcttgtgtcacatgagcatgagttcattcatccattcaacaagtacttgttgagcaaggacaaagtgccaggcactgtgctagataccgggatgcagtggatagcagggcacacaggttccctaactgtcatgacagcttttctggtgtccatagctgggggctggctctgagatgtcattgtgttcttgatgcaggacaagtgagccccaaagtggggcttagcccatgagggttcttggctttatccaggagagaattcaagggcaagcagaggtagatgtaaacagctttattgaagagacggtgttacagccctggcagtgttacgcctccgtgactgctcctgcagagcagggctatccttataggcagagagtaggtagtagctcagggcagttttacagtcatatttatacccacttttttttttttgagatggagtttcccaggctggagtgcagtggcgcgatctcagctcactgcaacatctgcctcctaggttcaagtgattctcctgcctcagcctcccaagtaactgggattacaggcacctgccaccacatctggctaattttgtatttttaatagagatggggtttcaccatgttggccaggctgctcttgaactcttgacctcacatgatccacctgcctcggtctccgaaaatgctgggattatgggtgtgatcccagtggcctatacccacttttaactgcatgcagattaagaggcagtttatgcaggaatttctagggaagggatagtagctcttggtttgtcaggtcattgacacggaggaggtggttactcccaggtgttgccatggcaatggtaaactgacatgtcacactggtgggtgtgtcttatggaaagctgcttctgccccagccctcaatttgatcctgtgtccaagccctgcctctggagttaagctctgcctctggagttgagtcctgcctcctacctcactctgagccctcttctggtgtgtgaatacctcttgctgaggatgaggagaggcagagagacttggagagaattttgttcccatctcagtcatcttctgaggaccccacatctaatggaggagggtattcttaggactttagggccattcctcctgggaggcagggcatctgggcctttttcattgttcattcagcaaatgaactcttatggagaccaaatacatgtgctaggacactgtgctagactctggagagtcaaaactgaccctcttataatggggcagatagccgtgatcaagtccttccaataccatgggatcagtgccgaaatgctagagcggagccatgtctatagtgctgtgggggcccaggggaagaagccttaactccagccaacttgaaggaggcttcccacaggaggtgacatttgactggggttgtgagccattcatgggggtcaccaggtggagaaggtggaaggctgtgccggggcagggggagctctggacacagtgcttcttatccttcagtgaaatcctcctggcctcagagagaaagaagggctgtttttcaaaagcataaggaatcatccaaaaaacatctgtatttgtttcaaaaggaaatggccactgccagaaaaacagcaaagttgttttgtcagaacccagtctgtatttattcctttgtctttgtttaattagattaatccctgaatggtttcccttgggtcggtacaaatcgctcgtggccataaatccccaacaattctaaaaacagtaagaaaggacaatccgcatgaagccaactggcaagcttgctgtttgtgggacagttctgggatgcgagcagtaatcttgcacccgcacataggtgtttggggttcttttagcctcttggagaggggagcaaggacaacaatcactcagatttgtttagaagaggaaagctgaaccgtagggtctcatcattaaagggggagactgactcctggatctgggcaccttccccagggaggattgtggggactttttatctgttaggttcaatgacattcagcctggctgcacactggggctacctgggagctttgacaaacaccactgcccaaatcccaccccctgccagtctgatttaattgtggtggggagtaccttggcatcaagattttcaaaggtcgctgctgcttctgtagatgggagcttgcagttactcacagactcttctgcggatatcccagtctgtcctgaaaggaacaagcatatccttgcctttctctacctaccctgtgcagggaagccttttagaaaaaaagattgttccttcaaggtcctggttccttgcttttgaaatggtactttcaaaagggttcttttgtaacaggttgatttttttgtcttcctccattattataaaagttcctgttagaaaatttgaaatcagacaattataaataaaagaatgaaaaatcacctgtattcacaccactacttggtaaccatggtaggtagggttcctgccagacccctgatggggcaaggcagcatctgcagtagagattgggaggacccatgtggagaagctgctgccacccttccagagctggttccagcatgctggagcgtcacctcccagccatcaggacttcatgcagggacactgcccacccacttagggagcttagagtctagtaagagagacacagtacatccatcgctctataaacacatacgtagttaacattatgattcatgccaggagggaaaagtgcaggggtgggctgacagccgatgggtgaggccaaaagtgtaaagaatgtttaaaggtcctcatagcaagaggttaattttctcatcaccattcaggcaacccaaagctacttcagcccggaactcagaaacctactgctgttcccaagaaagcaatgcttttcattgaactttgctagaggtgcttaaattttcccaggcctgagaggatctgtggtgctgccagacttatccttccgaagcacaacttgggtgaaattgctggtctccctttttaaagtttttcccttgagtggtccccattgcccgctgattggagttcagcctatgcagcctgtgtgcagagatccctctgcctctggtgtcaatggtctttcccatcctctcttctgctacttcccctggaatttccagagcagaattcagctgccacgcctctcctgcttccctcttctgtttactcacgcgtcccaagcctggagtgctgtttctctttctccatacctgccagcctttcccagtccttgctagacttgcagtaatctgtcccaattctgaactcccatagttttcttggcacttctcttagggattcttatcatgtcctacctcgcatgttagttatttaggtggcatctaacaaccactctggcctttctgttcctcaaataggatcagtttgttcttcaggacctttgcattcactgttcttttggccgaaaatactcttcctaaaggttcatgttattaactcctagtaggatacaagctgcgtgacagcagaaaccccttgtctgttttgttcaccatgatatccccaatgcttgggacatagtatgcgctcaaaccgtatttattgactaaatgaatgaatatcgtatgattcagacatttcttatatctggcctagctcatttaggttttgtatttctttgattactcactacgatttttgtattagctgaagttttcttccggttatgggtgttttccttacatctgaatccactgaaaatctacattggactttctggttggagttctcaattggaaatgtgagatataaacttactggtgagaggtaaaagaatctgtgtctataaggcttttttttccatctactttattgatttgggagtgaaacttcttttaggagtttaaaaccagaattcttatttgtagactcttagacctaagcgtttttaaaatgtgatgatgtaagttttaatgtttaaaattgtttaatgcatttaatagagatgttgaatcaaatcagcttttatctttttaaaaatcaatttggatattttatatttatgtaaaagcataataaactatgaaactcaaagatctagaagatgatatgaaaatgtagccattggattcaggaattaatcaagctttctaggtaattaagtttttttaaatcatacctgttgtagtgatagcttttttttgtttgagacagtcttgttctgtcgcccaggctggagtgcaatggtgtgatctcggctcactgcaacctccacctcccgggttcaagccattctcctgcctcagcctcccatcttctgagtagctgggattacaggcgcgtgccaccacgccaagctaatttttgtatttttagtagagacggggtttcaccatgttggtcaggctgatctcgaacttctgacctcagatgatcctcccgccttggcctcccaaagtgttgggattacaggtgtgagctaccacgcccggccagtgatagcttttaaccagagaaaattctctttaatatattcaacccctttaatgctctctgattatctccagttttaatggcaaaatcaatggtacagctagctgtttcatggtatccaagctgttctccttgctgggaaatagtgttagagactgagtcagtgatggatggaagatgcctttaatcttttcatccaccaacatattcttagttctgttgcagtagatgcatactgcaattccattcctacgttgcatgtgaataaacaggcagagcttagcacttagtggacatgtaataaatatttgaccaaaataagaccacgaatagacatgtatctatttctccctggcaatgtttgttacctctacctaacctcttttggcttctccattttcctcgtttgttattagaatgaatacatagagcacaaagagggttttcaaagagctttgtctcattccttcttataccagcaacagagtgagattctgtctcaaaaaaattatttaatgtatttcaaagtaattccaactttgaaaaatgtgttttttttatgttatttatttattttgagacagagactcgctctgtcgtccaggctggagtgcaatggcacgatcttggctcactgcaacctccgcctcctgagttcaagcgattctcctgcctcggcctcctgagtagctgggattacaagcacacaccaccacactcagctaatttttatatttttagtagagatgaggtttcaccatgttggccaggctggtctccaactcctgacctcaagtgatccgcccacctcggcctcccatagtgctggaattacaggcgtgagccaccgcatggctgaaaaatgtgtttttatatacatgcagaaactcacctggaaagaaaactcaccaaaatgttaacagtggttgcctctgggtagtaggattacagatggggggattacaggtgaattttcttttatctatttttttatgttttccaaattttctactatgatcacgtatcaaaccttacaatgtttttaaaagttactttggtgagggctctggagttccctgttgcctcaccctgggctgggagcattctcaggtgtgcctgacgttgtgttctaacatcgtgactttgcctcagtccaggatctgtgtgccatggaggaccacaactgtgagcagctctgtgtgaatgtgccgggctccttcgtctgccagtgctacagtggctacgccctggctgaggatgggaagaggtgtgtgggtgagtatccctccagctgggcttggtagggaaggacaagttaagcatggtgaggaggaggggagactcacgtgtacctcccacatatttgtttcctcacctttgggtttccacaaagtgctcagttgtttggtgtagttgttaggcagaatttgaactttaaaggcttcatttatggctgaggtcagcgttttcttattctgggtctccagtaaaaggaacacttatgataatccatgcaaatataactgtgtgttactgcatctcttgaaaaggatcgggtggattttcttcaactttggaggatatgtttggaatggcctgacttatatatagctcaggtgttatacatgaaatttacttgggtgggttgctgagtgacacctcaaagacaacgggcagccttcctccctaatgtcacctatagctcagtgacaggccaaagtgactgccaggtgaaagagcccagccatatgggctcagcgtaattagacggcgtggtcagaggaaactagcagtagcctcaaaccctcaaacacaagcccaggtaatgaggctcaagggcagtgcttgatgctgcagacatcccccctgtttatctacaaagcctttgcaacttaacatggtctcattcctccttataccaacaaacagtgcctggtggatagtaggtgtttcataaactgaactgaatacttatgaggcagaaaatctagaaggaaaagaacttgactgacatcaaaactggaatgtaaattttctgctaaatcctgcattttgtcttccgtgttctattgttttcaggaccctattttattttgcttcgcacaaacagggtatgcttatatttttgcacatagaatttgcattttccagcacaccttaattcttagctagggatgtggaaggcaaaacaaaacaacaacaaaacaaaagttaggtggtagcctgcaattggcaggtgagtgatgagagtatcgtgggtttgtttttacacactgataggaatgaaagcaacctctgcctctgactctcatcaaagggccacaaatgcagctggtctcctgggccttagggttgtttttcttcttaatctgctggtggtggccatgatagagtggcagggttccacacccactaccactagcaaaaaagaagccaacatatatacccatggttatttttgcttcattaatttttattatgcaagtaatacccgttcatagagaaacttaaacagatgagaaaaatcactattaataggttattgtattttctaccagactttctccatataaatatctactttaaaacattttgttggacaggtgcgatggctcacgtctgtaatcccagcactatgggaggctgaggcgggcagatcacttgaggtcaggagtttgagaccaacctggccaatatggcgaaacccggtctctactaaaaatacaaaaattagctgggtctggtagtgtgcccctgtattttcagctagttgggagggtgaggaagaagaatcacttgaccctgggaggcggattttgcagtgagctgagattgtgccactgcactccagcctgggtgacagagcgagactcatctcaaacaaacaaacaaataaacaaaaaacattttgtaaagatttaacaaaatgaggtcacactgtctattttgttttacaacctgctttttcccctctactatttgttaaatgggtagaaactctgagtgctgtttggtcaggaggaaatcaagccattgtgagttaggctggtggaggagcttcaggaaacaggatgagggtaatgggttgattaggacaaggggagggacagtagaacacagggcttgcattggtcacagggagtagatggggcaggaagcccaccttggcccatgggaaactggaggccactgaaaaacccatttctctgagtgtttccaaataattacctgcttgtccgtgtgtagtagagaacctttgtatctctgaggattttgctgtaacttttgggatttgacatttattgaagagctacaagcgtgggagggtagatgctgtcattgccagagagctttggcgtgctgtttatcggagatgggcgtttctctgcggctgcttgactgcatataagaatgtctgcattttctcagtggggatccaatccaaagagtgggaaaatgggagagactgcatcccattgcaacccaggtctcctccgtcagatgatcctagcatcaccagccttaccaccttttccccaatgccctttacagcggttcactaagcactcgatctgttagaggctgggagtgagatgattaagcaggcagtacttttgttgccagtagcctttcttagggactccagacaaaatcctacaaggttagttgctgctcaatagggctatggtgagtacaacgcaaatgatagagaaaatattggccacggaaggtcagagagagacatcctaatggctaggctggaagatctgagtgtggaaggaagggtggcaattggacaaatgtccaaggcagggggagagatgaagggcagtgactgtggaggtggcaatgctcttcaagcattagggctaagtctggcctaggagtggcagggccagctcctgggagctggtaggtcagagagagactgttacagtgaaaaggccaaactgaaagttaaccaggtggcctaacctgagggccagaaggcgcttatcaaagatggagactccaggtaccagacttagagcaggaaatttagaggagaggctggtgagaactctggacatactccattagtagctgatctggggtgccctgtgtgtagatggccagggaacattaagaacagagtgattatgcctcccagttaatacaggacaatcccagtttatgccctgttggcccaattcttttttttttttttcttttttttgagattgagtcttgctctgttgcccaggccatgatcacagctttgcagcctcgacctcctgggctcaagcgatactcccacctcagcctcctgagtagctgggaccacgtgtgtgcaccactgtgcccagctaatttattttttgtagagacagggtctccatacattgtctaggctggtctcaatctcctgggctcaagtgatcctcctgccttggcctcccaaagtgttgggattacaggtgtgagccacctcgcctgatgccatttctttttatttttagacagggtctcactctgtcacccagactggagtacagtggcgcgacctcggctcactgcaacctctgtcccccaggctcacatgatcctcccacctcagactcccaagttgctgggaccacaggtgcataccacacgtctggctaattttttgtatttttggtagagatggggtcttgctatgttgcccaggcaggtattgaactcctgagctcaagtagtctacctgcctcggcctcctaaagtgcagggattatagacatgagccactgcgcccgactgaccccatttcttacccagctggcctcatttcttgatggcacatcttttcactttgaaaggggttccagtttggatgataaattacataatcaccctagttaaggctgtccaatttgacttaaactgttaagttcagcagagaattcctgtatacatgaagtaggagatgaagttgaagacagcagaaggaactggattgttcagggctttgaaaatcagacgtaaagcctagattttatctctgaaaaagagccaccgaagggtttatatttgggtgacaaatgcaaagcttcatttttaggaaactcaacctcatggggaactgcagggtgtattccaggagaaggatggcaagaagtgggaagaccagataggagattgtagcagttatcgggtgagagaggataggaaccagccaggatttgaggtgcaactgtaggaaaggagagggagacagtaaggaatgaaagaaggtgctgtacataaagggaacaaggagaagtcaaaagtgactctaggccaggtaccgtggcacatgtctataatcctagtactttgggaggccaaagtaggaggattgcttgagcccaggtgttcaagactaacctgggcaacatagtgagacccccatctctaccaaaaaataaaaaaattagttggacatggctggatgtggtggctcatgcctgtaatcccagcactttgggaggctgaggcaggcagatcacctgaggtcaggagtttgtgaccagcctggccaacatgatgaaactccatctctactaaaaaaaaatacaaaattagtcaggcgtggtggcagtcacctgtagtcccagctactccagaggctgaggcaggagaatcgcttgaacctgggaggcagaggttgcagtgagccgagatcgcaccattgcactccagcctgggcaacaagagcaaaactctgtctcaaaaacaaaacaaaaatattagccaagcatgttggtgcacatgctggtggtcacagctacttgggaggctgaggtaggaggattgcttgagcccaggagatcattcaaggctgcagaaagtcatgttcacaccactgtactccagcctgggcgacacagcaagaccttgtctcaaaaaaaaaataaatgaataaaattgaaaaagactccatgatcttgagcttccatggctgtgagagtgatggcaacagtgatggaagagtgatggaatcgattttcaaaaagataaggccaagcgtggtggctcatgcctgtaaacctaggactttgtgaggccaaggtgggaggattgcttgagaccaggagttctagacaggcctgggcaacaaagcaagaccctatatctacaaaaaaattaagaaattagctgggtatggtggtgcacacctgaagtcccagctactccagaggctgaggtgggaggggtgggaggattgcttgagcccaggatgttgagactatagtgagccatgatagtgccgctgcactctagcctgggcaacagagtaagaccttgtctcaaaaaaaaaaaaaaatgttggggtgataattagtagtcattgacaaggtgaattttgaattcaggttagacaccacaaggacacgtcaagaggaagcagaaaactcggcattaacatgacagagagagtagaatcaatgctgtagtcaggaagcagcatagtttatttcttaacttccagttattttctattttaaatatttatgtgtcagttggtttgttttgagggcatctagacctttaaaacagtgctacctgagctgaaatcccaactctgctacttgctaggtgtgttaggccatttgcgttgctataaaggaatacctgagattagctaaaagaaaaggtttaattggctcatgattctgcaggctgtataggaagcatgacaccagcatctgcttctggtgagggcctcaggaaacttccaatcatggtagaaggtgaaggcggagcaggcatgtcacatggtgagagcaggagcaagaggtagggggaggtgacacactcttttcagaccaaccaaatctcacatgaactaactgagcgagaaatcacttatcaccaagatgataacactaagccattaatgagagatccacagctatgatccaatacctcccactaagccccacctccaacattgggaatcacgtttcaacatcagatttggaggcaataagcatccaaaccatattattccactcctggccccccatatttcatgtccttctcacatttcaaaatacaatcgtgcctttgcaatagttccccaaagtcttaacttgttccaggcttaactcaaaagtctcaaactccaaagtctgaagtgtcatctggagatgagttccttccacctatgagcctgtgagatttaaaaaaaaaaaaagaaaaagtttttacttccaaggtacaaggtgttataggcactgggtaaatattctcatttcaaaagggagaaattggccaaaacaaagggcaataggaccatacaactttgaaacccagaagggcagccattacattttaaaactccaaaacaatctcctttgactccatgtcctgcatccaaggcacacaggtgcaaggggtgggcccccaaggccttggttggctccgcccctgtggttgcagggtatagcccccaaggctgccctcacaggttgttgggtgcccatggctcttgcatgctaaggttgcaaactgccagtggctctaccattctcaggtctggagggtggtggcccccttctcacagctccactaggcagtgccccagtagggactctgtatgagagttccaaccctacatttccctttggcactgacctagtagagtctctctatgaggcttcacccctgcagcaggcttctgcctggacatccaggctttccaagacatactctgaagtctagggagaagctgccaagcctctttcatgcctgcattctgtgtgcctgcagacttaacaccacatcgtagccactaaggtttatggtggcttgtactctctggagcagcagcccaagctgtacctgtggccctgtgagccatggctggagctggagcagcctggatgtgaggagcagtgtgctgaggctacacagggcagtagtgccctggacctggccccccaaatcatttttttcccctaggcctctgggcctttgatggggagtgggtgctgcctagaagatctctgaaatgcctttgaggcctttttcccatgtcttggatatttgcacttggctcccttttagttacactaatctctctagcaagtggttgctccacagcctgcttgtattcctgtcctgaaaatgccttttctttctctgccacatggctaggctgcaaattttccaaactcgtacattctgcttcccttttacatataagttccaactttatttctttgctccagtatctgatcataggcttgaatgctttgctgtttagaaattttttccatcagatagctaccttaggtcatccctcttaaattcaaacttccacagatccctagggcatgaacacaacccagctaagatctttgctaaggcatagaattggtgacctttactccagttcccaataaattcttcatttctatctgagatctcatcagcctggcctttactgtccatatctattagcattttggtcacaaccacttaacaagtctctaaggggttccaaactttccctcatcttcctgtcttcttctaagccctccaaactcatctgacctctgcccattgcccagttccaaagctgcttccatactttcaagtgtgttaatagcaacaccccactctcagtaccggttttctgtgttaggctgcttgcattgctctaaaggagtacctgagactgggtaatttatttgaaaaagaaagagtttaattggctcacagttctgcaggctgtacaagaagcatggcattggcctctgcttctggtgagggcctcagaaagtttacaatcaaggcaaaagccaaagggggagcaagtatgtcacatgacaaggacaagagtgagagttgggaggtggggaggtgccacacttttaaacaaccaggtctcatgtgaactaactgagcaagaactcactcatcacctaggggtggtgctaagccatttatgggggatctgtccctgtgatccaatacttcccaccagggtccacctgtaacacgggggatcacatttcagtgtgagatttggagggcacaaacatccagaccgtatcactaagcacatatctttaagtctaatttctgagcttattttcctcacccataatgtagaatagtaatatatacattgtaaggttttatgggattaaataagatagtgagtgacattcccaatatactctaagaacttagcattattattacaacacctactattatcgtaatttcctgtatatagtgaagtatggagtgagaagagagtgaaggactgagccttggattgcagtcacatgtagggagcaggaagtaggggcaggaaaaatattcatgaagaagtagcttaaggctgggggagagaaagaagaatcatggaacatgataggaagataatttcttggccaggtcaatattaatgtcatgcttcagcatggccaaaggtaacaggacttagagaaaaagccatcaacttgagtcacagattcaccgctgcaaacatttcagaactctgccagggactttgctaggcttgaggagcacaaaggtgaccaggaggccattgagaatggcaaagggggcatgggtaaagggcagatttcaagaggcagggagtgggtgacaagaaagtgtgggcagcaggttcaaactatttatttaaagaaatttggtagaagttaagcatgtccagctgatgcagggcaggcaagtcccaaagtggagcttagcctacctgggttcttggctttgcccagggaagaattcaagggcaagccagaggtagaagaaaacagctttattgaagaggcagtgttatagctccatgactgctcttgcagagcagggctaccctgtaggcagagaatagcagcttaggcagttttgcagtcatatttatacccactttcaattgcaggcacgttaaggggaggtttatgcagaaatttctagggaaggggtagtaatcgttgggtcattgcccaatgatagtaagggatggtaactcccaggtgttgccatagcaacagtaaattgacatggtatactgattgaagtctgattgaaggctgctttcaccccagccctgttttagctagttctcaatcaggtccgatgtctcagccccacctctggagtcaagtcctgcctcctacctcacagctactagtgaatttatgcagtagattttcagtttcaacactttcatagctactgctatgaaaagcacttcttttgttaccaaaacattaggggttcagtctaggtcctgttgcttgttgcacagaaagccaatcactgagacaacaagtattaccaggaaagaaggcttcagtcaggtgccatagccaagaagatgggagatcagtctcaaatccatctccctgactgactaaaattagggatttaggctggatgtggtggcttatgcatgtaatcccagcactttgagaggccaaggtgggaggatcacttgagaccaggagtttgagaccagcctagacaacatagtaagactcctgtctctacaaagaataaaaaaaaatcagctgggtgtggtggccaacacctgtagtcccagctactcaggagggaagattgcttgagtctgggaggttgaggctgcagtgagccatgattgcactactgcattccagcctgggtgacagagtgagaccctgcctcagaataaaataaaataaataaaataaaaattaggggtttatatagcagggaataaatgtaaacatatgggggaaaacaggaattagggaggagtatggaagaggagttggtcaacacgcagcaggtggttggttaggcagtcataaatggggaggggtctggcatgtcattgtgcagatgcagtgatctggtaagtttcagccccttgatactgtcagagagtcctgacggtttggttcttgagaagggttctcagataaaacaaatgtaactttctcaagtttcaagactggaaaggtaaatttctatgtttattcaaaataaaccataaacatcagttctgtgggacaattgggccggtttcactttgattcatccctgaattattactgtgacctgcatgaaagttcagttcttagtcatggactcagcatttttttatagatttccacacatttgagtaagtggaacgttcaattccagcaccagagttccaactccctgacagctcatttcaccattgagagtcctgaatttattccgtattcaatggtggattgctgactaagaacctcctctgctttagtggagtccctgaatttataattcatcagctgccactaaagtcatgttcattgccatccaaaactatttttcaaagaccatttatctagatttctgaacatgaattttctgctgtacttactcacctggtgtttacaaactgtcttttattttggggtaactttggtcctgtttgcatcttatctacccaggcagattgtaaacccttgagggcaaaaccacttgtacttttcatctttcacagagtggacttgaaatacattttcttgaagcactgactgaggttgattgcaatctcatgcattcatgttttgtaaaaaatatttcccccattgactggtttttaaattataaagtcatttttgcttattaaaaaaaaaaaagtcaggccaggcatggtggctcaagcctgtaatcccagcacttcgggaggccaaggcgggcagatctcttgagctcaggagttcgagaccagcctggtcaacatggtgaaaacctgtcactacaaaaataacaaaaattagctgggggtggtagcacacacctgtagtcccagctattcaggaggctgaggtgggagaattgattgagcccaaggagatatgtgccaccacccccagctaatggaccaacaccgtctctaccaaaaatatataaagaaattagccaggcatggtggcacgtgcatgtagtcccagctacttgggaggctgaggtgggaggatggcttgagtctgggagggctgaggttgcagtgagccgtgatcatgccactgcattagagcctgggcgacagaatgagaccctgtctcaaaaaaaaaaaaaaaaagaaaagaaaagaaaagaaattttctctgggttttaaatcctgcatttggaattccagttatgccttggagaagagaggttttgtgagtctgactctgtgtgtgtgtgtctaatgtatgctcagcaagtaaattggttctaccatttctctaaatgacaaatttggtttttcttactttgttatcagcaaactttaaactccaaatgctcctctttaaaatatactatttctgctaatgccattcccttgcagacggagtcctgctgagaaaacgttagaattggaccaggttataaaacagaaatcattgattttagggttttattacctgcagcaaggtatcatttattcttagagacagtggagtgatttctcacatgttgggcagagaatgaatgtggcaagactgacttctgactctgggatcttagcacttgtgatctggagggctaaagagctacagctggagaattactctttccatttgtaaacaagaatgtagacattttaggcataaatgactgagaacagattttgttgaagtagatgagaacttggaacaatagagccatcattgagttatacaagaggtcacctccatacatctgcctccctaatcttgacctctctttttatgagtacaattttgcaaccaagaaagttatgcaaacaacccaaaccacttggcaaataacattagagctgaatgccctagaactctcttggccttaaaaaactgttagattcacatgcctggcagtgggttcttccatgtttaaccactgcactgatggcctcatctgccgtctccagaagcctagcagtgtgtcagtgggtggatttcaaattgagatgggatttgacaccttggagttttacagactggagacttgggacccaggaatgcgtgaatcctgccttgccaatcacatcctcccccttagttccccagagagctgtgtacacaaagaacaaaaacattatgagagtcaagatccagagaagctctcttatctcatgaattgggcctgtggttagctgataaatggaaaacatcattcagagaggggaatcctaaaaaactatatatgcaaacccaccttagtcattttatttttatttaaaacacataaatgtatacttagtaaaaatcacttttatgcttttaaaaaatgctaattttaagttgaagaaaaaagtatgatatttacaaatcttttttttttttttttttgagatggtataattctgttgcccagattggagtgcagtggcatgatcttggttccccgcagcctcaatctcccaaactcaagcaatcctcccacctcagcctcctgagtagcttggaccacaggtgcatgccaccatgcccagctaatttttgtattttttgtagagatggggtctcgctatgtatcccaggctggtctcgaacccctgggctcaagcagtctgcctgcctcggcctcccaaagtgctgggattatataaaaatcttttttgcataaaccatacccataatgtgttgtctatgattttttagttttggtttctttaaattggaacaaggatttcaagacatctgtaaagcagtctaacagcagaactcttgtaaattttaatgggaaatttcccaatgttttacatttgtttcatccatgcctggttctatagcaattttggttagcaaattgctttaattttttccaaagctttcaacaaaatttttatttttaaaaactcagtttcttttagtgcttatattttattggtttttattttatttatttatttattttgagacagaatttcgcttgttgcccaggctggagtgcagtggcacaatctcagctcactgcaacctccacctcctgggctcaagcaatcctcccacctcagcctccagagtaaatgcgacaacaggtgcccaccatcatacctggctaatttttgtatttttagtagagatggggtttcaccatgttggccaggctggtcttgagctcttagactcaagtgatccacccaccttggcctcccaaagcgctgggattacagatgtgagcctttttgttttgttttgtttttttgttttgttttgtttttgagatgtagtctcacactgtcgcccaggctggaatgcagtggcacgatcttggctcactgcaacctccacctcccagattcaaatgattctgctgcttcagtctcctgagtaactgggattacaggcgcctgccaccacgcccagctactttttatatttttagtacagatggggtttcaccatgttggccaggctggtcttgaactcctgaccttgtgatccacctgccttggcctcccaaagtgctgggattacaggcttgagccaccgcgtccagccccagcccagtttttataatatttaaattacttacaataacatgtacaaatgacacatacaggtttggaaacaaaagcaaccttgactctaacaatggctcttaagttttagcgtgcctcagaatcacctggagggcttgctcaaacacatattcctgggtcccactcccagaacttctgatcagtaggtctgggatggagcctgagaatgggcattactgacaagttctcaagcgatggttgatgcagttggttcacagaccacactttgagaaccaatgtttataagaatacatctcagtcaatggaaaaagtacacaggtgtcctagagcccatgtgttccaccaaggctgctttatcagcatacaacccagccaatgtgaggcgtgtacaggtgttttaaaacacaggtgttctaactgccttgagtgtgtagcatgccctgggttatcaggattcatatggtcagagggaatgaaagcgttgcttgatcaggagttgcttaaggagtgatcagttaaaagagcatcttagtacaacttttttcttgaaacacccgagccaatttggatactctattctataacattctggaaaaggggaaagtttggagtatgtggcttagattcaaagcctaagccaagccttcaacacctctctaaattattacattagtctaaattacggggccagcataattatgggatatccctctgagagacagaaatggccgggctcagattataccccatggtgtaagagaggacattcaagagaaaaggtagagtgtgagtttctgacttttaggtatagagacctgaccactcattgttgcagcaccatcaatgtcctacaatttggaagtcagatcagcagctcctctctttgtaggggatactaagaagtgggtggccatagataggactggctgactgatggcaggcacccatatccaggattgggagattttcatcatggtgaatcaagcccagcatgaggaagttgaagctggggattgttgactgctaacacgggcccaagcaggctctggcatggccaactcctgtgacaaacagactggaccgtgtgccagggtttagccttcctcgatctcagtgttcccagtgtcaccattgattcttttgatgatcccttggttcttgagaaatgagaaatgaactattagaaggatgtggtgctagctcagtctttatgttatgactcaactctagcaaccagctgatatccaatgacgttgagatcctgagatgacatgaatgccctatccccaacataatggcttgtgaattaaacctgcaaatactaggttctactagaactctttagggagctgaagttacaaaaacaatatttagactgaaacttttttttttttttgagacagagtcttgctctgttgcctgggctggaatgtagtggtgcaatctcggctcccgggttcaagcagttctccctgcctcagccttccgagtagctgggattacaggcacctgccaccatgcccagctattttttgtatttttagtagagacagggtttcgccatattggcaaggctggtctcaaactcctgacctccggtgatccaccctcctcagcctcccaaagtgctgggattacaggcgtgagccaccatgcctggcctagactgaaacttaatgaaactttgaagcaaaagaataaacgtaacacaggttattaccctttacaaatcttcagtgtccctttgcatctttttattgctatgctaaatatgtcattatcttctccatgcatggttttgctttttaaaattttacatatgtattacttttgtagattctatttccttgttattatttacacacttttgatattaatataatcctaaaacattgtagggagtacttttttttgaaaagggactggtcttaagctcctgagctcaaatgattgccctgcctcagtctcccaagtagctgggatttccaaaaacttttttttttttgagacagggtcttgctctgtcaaccccagagttgaccctaggtgcactctctttttctcatttcacctctaatccaacaggaatcctgttagccccaccttcagtatttaccaggtgtattagtttgctagagctatgctgtggtttggatatggtttgtttggcttcaccaagtctcgtgttgaaatttgacctctgtggccaggcacggtggctcatgcctgtaatcccagcactttgggaggaggctgaggccagtggatctcttgagctcagaaggttgaggccagcctggcccacatggtgaaaccccgttcctactaaaaatataaaaattagccagatgtggtggcgcacacctgtagtcccagctacttggatggctgaggcaggaggatcacttgaacccaggaggttgaggctgcagtgagcagaggtggtgccactgcactccagcctgggagacaaagtgagaccctgtctcaaaaaaaaaaaaaaaaaaaaaaaaaaaaaagacaagaaatttgattcccaatgttggaggtgggacctgctggaaagtgtttgggtcgtagggacagatctcttcttataagaacaccagtcatattgaattagagcacgccaccctaataagcacattttaacttggttacttctgcaaagaccctatttccaaataaggccacattcgtaggtaccagggtttaggactccaacatgtctttttaggggacataattcaacccataacttccagaacaccactccccctcatcccctgcaacatcctggtttaagcctccacccttcctccctgggattactggagtcactttcttactggttttctactctcagatttgccctgtcagtctattcttgactcatgggtccagaaccctgcagtgactcccaactcattcagactaaaagctgaggtccttgcatggcccatgggtccctcctgactgcccccttctcatctcccacctctctccctcctccagccaccctggcctctttgctgatcctccagcccaccaggcagagtcccacctcctggccttcgcacttgctgtttgttttgcccaagataccctctcccagatatcctcacggctcgtattttagtcaacactcttcctaaccacccaccttctcagagaggcctctcctgaccacctctattacatcccacctgctacccactcccccactgaccctactcctattcattgttttgcttttctccagaattttctttatctcctaatagactatgctatttacttattttacttcttatctgctccccactcccagcatcattatccaaatatacgctccttgggggctggaattttggattattttcttacttgttctatccctagcacctaaaacaggacctggcccgtagtaggtactcaggaactaatgaatacatttttgttcattacacatatttgtgtaatgaacacatatttgtggaactaatgaaacaaatgaaatatttgtggaacacaggaacacatttgtggaactaatgaaaaatcagccagtgtattttctcatacattgttaaatcatttacccttattcaatgttcatcttattttctaggattttttgttgttgttgtaaacaatgctattaatagtttattgtatataatttcacccttttcctggctatttctttgggtttcacgtccagggtgaacattgtcaaattgccttccaaaaggatctttctcaatttataatgcccctaccattaataacgctgctgcctttctaccactgggttttatctcatcttatttttgccagtttactaggtgtaagtgcaccttgtgatgattttgatttgcaattctttaacttttaaatacaattgttcacatgttctttagtttacttcctatatcttcctatatgaattgcctgatatagactcctgattttttttgaggggggcagagaccttgggttcataactgtttatcctactcttttggggggcaataatattaatcctaattaatatctgttatcattttgccctcatcctaccattcccttttcctctgtttgcatttctaattctgaatgtgttttattctctccagctgtggactactgtgcctcagaaaaccacggatgtgaacatgagtgtgtaaatgctgatggctcctacctttgccagtgccatgaaggatttgctcttaacccagataaaaaaacgtgcacaagtaagttacacacacatgcacacacagagaaatatttgctgttactgctgtggtgactgtgaccatggaactctctcaagtatagattagcaatataattatgtcatgggggtctaataccttttgccccattcctcctctgtcaggactttcatgacttggcttaagaccatagaccactgtatctcaacatcactattcaaggaatatgatgaaggcaccatgtgtaggactgttccttcagcatctgctgagcatgctgacaatccgagcaacttacttcctgctaactcagcctgactgtgcccatcagcactaacagggcttgagatgttttcattgaagctttgtggcttgtgggctttagctctgactccacgcaagaaaatcgctgagccaaaaagaatcataagtgatttcttctggtggaccgcagtttgcaaagaactgctcatgttttgtttgagctatttagttcaattggattttaactgtatacataaaaatcagaattaatttcagctcccaaaatttgaacataaaattcgataaactaaagatgatcattagttttgcaaaaaagataataactagttacaaaaagattccaaaagtgttctattaaatataaaggtacatcaggagacttaagggattgtgtatggattattatccttctatagggaggatcacttgagaaaagcttgcttgttaagtattagggccaagcatttataaaaagtggactttaataacaatctagaatagggtaaggcacctcagagacatgcatcagtgagaaaacaggattttaattcataaaaagttcatgtacctacaacctttctaaaatgtattcactatgtaaaacaggatacatctgcacaaaacctttttcaacataaacttacttcctactcttcaatacctaaatatcagcagcttacaaacaccagagctggaggtttgggtgatgtatggaactataagggacacattaggtcaaaagcatacatttctggagccccaaccatgtgccaatagaaatgagtacggcaaggtccttaagggagaagataactgtggctgagtcttggaggtggagctgtcattcactaggcagaaaagggtgaggtgggggttccaggagaaggaaagaagttgaagatgtgaaccaagcagagaactgtagtctccatgccccgtgcatgactggcatatacagtggtttatttgttttgtttattgaaagagtaagtaaatgaatgagtgggctgctgtgtttgtggtctcccttcccttctgaatattctgaactgtaaaatagcagcctgtgctgtcgtcgtggttggggagttgtggttgttgggctgatgagtcagtgttcctcatcaaagaggaggccgtgggctgccagcagcgggccttggttctaatcccagcttctctgctttttctcttggtgatcttgggcaagttacttatgcctcagtttcctcagttacagtacaggatgataatgctgcctactgcatagcattattctttccttttttttttttttttttttttttgacactgggtcttactctgtcacccaggctggagagcagtgatgtgatctcggctcactgcaacctccacctcctgggttcaagcgattcccccacctcagcctcccaagtggctgagactacaggctcgcaccaacacacccagctaatttttttggtattttttgatagcagtggtgtttcaccatattagccaggctggtgtcgaatccctgacctcaagtgatccacccacctcagcctcccaaagtgctgggaatacaggcatgagccacagcacccggccatagcataatcttgaatactaaatgaggctgggcacagtggctcacgcctgtaatcccagcactttgggaagagaagcaggaggattacttgagcccaggagtttgagaccagccctggtaatatggagggaccctatttctacaaaaactgttttttttttaattagccaggtatggtgacaagtgtctgtactcccagctacttgggaggctcaggtgggaagatcactagttgggcctgggaggttggggctgtagtgagccatgatggcaccactgcactccagcctggaggacacagtaagaccttgtcttaaaaaaaaaaaaaggctaaaaagggatgatgtgggtttcaaagactttatttattatcattatgtttttttagaaataggatcttactctgtcacccatgctggaatgcagtggtgcaatcctagctcattgcagcttccaactcctgggctcaagcaatcctcccacctcagcctcccaaagtgctggaattatggtcatcatgagccaccacacctggcctccaaaactctaaaaaaatgagtatttaactgtgcatataccacgtgcctgggctacatttaaaggtgcaaaaaacattcaagatttccactgcaagctggtgagggaccttagccatagccacactgagtagctgagtcatggtgccaggagttatgtgaccaagggcctacagtgtgatgcagccaggaccacagcaggagttagaggaaggagaccagttagaccagaacaggtgagatgctgccttgcagggatgaggactggagaaaaacacatatcctagccagtctcctacctgcctctccagactgcacacactggctggggtcacctgatttccaccccagcaccagccctagttcccagagtggcaccatcttccccaccctgtggctcagcatgcctcctgtcccagatccccagcccagggtggtgcaggcaaggagggtgttggagccctggaatcagaccctggaagtagataccgcagcatagtgggactgggagaggaggtttggctaggagccacgggaggggctgatccagctgtgaggtctcaccagctaggcagcgagcccagcagtgcagttgtcagaatcaagatccagaagtgggccgccccaatgcgtgtgcagggaagagtgctgggagactggagggttcgtgcaggcagcctcagggcagtacatcccttagaagagccctcttcccaccatgcttggggtgggcaggagccagacccaggaggagggagacaagaggaagaaaggagacagagtacttggaaagctaagagtagaaaataaggcaaaagcccagtcgtaagaatgaaacactcaggagtgctccagatctgtggcagggacaagaactgagaaatagagactagttaaaattacagaaacaggatagaggcagaagctcagaaccgaagcagccaccctgttttagtgagtaccaaggcctcccaccagcttccagccaagtcggcctggttactgctgtgatgttgaaagatttttttttaaaattctacttcttatacacttgcaaaaaatgaaagaaactcagtttctcaaatttcagcctatatttttaaccaaaagtatatttgaaagcgaatacaattagtaagtgtgcaactattatctcaaaaaggtagactagtcaatgtaataaaccaagcatggttaatttatgattaagcaaaaatgtacataatagggctttatgttcatgaaccagtactataatttgaaatatgtaagtggtgttcaaaaaagcaccacctttatatcaatttcttaccctagagcagcccatccaaatctagacgggagaaaggtggaaacacacaggtaccatcagtttgcaaaaagttagcaagacttttctttttctggtattgttataaaacatacataatagaaaatttaccactgtactcattcagtggcattaaatacactcacattgtgaaaaacgcatatcctagcctgtctccttcctgcctctccagaccacaccccctggctggggtcacctgatttccacccagctgtaactatcctcaccatccatctccagaacttttcatcaccccaaactgaaacgctgtacccattgaacaataactccccattgcctgccctgtcaaccaccattctactttctgtctgtgaatttcaccactctcggcacttcatgtaagtgggattatatggtatttgtcctttgccgtctaacatatttcacttagcataatgtcctcaaggtttatctgtgttgtagtatatatcagaatttccttcctttttaagactgcataatattcaattatatgtatatatcccattttgtttatccatctgttgatggacgtttgggctccttccaccttttgcctattgtgaataaagctactataaagatgagtgttcaagtccttgctttcagttcttctgggtttttatacccagaagtggaattgctggtcctatggtagcaagactttttgagatctagattgaaacccttattcttgagccaagcatgagaaagaacactctcagatatccagggtcttttcaccagaaagatctatagaggacttcagtctgctggacagggattcatgtctttggtagcaaggagactgtgggctttgagtctaatgcttaatcatctaatgcctgtaaggatgaataaaggcaattgcggacaccatcttttgcatgttgccatttattattttcgtgcttggaggtcattatactcattgtttttcagtctccagtaataacttggttgacatttccatccttatttttcaaataagaatgctttgcacagagtaaggcactgaatgaatatttttgtgtttgcactagaaacaaaacacagaaggaagtaaactttttaaagtagagatggggtctgctatgttgctcaggttggactagacctcctgacctcaagtgattctcccagcttggcctcccaaagtgctgagattacaggatgagccaccattccggaaataattttatactgaatcagcaatagaagaactacaaagtatcggttgtcaggtttcttggccagagcatagttaacatactgagtgccactaccttcctacagcctgtaatatgccacttttgtgactccctatgtggataaatcaaacactttcagctggaagaggctttaaagttcaacctagttcttgcccaactatccatcctacaatattctcactgtgccatcatccaacctgcatttgaatacccccactgacaggatattcactataccccatggtagttcattccactttgtatagctctgactcttagaaagtgattccctagactgagctgatatctatttccttgctcttagaaatgaacaaaacaaatttggctacttgcgttctttgtggccactaagagtgagtcatatcagagtaactttatttcacttagtagactagccaggcatggaaaatgtagtagtgaccatctaaattttaataggcatttgaccaatttgtgtgtggaggaatttgtgctcaatgaatgattggttggtttgtaactggccgaatgtctgtaaccacaggatgctaattgttgaactgagatcctcctagaaggaggtttttaaacagcttgctgggaagaagccttatggagggatgagagctatcttccattcatagggtcccccgtgtttcttcatggtgtgcaatgtgtatgtatctaaactctcaaaaacacactccagtaagagtaataccaataaccttttattcattccacaaatatttgttgagtatctactatgtgtcagatatgattgtagacactgggcatgcagtaataaattaaacagaccaaaaagaaaccccaccaatatctgtccttatggagcctacattctattggagcaggataagagaatactacaggtctcaacagcaaagtaatactagtctttgattaaagatttgaaggcagtgagagaaggaggaaacctttgaggcagaggtagaaatgaaattctatgaaataaaatgatctgtgatactatcacacagcaccagtacaaaatggatatgttttagtccatttgtgttgctataaaggaacacctgagactgggtaatttataaagaaaataaggtttatttggctcatgattctgctggcgggaagactgggcatctagtgaaagcctaaggctgcttccactcacagcgggaggtgatgtggagccgacctgtgcagagatcacatggtgagagaggaagcaagagagaaaggatgaggcggtgctctttttaacaaccagctctcatgagaactaacagagcaaacgtactcattactgtgaggacagcaccaagctattcattagggattccccaccatgacccaaaaacctcccattaagccccgcctccaacactgtggattaaattttaacatgaagtttatgggatcaaacatccaaactgtagcagatatgcacacctgaagctatatatatttattgtttttagcaatgttccctgattatgttcttctccaaatcacaggacacttcccacattgttcttttttgtatattatttgggccgttttccatggcaactagtttcacaaagtacaaatgtacaaatgtgtacatttatttttagtactttttctgattacaaaagtaatacaggttcattgagggaaactggttcctatagaagtgaaattctatgaaataaaatgatctgtgatactaccgcccagaaaaaaccactgtttttgtgtttgttttgctttttgagatgggtttctcaccatgttgcccaggctggtcttgatctcctgagctcaagcagtccttctgccttggtctcccaagttttgagattataggcgcacactactgcacctagctgataaccattgtttatgccaatttggaacatttctctccagtctttttttaatgtatgtgtatggatttatttttatagagttgagatcatgcagtataataataaatcataagcattttgacatgtcacttaaacgttatcaaaaacattttaatgtctgtgtaaaattctattatatgtatatgtcagaatgtgttcaggtttttttggctgctcaaataatattgtgataaacattcttatgcttgaatctttttttctgatcattttcttaggaacacaacaaaaaaggaaatttattgagtcaaaggcaattaacattttaagtcttttgatacatattcaaaattattttctaaaaacgttttaccgatttatactctaccatcagtgtttaagggggcaatttttatttttaaattaaattaaattatttatgatttcaataggtttttggggagcaggtggtgtttggttatatggacaagttctttagtggtgattctgagatttttggtgcaaccatcacctgagcaggatacatagtacccaatgtgtagtcttttatccctcaccatcctcccaccccaagtccattgtatcattcttatgcctttgcatcctcatagcttagctcccatttaaaagtgagaagtgggatatttggttttccattcctgagttacttcacttagaataatggtctccatctccatctaggttgctgcaaatgccattcttttgttcctttttatggctgagtagtattccatggtgtatatagacactgtattttctttatccacttgttgattgataggcattgggactggttccatatttttgcaattgcaaattgtattgctataaacatgcgtgtgcaagtatctttttcatataatgacttaatttcctctgggtagatactcagtagtgggattgctggatcaaatagtagatctacttttagttatttttttttgagacggagtctcgctctgtggcccaggctggagtgcagtggcgcgatctcggctcactgcaagctccacctccagggttcacgccattctcctgcctcagcctcccgagtggctgggactacaggtgcccgccaccacgcccagctaatttttttttttttttgtatttttagtagagacagggtttcatcgtgttagccagggtggtctcgaactcctgaacttgtgatccgcctgccttggcctctcaaagtgctgggattacaggcgtgagccaccacacctggcctacttttagttctttaaggaatctctacattgctttccatagttgttgtactagtttacattcccaccagcagtgtaaacggaatttgtccatttcatcttaacacatggacacgtgatagggagcaacacacaccggggcctgtagcaaggagtggggagagggaaagcatccagaagaacagctaatggatgctgggcttaatacctgggtgatgcgctgatctgtgcagcaaaccaacatggcacacatttacctaacaaacctgcacatcctgcacatacaccctagaacttaaaataaaagttgaaggaaaaaaaagtgtttcttaagggagcaatttttaaaaatgttgctgattttctaggagaaaatttcttcttcttgcttttttatcatgtctttaatacctgttcttcataaaattatccaattatatatatctaatttataaatgtatgtttattggtgttattatttgattaatgaatattttccagtataagtgattgtaagggactcttacaaatttcatgaagcaagggactgtgcctctttgttcaacactgatcctagtgcctgtcccatggtaaatgctcagagaatatttactgaatgaatgaatgaacagggaagttaacatgtcttcatatattagacattcaagagagagggaataataaagatctgagctaaaataaaaggaatagaagacataaatcaatagagataattggtaaaaaccaaaatgtgttttttttagaagattaataaaattgataaatgtctaaccagactagtcaaggaagaaaaaagagagaagacacaaattactaatatcaggaatgagaaagtggacatcaatacatatcctacaaactttgaagcataatacaggccaagcatggtggatcatgcctgtaatctgaacactgtgggaggccaaagcaggaggatcacttgaggcaaggagttaaagaccagcctgggcaacatagagcccatctccaccaaaaaaaaaaaaaaaaaaaatatatatatatatatatacacacacacacatatgtatacacacatacatatatatatatatatacagaaaaatcataaacaagtttatgccaataactatgacaacttagatgaaatggacaaattccttgaaagacacaaactactaaagtttacccaagaataaatagaggctgggcatggtggctcatacctgtaatcccagaactttgggaggcttaggtgggaggattgcttgagtccaggagttctagatcagcctgagtaacatagcaagaccccatctctacaaaaaataaataaattaactgggcatggtggcaagtgcctgtagtcccagctactcgaaaggctgaggcaggagggttgcttgagcccaggaggttgaggcttcagtaagccacgatcacaccactgcactccagcctgggcaacagagtgagactctctccccagaccgaccaaaaacaaaagaatatagtctgaatagatctctatctattaaaagaaatggaatttgcactttaaaaccttcccacagagaagacttcaaacctagttggcttaactggtgaattctaccaaaaatttgaagaaaaactcatactaattctacacaaattattccaaaaaattgaagaagaaagaacaattttcaactcatcctatgaggctatcagtaccctgatacccaaaccagaaaagaaagacataaaaaaagaaaactatacacaaatatttctcatgaaatacctgcaaaagttatttaaacagtttctagcaatcaaatttaacaatatattaaaaagtacaatacatcacaaccaagtgggatttattccaggaattcaaagttggcttaacattcaaaactcaatcaatgtaattcataatattaacatattaaaaagtcaaaaccatatgagccatctcaatagatgcagaaaaggcattggataagatctgacattcattttttctttaaataaactttcagcaaattaggaatgaaggtggccaggcgtggtggctcacgcctgtaatcccagtactttgggaggccgaggcgggcggatcatgaggtcaggagattgagaccatcctggctaacacggtgaaaccccgtctctcctaaaaatagaagaaattagctgggcatggtggcaggcacctgtagtcccagctactcgggaggctgaggcaggagaatggcgtgaacctgggaggcagagcttgcagtgagccgagatcgtgccactgcactccagcctgggcaacagagcaagactccatctcaaaaaaaaaaaaaaacggaatgaaggtaactgcctcaatctgataaagtgcatcagtgaaaaaactatcagctaacatcatacttaatagtgaaagacaatgctttctttatcagatcaggaataaaacagaatgtccactcacaccactgctatttaatattgtactggaagttctagccagtgcaataagacagagaaagatcaataaatggtacctagattgttaaaaaaaaacaccatctttattaacagataacctgatcacctgtgtagaaaatccaatggaatctattaaaaagctactagaactattaatagcaagtgaatttatcaaggttgcaggacacaagatcaatatacaaaaataagttagttttatgtacttacaatggaccatcaaaatatgaaatttaaaaaaataccttttcaggctgggcacggtggctcatgcttgtaatcccagcacaatgggagaccaaagcaggtggatcacttgaggtcaggagtttgagacaagcctggccaacatggtgaaagcttgtctctactaaaaatatgaacattagccaggcatggtggcaggtgcctgtaatcctagctacttgggaagctgaggcaggggaattgcttgaacccaggaggcagaggtttcagtgagctgagattgcaccactgcattccagcctgggtgacagagcaagactctgtcaaaaaaaaaaaaaaaaaaaaaaagacaagccactcaataaaaatgggaaaaatatttgaatagaaacttcaccaaagaatatatagagatggcgaagaagcatatgaaaatatattcaacaacattagtcattaggtaaatacaaagtgaagtcatattgagataatcatacccactagaatgactaaaattaccaagtgatgatggggatacggagcaactggaactctcataaattgctggtgggaatgtttaagcagttaagcatacatgtcccatatgactcattcattatgcaaaaggaatgaaagcatatgtccacacaaaaacttgtgcattagtgttcatagctgctttatttgtgatagccccaaactgggaacaggtaaccagcccttcagcaagtgaatggataaacaaattgtggtataatcacatagtgaaatactactctgcaataaaaaggaacaaactattgacacacatatgaatctggatgaatctcaaaataattatgctgaatgaaagaaaccagacaaaaaagaatacatactatatgattacatttatttaaagttccttggggagataaaaaaagaagataaaaaataaaattctagaaaatgcaaactgatttatctggatagaaggtaaatggttatttgggactggagagagtggggaagaatgaattagcaagagacaggaggaaagttttgagagtaatgcatatgcttattattttgattgtggcgatggtttcatggcaggatacatatgcaaaatgcatcagattgtttttcttgagtatgtgcagtttggtttttgtcaattatacctcaaaaaaactaaaaacaagtagaagagactgtattattccaaaatttctatgtcataaaacacaaagagaggctgtggaaatgttctggcccatcactatcctatgggacactctggttgatggaaattctctgtttgcatcatacaatacagtagtcaggagccacacgtggccactgagcacttgagatacagccagtgcaacccagtaactgaatttttgtttcgttttgttttgtttgttagagacaggctcttgctttgttgcccaggctggactgcagtggtacagtcatagctcatagctcactgcaatcaccaactcctgggctcatgagatctcctggcctcagcctccctagtagctgggactacaggcaggtgccaccatgctcagctaacttaaaaaaattatttttctgctgggcacagtggctcacgcctgtaatcctagcactttgagaggccgaggcgagtggattgcctgagttcaggagttcgagaacagcctgggcaacacggtgaaaccccgtctctactaaattacaaaaaattagctgggtgtggtggtgtgtgcctatagttccagctactcgggaggctgaggcaggagaattgcttgaacccgggaggcggagattgcagtgagctgagatcgtgccactgcactccaccctgggcagcagagcgagactctatctcaaaaaaaaaaaaaaattcttttttcagaaatggggtcttgctatgttgctcaggctggtctcaaatttctgggttcaagcaatcctccagcctcagcttcacaaagcattgggattacaagcatgagccaccacccctggctgaattttaattgttatttcattttaatcaattttaatttaaatagacatattaggcagcatggttctagattaagggagactaagcagatatgaaaacgagatacaatctctgaccctagactagatcctgtactggaaggtgaaaaatgctatgaagaacataattaagtcaactgacaaaattagaatatggatggtagattaaatataagtattgtatcaatgtaaacttatgaaatttataaccatactgcagttatgtaagagaatatccctcctcttaggaaacacggactgtttttaagggaaaggaccagaatgtatgtaatgtaccctcacataggtcagagagatgaccaagtaatcacaggaatggggtaaaatgttaacaaaggtgaatctgggtaaagagtatttaagtgtttcttgttttatttttatgtttgtaactttttgtaagcttgaaattgttttcaaagaaaaagattttttaaatgcctttatatatgactatggtattacaattatattgtttataaagactcccagtgttttaaagctacattatgaagcatttatggacaaaataatacaatgtctgggccaggtgtggtggctcactcctgtaatcccagcactttggaaggctgaggcaggtggatcacgagatcaggagttcaagaccagcctggccaagatggtgaaaccccatctccactaaaaatacaaaaattagctgggcacagtggcaggcgcctgtaatcccaactacttgggaggctgaggcaggaggattgcctgaacctgggcggcagaggttgcagtgagccaagattgcgccactgcactccagcctgggtgttagagtgagactccatctcaaaaaaaaaaaaaaaaaaaaaaaaattactcaggcatggtggcatgcactggtaattccagctactcaggaggctgaagcaggagaattgcttgaacctgggaggtggaggttgcagtgagcctagattgcgacattgcgcttcagcctgggcgatggagcgagactctgtctcaaaacaaacaataataataataataataataataataataacaacaatacaatgtctggggtttgcttcaaagtaatgtgggatcttactatagagagtggggacatagctgaaagccaagcagccatagattgattctcctgaagctgggtgatatgtacatggatttattatactactcagtccatttttgaaattggacattattgtatattttgcttaacatttccataagtttaaattgggaaaaattggcatctcactcaacattttttcctttcaagaatattgtatatctttcccttactcagtttgtttcctctggtatggactgggaactctcatttataccaaattatttgttaggaagattatttatgcagttcaaatgttccttaaaataataaaaaccctcatcaaaacaaagactccttttaagattccatcagtggtcatttatttcaagcaattttaaacaatgtgtccaagttccactatgggaaaatattttgctcagattctgcaataaaagtttctttccatatttaaaaatacttatacaaaaaatacaaaaaaaagaaaaagaacaaaaacaaaaaaataaaaatacacaagtaaaatttcattatgaaaaatttcatgaaatacttttaaaaaaatattttggtttaaattaatgtatccctagagatcacattctctgtgaatcttgaggtaaaaatcctatttatgtgcagctgagcccaatgaggtaaccaggaggtgttttgaactcagagtatttatgcctttcactcctaggccttatttttcccaggatatgattttgtgtcttattgtttggctcattgtttgatgggtttaagtggtttggagtttggctttgggaacgtttaattgttttaattgcttaaattcgataaaacactcagctaaaccattctcagcctgcagtctggcaaataccccatcttcattttagtggctcttacatgaatcaagacaaggaaagcatgttcacaaatttgtttgttgcataaacgttttgtaatatgtcaggaagtttgtctttgcctagcagaagagtccaggtataataataataataatagaagaagaagaaggaaaggaagagagaaagaaagaaagaaagaaaaagaaagaaagaaagaagaaaggaagaaaggaaaggaaggaaggaaggaagggagagagaggaaggaaggaaagaaagaaagaaaagaaaagagggaaagaagaggaggagggaggggggaagagggaagagggggaagggaaagaggaaggagaagggggaggaagggaaagagggaggaggagggaagaaggagaagaaggaaagaaggagaagaagtttctcttaggagaggccatatctctaaacatggaagtagctttattgggagaccccttcatggtgtgactctttgaggtgtgggattttacctgtttgggaaaatgaagactggaaatccctggttttcctatgctagctttattgattggtttgccattcttgtgatttttccttcttgccagagatagactactgtgcctcatctaatcacggatgtcagcacgagtgtgttaacacagatgattcctattcctgccactgcctgaaaggctttaccctgaatccagataagaaaacctgcagaagtaagttacagtgggagttggagaagggcttgttctgctaaatgctcctctagttagttttcctttccgtgcaaatcttaagcaagatgtgcttgtattcagcattgtgtctattaacattattctcccctttattttactttttggctcactagatcctattatgtggatgatttttaaatattgaataggtctggccattagattcaattagccaagtggacccaagctgaagctcccacctatgtgaaatgcaggtgcagtctccctcccccttattcccatagcattggggtcttggaaaaagaaaagaatgggcccagagatgagaggtagaaggagttggtttcttctactcctacaagataagacacttgacggatgctaagagggaggacattgcagctttattccctttgataggaaagaagaagaaaaatgagactctaggacatcccagcaatattcaaggggtacagggtgtcagcgggttgatattgtggatgtactgagtgcctcaaatgcctgtcatctagcacatcaaagggcatgattggggatctgagcacaggccccagagggcacctgcttaagacaaaccattcctgagagactgctagaatggacggcccacaaggacagagacgattatctttttctcgctgctgaattctcaaaagctcaaagagtgcttggcactcatagatgtgcacaatgtttgctgaatgggaatgagtaagtgaatctttctatgatgtatcatcctggagaaattgaagctattttttttttaattcttcaatcttgttagaaagatagccttttttaggcgtgcaagttgtgaattttttttcagaaagtctttccctagttagtccacacttatgcacactgaattgtttggggtctgctgacaatgtcattcgtagaactctctggagcttccattgagggatgtaattttctgtatgttccttcacccatttcttcctgatggtgtgtacagcagtgttctgcctggcaagactgcgttttgaaaggtttcacatatatcttttttgaaaagcaccatgagctatttaactgaatccagatgagtcacattctgctcatagcacagattaactttcatactcattctagcaagtgctaaactgtgtatagtggcagatggttgcaaatcctggattttgaaacggagcctgtcttataaaactattctcactgccttgtgagggtacaaaccctgcacacattcaagcattaaatgaaaattttaatggagagcattcagaatgtgaaaacaattagataagctatttttcataagaccacacatgcctgcaataggtcagagggccaacttttctggtctggccactcctctgtgctatttacaccttttgctaggagtgggtgtgtgagggactggctgcacccaggggaaatcactcccaggtggactcaaatttgcagacccaaagctcttcagtgggcggtgattagatctggttcagctcagatgctcattgcaagcttcctcatgtgttactaatggaggggaaaaaggaaacaagttaggcttggggccatgggcggaggacattttcttgacgttctgcatgtcttaccaaccatctgagtcccttaatttctgctactccctccacacccttcctggagaggcacttggaataagagaagatccaatgcaatgcaggcatcattatcatgggaaggagaagactgagaaaggaagagcgagtagagagggagtgaccgttttggagtggtctgagcgctacagattggtccccaggtgggcctgtttgcaagcaagctgtggccccgaccagagtccctaatgctcatccatgtatattcagtgggtatagcccctctttagccagggttcttactttttcatccaagaaaaatgaaatttgttcctaaaggccagtgtcctcatcagccctcgcccaacgtcccgcctcatcgttacattttccattgtctttgctgtgaacccaaccctgactcctgaggtcagcctgcaggagcggcccctgacttcatgcttgcactcagtccattagggcagacagctgtaaacggaagcgagtgctcactgtctctctggagcattatgtggatgaaggaagccaagaaattgggtttaaaaatctggagtccgttattagaagcctgaggtctcttgagtgatctgagcattacaaatcttcagcccaggatacagccatttacgtttaataggaggttgatggatgtgggtaattttcaaatctaatatgaaatctatttttaaaggaatttgatgtcatcgaaattaaactgggggaaaaaagatcaaggcagaatcctactgaagaaaagattcttggccaggatttgttcttgctcctcatctgggcacaatttctcctcatggagagtgctatcatcagtttaaggcatgaattattaaggcagtagtgcaaagcacagaaactgcgactgccttgcctgcccaggtagagccctagggccaaatcagatgtgggttcatcccctgtgctgggctccaggatccctgattctggtaccatgatgagtgctctcaaaaattggtgtgaagcccacgggttcgactgagccaagagacgtgacgtccaggcttggcaatgtcactcatattggttatgtgaccctgagcagctactttctacttctcaggacctggatttcctaaactgtaggaacaggacttcctgccttaacaccctgttgcctctccagtttttttgaaacttactatctgtgcactcagctggaatcaaaatgtactacctggggtcactgatctttcatggtttcagtcttacctgctcagggctccaactctttcacaagttagcactcagaaagatcgtttgatttgttttctgacagtcctgtcatctgacctcacagagctttagtggacactctgggccttaccagattaagttgtgtccatcctgtgggtgccatgtcagagcacctatcatggtaccagatataggatgcacagtaggtcctcaataaatatttagtgaatgaataagtgagtgagtgaatatctgagaagcacacacatgaggaaatatgacaaaagggtggtgagaaggcaaagagccactgttaaacgtctgctaaaaagaaccatttggagaaggtttttttttttttttttttccagacagaatctcattctattgcccaggctggagtgcagtggagcaatcttggctcactacaacctctgtctcccaggctcaggtgattgtctcacttcggcctccctagtagctgggactacaggcgtgcaccatcatgcctgactagtttttgtatttttagtagagacggggtttcaccatgttgtccaggctggtctcaaactcctggactcaagtgattctccctcctcagtctcccaaagtgctgggattacaggcatgagccaccacgcccagccgaaaagggtggtatttgaatagctgcctgccagattgctgggtgataacctctttaagaatctaaatggttttcagttgaattatctcatgtgtaaatcattctttaaaaaaaaaatcttgctgggcgcggtggctcacgcctgtaatcccagcactttgggaggccgaggcgggcggatcacaaggtcaggagatcgagaccatcctggctaacacggtgaaaccccgtctctactaaaaaatattaaaaaattagccgggcttggtggcgggcgcctgtagtcccaactgctcaggaggctgaggcaggagaatggcgtgaacctgggaggcggagcttgcagtgagccgagatcgtgccactgcactccagcctgggcgacagtgagactctgtctcaaaaaaaaaaaaaaaaaaaaaatcttgcttgaaacattatttactaatttattttaattttttaaaaatgtttttctttttatatttttattgtatgtgctgctgaagcgagagcttcagcatatttttttatatttttaaaattttaaaaatttttttttatatttttaaaattgttacaacatagttgtacctctttttggtatttatttattttttaaaattgacataaaaattgtatacttgtatacaatatgttgttttgcaatacgtaaatataaatttttcttaaagacaacattggcttttttagtgtggcaaaatatatataacataaaatgtaccattttaaccatttttaagtatctagtccagtggtattaagcacattcacattgttgtgcaaccatcaccaccttcaatctccagaacttcttcaccccaaactgagactctatacccattaaacaataattccccagctcctcctcctccatctcctggcagccaccaatctactttttgtctatgaatttgactattctaggtgcctcatataagtggaatcatagaatatttgtccttttgtaaccagcttatattgcttggcataatgtcttcaaggttcgttcagttgtaggacgtgtcagaatttccttcctttttaaggctgaataatattccattgtatctatacatcatcctttgtactcatcctttgatagatccctgggttgcttccaccttttgacttttatttattaatgcagctatgaacttgggtgtgtatacccagaaatggaattgctggatcatatggttaattctatatttaattttttgaggaaccgccatgctgttttccacagtggctgaatgctgggttttaaaaagagagttgactaaagatcatttcacctttccctgatggtgtaatggagtgattcctacaggcagtagactgcgggcccttcctgttctgtgtttgtctgtctgtctgtgactggtgttttattgccaggcctattttcctccatcaaagctcttggcttgtttcctggcactcagttatggcctgcacaggtgaggctgctgatgagtttcaggtagatgaatagaaactgcacacagctaacaatatcctgcctctcctcacatgggagtgagctccagagagagtgccaagggtcagtgacacagcaaggtgatgtcttttcttctacaccagccctgcatgttgtgaccttctctccatgcactctgtctgcagccattctgctcatactctgggcatgaagcaagctccagccaccagtcacctgggagggcacgtcacggattctttttttttttttttttttaattttttaatttttttaaagacggaatctcactctgtcacccaggctggaatacagtggcgcgatcttggctcactgcaacctccatctcctgggttctagcgatcctctcacctcagcttcccaagtagctgggactacagatatgtaccaccatgcctggctgatttttgtattgttagtagaggtgggctttcaccatgttggccaggctggtcttgaactcctgacctcaagtgatccatccgcctcagccttccaaagtgctgggatacaggcatgagccactgtgtccagccagatcctttaagagaccctttgaggggtccttcaggtctgggtcccattcacatttccatttttactagcagtggatcttgatcaagttattaacctcgctaaacctcaattcctcagctttgaaatatggataacaggccaggtgcggtggctcacgcctataatcccagcactttgggaggctgaggcgggtggatcacaaggtcaggagatcgagaccagcctggccaatatggtgaaaccccgtctctactaaatatataaaaattagccgggtgtggtagcgggcacctgtagtcccagctactcaggaggctgaggcaggagaattgcttgaacccaggaggcagaagttgcagtgagccgagatcacgccactgcactccagcctggatgacagagcgagactccgtctcaaaaaaaaaaaaaagaaatatggttaacaatcacacatatcttgcagggtcaaatgaagttatgtttgtaaagtggttggcacagcatctggcattcagcaggtatttaagaaatggcagcagctatgatgctatgattatcatcactaatgtaactatcagactgccactaatagtgagaaaaataaagatggcatggtccctgctcgtggaactcagtctagtgaaagaaacagactttgaagcatcacagatacaaaacatactacataaccattgtgatgaatgctacgaaagagaggtcctgtagaaagaactgacttcatctacgaggtcacaaaagatgacaaaatgatgttgagctgatcgtgaaggaagatagaggttagccagtgcagcaaggagccactgagacaagagggtgatgtgtcatatctttaagtgatttgtggatgtgagcttcgtcaaataacttttgggcagatacatggtaaaaataaaatctagtcattactttatgatttcagatcatttcccctgtatcagttatggtgctttttgttcacacaaaaccggaaatccaattaatggtgttttaagtcagaaggacttttattttttacctgacaagtccaaaggtggttggtcctatggatggctcagtgactcagtgatattatcaagaacccagactctttctgtctttctattctggcaaagtatgttgcatttacattttcatccttgtcacctcttggttacaagatggttgctgcagctaccagcatcatatccttacactacaagactcaaaggcagaaaggacagagagcagagaaaagcatttctctttatacacttttgtcttttttttttttttttttttgagacagagtctcactctgttgcccaggctggagtgcagtggcacaatctcagctcactgcaacctctgcctcctgggttcaagcgattctcatgcctcaggctcccaagtagctgggattgcagacgcatgccaccatgcccagctaattttgtttttttgtttgtttgtttttagtagaggtggggtttcaccatgttagccaggctggtcttgaactcctggcctcaagtgatctgcccaccttggccttccaaagtgctgggattacaggcatgagccactgtgcctggccacctttgtcttttcaggaagaaaaatctttcttgagggcccccagtaagcttcttatgtttcattggtcagaactagggcatattcccaccccttgaccaatgactgacaaagaagaacatggttgccacgctggcttagaccagccatgactcatgcttgggggtcatggggtaatggttattggcaagacaaccaacagtgtctgccacatccccagaaaaagaacaatgctgtgcagttaaactgatccagcccagccaatgaggtcggtggtgaccttttcccgcaacaccagtctcataaagcctctccacaagctcattttgtgtccttttccagttctctatcttccctggagcctgctatgtgtggggtcttatggctttagcattttctaccaggaaaggaattgcttattggctcctggttatgacacagtttccatctgctggcagaaacacagcatggatagagtgaccttaccataggacagaattgcagtagcctggggcagcatcagagatacgcctcctccagtcccacgatactatgccagcgtggtctcaacagagcaaggcgaagcatttagatccttcttcatgaaactgccaacccctgcgtccctaaatagctggatattttgcaagatcaccttttgtttattttgccttgtgccgtccaatgtcactgtcagatgtcactgtagacagaagctctctacatgctttgagcccaagtgatcaggttaacctgagagagatactggattttcttagcttttccatctttcttggaaggaggtaggctggggagcgtggctctcaccccagctctcagctctttggccactgactcagttcagctcagctcaactgagccttggcttgctctttggccatcaaagagggaaaatgctggagaatccacaggtatacttcaggtgccaggccctcttttaaacaagctcctggagagcaggagctattttctctgtgtcctgtagctcacctggtttcctgaagatttagtgaagtttgcctgcctttccacctctactgcaaagtcttcttcaagacataaccctggccttgtcacctccaccaacattctcacctctagtcacctgtttagagccttcactgatccatcctggggcttgcaaagcccgcacgtccagtcatgctcaggtgggccagctccctctgcctcccagcctcatctctctcctcacactccagccatactcagctcctcacagctccccaggcatgcccctcgccctcatccccaggcatttgtgttcactgtcccctcatccctgggcgtttgtgttcactgtcccctcatccccgggcatttgtgttcaccgtcccctcatccccgggcatttgtgttcactgttccctcatccccaagcacttgtgttttttgtctcctcaccctcaggtgtttgcgtttgctgtcctcgagtcctcatgttcttcttcctgttgagctcccttacctatggaactcctcctcctccctggggcctcctgttggccttatctcttcttggaagaccctctcaccccaggactcagtgaggcccctgctctgtgctctgcattgtcttttagttgctgtccttgtctgactcctcaccagagcctgaacccattgaggcagggcctccatctcagtcgtcattaaatctctgaatctagctcaaggcctggcacttggctggcagacaaacgaatgaatgatccgtcccggcttgcctcagcaggcagcacccaccagccctctccatgggggctcatgggagccccgaggggctgccatcagccctgggagaggtccagagtctgaaggaaggtctgcccttcttcccctcagggatcaactactgtgcactgaacaaaccgggctgtgagcatgagtgcgtcaacatggaggagagctactactgccgctgccaccgtggctacactctggaccccaatggcaaaacctgcagccgtgagtgtaccctaggggtggggtgctgatggaaggtggggtccactcatgggggcgggcgggttcactagcaaccagttatttctggagcccaccgggtttcctgatggtctgtcaggtgtatccttccttatcctcagtttcatcacccatagaatgtgactattaatgctatcggcctagccaacttgggttgcaaggattaaaagaattaataggaataggctgggcgcggtggctcacgcctgtaatcccagcacagggaggccaaggcgggcagatcacctgaggtcaggagttcaagaccagcctggccaacatggtgaaaccctatctctactaaaaatacaaaaaattagctgggtgtggtggtgggtgcctataatcccagctactcgggaggctgaagcaggagaattactcgaacctaggaggcagaggtgcagtgagctgagattgcgccattgcactccaacctgggcgacaaagcaaaacttcatctcaaaaaaaaaaaaaaaagaataggagtaaaatacttagaacagcactgctaggcataagcactcaataaatgttaactaatattagtatttgctgttaagtgtatttactaggtcagacaggtctaatttcaaatccaacctctcccacctactagatgtgtgtgaacttgggcaagttatttaacttctccatgctttgatttcccatttatgacaaaaagcaaaactaatagtcgtattattcccacagggtttttatagggagaaataggagccattttgatatgttagcctggtgcctggcacagggtaaacttccaatcaaggggaactgttcctatcatggagcctgtgagaggggccagtgcctggcgccagactgggacaagaggccggaggggacagaccttggaaagcaatgggctgcagaggctgatctgagagcagaatcaagaaacatgggattttctgagaaggcttgtcttaattttcttgtgtcagagccacaacaaagctccactgggtgatgtaaatgtatgggaacttgcaagctctgccagctgggcggctccatggttttttatgaggcaccatctccacgggtcctggccagcaggataggagcgcctgagtgtggtgatggaccctatgcccttggcatgcgggagagggggcccatctccatgacatggcctatgcagaaggggccctttatgtgcctttccactcagcaagccccacatctgctccctttggagaaagagatagattgtgagtgaggacagtgcagctgttgagccctgggctccacgctgccagcagggaagtttcccagatgaaataagaggtccagggcagtcctcaggaaagcgtggctcctccagtgtccagagagaacaaagtgcccggtaaaggctttctaaggactgatctcagaggccaaagggcttttgaactggaaagtggtgccaaagtcagtgcctgctgtacgttgcctctgcatgtctctgagtccttttgagaggccagcggggagcgggtctcccattcaacaggagatgccctggtgaccatggatctgtgtgtatcctgcctgtttcccggagtgtcaggtctgccagctgatggccctggcaattttcccagggcaggtggtcctgacctggctgagcccacgcagatcaccagggacatggcttgactgcccctcccagcatgcttccgggggccagaagagctctaagaacggaccacaagagatcgggaccctcccttctctctgggatctagtcaactctaagaaagtacaaaccaagctgtttctgtctcgcagtccttagagaaagccacaggcttctgctttctcagaggaatcagggagcccaggccataaagacagcaagcaattctgaggcgctcactctgtgcaggcaatgccctgagcacttcccatgcataaactccctgcatcctcacagccgccctactgggcacccacattcttgtcgctatttaaacaagggcaaactgtgacacaaagggattaagtcactgtcctggggtcctgtgattaacaaatggcaacactaggatgtgaacacaggcatgtagctcccaagatccagcaagtgttcgcaggagatgcatccaccagtggaatgttctggaaggcactggtcccagactctgcgggagtcaagaggcccacttggcagacctgcaccaggcctccagtgtctgtccagtctctggaggtgcattttctccataagggaaacctgggaagcagcctgcagggctgttagtgggagctgttcaccacagctgtgtgttcattagccttcggcacttgctgcccggaggaccagctgtgcagcattcggatgccaggataggccacacatgcagtcccaggctttggtttgttttttaatctggatgtcctgataatgggggtaaaaaaaatagaaattgatttcatggagaatgacaactctttttcattttcaattagaaatgaaactatatgactaattcttactcagcactacttgataataatagtgtgttcattaagtggttgctgtatgctagctactgttctgagcgctttacataatcaacccctcttattctcaccctattcctataagaaagcaaccatcaacatccacattcacaaatcaggaaacgatggcaaagaggccgtgggactgcccagcatccatagctaggaagtggcagaggtgtgatttgaacccaggtagtttgatgccagaacctgcattctaagcactactctattagctgtgtggctttgatcttgaccttcctgagcctcactttcctctctgtgaaatgggaattgcacctgctctcagaggtgccctgagactgtggattctgtgcgccatggccctggcagagtgctgctgtcgtcaacaccagggacagcattccccagccattggagttgtatgctttacccttcaaagaaagaaatgggaaagaaggctgggcatggtgtcaggcacctgtaaccccagctagctactctggaggctggggcaggagaatcgcttgaatccaggaggtggaggttgcagtgagccgagatctcgccactgcactccagcctgggtgaaaagggaaagaaaaccaacaagccaggctgattttctagagggatcagtgatgtggggtagaatgacaccttccctgtggcttgttatgcctccggttttgtttttgaatcttggttgctggtggggtattgccccctcggctcctctatgctttcgcgtgtgtgaaaatgcaggagtggaccactgtgcacagcaggaccatggctgtgagcagctgtgtctgaacacggaggattccttcgtctgccagtgctcagaaggcttcctcatcaacgaggacctcaagacctgctcccgtgagtccctccgcgctcctctcataggggaaggtttgcaccaggagtgaaacctatgtgactgcagagggcacaggttgtacttgggcacccctcccctgccccttgctctgctccaggagatagtgaggatgtccactgggactgcatgccttcgagggagggcggggtgagcatgacggtcacttgatccaatcactgtcgcccagaggtctcactgataaagggctgcctggcttttggttttgcaggggtggattactgcctgctgagtgaccatggttgtgaatactcctgtgtcaacatggacagatcctttgcctgtcagtgtcctgagggacacgtgctccgcagcgatgggaagacgtgtgcaagtaagtgtctgaaggacaagcaggacctgcacaggtgttccgtgggtgccggtgtgggtgcgctgccgacgtgtatatgtgcctgtgtgtcctgtctccaggctttgctgggcctgcatgaatgtgtgtgacagcatctcttagccattaagccttggtggctgcttcaccaactcccctcaatcttccttcccccgtgccctgaagtggctttttgctgtttccacctccctgtcattctgaagctggacagagcccttgtcctcagctctctctgctctacccccagccagctagtatggcacatgaataataataatgtggacccctcactgactgctagctgcatgctgggcactgtgctaagcacacatgctgttgcattcaggggacagatgaggaaaaactgtagctcagattaagtaaagagcctaaggtcaccagctagtgagtggtgggttcaaactctgctggctgtgattccaaagtcagtcctgggagaagaggatgctcctgagaaacgctttgccctgctttctgaccccggtgatctcacagcacatggtgaggctggcagtgatgtgtcctgggtacatatttccttgcagctggtcccaaatcttgtctcaattaaaaaaaaaaaaattgctcccagacctccttctctcctttactgaagaatgctggtgtgtttgttgccctgaaatcctgtttcgaagtggaccaagataaagaatcgaaatatggtcattttgagagaaggaatcagaaatgaaagaaaaggaccaccatttatcttccccagcctgctggtctttctggttatagggccaagttccctgaccactggtataattgtaggcacaacctaatttatccactttttatatcatctattcatctaggcagatgagctggctgcacagctgggcgtgcctctctatgctgcctgtgagaaaatatttccagtttgggacagatccttggatcttagcaaatgggttatccatgttatagctttcggtggctccctgcccagctgcctcccagactgctgctgcagccagctcagggagggatcgggcacagggggtgcagaaagagggtgggtgtgttgaactgcatcgacattgacagcatgccaaagccagatgtaaggggtttgttggtttgtttaattctccatcattttagattattctgagaataagaggagtcattcttctgtccacctcgttcctgtaataatcaagaactgactacaagatggttgtaggaccctacgaaattctcatgagcccttctaaacaaatgcagctccatctcctttgaatcaggtgccccttcctctcccctgcccaggtccacatctggattttgacctgaccacttttaagtgttgcccattttctcatttaaagtgggtttctaaccaatggcacagtggaaccatctacatgagtaaatgtccaacaatgcaatgaatagtgaattttgttatttatatgtggttgtatctagatgagaacttgtgagatagtcagataagtgagaattgtcctcaggaaccgtataggagagatgcatttcacccaccagctgatacatatgcattgagctattcccctaattgaagactttctgcctgtcccagaatgattcattctgactgtcctgtcctgtaataatgggctaggttttcagcgtggccacagctaactgggggttgggatgtgtgttccccagctctactctcaatgacaaagggccagacgacatgactgcacctatttggtaaagccttttggggggcagtcaggcctggctcagcagataagagtgtccttggctctttatagaggcagcctccacttagagctttgatagcaagtggtcttaagaatgtgtcactcaccttctggaaagttctctgaagtgtggaggggttccaggggccctgggatgagatgggcactgctgtgcccctacctcttcaggcaccttgggttctctggcctctggagcgatgtcccctcccttcctccagccccctgaccgcaagctctgctttcccagattttccccagaggcctttttgcctcgggcagttagatgcacagactcagggtgtggggggtcggggaggggatggggcgatctcttttaccagctgcagctgcgcagactccttccctctctagacgtttccctgagattgaccttgtgcaagggcatcccagcaccaagaaagactctataggcctgatgtgcatggaccacactgcccactggcctgcaagctcctggaggttggaggtcagaggccaacatgaaatgactgggagcgtgaatggacagaggccacctgtctttttgccccacggcccctggcacagggtccgctccccgcttgataaccttcagtggctctccactgtctcccagaataaatttccattgcactccttgatttggcagagtgcagaaccccctcttccacttctttagcctcaccccaggccctccctgaagccgcctcctgttctttagccaaagtggcaagtcccccattctctgaacaggcctggtgccttccagcccatcccaatgtcacccccatgggtaacctcctctcccacctgataggctctcctctcctcctcccaccccaggctctgctggggcctctctgcagagctctcctgcccagcctcaccctggggctctctgtgcacatgtctgagaaacagtgtggcagagcagaaagagtactgaactggaagcccaaagactgggtttaaatcgtgtcgcttctaccctaggcaagggaattggccctcttggggtctgactgctcatctctaaactgagaatggtcgttgctgcctttcaaggccactgtgtggttcagggagactgctgttgcagtgctatgtgaacttgtggactgccgtgacccctaaggaattcctcttcctctctcccctcccagcatcagaaccccctgcactgaggagactcagaaggtattgctgcctggaaacccatctgccagggccaggcctgctctccttggaggggccccagagacacacaactctggaagtgggctggactcaggagtccaagggctgtcctatgagggaccctcccttctgcaagcggaggacaccaacggggatcagagccgtcagcctagggcactgggggatctctgctggtgatactcccagtccaactaccacaggcagatctgcgagggcctgttaggctgcctgaggccctgagcttggccttccagggctgaggcaggcctaggcgaggctaggggagtgtcttagtctactcgggctcccatcacaaaataccatagactgaatgttgtttcttaaccacagaaatttctttctcacagttctggaggctggaagtccaggatccaggtgctggcatggctgggttctggtgagggccctcttcttggtttgcagacagccagcacccagctgtgtcctcatattgcatgggttgtagggggtgagagagcaaaagagtgcaggcaagttctctggtgtctcttcttataagaacactaatcctatcaggtcaggatcctgccctcacaaccccatctaaacctaattacctcccaaagactccacctctgaataccctcacatcagggttagggattcagatgtaaattttgggggaaacagtctgtagcagggagtagggggaggggaccaccctcactctcatgtattcacattacaggcttgatgcaacagaaggaaactagagattttcccttattttgtgggaaacggacacatggaggaaagtgatgcctccaagctggccctggtcggggagtcagtggcagagccaggaccagagccgagtcccctgattttaggatcttttgcccagtgtgagatgccctggaaaagcacatctcagttcagctgcttcttggtttgtctgagaaaaagcctatattaagttagcaaaggattggctgctgctagttttattacgagaaaagccaggaagcagtgtaattctatctgtcggcttctggttactgtcttggcagatggccactgtggctttctctctctggggttggggttggttttaacaacgtcttatgtggagccccagacgcaggattgctgtctgtcatcacggcagaggtgcaagtccacagaacacgttgccccactgttgctgcgccacagacttacgtgactcacctgtgtcagcgtgcagggctgctagacagggaccctaaagacccgtgctacatcctaaaacttctaatcatcctgagcacacgctgcagaatccattcacgatgagggtttaattaaacacataggcctgggtccttatgtgtaaaaggaggagaatccttctttgagaggaaaaatgttttctttctccctcttgagatttcttacatcctcccacctatttcacttaagtgatggctcctaatggagtctgtctttactctcctctctgggtttgaatctaggtacttccttaagcgcttggttcctttaccctcgttctctacaaatatttactgtgtacctgcattgtgcggggtgctggggatctctggggttgatgcagattcggtttgtgccctgacagtgtttaaagcttctcggggaagaaggatagcagagacagcgtccattccttatggtgagagtggtgatgtgagaaggatggagccgtgggagcaccccctagtctagagaaagagaagtttaatccaacacccagaggagggggctgtgggagcctcccctagtctagagaaagatgtttaatccgacacccagagagtgagtacagtgagccagccagagatggaggggaaatgcttcactaggggccagagagcgaactgcaggaagttctgtgctctgagtacggggtactgaatgcgagagggaggcggtgggtgagaaacgagcctggggacgccggcgggacacatcacccacctacagccttcagagacttcctggctggcctctcttgagaaaatgatttttgtctagtttgtcttctgagaatctgccaggctgcctcagcacactcccttaagctaggatgatctgtggatgtgcagctggaccagggacacggaggtctatttgaatatagtcccatctctgcccccaggacagctaagaccagtcacctctgaaggttcagggacattgggaaagtcacttcccctctgaccatcagttttctcatctttaatgaaggggttggactagttcatatccaatgagttgaacttccagcacccaaacaaggatattgcctggctcagataagtgctccgtaaacacttgctgaatgaatggacttactgtggtgcccaccatagtctcccaggctgaagacacccagtggtactgagtcaggggtggtggctctgtttgcctgttaggggaccactgaagcattttcctataggggagtatctttgccctgggtagaaactgactccaagttggtttccagacttggtggatagaaagctagcgcctatggtcaggaggttaactatcatccacctttggcattctctaatttcccatccacggttctttgaatttataagtggcccagaacatccctgaagggcagaaactggacattttgctgaacaaatgtgagtcgtgcattttgcaaggtgggtgtgtgggagagagtgggaagcctagctggccacaaacatccacacatcccatggggttcttatttaaaacatctgcacaaaacccctgtgaggtggatctaattaccctcaattttcagaatagcaaactgaggaaatgtttccttttgttcaacaggtctttcctagggatctgttaggtgccaggcattatggccactgccaacatctcacctctgatgattcgttgaaatcatctatggggctaggaaaaagtctaaaggcccaggcagcatcccagaaaccctgaatcagaaacagaaacagagactgtcttacattgttggtgagagtagagattgaaataatctctttggaggatgacttggaaatatttatctgcctttaagtattcataccctttacctaggcaattctgcttctggatgtgtaactttcaggtatgccttcacattgtacataaaactacatgcacaagaatatccattgcagataaggtgtggtggctcatgcctgtaatcccagcactttgggaggctgaagcgggaggatcacttgaggccagaaatttaagaccagcctgggcaacatagtgggaccccatctcaacaaaaaatatgaaaattagctaagcatggtggcatgcacctgtagtcccagctactcaggaggctaaggtgggaggatcacatgagcccaagagccaaggctgcagtgaactgcgatgacaccactgcactccagcctgggcgacagagcaagcctgtgtctcaaaaaaaagaaaaaaaagagccttagctgaagctaggaggacaggactgggcacaagggaagctccaggaaggaagggcttaggggtctgtctggattatggcttgacaaggttgacgtgaaagagctatagctattttattaccatggaaaatggagtagtagtagtattataaattcacggtagggggaaaaaaaaacacctcacctccatggccatccagttgtctatatcatggatcactcaactctactttccactcttacaccatgtgaggaactatcccaaaccatcaggaaatgttctgcattaatagtgagtctagaatttgctgagaaaagcaagtcatgctcagggcaaacaggagggtccaactcggctttgagcctcctctgcagctgtaattgcagttatcaaacttttcccattcttcaaagattttggcagtgcttctccccaaagaaattcccttcacatttgaaagcttgctgtagaatatagcaatgtagtatagtcagaaaatacggggatttatttataagattacaatttttgtctggttctttctcttgttaacaattggtcttgacaagccatcagccttcccaacccttagtttccctagctggtgagtgagaataacaacagctgccttaactaacccaaaggtggttctgaggagtcctctccagagagatactgcaaagatgctttaccaaaaaaagtgtgtggtttgtgcctgattataaaggtcattatgtgctttggggcctttatttaataattccgattcatgtccattttagaaattctactcaatctgaaaggattgagttaactttcagaaatatgtagggttcttataaaaagtcaccactcacctatcctcagtattaagcttttaaagtaacagcctggttttcacaggttcacaaaccttctagtcccccagaagccacccagccctgtaagatggcaatgccatccttcagttgctcagtccagcaacctgggagtcttccttgactcttctgtcctatccatatgggctctttgtattaatccatgaacaaattttatagattctaccttaaaatacagccagtctgaccacttctcaccagcctggtctgggccaccaagatctttgcacagggctgctcccaggtgtccaagctccattctgtgcagagcgatcctttaaaaacaaacccatatcatgccactccactgctcaaaacactgcagtgactgcccttctctttcagatctgacccccactgtgaaccccacatggtctgccccagccaaccttgctggcctcatcccctgccaggctcccggatgctccagtcacagtggtctccttgcctttcctgaaacacaccaaccaagcagctcccgttgctgcagtttgcaaatgctgttctttcttgctgataatgctctttcccagacaccaccactcacttcctgtctttctgcagggctctgctcagtgtcaccatatctgacacaccatataatataacaagccctccctactctccagcccagtagccactctccatccttctatcctgctcttcctccatagcactttttcccacatgacatatcacatatttgtctgttttccacgcatccctcttctcctgacacctgctgccaaatgtaagcttcacaaaagcagaaactttgtttcgttcattgctatatccccagagtctaaaacagtgcctggctcattgcagggactcacaaaatatttgtgaactgactgaatacatgaatgaattggttacctaagtgtaatatatacatacatacataagtagatatgtaaataagttgatattatagttacataatagccagttaggttaatcttattttctaatatttacaagtaatttatctctcattctgtaacttgtattctcatgttttttgttcatttttcttgtggagatgatttatattgtttgatttttatgtgccatgtgtatattaagaatttttgctcactttgggagtccgaggtgggtggattgcttgagcccaggaattcgagaccagcctgggcaacatggtgaaatcccgtctccacaaaaaattagcctggtgtggtggtgcacgcttgtagtcccagctatctgggaggctgagatgggaggatcacttgagcccgggaggcagaggctgcagtgagttgagatcacgccaccacactccagcctggatgacagagtgagaccctttctcaaaaaagaatttttgctcatagacatgctttatattctgaaatgtgtactgtaggataaggcactgttttaattcaaagtgtctgaaatgtcttttatgattgaataagccactaatatatgagtcattttcttcttctgtttctctaattcccatttgattctcagaattggactcttgtgctctgggggaccacggttgtgaacattcgtgtgtaagcagtgaagattcgtttgtgtgccagtgctttgaaggttatatactccgtgaagatggaaaaacctgcagaagtaagtttgtactggagctggctcctactactatgccagaccactgtgtgaaatcgctatccttatctctgtatatatcagttcctctcagaagtcaatgccacacagcaaaatgtaatgtagtgtcctggataggaccctgaaagagaaaatggacattagggaaaaaataagtaaatgtcaataaaatatagactttagttaataatcatgtatcagtatgggtttatcaataataacaaatggaccatactcatgtgagttgttaataatagggaaaactaggtgtggggtatattgcaattctttgcgctatcttctcaatttttgcgtaaatctaaaactgtcctaaataataaagtctattaaaaaaatggacaaacaaaaaaagtcaatgccagagctactactgaagttcttcacttatatgctctgtggcaagaaacagtggtttggcagtatactctagtggaaagatggacagtcagaaatccaagattcagtcaacctctgtctctgccatttattagctgggaaagttgcctaacttctctaagcctctctgcttatttatctttaataatgttgttgttgttatttctggtagcacaaatccctcccaaagggcaccttgtgatgaagccagttttgcctttcagaaggcaaagcctcttagatggggctgcagccagccagcccaggacaagcagccttagagtgaattgctggtgtaaatctcaagacacatctctgaataatcaaaggggagtgtgtgaccctggtttccatccatatcagttatctttttctcaacgtctcaaagcactttataaagagcaactcatgttgacacttttggaagaaaagatgggtaactggaataattactctctcattttttggacagcacagctaagactccaagaagttaagtgattctcctaagtcatacactatgttaggcacaaagccaaagttagatttcagtgctgctaatctaaattgaggtttaacctcctaaggaatcatatcaagtgtttccattctgatatcagaaactatgtctacagaaagttgatgatggactgcattttaacactaaagtagtgctggtgaacgatgatggtgaagacagtgaaacagtttgaagggttagcccgaattagagccgctaaactttgttctcaattgtaacttcctgccccatggaccactgagctcaggtggcagatagaatccagtagctgactccagtggatgggtcctccaaggtgaagtccatgtgaaatgtatgttgttgaaattgttgtaacttgctctcctgtcttcagggaaagatgtctgccaagctatagaccatggctgtgaacacatttgtgtgaacagtgatgactcatacacgtgcgagtgcttggagggattccggctcgctgaggatgggaaacgctgccgaagtaagtagcctcgaggtggagaagaacttttccctctgtggactcagacagttagagaagttcatttaatccttaaagtcctcctttattaccactgtcacaagtgtcagttcctgccttgggtgctctgaaagtgtttagctagagatcagttcagtagccccttgctttttcgggaatttctcagtcaaggcctgagttttgggttctttgcttctcttcattttctgccagccatcagccctttccacagtagctgtgtgggtgcccggaaactcgcacagtgctagtcactggactgaattagaacctctgccagcaatcactacaaggactgaaggttaattacagagctttctcctcttggcagaccgtaaaagtaagggcaaagggtgaaagggtgtattcgtccattttcacactgccgataaagacatacccgagactgggcaatttacaaaagaaagaggtttgatggactcacagttccacttggctggagaggcctcaaaatcatggcagaaggtgacgggcacatctcacatggtggcagacaagagaagagaacttgtgcagggaaaccccctttataaaaccatcagatcttgtggagacttattcacaatcagaatagcacaggaaagccccgtccccatgattcaattacctcccaccaggtgcctcccacaacacgtgggaattgtgggaactacaattcaagatgacatttgggtgggacacagccaaaccatatcagagggatttcctgtgggttttttctattatttttatcatttgcttctataggtcacccagaacaggctctgagagtttcgttagaaggtgtattccccagagttctccagagaaacagaccttctctatgtatatcttcatcttctattatatataaatataatagaagacatatatataatatatatatgtcttctatggtctgttctatcttctatttatatatatcatagaagatatatatatatacacacacatatatatgtgtgtgatgtatatatgtatactatggtctgtttctatcttctattaatatatcatctccacaggaaaaatggacatacacacacacacacacaaacacacatatattgtgagggaggaaaagattggttgattttaagggattggctcacacaattgtcaggggctggcaagttctaaatctgtagggcagcctggagacccaggcaagagctgatgctgcagcccaagtctgaaggcagtctggatgcagaattcccttttcctctgaggacctcagtctttttctctttaggccttcaagtgattggatgaggcccatctacattatagagggtgatctgatctgcttcactcaaagtctactgattaaatgttaattgcatctaaaaattagctcacagcatcatttagactggtgtttgaccaaacaactgggcactatagcctagccaaagtgacacatcaaattaaccttcacagtacccaaaggaacagagggatgtcatacgagctcagtgaggtgggcattaggagagtacagagcagggatttttccccaccatgagattctgagctggtaattccctattttggggggaggggtggttgacaaagtctacttgcttttgtgacactttgccccagtgggcaaaataaccctttttcaattaagtcaaaataagttcagttgctttgaggttgatttttgggaatttcctcacagactcctttgagataactggggatattccacaagccaacaaggctgggttggagggatctcaatacctcgcttcttcctccaggaagagggactcctacctttagcaagaagttctgtgtgaatgactgacacctaggatgcctgtggtaccctggcctaactctgcagggattcccctcacaactgcaggtccagcttcacactgcagtggccctcttgtggagattttgtctataattctgcccattgtgcctgtctgcactgcttgttcatgcttttctttttgtttgtttttgttttgagacagggtctcactctgtcacccaggctggagtgcagtggcactatcttagctcactgtaatctccacctcctgggctcaagcgatcttcccacctcagcctcctgagtagctgggactacaagcgtgcaccaccacacccggttaatttttgtattttttgtagagacatggtttcaccatgttgcccaggctggtcttgaacacctgagctcaagaaatctgcctgcctcggcctcccaaagtgttgggattacaggtgtgaaccaccatgcccagccctcatgcttttctttctgcaaacatctgcacactcacacacacactgtttattcattcaacacatttattgctcagtaaattgaacacaaggtacaacttctacctctggaatttgatcctaaatcagatttcaccattcctgcttcctagagggatgtgttctcactgattccaattttgtgtgaagcctctccttttaaggggtaatgacaggaaagagccataggctctcatgctatggaggagcactcgggagacagctgtgtcatcaacctgccagatgaccgtgggcagcagtgaagctctctgaggatctaattcttcattgataccttgagaataattatccctgtcttccttgtctcacagggtgttgtgagggttaaagggctgtaagtacttcgaagagtttaaattacctcacacatgagaaatgttcattagacaatctgaactggagtgtttgggatgtctgtggcaaaagaaattagaagctaaagcacatctaataataggatagtaagtcaaggacacctaatcacccatcgtaccattcagactcatgggagctagagctttctgagaggagctttttccccatcctgagtatgagactgcaaaagacattatgaaggaggtttgaagagaggtgtattttctttaaaagagattacttccacaatctctactcacatgactattcaattcacctcatttctacactgatgggattgttcaactccctacattttcctcagggaaggatgtctgcaaatcaacccaccatggctgcgaacacatttgtgttaataatgggaattcctacatctgcaaatgctcagagggatttgttctagctgaggacggaagacggtgcaagagtaagtgatctgaacttggctctctgctttaattttgttttggagcaactgctttttggagtattttcaggcaacaaatccctcacctctgcttctcccataaatataaatgcatatgcacaaatacagaatggggaagagagggcttaactgcagcacctgtgaaaacactttcggttttaattgacagtaaattcattatcagccaagaggctagggtgatcgtaggctgaacagcaatgtctgcatgagggaggtggagagagctgtgctctgctctgtgctggagaattacattcagttctgggcatggtactttaggaaaaaagagatggatcaacagtttaaacataaaaaaaaaaaaaacacaaaagagcaaaaggagtcttgagagaattattttttaatctgagagtagagaagatctttctaaacatgacatgaaatttaaaagccataaaagaaaaacaaaggaaaatatctagtaagagagtaaagctgtgatacctttttttaacctattagttaacctattagttaccagagatcaaaaagtttgattccttatgttggcaaaggtatattgtagtagggaattataaatggatcagtgagtgtctgaattggtataacctttcagagggcaatttggcaatgttatcaatccagttctagaagtttatcttacagatacgtgcatgtttacaaagccatgtatacaaggatattttatacagcactatttgtagcagcaaaaaactggaaacaagctaaatgatcacccatgagcctggctgaataaattaaggcacatctatgtaataaaacatgatgcagctgttaaaacaacaagcagctctggatgtatccccaagatattttaagagaaaaaagcatggtgctgaatgttttttatagtatgttaccatcgatatattttgtaaaacactctaacatacagtctctctttctctatatatgtgtgtgtgtgtgtaccattatatacatatctaatgtgtatacccttatgcacacacacacacacacacacatacacacaccctttttctaatatttaagttttgttccaaatgcatgtattattttttagaaaaaaataagataaacacgatttagaaagaattaagcagcatgatcttgtgaggaagttcagtattatgttaagcagaaaaaaattaggaaactggggatctttgtagaaaaaaattttgaggtaccaaataccaatgtgactgtcatctcactcatgatttgtatgatacccccaccccaccccaccctaccctggaaagaaaggacacttggagaagctacagcttagcacgaggacaaagaagctttctaccagggaagctgcatgcctaattagttcagagcataagcttcagctcagacagatctggatttgaaccctgattcatactacccgtgtgaccttggtcaaattatttaatctcggccgggcgctatggctaacgcctgtaatcccagcactttgggaggccaagacgggcagatcacctgagatcaggagttcgagaccagcctggccaacatgacaaaactctgtctctactaaaaatataaaaattagccaggcgtggtggcacgcatctataatcccagctactcaagaggctgaggcaggagaattgcttgaacctgggaggcggaggttgcagtgagctgagattgctccactgctctctagcctgggcaacagaggaagactccgtctcaaaataaataaataaataaaataaataaaatacaaaaattagccgggtgtggtggcatgcacctataatcccagctacttgagaggctgaggccaggagatggaagttgcagtgggccgagatcgtgccactgcactccagccagggtgacagagcaaggctctgtctcaaaaaaacaaataaacaaacaaaaattatataaactctttgagtcccagtttccccatctataaaataaggataataactcacaaagccatcacaaggaatacattagatcgtgtatccaaaggtgctgaacagccgggtgttgtggctcacacctgtaatcccagcaccttgggaagctgtggtgggaggattgcttgagctcaggagttcaagaccagcctgggcaacatggtgaaaccctgtctctacaaaaattagaaaaattagctggttgtggtggtacgtggctgtggtcccagctactagggaggctgaggtgggaggatcacctgagtgcaggaggttgaggctacagtgagttgtgattgtgccacttcactctagcctgggtgacacagcaagaccttgtctcaaaaaaaatttttttaataaaaaataaataaaggtgttgagcccagtgctcacacacactaagtgctcaaaaaatgatcactattacgattcacaatagtaaagacatggaatcaacccaaaatgcccatcaatgatagactggataaagaaaatgtgatacatatacaccatggaatactatgcggccataaaaagaaatgaggtcatgtcctttgcagggacatggatggaactggaagccattatcctcagcaaactaacacagaaacagaaaaccaaacactgcatgttctcagttataagtgggagctgaacaatgagaacacatggacacagggaggggaacaacacacaccggggcctgttgggggtagtcgggagtgagaacatcaagataaaaagctaatgcatgtggggcttaatacctaagtgatgggctgataggtgcggcaaaccaccatggcacacatttgcctatgtaacaaacctgcacgtcctgcagatgtatcctagagcttaaaataaaattaaatttaaaaaacaacagacaggccaggtgtggtggctcatgcctttaatcccggcaccttgagaggccgaagcgggcggatcacctgaggtcaggagttcaagaccagcctggccaacatggagaaaccctgtctctactaaaaatacaaaaagtgtccaggtatggtagcgtgtgcctgtggctctagctacttgggaggctgagacaggagaatcacttgaacccaggaggtggaggcagcagtgagccaagatcgcaccactgcactccagcctgggcgagagagcgagatgccatctcaaacaacaacaacaacaacaacaaacaaacaaaatgatcactattgtaatcatcaacagcagaggtgtccaaagatggggctttcgtggtaaggtgacaaattcctcatcaggagaggcattgaggcccaggccgaatggtcactgggtgaggatgctgtaaagaggatgtaagcaacagcagggctggagtagatgatctttaaagggcttatccatgcctgaagttctagaactttctgaaaattacgttctgaaagcaagtcacagctccattccagtcttatcaacttaactaccaaaaagaaaatgcccaagaaaagtgggaattaacctctggcaaaaaaatagtctaataagtggggctgtccttcctgtgtctgaaagcaaatacctgggccctgctctccctgatgcttttccactctactttgttttgtgtttcctggagaagccttctggatgccattctatgtgtgggggttgcaagtgctagttttgttctgtaagaaaaatgtgtacagaaaggaggagaaaacagactcactgctggaaaattatttcagtatttttgaaatctgctgaagagccacatgcatgctgcctgagtctttttttggttcactcaggaacagactatgaatgtaaatgaagctttgagttggccttttcctctttcactaataaaagatcgataggttgagtgatgaggaaaagcacttaatggagaaacagaagaacccaatcccccaacatgtgcgcactcacgcacacacacacacacacaccacacacactatgacgttaagcattttatactggccaggcatagaaatggttttgcatgtgtgtgtctctacatgcttatattgttgtgcctcacttttaaagattagacagctgcttgatatataaaacagaatgtttatcacagattgtggattgtttgaaatgagatcatctggcccagcacggtggctcacgcctgtaatcccaacattttggaggccgaggtgggtggatcacaaggtcaggagttcgaaatcagcttggccaagatggtgaaaccccgtctctactaaaaatacaaaaattagccaggcatggtggcatgtgcctgtaatcccagctacttgggaggctgaggcaggagaatcgcttgaacctgggaggcagaagttgcagtaagccaagatcgcgccattgtactccagcctgggcgacacagcaagactctgtctcaaaaaagaagaagaaatgagataatccattttggatctgtccatttttcttttgcagtcctaaataacaaaaagcctctccacacccaaattgcttaacataaagcttttatttctgcttactatcgaccatctattaatagttgcctgagaccaggtacagtggctcatgcctgtaatcccagcactttggaaggccaaggcaggtgaatcgcctgaggtcaggagttcaagaccagcctagccaacatggcaaaaccccgtctctactaaaaatacaaaaaactagccaggcatggtagcgtgtgcctgtaatcccggctacttgggaggttgaggcaggagaatcacttgaacccaggaagtggaggttgcagtgagccaagatcacaccattgcacttcagcctgggtaacagagcaagactcaatctcaaaaaaaaaaaaaaaaaaaaaatgcctgaaaagcttccatgtaaagaatttatggtgataactttttttttaattttgttttttttttttttacggagagatgcagggtcttgctctgtcacccagactgaagtgcagcggcacaatcatagcttactgcaacctgtaattcttgggctccggtaatctttctgcctcagcctcccaagtagctagggctacaggcatgcactaccatgcccagctaatttttctttttttaagaaagacagtcactctgttacccagggtgttcttgaactcctgtgctcaagccatcctcctgcctcagcctcccaatgcactggggattataggcgtgagccactgcactaaggctaattattttgtaagctttaataggtcagtagggtacttacaggtgtgctacccaatgaacatcacctcattcacttagtctgtcaccacacatttactgaacactttttttgtgccaagtattggggggtggggcacaaaaatgaatgaaacacagtccctgctgaggaggaactcacagactggaggaggaaacacatcattaaataattattgtacaatgtggaacactatatagagtacattagattgtatgcagcttggtgttagggattgtgtcttggtcactattgcaatcctgctatgcccatggccttgtacaaagcaggtcctcaataaatttttggttgaataaattagtagtgtttggggtatatagaaagcaatacaagctgagttactaggaaggctccccagcagaggtgatggctgagctgaagaaatctctttctccattgactgtcagaatgccagcactagggtgatgtcaccctcctaaagttctaggagtcttttgggtattgttagacccttcagtgtactctacacccagctcctcccagacctgtcagtgttccagggtacaatgtagacttggtttcctagacaattgtatatctgccgttttgcttgtgaaaaatactatttttatcaatatgacaagccaaccataaaagtatacgtgaaaattattgttgcttgtggccctcccaacaactcatctatcctgtgtattatctaaagaacaaaactggttccccaaagtggttatgcctccaattgaagcatcattttattctactcttgtgcataaatgattttttattcaactatgtcaactttccttctgttcatatagaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtaatatggggtggaggtgcggtttacaccactcaaggttcaggtttcttaaactcactcagtggtctcagctggccataagggtaagcttctttgagtgtacagaaaggcctcctggcaactgccattatacatctttactaccctgccacctagaagccttaacaggaccccacaggagttaaataaagtgctcaggaaggagtctggctactagaagggtaggctaagctgaccacaggcgggtatcctctcactgtgatttactagccagtgtgtgatctccagtgtaagaatcgcctagatatacacaatagttccgaaacactggtcggcttgctctagaatcaactgaagactttgttaaattgtttctgatgggaacttttactgtgtatatttattcttgtattttttaaccaatacttcaagcgagcattctgaaaatgcaatagcccctagggtggataatactcttgtgtttccaggaggcaaagttagcttttccgaaaatcaaatgatggaacagattatgactctaagctcttgttgctcagtaaagcccagcctcttctctgaggttttcctgacctgagggttacttcagttgtacagatgtgaagcgtgctcgaggagtatgacccttggctaaaggaaacccaaaaggtaggataattggtagagacagtttatggtgaagtttctagattccttgagggagataagaaaacttgaggttgtgaactagtttgcttgaaaactgctttttttttttgagatggaggcttgctctgtcaccgaggctggagtgcagtggcgcgatgtcagctcactgcaagctccgcctcccaggttcacgctattctcctgcctcggcctcctgagtattgggtactacaggcgcccgccaccacgcccagctaatttttttgtatttttagtggagatggggtttcaccgtgttagccaggatggtctcgatctcctgacctcatgatccacccacctcagcctcccaaagtgctaggattataggcgtgagccactgtgcccagccgaaaactgccttcttaaagtacttgttgaggacacactgctttagcaagtcctgtaagaggaaataaggtatgcacagatcaaggcctcatctaagactttatggacccagtgcctagatcaggcctggcacacagtagatgtgtgacaactacttgctgagtgaatgaagaaagaagtgagagtactggcagtcccattggtgaactccattcctcctcacagaaaggctggttcacatcgacattcactcgctgtctttgtgaaggaggtcattttattgatactgcgtaccttcctctttttctagcccaagagtggtagccacaaagtgtcctgccctgaatcatctggatagattgtaaaactggctgttcacactagcctagattgctagagctcatgtcaaactcataggccccctagtctgcattcttaaaaagaattaattaggggaagcatcttagtctccagagacagtggttagccctttcatctcactgagactaatctaccttaccctttgctccactcaaatgtctctacacatcacacaaagacaggtggtagcagaaactgatgtttacttgattcttgaatcaacaagatttatatgaggtgacatcctcttatgaatttaactagtcttatgtatagcaaacagaatcttaaaatagtagttatcctttttaggaagtcgtgcataaaatcactgggctcccggacaaatatgctgaacttggttagtgaccttacacagactcagaacaaggcatcacaactcttgccccttgtcttgaagagccatttttaagtacatttttaagaatctagtctaataaattagctagaataagttatcagtgctgaaaaatgtttggactccagcagaacatattcttattgtgttttactttcaaatgaagagtatataggggaagggagtctaaggattgagtaagaaaagcttttaaagcaaacgcatatccctgttgaaatttaaggctgatcttgggtttgttctttttcctgactttaggggtttccaatggtctgtagattatccttttcagcttagcacttcctcacaaagttgtgtcatcttagcagaagtgggcaaaaagcagcttcacttggcctcaggtcacttacgtttcctaccctgtagctttgagtagaaactaggttattaggtcataaattgacttgattcttagaattcttccagaagagattcccatttagcaagccataaaatagggctcatttctatgaatccagaaggctaattcagggggaagttgcagatttgttaaatggcccagcccagggctgagcaacaggttagtagtttagttccccagcgtctcccagatgcctcacttctctcttggatccctcccttttgttcataggaccaaaataaaaatggtagaaaaataaaaaggaaggttggcatggactcttcaaatcataccacttaacatctaactggctttgggtgcagtacacacaacttccagcccctgggaacacaactctaactaacttgctcttaatttttcctgcaccctaggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaaggtactatagcttacgccgaagaccttagcaaacaaggcagcatgaactcctttttttttgttttttgagatggagtctcactctgtcatccaggctggagtgcagtggcacaatctcagctcactacaacctccgcctcctgggttcaagtgattctcatgcttcagcctcccgagaagctgggattacaggcacccaccaccacacccagctaatttttgtatttttagtagagatgaggtttcaccatgttggccaggctggtctcgaactcctgacctcaagtgatccagccaccacagcctcccaaagtgctgggattacaggcgtgagccaccgtgtccggccagcatgaacctttagtgataaattctcaaccaaaaaaaagtgtctccttcatgggcagggccagcaatgcctagaaacagtacaaaaagaagggctgggcaccatggttcccacctgtaacccaaccattttgggaggctgcggtgggaggattgctcgagcccaggagttcaagaccagtttaggcaacaaagtgaaaccctgtctctgaaaaaaaatttaacaattagctaggcatgatggcacacacctgtagtctcagctacttgggagactgagcggggaggatcgtttgagccctggaggtcacggcttcagtgagccatgattgcgccactgcactccaacctgggtgacaaagcaagaccctgtctcaaaaaaagaaaaaaaaaaggtgggggaaacaggggaggtgggaaagaaaaaagtaatagctaccattgtttgcgcccttgctctgtgccaagcagtataataagtgttttgacacaccagcatgcttcatcctcacaaacaccctagagaaatgatcatttaactaaaaatcaatcattatataaatcaggagagctgaagtgcaatttcagaatatacctataattggagtggaaaggggcgtacctagttcttccaagcccactgttaaaattaatgcctttctgcatggactacttgtttacagaatatcagactgccctttagacttcagattttgttatgcatgcttttctccagtttactaactgtgccagatatgcttacagatagcagttctgcctatttttccttgtactcatgtccccggctcaccagttagatcccagtctaagtgctgtgtcttacccctctagggaaagaactcttgagatgaggggtaacagggagggaaggcctttcagatttctgagtagagaatgttttgcctcttgattgtttcatgcaagttaaaatgcctcaagtggagctgctgccactgcaactaaaatccctcaacaacttcaccttttttttctgccctactttctagacatgacatttttgggagcattcttaagatgtacttagggggtccaagcttctcttacgagagagaattgccctagagtggtcataagtatcatggtaaccaactgcttttttgaatctttggtgttaccaaacaaaactaaaaaaccttaggttatggcaggtaggtaaggaggtggtctgggaccagcttcctgaagaacacacacatgcctgtggacaaccatcacttcttttggtcatctttttctgctcagctctagaagactccgatggaagacaggactctccagcaggggaactgccaaaaacggtccaacagccaacaggtacagtttttaaggcagtgtttttagaaattttggtggagggaaccatggtttccctccagataaaagctgtaaagaagtgaatgtaagtatgttcaaattatgataatgaaggccttttttccctcaaaaagatagttaacatttactcttacattaagccatatttggtaactagcatcgtttcaggtgacagtgtttttttgtttttgtttttgttgttgttgtttttttgagacagtttcattctgttgcccaggctggagtgcagtggtacgatttcagctcactgcaacctccacctcctgggctcaagtgattctcctgccccagcctcccgagtagctggaattacaggcacccaccaccatgcccagctaatttttgtatttttagtagagacggggttttaccatgttggccaggctggtcttgaactcctgacctcaagcgatccacccaccttggcctcccaaagtgctgggattacagacatgagccactgtgcccggctgtttttgttttgttttttgttgttgttgttttttgtttttttaataaagatgtttactccactgaagataacagtctttttgcttcagtatgtcccaaagtaaagctctgtaccaagtgctaggaataccaagtaccttactctgctgatggctgttttataaccaaaagcgttaagcaggtttgattgcagttttctttctctttacagaatctgagccagtcaccataaatatccaagacctactttcctgttctaattttgcagtgcaacacagatatctgtttgaagaagacaatcttttacggtctacacaaaagctttcccattcaacaaaaccttcaggtaattccaagtaaaatattactataagataacttgatctcagcctttcggcttgccaacaaccttagctttaaggaggaaaggaaagaaggaagtaggaaatagtatagaggaaaagagaagaaagaatttaagtaaaatgagaactaaaacataaactaaaagaaactcaagtagtgttcctcagtaatccacagtaagggccacttccagtgttggaagcatatacagtgctttcctggtatttactggatctggctgcatggaaaaagtggaacatgtctttcattatggtttcctccatatgctgattcattcctattattatgcgtctgggaagtctggtggattctagaggtgaacactttccatctgctttctcaggaagccctttggaagaaaaacacgatcaatgcaaatgtgaaaaccttataatgttccagaaccttgcaaacgaagaagtaagaaaattaacacagcgctatatccttttcttgcattatgcttctgtatggaatgcaaagaatattatcaaaacttcacacactctatgtaggttttatcaactgaagtaaatcccacgaagtcacaaagaacagtgatctccaggaaaggctttttgctttaaaaagcagcctcacaggtgtttgagaggcaagggcaagccaagcttattagcagcagtcaagcacttagttgccatcggctgttctcgggggcttagcaataaggcctgtcagtcagcatacaaagtaaggaaaaaagagacactggcctaactccgtctctgctaggaaggtgtgtaggacatgatgaggtctgaagtgcatcaaaggtacggtaagtatagacaaagaatgttgtagaatgaagaggtttcaaactcagtactccaaacttttcctttagccccaaggaacaccacagccacatatagattcagtgtgtttagtttctggaggacaggagtggttttttcttttttttcccttggcagcagagatcttctctatcggcactctaaaaaatgaaacactccaccaagggaacagcaggatccaatgattcatttaaacaatattaaataaaaggaatgcttggggataataaagaaaagaggattcggtgcttttacatattgaacaccctgccaagtgctctaaacttaaaattacagtaagcgtactaaagctggctgatatctcaagtgcatcaactagtctatagggaaatggcttaattctgaactatctctgtgccaatgggcttatgtaataaggaacaacagcatagggcaattccatttctgaaagctggaaatacgctcccttaagtaaaatgaaataatctttctgagtggttaattgacgaatatgggctctcattctgccctcaagagggcagatagagggtactgaggagcttacagggaagaccaatacctattctaatgcccttttcttctcgcttgcctgtcccaccccaaagttctactcacaagagactaaagaagacatatttttacataggtcagaattcctcaaaaccgtggccttatgtagcatcatggtgaaaactccgtatcgccctttgcttctgacttcatatcttactttccaaggccgaattctttcattgtcttctcttcaccagattcccaacattatcaattctggctcctagaagtgtgctatggcaaactaatttgcaagcattaagggtggaagtggaatcacaattaaaaaaaaaaaaaaaaagactgcagctgggtgctgtggctcacacctgtaatcctagcactttgggaggccgaggtggccttgcttgagcttaggagttcgagatcagcctgggcaacatactgaggccttgtctcttaaaaaataataaataaaataaggccgggcacggtggctcacgtctgtaatcccagcactttgggaggccgaggcaggcagatcacctgaggtggggagttcgagaccagcctggccaacatggagaaaccccacctctactaaaaatacaaaattagctgggcgtggtggcgcatgcctgtaatcccagctactcgggaggctgaggcaggagaatcgcttgaacccaggaggcggaggttgcagtgagccaagatcgcgccattgcactccaacctgggcaacaagagcgaaactctgtctcaaaaaaagagaaaaaaaacaaaaataaataaaattaaaattaaaaagacaaattcacactgagccatctggctttgctgatgttaaaaaaaaaaaaacccaaaatatttgtcttgacagaatatgttaaatgagttctacaaatttacaagtcagggttttaacatacttgacagaaatgggaaaaaaaaccaaaaccttttagatttcagaagccaaaattttacgtggataaatcaagttatatttaaatgtaaataaaaatagacaattcttcatcttccttaatttgagatttactagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaatggtattcagtgcaaaaattcttagtttaactttaaatggaagatatgtatgtatgagaaatggccaacatgcctatgaaaaaaatgctgaatctcatcagtaatcaggaaaatgcaggttaaaacaataccatttttcacccatcagcttagcaaaaatgagtatattttttaacaagtgttggtaaggatgtggaaatgtgaggttcttgtagtaagaatgcaaatggcactctttgtagagtaagtctgttgacatctcataaaactgaaaatgcacacaaccctgtaaatctagcaactgcactcagttgatttcagcccatacatacaaagagacctgcataagaatgttactaggctttgtaaaagcaaaaaataaggaacaacttaaacatcatcagaaggggaactgataaactctggtgtaatccataccacagaaatacaacaccgcatgtacaggaatgtgctacatctatacaaataaatggtcaaactcaa

SEQ ID NO: 700 - DNA, 167637 bp, Homo sapiens; identical to SEQ ID NO: 699

SEQ ID NO: 701 - DNA, 148814 bp, Homo sapiens
atatatgtaaatatttttcaaggttttattgcaaaccaaaatcagtttatcacacacaaaaaaagttgtgtgatgggatgagggaaggattgtacgtattataaccatgttaattacagtacattaaaatggtggtttacattacaaataagcctgtaagtttaaatatactagtgttataacccaatgtacagacgttctttatacaatacatacaattatcaggaatgcaaaaaaaaaaacataaataatgcccattttacaggtgacattttaaacaatgaaaaacaccaacggctctgactgacaactggggcattggtccataaaaaccctttctaaaaatagaaatatttgtagcagcaatgctttctttaagcatctgaatacgagtcattgcaagaccatttcaataaattttagttattaaccgtatcttacaaaaaagtctacacataaatttatcttccaaatatggaagaaacaaacaatgtcccacgttgtagtgtcctgcaagtgtcacattgatgcttataacaaaatccatctgtgatcaggcataccacactcacacgacggttcacacagcatatccacaagggaaaataaagaactgaaacactgcgataggaaaagctttggagctaacacaatctcttcagaaaaggcacatttcataatattcgtcatcacagcccagacagatctgcaggagaccttttttagaacagcgtccgctttctaacgaaactcctgcctccgtctaaggcggcactctaacgctcgtttcagagatagcaccacgttggaaggaagaataaaaatgaaaacctcatgagctcactgaggagaatgtgctcttcaaaaagcttccagcgaacagtgtgcaataagattgctaagcttccagagatgtgcaaattctcttgtaagatgtcctgtcagctggcggctccaccaaaaggctaactaaaacattcggaaacacacataaaatcctttaaaaccaagccctaacagggttcagaggaaagagtccgtgggaggcgcataggaaaagcctaggaaagcctcggcagcttccttgacgctggctgtgacgaggacgctgtcaggggacttgccaatggagttggggacaggctcttcggtaaactcggggtcaaagtgccgtaggtcgttgggcccactctgtgacgggaagggaaaaacactcttgtcaagaactcacactagacacaggacagggaaatcttgaccaggctttaaataccaagtttaagtcttatatcaacttccataatcacccacttcaagcacaaaatctcaaaaggctacacacagttaaacataagaataatgttcacttgttgccttttggtgcttcgaattgataaatgtgtctaaaaattatgggagccttgttgggacacaaaaatgtgctttttatgtaggtaaaataacaggtttatggagaaaacatctgccaatgtattccttccaaccctcccccagacaattctgaattaaaataaatgccctttgggcttctctatacttagaagagagacagatactcaccacatttgggttaaaagggggagtaatcttcttattaatgagatcatcccagttaattaaggagaagaagacatgactcttaatctccatctgttgataagaaacccaagattaatttagacaggtgcattcaataagggcagggaggtctagtgcacgtcccggccggcccaggaggacaggaaaacatcactcacgaagtcatccttggccccgagccgctttgtcctgtccttctgcaggaggccctccaggaggtgtcttgcggaatttgtaatatttggtttcagctggagaggcttgttcagaatgttgtcgtacatttcagctgtgtttcggctataaaaaggcggctgaaagaaggggaaaattactttagacttaattggaagtttcatatggcacacattaccagtagagaaaaagatataaacggcaataaatattaggctcgatttgagaaactctccccacctcaatgctttcttttcccttgctatttaagtgtctactttgcaacccgtgtgtgtgtttgtgtgtgtgtgtgtggagggtgagggggtagatgttaataagtggtagtttttcaccaccacacaggttcaatgtggtcctatctagtaaaatgtgaaatgcacaaaagaaccaggtaagtgattattcttatgaactataaaataaccaatatgcctcttagctgcttttgataagcgtactggtaagggcaagacaccatggccaagcatgggctgtgtgaaggcaatattgtagggagcaggcagtgttccatggttcccaatgtgccactcaccaggccatacagcatctcatacaagacagctcccaggcaccaccagtccacagtcctgtcataaggctgcttatgaagcacctcaggtgcgagatactgaaaaacagaccagggaaacagcgtttagaacctgcgaaagcaagcaatcccacgaccacacatttagtttgaaaaagctgagagacccagagccagcttggaagatagatatctttagattccttcctgataaaactgctggactttttgagggtgactggctacctatgtgtactgacatttaggaaactgctgggcacttgatatctcttacttagggatttagaaagtttttatgatgcagatcttacttacaaacagctacttttcagtaaaggaacagaaggacttgggatttctcatgctacatcaaacagcaaatgtattttatttgcactgaactgtattaagaagtctctgagaggagtttactctttttggtagttaagtgcatgattgtacatctctctcttggaaggcgggggtaaaccaggcaccaaaccaagacagcgcctacctccggcgtgccacagaaggtggatgttgtgctgttgtgttcaatgttctccttgcagagtccgaagtcagtaaggacaatgtgtccctgtgaatctagcaaaatattctctggttttaagtctctgtaaaaaagtgaatagaaaagtagttgcacaagttaatttcacttcataagatatcctcttaaagataattgctaaaggtattagaggcattttaggttcactgtagttgtgtagtgaagaaaaaagggagcccttgttctgctcatctattctggattaggcacaatcctacttggctggttcccccttggcacttaagtcaagccagctcacgtgctaggggatctggttttaggcaaccaagttgcaaataaacacaaattattttaaggccctatgaaacagccagtgctacgtctcctttataccaaaactggtagcctgaagagctctcaggcttacctataaacgatgttcagtgaatgcaggtagcccaaggcactggctatttcagcagcatagaaacgagcccgtggttccaggaagcagcgttccctctggagatggtagaacaactgcaggagacagaacaaagtcattctgggttgcaaatgaatttaattagttttgacatacacagcaaaagaacaactgcaggaagtggccccaagtaatctattaactataaacctgacaggttgaaggaaatgctaattctggtaacattctccccaccaaaaatctttgaaaacttttttctcaaactaaaacaaagcaggctgtgcagagacactaagagttgacttctatcccccctgctcacctctccaccattaatgtagtctaggacaaagtacaatttgtcagcagtctggaaagagaagtgaaggcccaccaggaaagggtgcttcacattcttcaacagaacattccgctccgacataatatgcttctcctaggaaaatgacgattcagatttagtggcatgtttcaacttggcaccaacattccagaatcaagattattcaaggagtgtctaccgccaatgccagccccatcaagcacatctcatacctctttctttttcaggattgctttcttctgtaaaactttgactgcatagaacacttcttctgccttgtgtcttgctagaagaacctgaaatttcaatttaaaaaaatcatttttctatcctcatccagggagaatacaaaagaggacatgaaggaagtgtaccaaaagatcttcagatttgaaattacctttccaaaactgccctttccgatcactttcaagaagtgaaagtcagatggtttagcatgaggattggacgacgggccaaggttgatttgctgagaaggacttggctagaaaaaaaaaaaaagaatttcttttaataccattgcttcaaaggaagacatctataacataaacgatgtagaaaatgttacatctacaaatgactgatgcaaatgaccatacatctataaacattcaaaactacatttcatcacatttcaaatgagtatggaaactgcacacagtcatgttgtttcagacagataaaacctttttatgaaatatgccttttaaaataaccactttggaggtaaaatatgcccaggaaaaaaataaaataatactctgactcaatacttaaatatttatatcacttgttatgccataatgaagcattcctgccttgatactaatttctagaaatgctattttaatccattaatgtaggaatactaactgactcccttacagttctccacagatgcacggcacatacaaaaacttactggaggagaagggttggcattcataagctcaggctcctgaggttgggagatcttcaagatggactgaacttcagggctgcagggaataaagggcacgatttagaatccagctcgccactagggggcacaccaacatcaaaagtgagtttctggctctaccgacttctacccggataattcactgtttaaactgaaaataccccaatacattagtcagttaaagaaaataataaaccccattaaatacagaaataaggattgttgctcatggagaaaggccgtgaattcggccaacacgaaccatttatcttacatctccagttcaagccaaatcagcaaattaactttaatgtttaaaatgtgtcaaatatattagaatttaaggagaaatgagatccccaccccagaagaagtcttcgccttcccgataaacgccgtgatgagaatgtttaccgctggcaaattcaaactatactagttatttcctcaaatccggtcaaacttactgtttgcatgcataggagttattggcaatcttctgaataaagtcgttcagacccatcctcctctgcttcatgaaagctgtggatgaaggaggagaaataaagaaacgtttagacggcttcataacgtccggcgccacacacactaatctgatccgggactttcaaaaaatttccactttgcgtctcctggagcagaagtcccgcaagattcctgcactcaccgatgagaattgccaccatgcccctcatcctggagtaagtgagggtgcccttagcagcctcagttttcaccgtcatcaccaccgcggggagacagaaagacgttagcgctcaaagaccggctcggcgtatgctgcgccaggccgcgcgctcggccttataaaaaaggcaccgccgcgggggcggggcctgcgcgacagtgagaagtggccccgcccttcgcctcgcccctcgccccgccccggccgcctcgcggtttgctggcggctacgctgcctgcggcgggcggttctgtccccattgagagggcgagccccgggcgggggcgcgaggaccgcccggggacggcctggcgcagggccgttatcagtctccatcggctcctggggcaggagagagagaacgcgccggcggagggcgcggggagggccggagagcccggggtagttttccacctctctcatttattccgccgccggagaaagccgggttcgcagcgccgaagcgcttcccggcgggtgcgcggcggccacggtggcttcgctcactgtccctgcagataccctctccccggccaggcgccgtcctgcggccggactcccaccctcctccccaacccgagccggcggtgcgcgccaccctccggggtttatccctggggcgcaggcctgcgcgcgcgacctcgcccgccaggtcctcccgttcccgccgccgggaccccggccccgagaactccgacgaaagccggcccctgcctccaagccgctctggggaagtgagccaagcccccagcggggccggcggcggcgcttacccagtccgctcagcaggaaggactcgctccttttctgcgcctcggccctctttttgtggcggggccgcagcagggactcgagccgggctctggccagcgcgccctgcatctcccccatgggcagcgggcggcggggcgcgcggcagacgagagcgaccggcgagcactgacgtttccttgaaggagccgccgtgactcaggccgggcaagatttcctgccccgagtcccaaaacaaacaaatggcccttgtgcacggtcgggtcgcttccgaaaacgccttttttgtgcttttggccaaaaccaagcaaggctgaaaaatcccagaacttggaagaggaggaaggaaggaaagaaagagggaaaagggggagggagaggtcaggaatgtggaggggagggggcggaaataaaagtcgtctctgcactaaaggaagaagtacaatctgcatttcacttttttttttctgaagtaatctctgagaacattttgtccgttccgcatgtaatttttttccttgcatttttaatctctgccatgccaagaacacgtgaggaggtaacaagcgaagggaggggtagctttgcccgggggcagacctggcgtgaaccgggcatcctcgattcctctgtggggcctgctcctctcccgctgtcccacctgaaaaccctgcaggtcatgatacatggtcttaaaatcgtccctaccctccctgggtttaactcaaggctgccccagggcttcttagttttgccacctcgctcgctctttatgtgagtcccacataaactgtgactttatcctgaaagattagccgggtgactccgctgcagaaggcagggaagagagggaagctcgaggcggcggcccgggctctgcagaacagcgatgccggtgccttccagtaaccccgcggctgggggatgtctgggagccgcagcctgaccgccggcgcggggacgtgagccagtgctggccgggaagccgcgagcacggcgactgggcccggagcgggcagttacaagttaccactattcgcagggccaggtacctggcgctcgctgttgctgtctgcggtggctgccctgccatgacctcttgctaccaaaggctctgccattttaaagttgcctactggatctggcacagtcccgaaataccagctgtcaaaccaggaatagcatgtgaaacgccttttccttggtcttgggcaggggtttgttttgcaggcaaaaccacccccacttgccctaaagtgagctctagtctcaactccttggtttgctttgttgcaacagccccaaaccgagagaagggaaacacattctctctcctggagtctggctgggaaagtttgctcagtgcccacacttataaaaagcatttactggggccgggcgcagtggctcacgcctgtaatcccagcactttgggaggccaaggcgggcggatcacgaggtcaagagatcgagaccatcctggctaacatggtgaaaccccgtctctactgaaaatagaaaaattagccaggcgtggtggcgtgcgcctgtagtcccagttactcgggaggctgaggcaggagaatcgcttgaacccgggaggcggaggttgcagtgagccgagatcacgccactgcactccagcctggcaacagagcgagactccgtctcaaaacaaacaaacaaacaaaaacaaaacaaaaacaaaaacaaaaaaaacactagtacctgaaattgacatgccaacctaaagcaatgtttaggcaatttcaaatcacagtaactggcccatgtctgcttcctcttgcagggaatcttcatagaatgtgactttgttattgccagtgccacccgtatgtcatgtcccaccattcaactagcctagcccagcctagctctgctcccacctggttcctttccctcttgagagagcaaattttgctcaggctgcccagaaacatcaacctgcacacagacttttgcatgtttgttttcaaacattaaattaagaaacctacaaccagagaccctctcctacaccccaccttatgtgccttccccatgccaagtaaccccaaatcctttgaggcatctgcaaaatatagtacggtaagtacgaacctttcaaagggggttttatagcttcttctttcattcttcgggttgcccaaggatatgcaggttggggattacttctggaggctggaggtagagcccagttatggctggaataagcctccctgctacatgcctctgataagctggaactctgagatgacatgagagcacgagccagagacggctatccctgttctgttatgaaccccactttatatcaaggcaatttaagtacaggaagggagcaagctgcaaagttcaacactgggccatttattctccccattgcgacatcactcagaaaattacagtcatcagtgtcctagctttattacacccccagcacgcacacaagaaatgtaacttaactgattatcctcacaaatcagtccggaaaaaattcaaaacacatgcacaggatttattttctcagaggctctgtggcatgcattccgggaggaacgtggcattcaggtcggagggttctacgcggaatagagaatagatgcaaccgtatgatttgtggttggaaaagaaagggaacgtctgatgtgctccttcctcccctaccctaatgttcagcacttggagacggatggtcggctaaacttatcatttaaccgagagaatcaagttgttgagactggcttttcttccaaccggatacgtgatgggtggagcaggcgccccctgttctgtcccagcaacctactaagacttccgaacaggaaggtgacacacggcggaggggtgcttgaggggagggggagacgggggagctgtgtgtgacgcgcgcctgttaacactgcacaggcattaggttgccctgtagctgctattcaaactcttgatctgttcttccttcctgtcgccagcctctttctttggtccagatagtcctcctactgggaggaatccggcccctttcctcatactccctggtggcgaagtggtccgagtagcctcccgaactgtttgtaaatgcaacctagagggcgatcgagttctctgggagaacttgctccatatacgcgtatacgcggcttcccccacttgtctcctgaggttctattggtccagggaatttctctacaacaccttgtgcagtcatagaaaatatagacggcttgataggagataggctaattacctccccactcctccaagcgaattgtctcacatttatgtctcggtgctgggaaaactgcagtcaaaaccctcaagtaggaatgactgaccaggatgaaaagtttgcactgaaactaaacgtttcccagtgcatgtgcattttaatgcttcagaaaaaattttttcactcttctattttatttttttatttctttatttgtcactctatagtctgatggactataaatgctaaaacctgagagcttcacaaagatatgactttttccatttaattttaaaaggcttataaattattgatatttctcaacatattagagaaaatattttgaaaaatattttttataaggacttaaccatattcactcttaagacacttcttaaatgtatcagctgtaattgtcatgattccccgggtatgttatcttccattgataacaaggcaatataattgtttcatattgttcaaagtaccatcaattttagaacaatcctatgaagagtttaagttcccatactttttgattcattgtttgatgctcacagaaacctttccctggaacaccctcaaaaaagctcatagaaataccagaaaacataattattataattatagaaaacataattattactctagagagaaactgaatggatcagtttttgttgaaggttgtcagcaaaggcatgtctttttttttttttttttttacagaaaatgatgatgacaaatgagtttattcattatagctattatagacaagtcactggcaatggtggttatttaaatgtctatttatagacacaggttgtatagtaattattaccttccatattcataattgtcaaatttgacatgcaaaaagatgtgatacagtagataactaagagaacactatctctaatcatagtgttaaaagttattaaaacccacaaaactaattatttcatttatcgcagggtttatattttttccaagacagaggtgataatattctacacccattccttctaaaaagtgagcccataggaaaattgacgggagggtaggaacaagatttggtagtaaattttttatgtcattcaggggataaattaaagagaagccagtgggaatacttgacatgggaggaatgagaagctttttttgtttgtttgtttttgtttttgacatagagtttcactctgttgtccaggctagagtacagtggtacagtcacagctcactgcagcctcaacctcctgggttcaagtaatcctcccacctcggactcctgagtagctgggaccacaggcacatgccaccatgcctggttaatgtttttatcttttgtagacacatggtctcactgtgttgcccaggctggtctcaaactcctgggctcaaatgatcctcctgcctcagcttcccaaagtgctgggattataagtataagccactgcgcctcacctgaggaatgagaatctacatagcaagaaacaaacagatctttctcaggctgaaaacttacccatctccatcttggcaatgttgtcaatgtctgatttagtataatccaatcaatgattaaaaaaacaaaacatcagctagaatgcaatatgataggtaaggaattgtatgtatgtgacaactttatttttggttctcaggattgacctggaaaatggtgtccacagaactttacataagattatgaaaaatgatacattggtctggacagaagagtaaattggaaaaatttgtaagtcaatatttaatactattggtaaactcaagaggactgtggtggccaggtgcaggggctcacacctctaatcccagcactttgggaggttgaagcaggaggatcacttgagctcaggagtttgagaccagcctgggcaacatagtgagaccctgtctctacaaaaaatacaaaaattatccatacatggtggcacgcctgtagtcccagctacatgggaggctaaggtgggagaatcgcttgagcccagggtgttggaggtttcagtgagccaagatcttgccactgcactctcgccggggcaacaaagtgagatcctatctcaaaaaaaaaaaaaaaaggactctggccttatatttttggcatgcctttactgttaggcatttgcattttaaaaggccacttgtcaactcaaaaaatttaatttgcaatgataaaatgtcaagcattcaaacaagaaacaggtctgagagctttggggtgagaggcctcccgcaatatctggcctggtcggcctcctctccattctctccaaggtaaaactacgtgggcatctacttcccccacaagtccagcagccagaatccttcctaagacacacatattaaaggtgtaactgacacgaaggcaatataaagggctctctttcacccccactttatttacaaagggccaatagtaaataaggagtctggatttctggtggacatcttttgtcaaactaaagtgaaacctgaaagctttgatttgctcagtataaatctctctccaagtctctcccgtttgttttctttctttctttttctttttttgagacggaggagtcttactctgtcgcccagactggagtgcagtggcgtgatctcagctcactgcaccctctgcttccctggttcaagcaattctcccgcctcagcctcctgagtagctgggattacaggcacgtgccactactcccagttaatttgagtacttttagtagagatggggattcaccatgttgatcagactggtctcggattcctgacctcaagtgatccacctgcctcagcctcccaaagtgctgggattacaggcataagccaccatgcccggcccaagtctctcccatttctgagcctataatcaatctagaaggaggcaacagaagctcgggccacccctaaggacttaaggactgtttcctgtaaactctgtgtgccagttgtaacaacaaaagatacatgtaatagtaaccagcaatggaaaaaccagttatggggatgtcagtctagttggcgacaactgaggcttgctacctgtgagttttttttgttttgttttgttttgatatggagtctcacttcatcacccaggctgaagtgcagtggcgcaatcttggcttactgcaacctccgcctcccaggttcaagtgattctcatgcctcagactctcaagtagctgggattacaggcacctgccaccacgcccgactaatttttgtatttttagtagagacagggttttaccatgttggtcaggctgatctcaaactcctgagctcaagtgatctgtcctcctcagcctcccaaagtgctgggattacaagtgtgagccactgtgcctagccatacctgtgagattttagacaaggtattctctaacccttaatcttgtcagctgtatagcggggagagttatacctgcctcatataagttgtgaaaaataatggaaataggccaggtgtgatggtttatgcctgtaatcctagcactttgggaggccaaggtgggtgggtcacttgaggtcaggagttcgaaaccagcaggccaacatggtgaaaccccgtctctactaaaaatacaaaaattagccagaaatcacttgaacctggaaggcagaggttgcagtgagctgggattatgccactgcactccagcccgggcaacacagcgagactccgtctaaaaaaaaaaaaaaggaaataaagaatttagtaagcgcctctctcatgttggagttttaagtagaaaatatgatctgtgtatatttgccagccccaccctacgcacatcacaagtacaaacaacactgtcgcacagtgcaaagggttccaacaaatcaaaacaatacatcaagtaattatgggctgtgagtaaggcacttgcacagcatgggccacttaatctgctgggccaaggcgaggcctatgtgacaggaattccgtgaaaggcctgaatgataatccaacctccccctcctccattcagtctccctcacagacagtgctcctgaatgtgctgtatcaagaaacgaaatgccatgattactgaataaagacttgtttaccaagtgtttgcagcaaagactgaagtttagtgtgaaaaaagtggagagcaaaccaaaactaactcaagaaagtttttacttgctcgaggaaacaacagaaggcaaatatagacctattgagagggtggagtcattgaaagaagatcagaggccagtcatacttatcgtgctttttctaggtcaataagcttatcctgcaggaatgagaagaggaacaagatccagctgaacctagcctctgttagttttaatcattcagatctctgtggtgcacctctttcatttactgatttattgtattgatataagttgatgaacatattttggggtaacatggtattttgaaacatgtatacaatgtgtaatgatgaaattaggataattgggatatccgtcatctcaaacatttattttttctttgtgttgagaacatgctaattcttcccttttaactgtttggcaatatacaataacttattgttaactctgatttccctactgccatatcgaatgctagaacttattccatctatctagctgtactttgtacccattaatgtgaatgggttcttgacaggcactgtcttaagccctgaatctaacaaggatgtcatgatgggcagcgttgctgtactcagggagggtgtggtctatattttgtaaaatggaactgcacgttcccaaaagcaaaggtgagcttatagacatttctgattttcctcaggccccgctatgccttaatgtcattaaagtacagccttgggcacgtttgatcatttagattatctagtttttcaagtgaggaatgtgctggaaagtcttctgcagctctgattttgtacagttctatgatgtctgggaaaaaaaataaacccagaaggaacttctggaggcccagaactactctcctggcatggtttcctataataatgtcccacacccagctgatcctttagaagaacctgtccccaccccacccccaccccccacccccggcattggatccttcggtcaggaatttgtgtgcttagttatttaaatctcaggtgtttctctggaccttgagttccctgaaggccaggcagcacaatttgtgtctctcacctgcctaacattctctaatcaggtcgctgcctgcccctctgacctctcctcctaccttctccctccctccaggtttgtaccactgtggtgctctctgttccctttgcaggccaagctagtgtctgcccgagggactttgtctttgctgtgcccttcacctggaatgctttcctcctcaggctcacatggctggctccttcttgtcattcggatctcccagtaaatatcacttacaggccgggagcagtagctcacgcctgtaatatcagaactttgggaggctgaggcgggcagatcacgaggtcaggagatcaagaccattctggccaacatggtgaaaccccgtccctacttaaaaaaaatatatacaaaaattagctgggcgtggtggtgcgcgcctgtagtcccagctacttgggaggctgaggcaggagagttgcttgaacgcaggaggcagaggccgcagtgagccgagatcacatcactgcactccagcctgggtgacagagtgagactccatctcaaaaaaaaaaaaaaaaaaaaaaaaatcacagtgacgcagtggaccaaaagtagccagcagctgacctttctttgtcattcactctatttcaattatctgcatattagttttattatgtgactttttctgggtttattgttgatttacccaactagaaagtagtctctatgagatagggatatcatgtttgtttgtttaagacagggtcttgttctgtcccgcagtctggagtgcagggctgtaatcacggctcaccacaacctctgcctcccgggctcaagcaatcttcccacctcagcctctctagtagttgggaccacaggtgtgtgccaccatgcctggcttatattttatattatttgtagagatgaggtcttgcggtgttagccaggctggtctcgaactcctgggctccagtgatccgcacacctaagcctcccaaagtgctgggattataggcataagccaccgaccctggccggaataattatctatattatttgccacatcatccctggtgcccaggagagggcctagcccacaggaagtgcttgagaaataaaatgctttcataatggtttgcattaaaccccctctatggacgatatcatatgaatttggcttatagaaaagtatgccattgtaacctgttttactcttgtcatccaaccaactttcctcaagaactttagaacttttcttcctgccaggggatgacacagtcacctcatagactgttttctttctgtcttgcagccatgaagttctccataatttttgtattgccagaaagcctgaatgaacatttagcacaacccccttctactttatatccctttatatcctcccaaaatagccttctctacacaatgataaggacttgataaaagggcccctattgtgcagtcccagcctggacaaagtagttttaaagccatagcagaatggccatcaggttgtcagaaatgacaaaagccacagcacatatgcaagtggtacaaatgcttagtgccaagttaagatatgaaactacactttcatatctctatgagtgtgtgtgtgtgtgtgtgtgtgtgtgtgtgtgtattagttttctggagagacaaaaccaataggatatatctagagggagacagagaaagagatggagaaagagaaagagaagagaggagatttattaggggaattggctcatacaattatgaaagctgagaaatcccatggcaggctgtctgcaagctggagaccctgggatgccactagcatggctcagtccaaatctgaagaactgagaatccgggggctgctggtgtaagtcctagcgtccaaaggccaaaggctggagaacctgatgtccgaaggccggagaagaagcatgtatcccagttccaggagagtgagtgacctacccacggttctatctaggctcccaagcgattggacactaccccccacacccccctgtccccgcattagtgggggcgggtcttttctacttagtccacccagactcacacatcagtctcctttggaggcacccttaaggccacaccccaaaataatgctttgccagttctctacgtattccttaatccagtcaagttgacacttaaaattaaccatcacacgttctcacctttcaacttggcagccattacacatctctttgtatcacacttaatctccaaataaagacaatagcaaagtgataattctacctaatataatgcacctgttctgtgtacaacagaaaacataccagtcccttccccagaagagaaggtaaagtccttgggtgatgtttactcttctgctgatatcccataacttaaatactatgatataaaattaacaatacttaaatactgacataaagtcaataaatcttgtaaatactgatataaagtcaataaatgtgttacatgataaagacataagagaagaatgaaaacaaagatattaatatatgtacatagacgcacaacatattcttaacaaaacagggaggaaatactcatcacagttgcagtgcttggttctgtaactggtcacgtgatcatagctggtatttataactaccttcctttaccacccattctatatttcctttaccttcaacaagaacctcagttgattgtggttctttatgtggcaggtgacccaaacctacatttctgaagagtctgggccattcacagacttactcagattgagttgttgtaatttctcattgaccttaatcacaggacatggtaatactaagagacatcctaagggatctcctgtatttcagacatacacttctgggttttttttttggttttttttttgagacgcagtctcactgtgtcgcccaggctggagtgcatgggtgtgatctcggcttgctgcaacctctgcctcctgggttcaagcaattctcctgcctcagcctcccgagtagctgggattacaggcacccaccactatgcccggctaatttttgtattttagtacagacggggtttcagtatgtaggtcaagctggtctcgaactcctaacctcaaatgatctgctcgcctcggcctcccaaagttctgggatttcaggtgtgagccaccgttcctggcagacatacacttctttatctccattgtggaatagtagtccaatttctccctagtattttgaatcagttactccagccaacatcataactcccttcttagctttttgattcagaggcatgaggatcccaaagtggctgggtggtagtcttaacttccagttcaatggaatcattgttgtgtctccggaagcactcctccctctggaactaagacctccaggcctgcagatcataaagtcgtgggaacagaaagcaaaaatgtttccaatgggtcactagggggaatagtgagtggtgccactcccatttccaccccttccaccccttccatttctggacctgtggatcctggctatgggagaagcagcaccatatactggatgttgattcagagcatatacaactttctggagaaccttgcaccagccatgcaaaaaaatcatcaccgtaacttcaaaaggccattacaccattcattctattaacccagctgctccaggatgatgggaaacatggttaagaccagtgaattccaggagcatgggcccattgctgcctctctttggctataaaatgtattccttgatcagaagcagtgctgtgtctgtgtggaataccatgacaggggatagggcattctgggagtccatggatggtagttgtggcagaagcattgtgttcaaggaaggcaaatccatattcagaataagtgtctactgcagtaaggacaaaacactgcttcttccatgatggaagctgtccaatataatcagcctgcgaccaggtggctggcagatcaccccgaggaaaggtgccatatcagaggctcagtgttcatttctgttgctggcagattgggcactcagcagtggctgtagccaggttggccttagtgagtggacgtccatgttgctgagtccatgcataacctccatccttgccaccatggctactttgtttatgagctcactggatgcaagagtagttggggaaaggggctgtttggtatccacagaatgggtcatcttatccacttgattgttaaaatacccctctactgaggtcaccctttgctgagaattcatgtggacacaaatatctttacctttttttttttgctcattcagagaggtctattcacagatcacttccccaaatttctttgtcaccaattttccaatcatgttccttccaagtctctgaccatccagccaaactattggccacagcccataaattggtatataatcgcatatctggccatttctccttacaagcaaaatgaacaaccaggtgctcgaggttctgctcactgtgcgggtatcttttcagcactgtccttcagggacctgccagaaagagaccacagtgctgcagctgtccacttgtgtgattttgtgattttatatatagagatatatacatgtatgatagcatcagtaattcagcggtgttacccatagcatgagggtatgacacacaggcttcacctcacacagagacatgaaaacaataatccaccaacttcatactaagcaataaacactaagatttttatttcctgaggattccacaccttcattttcttagcacacagtagatttcagagccaccacgcctggccaacttttttttttgagtcagggtcttgctttgtcacccaggctggagtgcagtggtgtgatcatggctcactgcagcctcaacctcccgggctcaagtcatcctcccacttcagcctcctgagtatctggggctacaggcacatgccaccatgcctagctatttctttttctttttttttttttttttttttgagacagggatctcctatgttgcccaggctggtctcaagctcctgggctcaagtgatcctcccaccttggtctcccaaaatgctgggatacaggtgtgagccactcacgcaacccagacaatttttttttacagacactttttataaaactatttgtttctcagttgtgattatagaatccctttaacaaataagattagttatccccagaggattgtttgatggtttggggccaagcatttcagatactgcatattaactacctcttttatacaggtgtgtgtgtgtgtgtgtgtgtgcgtgtgcgtgtgcatgtgtgtatatataaatatacacatatatttttgtgtgtctgataacaccaactttgttccctaatcatcatttcacagaagatacaaatggaatctaaaagaatgaaaataagcttttgtataagaccacaagaaaattacagagaataaatgaaacagatgtgagcaaaagatggggatcatacataatgtctgaccttataaactacataaacatggttacttcaagaagctactactataatattacttattatttgtttatacaattttgcttaaaattacatcgtactctctacttatttagagcaaatgattgtgccaaatagataagactatttccatcaattagtatctacaattattctatttcacaactcataaagtgttgcttaaaaatctaattccttagagcacaagcacagatcatcacaatagacctagttaaagttcattcttcaaatcgtgttgtttatataccttattatatactgacataaatccagtttagcaaggtatttaataagccctgactttcctttttaaaagcagaagtattcccttttctctctttaccacattgtaagtactgttttttttggttgttttttgtttgtttgttttgagacggagtctcactctgtcacccaggctggagtgcaatggcaccatctcagctcactgcaacctccgccttccggattcaagtgattctcttgcctcagcctcctgagtagctgggattacaagcacgcgccaccatgcccggctaatttttgtatttttagtagagacatggtttcaccatgttggccaggctggtcttaaactcctgacctcaagtgatcggcccgccttggcctcccaaagtgctggaattacaggcgtgagccactgcacctggccctaagtactgtttttatatctacaatctgctcctatattcataactgatggccctttgacttttccttctatagtgggaaaacaacaatcaaagagcagaaatggggccctgtcatacatagttccttccttccttccttttttttttttttttgagatagagtctggctgtatcacccaggctagagttcagtggcatgatctcggctcactgcaaactccgcctcctgggttcaagtgattctcctgcctcagcctcccaagtagctgggattacaggtgcacaccaccaggcatggctaatttttgtatttttagtagagacagggtttcgccatattggctacactggtcttgaactcctggcctcaagtaatccacccacctcagcctcccaaagtactgggattataggcatgagccaccacgccaagcttcctggcatacacagtttttaacaccccttgtcactgttctcttcccacctcccattatcttttcttagggctttgattttcttgaggattataggtttttaaaaggttgaaagggaccttgcaaaatccctcaggactgctattccttttctatctcttcttaaaaataatgttaaagaattaatattacatacattacaaatattagaaagtacatttacataagatgtgaaagaggcatacgatggtaacagacacactagacttagctggattacttctaggaataatagtaagtgtctaaaacaggttgccttgttagaacatgatactactgaatctgagtgcttatcttcctcatatgtgccaattatgtttttgtcgaagagcaatcctttctgattttcgcagactgctttctgattatttgtctcacaaagagactgggtaaaagcatgtggctttatttttgccatttctaaaaataacccaacagctatgctgtgcactgctcaccttagcactattgtattcatgtgtttatgtgtataaaggacagttcatagtcagcatattcaatgcttttctccctctttgttttaaagttcaaagttactgtctacacgaaagttggggtatttcaccactagcctcattttatgctattcataaaatcatgagcagactttttaccaagggcaaaaaaatcttaagaaacaggaacatcccccttcccccatacaatattcctgacaaccatttattaaggtctttctctaatctttcgctggaatcacctctacttcccaaaccatctctaccactgtcaactagcatcaatcgttaaagttcttcgttaggctgtgatcaaatatcctcatgaaggttttttaaggagtagctcttctacacattctcaaggcgggtactacagtggtgctaaggacatacctatcagcgaaatgaacatgttctctttaagttccacagttaagtccacctattataatagctgacatttcttgaacgattatactaagtggcagacactatgcatagtgtttggtgttttgtttttttgtttttgtttttttttttttgagacgaagtctcactctgtcgcccaggctggagtgcagtggcgtgatctcggctcactgcaacctctgcctcctgggttcaatggattctcctgcctcagcctcctgagtagctgggactacaggcatgcgccaccacgcccggctgattttttttttttttttttgagacagagtctcgctctgtcaccaggctgcagtgcagtggtgtgacctcggctcactgaaacctccacctccgggtttcaagggatgctcctgcctcagcctcccaagtagctgggacggggcccgccaccatgcccagctaatttttgtatttttagtagagacggggtttcaccatgttggccagaatggtctcaatctcctgacctcgtgatccgcccgccttggcgtcctaaagtgctgggattacaggcgtgagccaccgcgcccggccctgatttttgtatttttatagagatggggttttgccatgttggccgggctggtctccaactcctgacctcaagtgatccacccgcctcagcctcccaaagtgctgggattacaggcgtgggtcaccatgcccggcctaagagccaaaattttaatcagtgggaaatgctgactgccacgctcatttaagaggaaaggtcaggatttcgtgagctgcattgttcactgacatctactttaacgactccagcccagcctgagctaatcttttcctaaatcctttgcattttctttctactgtcaatttacaccttaacaaaataaaggagttttagagtaagatagaatcaacttcaatcaactctcttgaattcgctggggaccctctgctctaaaatatagtactattcttgcctctggcatccctggttttaccttcgtcttcctacctccctcccacctccatccatcccccctccccccattcttttgagtgcagtggcacgatcttggctcactgcaaactctgcctcccgggttcaagcgattcccccacctcagcctcccgagtagctgggattacaggcatgcaccaccatgcctggctaatttttgtactgttgtattttcaccatgttggccaggctggtctgaaactcgacctcaaatgacccgcctgccttggcctcccaaagtgctgggattacaggcgggagccactgcgccctcctggtccacccactattaaccccttatttcctacccttcacctgcacctctttgagggccatttcattcctggaatagcctgttttcattattagttatgggcctattttccttactatgtacaattttaaagtcataaaataatttttcttcagatgttaaaaattgtgtttacatttaaccagataaaacacttgttattaagggcatatgttcaaaaatcttcttttccatttattttctctaagtcaggcatataagctgatatcatgtcttacatattttaaactaaatttgacctgaagtcacctctgttccttgaatctctacctgattgcagctcagcttagtatgttcacaaactgaaaacctaatttaggagtacgttataagtcctcactaaaaatggtagctaggttcttagatattgtaactttaagtgaaataaagtataaggaaaccaatttcaccataagctaattgatataatgaggaattaacttcctattgcatacttatggacataaaaacatcacataacttctaaataaagaccaaaacacttcaaatactgaacattgaaataaattcccggtcttgcccaggtgatctcatctcagcctcccaagtagctgggactacagggatcttctccctttgttttttttctagccccacttccagtttgtttccacagtacttagagtgagttgctgttgtttttcttctttgttctgttctctctttattttcttatgttccttcctgcacactgaagttgctgttgttttagattttctttttttgagtgagatcttctcactcagtcacctggctggagcgattaatagctgactctgggtacagtgcctaagctagccttgctctgcaaggaacagttaaaaaagaaaagaaaggagaggagaggggaggggagaagggaggagaggggaggggagaagggaggagaggggagggaaggggaggggaggggaggggaaaaattaataaaaactaagataactatttacccaatgattccacttgaggtggtagacaacccaagcttatcctggcagctcagggaacaaggtgacaccaaccttggacaggagtccgtcccatcctcaaggcacactcacactcacacccacactcatgctcactcagactgggacaacgtgaacacgccaatgaacctcaacatgcatatctttgggatgtgggaggaaagtggagttacatggagaaaacctacaaagacatgaagagaaagtgtgaactttacacagactgtggccccagctggaaatctttttttttttttctcatcaatgttataacgacatgctatatatatttttgttacaactagctgagtctcagccaatcacagcaaccaaacttcagctaatcacagcaactgagcttcagccaatcacaggatgccaactgatcagacgatgcccaaataaggcaaatttggagctttaaccagtcaagctgtttgtgtacctcacttccagttctgtctataaatgctccctgtccacctatttgcccagtggaactctctgagcctcctttggttctgagggctgcttgattggagaatcattctttgctcaaataagctgttaaattcaatttgtcaaaagtttttcttttttttttttttttgagacggagtctcgctccgttacccaggctggagtgcagtggcacgatctcggctcgctgcaacctccgccgcctcccgggttcaagtgattctcctgcctcagtctcctgagtagctgggattacaggcgcacaccaccatacctggctaatttttatactttttggtagagacgaggtttcaccatgtcggccaggctggtcttgaagtccttacctcaagtgatgcgcccgcctcggcctcccaaagtgctgggattacaggcgtgaaccactgcacccggcctacaagtttttctttccacagtattatgtatcctgtattatgagataaacttcttgggcaaaaagcaagccattaaaggctgaatatttcagcatgcctaacttaataaaatttaggacattttaacttttgctacagttaaaatccactagactttttgatctgctgccatattagtttgattcaaaataatgagagcagatttattaaaatatgaagttgcatttcatattttccttgtattttttaagtgagaaaatttcctggtatcattttagctatcataaaatgccttttaggactatggaaatgaaagatcttggacataaatgatttggataaaataagcacatgaaaatactgcctgaaaatagttttaaaagaatcctgaggaattagaaaaacgagctattgtgaaacactgttagtttagcctttagtaaaacagcagaaataacaagcaattttggtcagaacaaagagaaagagaaaattgtaagttccacaaacgcagaaacagattttgctccaattggaaagcttcagaaagctaaacccttcatttacacaatccaaggcagagtgaggggcctctctgtgttgagctaaactgagcctatagtcacacattcacacatttggcactaggacagttgtgaggataggatctgacaaacttttcactgccaaacataactcagatgctagatgagcatgactctaagtatctttacacagagagtttagaaataacatttccctactcactggaataaataacccatccttgaacttggaaccatctaaaccattgtagatggtttaagtcatgcaaaacaaagtgctttttgctttctagatcttagcttaagaatgcaatattttatctaaatgactaggcaactaaggttcgctccaatttgaggattttaagtctagccatatgtctatttccaggaagcttatcagttttgtgtctggggctccagataatggaatacagcaaattataagcttcatggttcagcagaaaaaacaagtttggggtccagtaatgtataaaatagtaacagtaatgataaaacaaaatgcattcttctttcaaaccatagttagtaaatcccatgaaagtgtaatcctagataaatgtaatcccatgtaaatgacataattctttctccaggtaaaaagagctaacataaattgaccactaattatatgttaacacagttataaatacctttactgcattatcttttttaatccccacaaaattctataatctattattactatttcatttttgcatgtataagaaatgaaaggacagagggttaaataatttgcccagccaggcacgtgactgtaatcccagctactctggagggtgaggcgggaggatcacttattttttttaaatttaaaaagagatggggtctcactatgttatccaggctggtcttgaactcctgagctcaagtgagctacctgccttggcctcccaaagtgctgggattacaggtatgagccaccgtgcctggccaagaggatcacttgagcccaggagttcaagtccagcctgggcaacagagtgagactctgtctcaaacaaagaaaacaaagaaaaaataataatttaccctaaaaaaaattaaaataataataataaaataataataatttgcccaaagtcacacaggtagtaagcattgaaatctgtggcaaactcagaaggcctgactcaagaattcacgacacaaccacaacagattgtacactaccgggcagtttcctgctgctctgtgcatggcctgctggccaactctgatgtgaggtcagttgactaaaagagatgtggttcaggaagctgagaatgattgtggttacctgttctaagatagagaaattgatttttaaaacttcgagttgaagtacgggatgccaaaaaccacgtatgagtgacagagtgagtgggtctctttctgatggattaagtcttcaaaaagactttcagaatgaatctctatctaccttaattttgggcagtgttaattgtattcattttttcaacacatttgattgtgcatataccatggacaagaaagtttgttaaaaactgaatgtataaggctgggtgcagtgactcacgcctataatcccagcacttcaggaggctgaggcggacagatcacttgagcttaggagtttgggaccagcctggacaacatggtgaaaccccatctctacaaaaaacaaaaaaattagctgggcgtggtagcttatgcctgtagtcccagctacttggggggctgagataagaggatcgcttgaacctgggaggtcaaggccacagtaagccgtgatcgcactaccgcactccagcctgggtgacaaaataagaccctgtctcaaacaaccaacaacagcaacagcaacaaaaaccctaatgtacaggaaattattttggggagtagtggaagatagctggcaagttggagactctaacttgagatgtggtactacttgtctgtacattttttttctcatttctgtctacccaaaggtgttatgtttttattgtcttaagggggcccttcatttgatggcataaaaagttatgaccagccatctgtagttcagttaataggtcaagaatatcagcagctattgttatgttgaggtcattatttatcaagcttcaacacataaaaagcaaaagtaggccgggcgtggtggttcacacctgtaatcccagcactttgggaggctgaagccagtggatcacttgaggtcaggagtttgagaccagcctggccaacatggtgaaacttaatctctactaaaaatacaaaaattagccaggcatggtggcggatgcccgtaatatcagctacttgggaggcagaggcaggagaatcacttgaacccgggaggtggaggttgcagtgaactgagatcgcgccactgagagcactgcctgggcgacaaagcaagactccatctcaaagaataaaataaaataaaataaaataaaattaaattaaaataaaataaaatataaaataaaataaaataaaatataaaataaaataaaataaaataaaatagcaaaaatagtccaaatgtcagttaacagggggaccaaatttatgggtgaacatccacaagaaacataagtggcctctagggaagccaatctttgcacagaatttttgtttaatgaggtggagggtatacaagatataggccaaaggataatttaggttcttatgactgtgtccttgttcttttcaaatcctagcttcatctctgctcccactgatgacactatgagactttggaattcttcactgtgtgtaagacgattttattactgagatagctaccgctttgtagttatgacctgagtaaacaaggttagtcaacccacaggattttcatgtgtccacagatttttactagataatttatctgtaatatcaggaggcaaagtctaccatgaatatactggccaacatgtatcagatggaaaattcttgtgtaagcagatgatgtttaacttttatcacatttttctcttttgttagataatgccatacttcggcagacaagcaattgttttctagctataaatatgagtattttgcttttcaagagaaaaaatctagaaattgttttctttactttaaaaaattcatgtactgaagtccttcctctgcttgtattaatccaatgatatcattttatatattctctgaaatactaaaatatttctgtagtccatatgttttcaaattatgaatcattttatttctacatttggtacataaactattactgctcctgagtaaatatggatataccactttatagtgattttttttcttctttttctctttttctattttttttttttttttttttgaaaacagggtcttactcctggcctcaagtgatcctcctgcctcagcctcctgagtagctggaattataggcatgagctaccagtagtgattcctaagtccccagaaatttgagctaatttttatttatttatttattcttgtatttacttattttgaagacaaggtgtcgctccgtcacccaggctggagtgcaatggcatgatcatggctcaccgcagcctccaactcttgggctcaagccatccttctgcctcatcttccttagtagctgggaccatacgtgcaagccaccacacccagcttgagctgatttttttaatgtgatgaactatgagaaaacatataggagctaaatgatgagaacttagaaacacaaagacggaaacaacagacactatggtttacttgatgatagaggatgggagggtgaagaggagcagaaaagataactattggataatggacttaatacctgggtgatgaaacagtctgcacaacaaacccctgtgacaagagcttacctatgctggcccggcatggtggctcacgcctgtaatctcagcactttgggaggccaaggcaggcagatcacttgagctcaggagttctaggccagtctggccaacatggtgaaaccggatctctactaaaaatacaaaaattagccaggcgtggtggcgggtgcctgtaatcccagctactcaggaggctgagacagaagaatggcttgaacctgaaaggcggaggttgcagtgagctgagattgcgtcactgcactccagactgggcgacagggcaagactctctctcaaaaaaaaaaaaaaaaaaagaaagagagtttacttatgtacaaaccttcaaatgtaccaccaaacctaaaacaaaagttaaaaaaagaaagaaaaataaatgtagaaaaaaatatatatatatatgaacaacgcataatcctggaaatataaggaaaaattaaattttctcctctgggaaaaatttatacagtaatgattcttgctctttaatttttgtttgaaagaaatctagacatttaaaaaaccccagtggtagaattgtcttgttaaaaagggacatcaagtaaaaggccaggggaacatcaaacaattatgtttcttacctggcaaaaccagtgtctagctaaaataatggcttgcaaatcaatcttgttgtttaaccacttcattatctggttttctctaagcaaagaacattatctgtgttgccaataatagtactggggaaaaacacacattttgaaagtatgaagaaactcattctaccttgaaattctcattcaagaggaaattataggccactgcaggaccagcgattgaaaaacaaaggtgtacaaaaacaaacaactcaggtttcaaaggctaaaaacaaagataacaggaaagaacctaaacttgtgcagcctgtttgcttactgtctgaacaaatgctgggaatgcatgagaaattctaagccctgtgaacaaaagtgtgagcagtaagatgacgggtgatcaattttcttcctttctctatttttcattttttccctatgatgagcatatgccacttttatgttataatgataaaaaagaaagacttaaaaaatgacttttgtttttccaactgtataccagtatctatctacacatagcaactgagcacgctagtcctgtcgtctggcactcacacaaaaagagtgaatgtcaaaatctaggcaattctaccagatttcacgtaatgaaactaccttgaataattccttaattcttcacaaaatcatgtttttatttaacttctatttctatcaagcaatgtggactaactacccctaatatttaactctatttaaactgtgtatcaggccagatgctggctcacacctgtaatccaagcactttgggaggccaaggcaggtggatcacttgggctcaggagttcaagaccagcctgggcaacatggagaaaccccgtctctacaagaatacaagaaattagctgggtgtggtggcatgtgcttatagtcccagcttcttgtggggctgaggcaggaggatcgcttgagcccagtaggctgaggctacagtgagctgagatcatgccactgcactccagcctgggtgacagagtgagaccttgtctcaaaaacaaaacaaaaaacagattacacactacattaaataaataaaatactctctgatgatgactgattttgaatgaaaatactccattcactggaatatattttccataaaaaatgacaaaaacattgtcattttttgtattatttctttttcttttcttctttttttttttttgagatggagtctcactctgtcccccaggctggagtgcagtggcgcgatctcagctcactgcaacctctgcctcctgggttcacgccattctcctgcctcagcctcctgcataactgggactacaggtgcccgtcaccatgcccagctaattttttgtatttttagtagagacagggtttcaccgtgttagccaggatggtctccatctcctgacctcatgatccgcccgtctcggcctcccaaggtgctgggattacaggcgtgagccaccacacccagccttatttctttttcttttttggagatagagtctcgctctgttgcccaggctggagtacagtggcccaatctcggctcattgcaacctctgcctcctgggttcaagcaattcttctgcctcagcctcctgagtagctgggattacaggcagacaccaccaggcctagctaatttttgtatttttagtagagacggggtttcaccatgttggccaggctggtcttgaactcctgatctcaggtgatccacctgcctcagcctcccaaagtgctgggattacaggtgtgagccaccacacccgacctattatttcttgtattattaaaatcatttcaggaatttgtaaaagttacagtaataaaactcgtactgcaaccatgactagaacatggcctttgtaaagaatccatttacaggctcataagatttggtgttgtggatggatggctatggagctgctcaagcttgtgtttgcacttatcagaattcaaggcagttagaaagagtttccaagtgctgatgtgctggagaagaaagggcatgctgcagtgtagaaaccacgggagaaacaattgcgtcacctagtttcaaactgtgagaaaactactagcgaactagaagaatatttaacttcctaaacctgagagatctacatcttaaagaatatagattctactctaggcacatcatagtcaaactgataaaaaataaaaataaaaataaaaataaaattacagcagccagtaaaagactacacgttacattcagcatagcaataatgtaaacattgttgacttctcatcagaaactctacaggccagaagacaagaaccaatatctttaaagttatgaaagaaagaaaaacaaagtagccacgcagaattccatatctagcaaaaatatccttcaagaatgaaataaaggtatttccatttataaagacatatcatgtagataaaagaaaactaagatatttcactgccagaagacttataagaaatcctggccaggcgcggtggctcactcctgtaatcccagcactttgggaggctgaggtgagtggatcacttgaggtcaggagttcaagaccagcctggccaacatggtgaaaccctgtctctattaaaaatacaattagccaggcatggtggcatgcacctgtaatcccagctacttgggaggctgagacaggagacaggagaattgcttatacccgggaggtggaagttgcagtgagctgaggtctcgccactgcactgcagcctgggtggcagagcaagattctatctcaaaaaaataataaaaacatgaaaaaaaagaaatcctaaaggaaaatttccaggctaaagggaaatgataccagagagaaacagattttcaggaagaaatgaagaacatcagaaatggcaaatatctggataaaaacaaaagataattttccccttattttttaaaaaatgcactgtactgtagggtttagtacatatatagataatacatatgacagctataatataaaagatgagggtagagtggggtagatgcacctacattgtttgcaaattttgacgatggtctatgaaaatttaaagtcatttattctcagctgggtacagtggctcatgcctgtaatgccagctctttgggaggccgaggtgggcagatcacttgaggtcaagagatcgaggccagcctggccaacatactgaaaccccgtctctactaaaaatacaaaaattagccaggcgtggtggcacgtgcctgtaatcccactacctgggaggctgagacaggagaattacttgaacccagaaggtggaggtcacagagagccaagattgtgccactgcaccccagcctgggcaacagagtgagactctgtctcaaaaaaataaaaataaaaataaagtcatttattgtaatcttcagagcaccactgaaaatgtgatgcaaagaggataactagaaagtcaacaggtaaattaatattaaattctaaaacctattcaaataatcctagagaagtcaggaaaggaagaataagcaaacaaagaagagaagggacatatagaaaacaaatagcaaaacagtaaagttaaatctaactgtgtcattacattaagtataaaggggctaaacatcacaagtaaaaaaaacagagatcattagataggattttaagaggaaaatctaaccacatgatgtctataagataagcaccttaactataagacacaggttgaaagaaaatggaaagaaaaatatgccatgtgaaaagtaggctttagaagattggactggctgtatctatcagaagaaatagacttaaaacaaagacttttaccagagataaagaaggaaatttcctaatgataaaatgatcagttcattaggaaataataataatcataaagatgtgtgtgtggttgggcacggtggctcatgcctgtaatcccagcactttgggaggctgaggtgggtggatcacctgaggtcaggagttagagaccagcctgaacaacgtggcaaaaccccgtctctactaaaaatacaagaattagctgggagtgatggcatgtgcctgtaatcccagttactcaggaggctgaggcaggagaattgcttgaacccaggaggcagaggttgcagtgagccgagccgagatcatgccattgcactccagcctgggcaacaagagcaaaactccacctcagaaaaaaaaaaaaaagtatatgtgcctaataacagaggttcaaaatacataaagcaaaaattgactgaattaaaagaaccaaaagacaattctaccactagaggtggagattttaaaacactcttagtaatggactgaccaactaggcaaaaaataaataaataaataaataaataaataaataaataaataaataattactctagacatagatcctactttatgagttggttaagttggtgactgggaaggatcttcatgagatgagctcttgtaggagggacactccattctttgtaacactactgatgaaggaaaagtaataaaaacgttttaaaaatgagtatgtctattgcaccactgcactccagcctgggcgacagagcaagactccatctcaggaaaaaaaaaaaaaaaaaagagtaagtctgaaatatttctattcctatttctctatgtgttctgcattagtttttcttgtaacttttttttttttttttgagatggaatttcactctttttgcccaggctggaatgcaatggcacaatcttggcttactgcaacctctgcttcctgggttcaagtgattctcccgcctcagtctcccaagtagctgggattacaggcacgtgccacacctcccggctaatttgtgtatttttagtagagaaggggtttcaccatgttggccaggctggtctctaactcctgacctcaggtgatccacccaccttggccccccaaagtgctgggattgcaggcatgagccaccacacccagcccgtaacataatttatttaggcttcaaaaattgtccaagcaacattttctttttctttctttcttttctttcttccttccttccttccctccctccctccttttctttctttctttctttttctttctttctttctttctctgtttctctctttctctctttcagtgaaagcaagtttattaagaaagtaaaggaataaagaatagctgcttcacagatagagcagtcctgagggctgctggtcaagcaccattttctagacctgtcctgtacagatttccctccctttccattttctttacataacatcaagaatcatttatgttcctttggtaatgtttcattctacattgcttcttcataacacatgtgctgtagatcttactagcagtattagccagcagatggcttgtttattgtggtggtatactgctgatggactgaaatgatggcataaataggctaattcacttttatgttttttcttctttcttcaaaagatataataaaacaagacagaaaacaattttttgacagatgaaattgataatgtttagaccgtaagtctggtctttgaaaaaaaaaaaagccatcagaaagtttctcactttccttctcaagtcctcctgtttctgctaataggcacagcctctgactcccttttatgaagaacagattatagcacagatttagcccaagctgtttctgctaggagagctgcttcttcctaagaagcgtgctatagaactgggcagtccactctccattctcctagccttggtattttctggctgcgagctttggatatgtcagctaacctattcagcttattatttcatttctaatagaggcataacaaggaaagggctgtctctcctatttcaagggattgcggcaaacactacattagatttctgtgaatactccttgtaaaagcgtgaggcataatacaaatatcagatatcagcgtgagttttctatttcattagacctatttcattagaaaaggtgaaagctctattatcactctcttaattgttttagctcctttttgcttcaccttcccttttatttctagtgtctactttgtgcaattaggcctcacggctcatgtgtgtttgtgaaaaagaatttttaaatgtcttctatttgctatgagaacataccctactctttgtctaagcgtaatttctaatcatataacctgaagcatattctccgatctcataaagtggcattcttctgattctgattagatgtacagccctaatatcatagtgcaagtatacatgccctcccataagtattctgaagtatgattcaccctaggttttcaaatctcttccttgccctagaaaacaaacttggactcatgtgtttgcccactttattcaactcctctgtcttctactccagcaaatagactcattcctcattcctcccaacacttaaatatgcttcacaatccacaaagctgtacctgatgatatatatatatatatatatatatatatatatatatatatatatattttttttttttttttttttttttaaatgacaggcaggtaatgtgcagacatcataacaaggcttgaaggaggcatatctcacacaggaacatgaaaacccaatcatcacacttataaacgacaaagggatctagtatatacgttttagatactgaaaagaagacataacaaaaggacttttagggtaaaattgattgcaaggctaggtatggtggctcacacctgtaatcctagcactttgggaagccgagctcagcagattgcctgaggtcaggagttcgagaccagcctggctaacatggtgaaaccctgtctccattaaaaatacaaaaattatccaggcatggtggctcatgcctgtagtcccagctacttggggggctgaagcaggagaatcgcttgaaccctggaggtggaggttgcagtgagccgagatcgtaccaccgcactccagcctgggcgacagagcaagactccgtctccagaaaaaaaaaaaaaacaaaaaaaaaattaattgcagtgtattcgagtgttgggttaggtaagaataaataaacaaggccgggcgcggtggctcacgcctgtaatcccagcactttgggaggccgaggcgggcgaatcacaaggtcaggagatcgagaccatcctggctgacacggtgaaacaccatctctactaaaaatacaaaaaaattagctgggcatggtggcgggcgcctacagtcccagctactcgggaggctgaggcaggagaatggcgtgaacctgggaggcggagcttgcagtgagctgagattgcgccactgccctccaacctgggcaacagagcaagactctgtctcaagaaaaacaaaaaacaaaaaacaaacaaacaaaaaaatatttccccccaaaccttgcctttgtgtagagctttactacagaatgtatcctgtacataacaggaaacaggttgtatttttccaataatacctggatcatcattagtccagaaggttcttggatcgggcttggtcaggatgttggcatgattacatggctctctcacctttaaaacataaagagaaaagaagtgatataaaaatggcttcatcatttcagctattttaggcttatagttctagagaaaggattccaaggctgaaactagtacatatggcatgtctgtgctctaattagggtggttttctcaggaccgtgctgggtatagcactgaaagtcccatatcctgggaagccttttagtcctgggcaaaccgggacagttggtccccttacacatgaagcagtttcactgggctgatggctgggttagcacatgggcgctggagctcacccagtgctatgtgcagtgcacaaactgcacagccgtatgaagaggccctggattattagcaaatttatcagtgtagacactcaatacataaaaagtgtttgaatctccacataacagaaatgatacttttagtacatattgcttgggaaaatacatattaattaaaagctacttttaattcagtagcactttaaatgctttttttgtttgtttgagacagtcttattctgttgctcaggttggagtgcagtggtgcaatctcagctcactgcaacttctgcctcctgggttcaagcgattctcctgcctcagcctcctgagtagctgggattataggcgtgtgccaccacgcctggctaatttttgcatttttagcagagacggggtttcaccatgttgcccaggctggtctcgaactcctgacctcaaatgatccgcccacctcggcctctcaaagtgctgggattataagcgtgaaccaccgcacctggcctgcattcttattttataatcataacaggatctttatattctcaaatagcagcacatgtacatatgcaatatgtattatttagtccacttagaggctcttcttagtgcagatacatgtttttaatgataaataatatttattgagcattttctgtcaggtattttttcatttttaaaaaaatttcaatagatttttggggaacagatggtgtatggttacatggataagttctttagtggtaatctccgagattttggtgcacccaacacccaagcagtgtacactgtacccagtgtgtagtcttttatctcttgccccactgtcacccttccccttgagtccccagagtccattgtatcctctttatgcctttgcgtcctcatggcttagctcccacttatgagtgagaacatatgatatttggttttccattcctgagttacttcacttagaataatggtctccaattccatccaggttgctgcaaatgctattattttgttcttttttggctgggtagtattccatgtatgcgtatatatatatatacacatatatatgtgtatatatagatatacacacacacatacatatacacacatacacgcatgtatatatatgtatgtgtgtatgcatacgcatacatgtatgtgtatatatgcatatacatacatgtatgtgtgtgtatatatatatacacacacacgtgtttttttcgtatatgatttcttttcctctcgatagatacacagtagtggaattgctgggtcaaatggtaaatctacttttagttctttaaggaatctgcatactgttttccatagtggttgtactcagatacaattaatagatttcatataacaagttccacagagcagcagtgatccatgtttttgacagctttatactactgtgatattagctttcaaatatattctcaggccaggcgtggtggctcacccctgtaatcccagcactttgggaggccgaggcgggcggatcagctgaggtcaggagttcgagaccaacctggccaacatgctgaaatcccgtctctactaaaaatacaaaaattagtcaggcatggcagcgcatgcctgtaatcccagctactcaggaacctgaggcaggagaatcgcttgaacccgggaggcagaggccgcagtgagctgagatcgtgccactgcactctagcctggacgacaaagcgagcctctgtctcaaaaaaacaaacaaacaaacaatcaaatatattctcatgaagttaaatatagatcttagtgttaaaactgcttttccatttatatatattttgtaatgtgatcatttgattactgcaaatattctatagtttcatcaactacttagtggataaattccttccattgcaacaataatcaaaatactcaagaatgacactaaggtcattgtttagtttcaccgacattttctctttataacaaggcttttgtttttctttgttgagatggagtctcgctttgttgcccaggctagagtgcaatggtgtcatctcggctcactgcaacctctgcctcctgggttcaagtgattctcctgcttcagcctcaatagtagctgggattacagacgtgctccaccacgcctggctaatttttgtatttttagtagagatggggttttgccatgttggtcagactggtcttgaacttctgacctcaggtaatccgcccacattggcctcccaaagtgctgggattacaggcatgagccaccgtgccaggcctgtgaagctctattgacgaaggaagcagtgcatgaatttaccatctggtacaagctccttctcttgtggaccagtatcaaagaatatgtggaaatcagagaaattgggatctcaaagaggtattttcacttccatgttcattacaactttattcacaacagccaagatgaggaagcaacctaaatgtctactgacggataaattgataaagaaatgtggtaaatacatacaatggaatattatttggcctcagaaagaaatcataccatatgtgacaacgtggatgaaactggaagatgttatgctaagtgaaattagccagtcacagaagaacaaatattgcacgattccgcttacataaggtatgtaaaatagctaaacacatagaagcagagaatagaatggtggtttccaggggctgcagggaggggcaaatgggaaaatgcttgagttgctattcaatgggtataaaatttaatttaggcaagacgactaatttctagagatctgctgtacaacatggtgcctagagaacattactatattgtgcacttgaaaaattgttaaggccaggtgcagtggctcacacctgtaatcccagcactttgggaggccgaggcgggtggatcacgaggtcaggagttcgagaccagcctggcaaacatggtgaaaccccatctctattaaaaatacaaaaattagccgggcatggtggcgggcacctataatcccagctactcgggaggctgaggcaaaatctgggaggtagaagttgaggtgagccgagattgtgtcacggcactcctgcctgggcgacagagcaagactccgtctcaaaaaaaaaaaaaaaaaaaaaaattttaaaagggccaggcatggtggctcacgcctgtaatcccacactttgggagactgaggcgggtgggtcgcctgaggtcaggagtttgagaccagcctggccaacatggtgaaaccccgtctctactaagaatacaaaaattagccaggtgtgggggcacacgcctgtaatcccagctactcaggagcctgaggcaggagaatcgcttgaacctgggaggcagaggttgcagtgagccaagattgtgccactgcactccagcctgggcgacagggagactctgtctcaaaaaaaaaaaaaaattgttaaaaggatagatctcatgttatgtgttctttccacaataacacaaaatctagaatagattgccatcctattttgtcagtatatcagaaaggaacagaagacatttgatacataaatatgtaagtggtctatattttataagtggaatttttttttgtaattgtaatacatttttcatttataggaaacatgattgtagatgtaagactgaaggaaaaaatgccattaaaatttaaatctcaagaaaaaaggacaggcctcttgcctctttgcctcattgaaatcctgaaagcaagatgcatcaatagcagctctacaagagccattagtgaaaatttggccagggttctcgctcttgttgcttctgctccaaccagcatggtttgacccagattatgtgcagccaatttttccatcagtatgcaaagtaagaggtagacttcattacgttgggctaagtgatcttccttgaatagattaccaaaatcatccacccagtgaaagaaaccatgctagctctttgcacgtaaaataaattaaaaagaaaataaaagaaagaagaagaacaagaaaaagaatgtgtggagcagtaacatttcctggactacattttgagcagcactgtaaaatatccctcctactgaatcacttgaacccgggagactgaggttgcagtgagccgagatggctccactgcactccagcctggcgagagagcgagattccgtctacaaggaaaaaaaaaaaaaaaaaaaaaaatccctcctacctgactaagcagcctcagtatgaatcccttctcaggatttatctactccactgaagtactacttcaattgttagaaagctcttcacaggttgaattgaaatctgggtccttgaaactttggttcctgtttttttgttttttgttttttgttttttttgggggggacggagtctctctctgtcgcccaggctggagtgcagtggtgcgatctcggctcactgcgagctccgcctcccgggttcacgccattctcctgcctcagcctcccgagtagctgggactacaggcgcctgccaccacgcccggctaattttttgtatttttaatagagacggggtttcatcatgttagccaggctggtcttgatctcctgacctcgtgatccacccgcttcagcctcccaaagtgctgcgattacaggcgtgagccaccgcgcccggtgattcctgtttttaactcactcttaaattacaaagaacaggtctactctctcttttatgaaataatatctcaaatatttgaaagtagctattatgtctcaccttagctttccatttccaagttaaccagccctcttccctttcactgctctcgaggagcttattttaagtctttttactgaggtcactctgccccagaagacatcctttccagtaagtgaactagtcctcagggagctcccaggccagggttagataatagtcacaaaactaaggagttggttttgagggacagctttcaggaaggacagccagcattatttccacatacaagtaattaaaatgttcccaagcacctataaatctaacataccatgggagtaaagaatgctttatgacttagccacttttaatattttttaatgccaaaaagttttaattgattttctacagtaactatatacctatttgggaaaattgccatatgcgagctttctttctgcattaagctccagttaccttgtttccttgaggctttcgtatgaagcaaatgccattcttacagatctcatttacttgtgaatgattatcactatttgttcaataaaatcttccccacgttgaagctgctcctgatgaagtcagggtcttcaagaattcttgttctctgtgtcattatcatacaagtatcacaccattctttatggttctcaagaaccaaagcatccgcggcaaattacccggagagctcatatagtaaattttaagcacaagtttatagaaatccttgaactatatatactgcaactgtttacaggcaatgctctataactcctatagctttaggtactttgcagaagcgagaaaatttattatcagataaagtcttggccgggtatggggggtcacgcctataatcccagcactttgggaggttgaggcaggcagatctcctgaggtcaggagtttgagaccagcctggccaacatggtgaaaccctgtctctcctaaaaatacaaaattagccgggtgtggtggcgcacacctgtaatcctagctactctgaaggctgaggcagaagaatcacttgaacctgggagacggaggttgcaatgagctgagatcatgccattgcattccagcctgggtgacaagagcaaaactctgtctcaaaataaataaataaataaataaataaaatgtcctcatgaaacacctgtggcttagcattccagcctgggtgacaagagcaaaactctgtctcaaaataaataaataaataaataaataaataataaataaataaaatgtcctcatgaaacacctgtggcttagcaggaagttggaagctaaagaagtgaccagcgcctggagtttggctcctggctgaatccacatgggctctttggttctttctttctttccctggaataaggattcaaggagaatttctccaataggatatatgccatgggagtatgattgaggaggggcaaaaacgtgatataataagaacagcaaaataacagtatgcaattttaaaatattttattatagaaagcttaaagcatacacaacagtaaactgtataataaacctctatgtacctatcaaccaactttaacaattatcaatattttgctaatcttatttttacctatcttgccttactttttggctggaatattttaaatcaagtctcagacatcataacaattatctgtaagttattaaaaaaaatttttttttttgtagagacggggtctcacttgttttcccaggctggtttcaaactcccagcttcaagcaatcctcccacctcggcctcctaaagtgctaagattaggtgttagccaccactcaaggtttataatttcttcagaatgtgtttctgacaacttttttttgcctaaccaccatgccattatcacaactaacaatttcaacaataattatgtttattaaaattaaggctcacgcctgtaatctcagcaatttgggaggccgaggcaggcggatcaactgaggtcaggcgttcgagaccagcctagccagcatggtgaaaccccgtctctactaaatatacaaaaattagctgggtgtggtggcgcatgcctataatcccagctactcaggaggctgaggcaggagaatcccttgaacctgggaggcggatgttgcagtgagtcaccgtactctagcctgggtgacagagggatacgctgtctcaaaaaaaaaaaaaattaatgaaagtaattaaagtttagttatttaataaatgacagcatgtacattctgaaaaacagaatatgtgcagtattctgcagacagaataatttgaataaaatttgaatttaaaagataccatttcaaactgtaagccccctaaaaatcagtggaccttggcttcacttgtttaaatcctcatggcttctagaagttttgggtggggggacatctttaaaaattatttttctaacagaagtcttactatttttcaacttattttctatgagtcctaggaggtagaaagagatttttcttgtctgatagacttgaaagtattgggttaggtaagtggaagaaagatcatatttagaaggtaaccgttgaatgtttaatcactattgttttgacatctagaagtattgtcataggttacaatttaaacatcagaagatgggggtgtatgagaatatcacatttagggagatgtcagttgtccagaagttttgcagagaatctggaaaataaacatgagagtaagttttctttctttctttctttttttttttttgagagagctttgttgcccaggctggagtacagtggctggctgactacaacctccgcctcctgggttcaagcaattctcgtgcctcagcctcctgagtagctgggattataggcgcctgccaccatgcctggctaatttttgtatgtttagtagagacagggtttcaccatgttggccaggctggtctcgaacacctgacctcaagagatctgctcacctcagcctcctaaagtgctgggattacaggcatgagccacggcgcctggccgagagtaagttattaatagttctactgatgtcagaaataagatgtagtctgaattccatgaattgtttccagttaatggaaagttgaattgtggtggaattggtagggaaaaaaagcagttatggtcctctgtctccattctagttcatccttatttaaagaatattactccaggcagtgagcacatgcgcgcggtggctcatgcctgtaatcccagcactgtgggaggccgaggtgggcggatcacctgaggtcaggagttccagaccagcctggccaaaatggcaaaaccccgtctctactaaaaatataaaaattaggccaggcgtggtggctcacgcctgtaatcccagcactttgggaggctgaggcaggtggatcacctgaggctgggagttcgagaccagcctgaccaacatggagaaactacgtctctactaaaaatacaaaattagccaggcgtggtggtgcatgtctgtaatcccagctacttgggaggatgaggcaggagaatcgcttgaacccaggaggcggaggttgcagtgagttgagatcgcgccactgcactctagcctgggtgacagagcaagactccatctctaaaaacaaaaaaagaacatttcttcaacaaaataaatatattcacgtatgcataaattttttaaaactttttttctttttataaaaaaatcagttttctcaggttgaaatgttaaaatcacctctgatgaagatagagaactaaaatataaaatatgggtttgtctctgattcctttttggtttataataatttgcatatggctttccatggatcactttagcagtttgtgctaaagtcattagttcttcctaagatacaaaagaaattctcaaaatgcttgtttcctattaggcagggaagttgtttttctcatctctcaagttgcatgaccaaaagtagcaaaaatactttatctctagggaagtgaaagcttgcttctcaaattgctttagtgaggctttaggaaatggcccctggctggtatcataggatataataccgtcttgcaaatagtaattttgaattcagttctttgtatctatgagataaaagagtcttcttccattgactgtcttagatgggcttatcacattcaacagtatttactgagcatttgttttaagaaactactaccctagttgctaactcattgctccctagacattgtatttggattgaggagcagaacatagacatcaacaaaacagatctggaacccgatatcatgtacctctaaatgtgaagtatgcggtagagctaatgttttgtcagagtttaaagaaggaagcaataatatgggcaaagttgttgagcaaggcttcagggaggaagtagaacctgaacaggcttttaaaaacactggcaccatttggattggtgaggaggcggtagaagggtgtcctctctgggtgggacagcacaaacaaaggtgtgggaacaaaactcaacaaggcacatttgggcaacacttggttgagcaattccatgggagtgcaagactcatgggcgaaatcattggaagccacatggtggaaggctttaaatgtcaatgtgttcttcatgccatggaaattcagaaggcttggcagtttgcaggaaagaccagaattgaagaatacaggagctgaggggatcaggggactgctataacaacagggagttgacagagcacgaactcacatgggagctctgaaagtgaaaaggcagggatgggtgtggagggcagctagaagaatgctttgcaagacttgaagaatgactgaaaactagggaagatgggggaatccaaaacatttcatggctttggaatttggtgaccaggcagatggtcatagagggtcaaagctgtccacgagctccagcaacaggaggaagcacagcattctgtgctcagactagtgtggcaggcctgcagaatgcgtgtgggcccttgttcctgtgcttggctgagggcttcctgagagcagttgctccatctctgacccaccggaccactactgcctttggatcctgggtggtgggcttcactcacacagtcgaatgggtttctcatgcctttgtccctgggctacagtcctccacttcacaccacaccggtcaagatggaatgtggccacattatctcactacagcaaacatgcccatagtttgcaaatttggtacatcaaccgccacgctcataaagatgatggtttggaccaggatagcaggagtctggtcaagagattaatgcagggtcagagatcaggagtcttatcatcttgatctctgcaagctaatgatttatccttcttcaattgcttaacattaatcacatttatataacatgaggcctaggaacaatacttgaccccacaagagattgtgattccaaacaactagtcagatgttcctccttttgtggttttatttcatttgcattcttttttattttgatatttttcagtttggcctttgtaattgcaaacagcttaaggcaattcaccacccaacccacttcacttatttatgtttcctgcctggctcagcaagcacttgaatttaaactctggtctacacaaggtcaagatattcaggtcaaatgtctattaaatcaaatgttttctatattctacacaactagtagagttcagaggatcagagatttggggacctgaagggggtcttttattaattccccccttgcattatggttgagacaatcgaggtccagagggtaacgtaacttgtgttagggaccaattaagggctggagtccatgtcttgagttacattttaagatgtcaattgagaacggatacgggtttcttaaaactcaaatttatcctcaatcttgaaatttattcagttattcatttaataaatatttgtggataacttattatacaataggcacagtgctaggagccatgggcataggtgtgaacagacagacagatcttgccctcatggaacttgttttcttttctttctttttttcttttttttttttttttgagagagtctggctctgttgcccaggctggagtgcagtggtgatcttggctcactgcaacctccacctccccggttcaagtgattctcctgcctcagcctcccaaggaactgggattacaggcacccaccaccacgcctggctaatttttgtatttttagtagagacagggtttcaccatattggccaggctggtctcaaacttccaacctgaaatgatccacccaccttggcctcccaaagtgtgagccactcttacaggtgtgagccactgcacccggtcagaacttgttttctgatgctggtagttgaggtgggtgctatggaggcaataagtacggacacatgagtaaggagtgaggcgataagtggtcattttagattctttaagggagtccatcttacctaattttttcaataatatcaccagaatcaatgatggcacatctgcatttttcagttaaaacacataacacatttaggttacaatggaacacagcttttcaatgtactaaaatggctgtttttttgtttttgtttttgtttttgtgacagagtcttgctctgtcgcccaggctggagtgcagtggcatggtctcagctcactgcagcctcggtctcccaggttcaagcaattcttgtgccttagcctcctgagtagctgagattacaggtgcgtgccaccatgcccagctaattttcttttctgttctggttttttattttgttttgcatttttagtagagatggggtttcatcatgttggccaggctggtcttgaacacctgacttcaagtgatccacccgccttggcctcccaaagtgctgagattacaggcatgagccaccgtgcctggccctaaaatggctgttttgagttgacacagagccatgtccaaacacccgtttccacttcgcctatttaaatttccctcctggctctgcaggcattggagtttcgacctgagattctatgccaggccaagatatctagattgtttgcattctatatcaaaacatataattggccagccgcggtatctcacgcctgtaatcccagaactttgggaggctgaggcgagcagatcacctgaggttgggagttcgagaccagcctgaccaacatggagaaatcctgtctctactaaaaatataaaaatagccgggcgtagtggcgcatgcctgtaatcccagctactagggaggcagaggcaggagaatcgcttgaatgagggaggcagaggttgcggtgagctgaaattgcgtcattgcactccagcctgggcaacaagatcgaaactctgtctcaaaaaaaaaaaaaaagaggccgggcgcggtggctcacgcctgtagtcccagcactttgggaggccgaggcgggcggatcacgaggtcaggagatcgagaccatcccggctaaaacggtgaaaccccgtctctactaaaaatacaaaaaattagccgggcgtaggggcgggcgcctgtagtcccagctacttgggaggctgaggcaggagaatggcgttaacccgggaggcggagcttgcagtgagccgagatcccgccactgcagtccagcctgggcgacagagcgagactccgtctcaaaaaaaaaaaaaaaaaaaaaaaaaaaaagaaaagaaaagaaaagaaaaacacatataattaaattattaagtaaaaattatttgtggcatggtgttttgtagattttgcctgatccagagaaaaggtaatcaatgcatgtttattgaccacatcattgatttgtaggagtcaaattatgttaaagtagccaaagttaatctatcacagaatcatagtattttgtggctagaagatatttaacagatgacttagttcagctcccttatttaatagatgggaaaacagactctgagggaggccaagtggcttacagaaggctacacagatagaagttatatatgttatttacagtacatctactgtggttaagagaggcctccttgcatttattttagagcggagttggtagaaatagttagatatagcagtttagagcatgagctctggtgtcagacagacctagagaaaatttaagtaaaacttaaaatttacttgactatgtatgtgcccctgggatattagttaatatcttttagctgtagtctccttattggaaaaattggcaaagttagagttcagtttagggttagggttagggcctctaagttttaataattggtaaaggttattattatccattttgtaccatcaacatgtcaacaggagtataatgacttagatggagtcatatactcctctcgggagagatataattttttgatagaagcctggccaacatggcaaaacgccatctctactaaaaatacaaaaattagtcaggcatggtggcccacgcctgtagtttcggctactctggaggctgaggcaggagaatcacttgaacccgggaggcagaggttgcagtgagccaagatcatgccacagcactccagcctgatcaacagagtgagactccggctcaaaaaaaaaaaaaaaaattttattaaaaaaagtttgctcaggccaggcgcagtggctcatgcctgtaatcccagcactttgggaggccgaggcaggcagatcatctgaggtcaagagttcgaaaccagcctggccaacatggtgaaaccctgtctttactaaaaacacaaatattagctgggcgtggtagtgggctcctgtaatcccagctacttgggaggctgagatgggagaactgcttgaacctgggaggtggaggttgcagtgagccaagactgtgccactgatctccagcctgggtgtccgagtgagactccgcctcaaaaaatgaaaaagaaaaagtttgctttatcaattgaataatctatatgcaaataattatggcaaaagtaaaaagacttctttcctggggttgtactcactgagccctcaccctggaatgttctttgcctagccttccacacagttctcatctccttcaggtatctgctcagctggcaccttctcagtgaaggcttgcttgtcattttgtttaaatggaaactttgttcccatttcctgctttatttttctccatgacacttacctcctaataagtaattttctaatttgctttgtttatgatctcttgtaaatttcatgagtcctaaacgggtgcttggcacatataatttttttttttttttcttgagagggagtctcagtctctcgcctaggctggagtgcagaggcacagtctgtgctcactgcagcctctgactgttgggttcaagcaattctcgtacctcagcctcctgagtagctgggattacaggtgtgggccaccacacctggctaatttttgtgttttttgtagagacagggtttcaccatgtcggccaggttggtctcaatctcctggcctcaagtgatccacccagcttggcctcccaaagtgctaggattacaggtgtgagctaccacgcccggctggcattcaataaatcttcgttacttatccctaaataataaaaaatgtgaatcataaatcccactgtacttgagctactagaattaaaggagataattattctgccaaaatgttgtgttttaacacatgtatcttcatttcttctagtgctttaatcctcctgaattcctggtgttggggcaataacatgccatggtggggttacctcagagtagggggtgcctctttaaatgcctggaggtgaatgaaagaagctattcccaacctagcagccaggctgtgacttctgacattgcatttcaatgccgtttttttctttgcataaagatgtagaaacctgtttaggctgtggtctactaccaaatgtactcattagaaaaaattgctttttttttttttttgagacggagtttcactcttgttgcccaggctggagtgcaatggcgcaatctcagctcactggaacctctgcctcccaggttcaagcaattctcctgcctcagcctcccaagtagctgggattacaggcgcccaccaccacgcctggctaatttttgtatttttagtagagatggggtttcctcatgttggccaggttagtctcaaactcctgacctcaggtgatccacccacctcatcctcgcaaagtgctgggattacaggcgtgagccaccacacctggctttagaaaaaatttctaatgactggctgttttcatctttcagattattgtctatgactataacatagtatggggctgggaaaaaataatcttcaaaactcttttcaaatatttaacttctattcaatacaatatttggatttgttcaaaaactatgaccaggttttcttgcactcatcaaaagcatatttctttccagtagtttcaatcatagctacccattataattaggaacttaaaaaatgaaataacagtgctaagttcctatccaaagggagtagggagactgggttatcaatgtattttcaagctccccaggaatctctaatttgcttaaaccaacttctgccaaatgaaagtaatacaaattgagcagtgtttatccactgggtacaggcaagaacccaaatatagctattttagggtcattgtgctgtataaggatgatataagagccgggcgcagtggctcacgcctgtaatcccagcactttgggaggctgaggtgggcggatcacctgaggttgggagttcgagaccagcctgactaacatggagaaacctcatctctactgaaaatacaaaattagccgggcgtggtggtgcgtgcctgtaatcccagcttctcggggggctgaggaaggagaatcgcttgaacccgggaggtggaggttgcggtgagccgagatcgtgccattgcactcaagcctgggcaacaagagcaaaactccgtctcaaaaaaaaaaaagggataatataagaaatgattcttaggcctaggttaaacaatgaacaaacatccactcctaggctgtatggggaaaagagaaatgttgtaaatatctctcattgcaaatgacactatattccttagtgtttttctccttggacttacctccaaaaaggtacctgacatgagaggaaaaaatagaaatcgggatttggattttatgcgaggttctgggaaaaatgttcctactctttcctatacaggaactaagtcaaattcaaggccaatgggattataatttgctttatgctataatttgtaatgtttaactttgttttagcaaaaaagtctgatattcaatcttccattaacactttagccatagaatctagactgctacgtgtaattgttaacaaacgcatggtttcttttctttgttatgaatggaactagacatctccattaacacatttgctgtttttctcatgcagtaggctaactgtacagtatttaatggtctacaggtttaaatatttcttatatgccttggcttgcacagaaagtgcttctgctaaaccagttaataatctggccatcccaagagtccagaatgttgagttaattttttacggaggttcccagatgtattggaagactcactcttggcagaccttgccaatattttttttaagattacatttggcttttcttgtatttgatatgaaacacatgttaaaaacaatacctgacaaatatgaaatgcatttttctgcataagcaaaaacaccatgaatacagcttttacaaagttttggatggcagagatacagggttttcactgcaaaactgggttagcatttaggcaagttaatcatacatctcgacaatgattctttatccaacatctctttggtattcagtgggcaggtcattaggactatgaagaaataagtgggagaatgtccagggaatgaaaaacatctatataacatgtggagaagtggatagatttagtgagtattcaactttaagaggtgcaggttctgatcccagccagatcacttgagttcttaacttctgggaagttaagaataataatgtgagtctttgagtgtttcaagaagatcctgtattagttgcttccctttgcaggtattttccacagcatttccatgtgttttctctaggtgctctggcagggcatcatatgcagctttatttttgccttttctttcagtctatattttctattctatttatttttacagggcaatgggaaatactgcaatatactgcaagtgtcctttctctttacgtgaattgaatttgtattttattgtttctttttccaggtctagccttagaaattttataatatggccaggcgcagtgtctcacgcctgtaatcccagcactttggcaggtcgaggcaggtggatcaccaggtcaggagatcgagactatcctggctaacatggtgaaaccccatctctataaaaacacaaaaaattagccaggcgtggtagcacatgcctgtaatcgcagccacttggggactgaggcaggagaatcgcttgaacctgggaggtggaggttgcagtgagctgagatggtgacactgcattccagcctggagactccatctcaaaaaaaaaaaaaaagaaaaaagaaagaaatcttataatatttacaaaatgtaattgtaggccgatgcggtggctcatggctgataatcccagcactttgggaggccgaggcaggtggatcacttgaggtcaggagtgtgagaccagcctggccaacatggtgaaacgctgtctctactaaagatacagaaaatgagcctggtgtggtggtgcatgcctgtgatcccagctactcaggaggctgaggcaggagaatcactggaaccagggaggcaaaggctgcagtgagctgagatcggaccactgcactccagcctgggtgacagagcgagactccatctcggaaaaaaaaaaaaaaaagaaaagaaatataattgtggatccagactctggccaaggatcaaacagacatttaagatatttgagggcaggagggtaccactgaggaagaatgatgctaccattaactgtctctaaaaagaggaagtaaatgccactgcaatctgctattgaggtttccctagatctggaatatcaagcatttcaattcacactaaagttcagaataataattactaataatatttttaatggagtatttacaatgggccaggcagatttattgtgtcattatctcagctgatcctcagaaggactgagtgctctcagtagtcccatttctgtggggaaggggagtcatggacaagttagcctttaaaatcttatccagtcttttattcctgctttccaggagtaaaagaaaaaaataaataagtaaaaagaaagtgggccaggcatggtgacctgtaatcccagtactttgggaggctgaggtgggaggatggcttgagcccaggagtttgagaccaggctgggcaacatggcaaaactccatctctaccaaaaaaacaaaaacaaaaaaaacaaaaaaaaacaaaaaaacacccaaattagctgtgcacagtggcacatgcctgtagtcccaattactcgggaggctgaagtgggaggatcaatcacctaagcccggggaggctgaggctgcagtgagccaaaatcctgccacttgccactgcactctagcctgggtgacagagcgagaccctgtctcaaaaagaaagaaaggaaagaaggaaggaaggaagaagaaaaaagagaacaatcttatcaaggaaggtgatatcaacaaaatggtgcaataggaagctccaaactcctataccccaaccaaaacatcagaaagtaagcataaactgttaaaccaaatctgttaaaatctggaaaacagtcaaaagtttatagcaaccaagcaaatgctgaatcctgccccccctcatccaaaaaggtgtttttttttcttttacttttaaagatttttattttgtttttgtttttttaaatagagacggggccgagtgcagtggcgcatgctataatcctaacactttgggaggccaaggctgtggattgcctggagtttgagaccagtctgggcaacatggtgaaaccttgtctctacaaaaaaagtacaaatagttagctaggtgtggtggtacgcacctgtagtcccagctacctgggaagctgaggtgggaggatcgcctaagcctcggaagttgaggctgcagtgagccatgattgtgccactgcactcaagcctgggtgacagagtgagaccctgtctcaaaaaaaaaaataaaaataaaaataaataaataaaaaataagagatgaggtcttgttatgttgtccagcctagactccagctcctgggctcaagtgatcctcccacttcagcctcctgagtagctgggactgcaggctcatgccaccatgcttggctaatttgtttttattttttgtagagatggggtcttgctattttgcccaggctggccttgaactcctggcctcaagccatcctcacactttggcctcccagaatgctgggattacaggtgggagccacctcactcagcccctaagaagacattttaaaataagtaggaaagcgttgtggtgttttcacttgctctttccccacctcctgcccagcttagtggtagtcttaggagttagcctccatggctggtccctggtccctggctctggcatgtatgtctttatttatttatttttttgagatggagtctcactcactctgtcacccaggctggagtacagtggcacaatctcaactcactgcaacctccgcctcccagattcaagtgattctcctgcctcagcctcctgagtagctgggattacaggcgtccactaccatgcctggctaatttttgtatttttagtagagatagggtttcaccatcttggccaggctagtcttgaactcctgacctcaggtgatccacccgcttggcctcccaaagtgctgggattacaggcgtgggccaccgtgcctggctgtggcatgtatgtcttttctaaactatctggagctatctgaaggactaatgcaaggtgcctgacactcactcaggacagaaaagtggagggcattgctggaaaagcttttaaggcagatatacaaactgaagctggctgagacaaaagattacacctaaagccaagaaggaaaagcatgttgtcctaaagtgctttacatttacttgctcactttatgctcacaacatccctatgaggaaggtataattgtcaccatccccattttacagttgaggaaactgaaataactgggaaaagtaaatgcagttagcttttaatcacttcatcacattgactccaaatacgcacgtactaaaagcaaaatgaaccaggtaacaactaaaacacatatagtaaatgagtaataaatcttatttgaaaattatactttaaatatatttcttttaactctagtatttattactgccttagtaacctctttgaaatagaagactgaatggaattcattcttttttttttttttttttttttttttggagacggagagtcttggtctgtcacccaggctagaatgcagtggcacgatctcagctcactgcaacctccacctcccgggctcaagcaattctccctgcctcagcctcccgagtagctgggattacaggtgcctgccagcatgcccagctaatttttgtatttttgtagagatgggttttcaccatgttggccaggctggtctcgaactcctgacctcaggtgatccacccgcctcggcctcccaaagtgctgggattactggcataagccactgcacctgaccggaattcattcttgatagcatcagtatttgctttcttcccagatagtacatagtactgtttttattatgaatttttttgtgggaaaatagagatgataaaataggaaacctttccacaaagctatggttaatattagttagaagtaaattttcatttctagaacataacattgaaaaaaggtaagaggggcatagagaaggcaaaagaatatacttcttgaataaacaagtatttctaatgcttattatttataacttagatatccccagactgtaaactgtagaagaagggactgtgtcctgagttattcagaagccaattttttgtgccttagcataacagtataggaatattggccatagtagtcgatcagtggagacttgttgagtgaatgaatgatagacatgctttttacttgtatatcaagttattactgggctctgcgcaaaggcagaagtggatcctatgtaaacagatacgggtgtttgcttatgataccttatttttaatgtaccccaagatcccccatggagaatttcaaatgctgtttataaaaggaaagaaaattcaggtcttgtagttgttcttttttttttttttttttttgagacggagtctcgctctttcacccaggtgggactgcagtggcgcgatctccgttcactgcaagctccgccttccgggttcacgccattctcctgcctcagcctcctgagtagctgggactactggcgcccgccactgcgcccagctaatgttttgtatttttagtagagacggggtttcaccgtggtctcgatctcctgacctcgtgatccgcccgccttggcctcccaaagtgctgggattacaggcgtgagccaccgcgcccagcgcgggtcttgtagttgttcttgctacaaattactgggcctgcagaagagagatactagggaggagatttacagcaaggctttgtcgcacatatattgttcttgttcgtcatcttgacttggtctgtaaacgtccctttcccttcccgttaaacttaacaagaataagcctgtatcctggattaggtggcaaaggtatttgaaataaaaataaagaattttaagaaattaaaaaagaataagcctgtagcacccagatgcataaaggaaaatggatctaaacagtttattacttaaacagctgctaaagtcatctcatccttgttccatttactccataaccacacaaacgtgacaattccatttagattggtcacatgtgcttaatgtcttaaaggaaatgaatgaatatattttctgaacactcatggaagtgatccatttttatacaaaatcaatttttgaggggaaaggtaattcctgattatcaaagaagtggccagggaagaaaagatctgcccccatgcttcattaaccaccaccagcagtttcaggtgggttctttcagaaaatgcgcatgcatatacatgaatatatctgcggtgagttcctctttgtttgtgtgtgtgcccaggtgctcacatgtacatctctggtctttattttctgtagagaatagtcagaatgaggccccagggtcaggaatggaaaaatcaggtaaaaagaaaagaaaacatctttttttttccttaaaaagaaaacatcttgtttagaatttttggaatttctttctaagcttaatctttcttttattaacactttgttctcaacttaaagccattaaaaagcctatatgcaaaaaataaaataaatcagctcaaggcataagaatttgatatacagctgggtggtaattaacaggacttgaccttacaataattagatgctgagaaagactggagcacagcagctcagaacacagcagtttatgtaactctcctggagaagagttaggctttaccccttgatgctatgaaaaatcagcctcaaagattattgaggcagatcaaaatttagagccgcacacggcacctcacacctgtaattccagcattttgggaggctgaggcagtaggattacgtgagcccaagagtttgagaccagtctgggcaacatagtcagaccccattgtgttagtcagctttcatactgctataaagaacagcctgagactgggtaatttataaaggaaagagttttaattgactcacagttcatcatggctggagaggcctcaggaaattcacaatcatgtcaggaggcaaaggggaagcaagatgccttcctcacaaggcggccggaagaagtgccgagaaaggggaaagagcctcttacataaccatcagctgtggtgagaattcactcactatcatcaaaagagcagagggaaaaccgcccccccatgattcagttacctccacctggtctctccttgccatgtggggattatggggattacaattcaggaggagattaggctttctgttcaggtgggaacaaaaagcctaatcgtatcatccatctctacaaataaaataaattaggctgagagcagtggctcatgcctgtaatcccagcactttcggaggccgaggcaggcaaatcacttgaagtcaggagttccagaccagcctggccaacatggtgaaaccctgtctctactaaaaatacaaaaatcagctgggcgtggtggcacgtgcctgtaattccagctactcgggaggctaaggcaggagaatcacttgaacctgggaggcagaggctgtagtgagccaagatcacaccactgcactccagcctggggaacagagaaagacgctgactcaaaaaaatgaaatgaaatgaaataaattagccaggagtagtggtacacgcctgtggtcccagctactcaagaggttaaggtggaaggattgcttgagctggggaggttaaggctgcagtaaactgtgattgcattactgcatgccagtctccgtgacagagtgagaatctgtattaaaaaaaataaaccaaaatcccaaaagataacttgggactgtgtagtggcttattactacattcctcaatgatccaagctactcattgaaaacctaaagtggaaaatgctttgtccacatatattaaataatacatatatttctttctccaccctgtaaaaagagagttagcaataatgctatttggttagaatatgcagtgtgaaaataaaatgatattcataataattacacagaactaattttttaaatggcaatattcaatgctggcaagggttcggtaatgctggtattctcataggttgctcactgtattttcatttttaaaacattttctgaaagctatcacaaaatattttaggagctttaaatgctcaatatttttatcccagttgtctcactttaggtaatttatctcaaataaataattcataaatctatatgcacaaagccatcttgacactatttataattgcaaaacactggtacttaatgcagaaatggttgagtaaagtatggcatatccactatttacatggtatctataaagtgtttttaatagtatggaaggccaggtgtggtggctcacacctgtaatcccagcactttgggaggccaaggcaggtagatcacctgaggtcaggagttgaagaccagcctggccaacatggtgaaaccctgtctctactaaaaatacaaaaattagccaggcgtggtggcagaagcctgtaatccagctacccaggaggttgaggcaggagaattgcttgaacctgggaggtggaggttgcagtaagccaagattttgccactgcactccagcctgggtgacagagtgagacttcatctcaaaaaaaaaaaaaaaatactatggagaaacattacctatattaagttaaataaaagaaatcacgatagagctgggcacggtggctcacgcctataatcccaacactttgggaggctgaggcaggtggagcacgaggtcgagagttcggaccagcctggccaagatggtgaaaccccatctctagtaaattacaaaaattagccaggcatggtggcaagtgcctgtaatcccagctattcgggaggttgaggcaggagaatcacttgaacctgggaggcagaggttgcagtgagccaggatctcaccactgtactctagcctgggcgatagagcaagactctgtctcaaaaaaagaaagaagaaaaagaaagaaagagaaagaaagaaagaaagaaagaaagaaagaaagaaagaaagaaagaaagaaagaaagaaagaaagaaagagaaagaaaaagaaaagaaagaagagggagggagggagggaaggaaggaaagaagtaaataaatcacaataaaaattatatttcaggctgggtgcggtggctgacacctgtaatcccagcactttgggaggccgaggtgggcagatcaattgagtccaggagttcgagaccagcctggccaacatggcgaaaactcgtctctgctaaaaatacaaaaattagctgggtgtggttgtgggggccggtaatcccagctacctgggagaatgaggcagggaaaattacttgaacccgggaggcagaggttgcagtgagccgagatggcaccactgcactccagcctgggcgacagagtgagactccacctcaaaaaaaaaaaaaaatgtatttcagctgtgtatagaacagataagtcaatgtaggaaacaatgtttattgtgttcatgtagtgggagtacggatgctcttgttttctatttcttcaatttttaataatattttaatattatattcataatttaaaatttatctagcatctatatctctaagtttatctatctacatactttatgttttcattttttaaccctctatctctatactttagtataaaaagaatagctttgtgaaagtttaggaaatggagtagagagatgagtttcatgattacaaaacgttgtattattattaaaaaagaaagatgtgcatttgagcccgctttctcatacttctttcagtgtaaaactattgatgaacttgaatgcatttgtatcccacttatagtcttcaattctaatttggtgttctggtagagtttctctggacttttgcaaaaataaagctctctcatactagttcaagagatggttcatgttgcgtcactgggtaaagaggaacaggtagtgtcaaagttcccttctgaggattctcctttaggtcccatgagcatcaatcattatttctattgactagtttccccaataactttctcccaaagtaaatgaaaatccacatgccagggcagcactatgttgaacttgtcaaagaccaatactgaatatgccagacacggttatcttcagctaccattttgaaggcctgaaccctcatagaggtattaacgaactcgaaattgcatacttgcatatgttgtaatcattttcaccctgctttccaaaaagaaaaagaagaaaaaagcaataaatatgggatttaaatataattcatgcagaaataggccaaaacattcctaaagactctaaatttattcctaatcacactgatgccaaactaaattggcatggttattctactagattctgattctttttttttttggccagaaatttgctggaaaaacacagaactggaaaatccatccaagattaaacagaggaaaaatattagaaaaaaatattaaatagaggaacaaaaacctattttagttgtagttataaatttctagaaattcatctttgaatttagagaaatacatcagtgtcatagtaaaataacctttattctttatagacacccttttctgaaaccaagcagttgtattcaaaacaagtccaaatttaagcaagaaaaaattgttttaataatagaacattttaaaaaaccaatgtatttctggccaagagtggtggctcacgcctgtgattccatcactctaggaggccgaggcaggcagatcacctgagtgatcagaagttcaagattagcctggccaacatggtgaaaccccatctctactaaaaatacaaaaaattagcctggtgtggtggcatgtgcctgtaatcccaactactcaggaggctgaggcaggagaatcgcttgaaccccagagacagaggctgcagtgagccaagatcgtgccactgcactccagcctgggcaagagagcaaggctctatttcaaaaaagagaaaataaaatacaaataaaaaaccaatacatttctagcttgtaactagaaggagagacaaaaagaccaacttaaaaatagtaagtgtaatgagagtatgatgtgaaggagctgttaagtgatctcaaattaatggtgctcagaaatgtgaacttctggaattcacgtttaaagactaattggagggccgggtgtggtggctcatgcctgtaatcccagtatttgggaggccggggcgggtggatcacctgaggtcaagagtttgagaccagtctggccaacatggtgaaaccccatctccactaaaaatacaaaattagccaggtgtggtgatgcatgcctgtaatcccagctactcaggaggctgaggcaggagaatggcttgaacctgggaggtggaggttgcagtgagttgagattgcgccattgcactccattctgggcaacaagagtgaaactccatcttataaatagataaataaataagactaattggaaaacttggaaattatttagaagacagctccaaggatggcaaaatgagtcaagtattggaaaaaaagaccaatgaggagaggcaaacaagacataattaattttcttgaagagaagaccaaatgacaattgaagaagacagtctatgaatttatagagagctttatatacagacagggttggttatcatcgctgagtataaaacaagggaaacaggcttggtgtgtagcataatggctttgttcgacacagtaaagctaactaaatgtcaaaataagatgcaggtggaggttgagcagtcttttctaaagccatgaataataagatagcagcttctttgtatggctctgactgaaggtgagagatgtgctatgtaagctttcacatcgcttccagggctaagattcaggtccttggggaatatcttcctgaattcagggagttaatgccaactctgaaatcaaattactggaacatagtaaagaaagcggggggaggaagcaactagaatcaagatgaaaatgtaacttcaaaccctgtttagaaaaaaataatgagattactttaaaataataaaatttattattaaaaatttagagaagttttgacaaggaggaagtggaaaaaatagatatttttatttatttatttatttatttatttatttatttatttatttatttttgagacagtttccctcctgttgcccaggctgcagggcaatggcacgagctcggctcactgcaacctccacctccagggttcaagtgattctcctgcctcagcctctcgagtagctgggactacaggcatgcaccaccatgcctggctaattttttttgtatttttggtagagaaggggtttcaccattttggccaggctggtctcaaactcctgacctcaggtgatcctctctcctcggtctcccaaagtgctgggattataggtgtgagccgccgcacctggccatagatattttagataaggaacaagatcaagcattaaactgtgaacaaggtatttctaattaactaattttttttttcaaacacagccttaggaaacgtgactccaaccatggagagtttaggtcagccctgattttgaggccacatgctccatcctcacaggtgggtgaggtcccttagttggtattgtttgatgattctattagttcttgacttttctgtatatattttaatgtacagtaaagggattgtagtattggcaggtttgtcccaaaatagactgtgagtcagttatgaaggagggggattccaggaactagaatttaagagtgaggaagttaaacacaaatttacatatgactcagtactaacacattttacataatattgggtactttctcttcctgtaattgcctctatgcttcatttgttgttttcaccaatagccctaaataagtggttttaaaaaacattaagggaggctggtagatcacgcctgtaagcacttttgggaagctgaggtgggcgaattgcttgagcccaggagttcaagaccagcctgggcaagatggcgaaactccgtctctacaaaaaatacaaaaattagctgggcatggtgacacgtgcctgtagccccagctacttgggaggctgagatgggaggatcacctgagtctttgaggttgaggctgcaaagaacaacaatctccccactgcactccagcctggatgacagaccgagactctatctcaaaaataaataagtaaataatgaattttaaacacacacacacacagacccacacacaaccattaagggatgactaatttggggtgtcttgccagcaattcaaatgtctaaaatagccttattctagcattgaatgttaaagcctttttctttagacagactaattgcagaatgaaatggtttgctacctgttgagctccaattctccccttctcaaaaaatcaagaggctatgaactcgcaagtgttaatgggattcagatagaagccatcactgctattttaaattttcctgtgtctcccactaacattatatccaaacatcaaaacatccacaacaatcatccccaaggttgctgctgtattatttataaatgaacacattgttgggtgaatacattccacttttgaaattaattttctttttctttttcttttttttttttttgagatggggtctcactccgtcacccagtttggaatgcagtggcgcgatctcagctcactgcaacctctgcctctggggctcaagcgatcctcctaccttagcctcccaaacagctaggactgctggcacatgccaccatgcccggctaatttttttgcatttttggtagagacaggatttcaccatgttgcccaggctggtctcaaactcctgagcccaggtgatctacccactctggcctcccaacgtgctaagattacagtcatgagccactgtgcctggcctgaaattaattttcactggtttattttcataaaataacgctggacacagtggctcatgcctgtaatcccagcactttgggaggccaaggcaggcagatcacttgaggtcaggagtttgagaccagcctggccaacatggtgaaaccccatctttatgaaaaatacaaaaaattagccaggcgtggtggcatgcgcctgtgatcccagctactcaggaggcagagggaggagaatcgcttgaacccgggaaggcagaggttgcagtgagccaagatcgtgccactgcactccagcctgagtgacagtgaggctctgtctgaaaaactaataaataaataatattttcataaaataaactcaatttcagttacatacagttttttaggaaagtgcttttcttttgtagctttgttttttccgtcctattgcatagtctggcttcactgaaatagctttccaccaaaatattctcttctctcaagcaatagtatactgaagagaacaagtaagttatttatttgcaagcccataggatttaaattagaataaacttgtccttgagaataatatactctaaataattcatatgagtcacaaaattttataccagaaaaagtgtgtaaaaaacatcttattccccaatattatgattccctcagtttgtatgacttaataattctttttttagagtataattgttccagagttcagaaatttttaaaagagattatctgtatctctgggaaaagattgacttccagctggaaagataatcttttcttccattttcccaccttttgcatcagaaaagtaaacaaccgatttcctgactaaatacacctggattatttctcaagagagcaagaaatgggttgatttatgcattagaaaagtgaccataaggtcgtggagaatcaatgactttagatgtaggaaggatcttggaaatctagttcaactccctcataaatgacaaggattagatataaaaagtgcttttaagaggcctattagcatcaggaatgaggtaagtcccttttcagcattaattacagtaactgctgtataaagaaaggggattctggcaactgctctccacatggcagaaattcaggacagacttgaaatcaaagaagtaggggctaaagtctaatgaactgacataaaactttttttaattggaactaaagaatattaattctctcacatgattcccaaagtcagtgtttttttttttaattctctcgaaactttcatgcatcaaaagatggttccaacatacaagcatggaaataattagtgcttttaattagtacaactgggaaataaggcataccagccttaataagggtctccaatgtggaacacattaaagtaaaaacaattttttcctaatatcaaagtgcattctaccgactaacagaaaatgagttactctgcaaaatggagagtataatcggattcagaacaagttcaaagtattaagaaaggagatgccatgaactgtgggacttgagaattagatcgtctcagacggccaccaatctatttttcagaacacactatccatatcgtagggtttaactattaaactgtaaatattctaaaatacttcataatgcctattttgtgaatcagaattgaagatgaaaatggtcaaatatattagaagcatgctaaacagcatttcagaacagtctaacagctgaacgcatacttggcaagaagagagctgctgtcacattacctcagaccaacagtagcaagcacatctggaatcctaatgatcccaggagcttttgggcatttgaaggacagccatctggtgcaaaggaagtctggacaaagtgtcccacccaacagaaagaacctcattgtgctgctatgaaaagcagctggccccacttccctctgataatacaccaccttctcaactggtgagtgatcaagagaaatccattatgtgcacaaagtgctcactagctgacctggatctaaaaccatgacaacctggcagataagacgcagtcagagatatatttgtgaaataaatccctttttgaaagggcgtcagcaaattctgctacctctgtctaacctttcagcaactgatgtagatagtatcagcctatgggctcttctaggtctcaattctttatctgtaaaattaagagattgggctacgcacattttacggccctttttagttctaacatcccatcagcttgtgattttacagaaaatactgtagcgccaaaagaatggatgaccaaagaacaagggatgacagcagacatttgaaggtggcccctgcatgttgcttgatggcattggatcattgaggggacaaggttgcactcaaagatgacctctcatttgtaaatgtgtcttatcatcttgcaagcaaattaagccagtgttatctttgctctaacctatctgcaaattatgcacagcatgttgggtctgccccacattaaacacactgcaggactctcaagtagatgaaggcagacatgcagcttcagcagaccatgatggtgaggcagtggataagagaaatgattgaaggtcatgagagggaggagagcatgacagggatgggaagcgaggacatcagggcacagaaagccctagtcaggagggaactgcaggccaggcgcagtggctcacgcctgtaatcccagcacgttggggggccatgatgtgcggatcacttgaggccaggagttcaagaccagcctggccaacatggtgaaaccctgtctttaccaaaaataccaaaattagacagggatggtgaccgacgcctatagtcccagctactggggaggctgaggcaggagaatcgcttgaacctgggaggcagagattgcagtgagctgagatcacgccactgcactccagcctgggcgacagagtgagactccatctcaaaaaaaaaaaaaaaaaaaaaagagggaactggagagtttaaacacctacaggaggaggaatttaggataattgtaagatccaataaataaccatgtcagtagatttatggaggaatggagctagagatgtatagtgaaagagtctaaaaatataatgtagggaaaggcattttggccagttaaatattgttcggaatcctggctctgccgctgaatatcctgtatattcctggacttgttaaataatgtattttcctcatcagcaaattggaaataatgctatctcttacatacagtagttgtggaaattaaatgagataatgcatgtcaagtgctgaagatacttattggtgcacagtagacattcaaaaatgatatattagttgtcattattcctagtactgttattcttgttagctgaataatgagaacaaatattgaaattccccagaatggttgtttgtgaacaagtagagagaaaaacgattacatcaggcaccaagattaaaggaagtgtcttcgaggttagtagatgatgacagtgagggcagaggaagggtgggtgtggttgagcaaagttggcgaagttcttgaaagtcaagttagtgcccgccgaactcttggctctgagccagacaagactggagaagaagccctttctgcttgagggcatcagagaaaatgtttcatctttagtagaaaatcaaatctcaattaaggcagcactttcctgaagatgtttcttttctttttttctttttttttttttttttttgagacagggtccagttctgtcactcagactggagtgcagtggcatgatctcggctcactgcagtctcagactccctggctcaagcaattcgaccacctaagcctcctgagtagctgggactacaggcatccactaccacatccggctattttttatattttctgtagagatagggtttcaccatgttgcccaggcttctcttgaactcctgagctcaagtgatctgctgccttggcctcccaaagtgctgggattgcaggtgtgggtcaatggacccaggctctgaagatgtttttttctttttagagatggagtctcgctttgttttccaggctggtctcaaactctaggcctcaggtgatcctgccacctcggcctcccaaaatgctggtgtgaaccaccctgcccagcccaaagatgcttttggtctgatctatctggggaatgctgagcctctccctcctcggaatttgtaagagtgcacacccaaatgcaggctctacgaagtctgtcttcctagattgaaatcacatgtagccaacaaacttgtttatttatttatttattttttgagatggagtctcgctctgtcacccaggctggagtgcagtgggacaatctcggctcgctgcaagctccgcctcccgggttcaggccattctcctgcctcagcctcccgagtagctgggactacaggcgcccgccaccacacccggctaattttttgtatttttagtagagacggcgtttcaccgcgttagccaggatggtctcgatctcctgacctcgtgatccgcccacctcggcctcccaaagtgctgggattacaggcatgagccaccgtgcccagccttgttttattatatgaagttacaatcctgtgtcacaagatgggagggcagagggaggattttgaggaaagcttaatgaccgaatggtgtttactgtcaggagtcccagaggaaagggagagaagggattaatgtggctaagtgagaaacaagataggccagagacaagtgaggttaaaactgcatgaagggattgagcaagtggaagcaatgaccaacgtgctggtgctcatgaaccgcagagggaagaaagggagcaactaggaattttgaaattaggaataaggctgggcgcggtggctcacgcctgtaatcccagcactttgggaggccaaggtgggcagatcacctgaggtcaggagttcgagaccagcctggccaacgtggcaaaaccctgtctctactaaaaaacaaaaaattagccaagtgtggtggcacgtgcctgtaatcccagctactcgggaggttcaggaaggagaatcgcttgaacctgggaggcggaggttgcagcgagctgagatcgcgccattgcactccagcttgggcaacagagtgagactccgtctcaaaaaaaaaaaagaattaggaataagagtgagggaaatgggcaacttgggccagtagcagagctgttttgaacatgggaaatttacccacagttgctttatagtccttcagacatttagaattttaaatttttttaatttaaatttaattttttttttttttagaaatggggtcttgctatgttgcccaggctggtctcgaactcctggcctcaaacaatcctccctccttggcttccccaagtgttgggattacaggcgtgagccactgtgcccatcctagaattttttaaattttcaaaacagtaatctgtccttgagtgtgaactagattgtactgacaatctgaatagatatttcaactaatggttaaaaaacaaacaaaacacccaaaacacatcttagaatgattctcatgtcttccaaataaaaatactttaaaatgttgtcaatacttttacctatttagcttatgcctttggttatagaaaatatagaatcaatgataatgaattaataagaaaataaaaatagatatttcaactaatggttaaaaaacaaacaaaacacccaaaacacatcttagaatgattctcatgtcttccaaataaaaatactttaaaattttgtcaatacttttacctatttagcttatgcctttggttatagaaaatatagaatcaatgataatgaattaataagaaaataaaaaatatattccatctttaatatactgatggttcagttttatttctaaattgtctgagatggaagtatattaaacataaatggtgaaagtataatggggacaattcattatgtcctttggaaacattttcattgtaaattccagttgtatttattttttatttatttatctatttatttattattatttgttttagatggagtttccctcttgttgcccaggctggagtgcaatggcacgatctcggttcactgcaacctccgcctcctgggttcaagcgattcccctgcctcagcctcctaagtagctgggattacaggcatgtggcaacatgctcggctaagtttgtattttcagtagagacggggtttctccatgttggtcaggctggtctcgaactcctggcctcaggtgatctgcttgccttggcctccgaaagtgctgggattacaggcacgagccaccgcgcccggccataacgtgcagttttaaagtattatccttgatgaaattaaattgttaccaattttccaacctgcatgattcattaactctgcactaatgaattatactgcctgacttattcccaggaagctctagatgttgctcatcaatctatggataattgttgtttgtggtttttaagctccattgcatttttatctatatagatggagaattaagtcttgatgtgacaaagttgaaaaataataaaaccaaagttcagaaaactctaaacaatagttttatttatttattttaataatattcatttatttattttatttatttttaaaattatacttcaagtcctgggatacatgtgcagaacatgcaggtttgttacacaggcatacacatgccatggtgatttgctgcacccatcaacccatcatctacattaggtatttctcctaatgccatccctcccaccccaccccctgacaggccctggtgtgtgatgttcctctccctgtacccatatgttctcattgttcaactaccatttatgagtgagaacatgcagtgtttggttttctgttcctgtgttagtttgctgagaatgatcatttctagcttcatccatgtccctgcaaaggataagaactcctttttttatggctgcatagtattccatgatgtatatgtgccacattttctttatccagtctaacattgatgggcatttgggttggttccaagtctttgctattgtgaatagtgctgcaataaacctatgtgtgcacgtgtctttatagtagaatgatttataatcctttgggtataaaggattgggaaaagcatagtatctgggctggatagcaccgtccctcacggcatagtccctcatggcttcccttggctacgggagagagttccccgacccccttgcacttcccgggtaaggcaacgccccccacctgcttctgctcgccctccatgggctgcatccactgtctaaccagtaccagtgagatgaaccaggtacctcagttggaaatgcagaaatcactcgccttctgcattggtcttgctgggagctgcagaccagagctgttcctattcggccatcttgcccgggaatcttatttattttttgagatggagtttcactcttgttgcccaggctggagtgcaatggcgcaatcttggctcactgcaacctctgcctcccaggttcaagtgattctcctgcctcagccccctgagtggctaggattacaggcacccaccaccatgcccagctaatttttgtatttttagtagagacggggtttcgccatgttggccaggctggtcttgaactcctgacctcaggtgatccacccgccttggcctcccaaagtgctgggattacaggcgtgagccaccatgccctgccttaaacaatagttttaaaaacctctaggacctgtagtttgttttttgtttagagatgaggtcttgctatgttgcccatgctggtctggaactcctgtactcaagggatcctcttgcctcagaatatcgtggactaaaggtgtgaggcaccatgccaagccctgtggtttatttacactgtaggctgtaatagtttagctttccaggcagtgactatgtcttagaattaaagataaagacagttgcttgagatgccttagagagggctgcagttcaatgggagaaaatgccagaattatttttctgtgagaatatttcaggttacagtctagattagacaaatagcatctttaaggttttgtcaacaatagatattcaggggaaataaaaccttcagaatcagggctaaaaatctaaaaattctgtcctagagaagggcaaacttgaagatttttacttcacttttcctgctagtttagctaaagaaatatgaaaatgggctgggcatggtggctaatgcctgttatcccagtgctttgggaggccaaagtgggtggattattgagcccaggattttgggaccagcctgggcaacatagcgtagaccttgtctctacaaaaaatatttaaaaatggccaggactagtggctcatgcctataatcccagaactttgggaggttgaggcaagtggatagcttgagcccaggagttccagaccagcccaggcaacatagtgagacctcatctgtatcaaaagaaggtaaaagaaatacaaaaacaagtcttaacaactaagcaaagaaataagtaccttgacttgttctcacttgttctataagagttacactggcacaagctcatctaatgatgtagttgctttgaaatctctacttccttttttacttctttttgctgaacaaaaatatttaatgaacaggcttggattaataagtttggtgatggtgtccaatgaacacaaatgaccacgtaaagggtagtagtagattggacaccttatacatagttcagaatcatcatatgatcttcatggttgaggcttgtttcttttcttttttttcttttttttttgagatggagtttcactcttgttgcccaggctggagtacaatagcactatctcggctcactgcaacctctgcctcccaggttcaagtgattctcctgccgcagcctcccaagtagctgggattacaggcatgtgccaccccgcctggctaatttttgtatttttttttttttagtagagaaggggtttcaccatgttgttagggctggtctcgaactcctgacctcaggtgatctgcccacctcaacctcccaaagtgctgggattacaggtgtgaaccaccacacctggcccttgtttgattccttttaggcttgggaaaaaagggtgaagatgggggaggacagaagcagagataaacgaagtaaatgttcatacattctctcacttgaacctctcagcaaccctgttaagtttgtatttgtatttgtatttatttatttatttgacacagagtcttgctctataccccaggctggagtgcagtggtgtgatctcggctcactgcaaactccacctaccgggttcaagcaattctcctgcctcagcctcctgagtagctgggattacaggtgcctgccaccacacccagctaatttttgtatttttagtagagacagggtttcgccatgttggctaggctggtctcaaactcctgacctcaggtgacccactcgcctccaactccctaagtgctgggagccactgtgcctggccaagttcgtattatgattcattttataaatgggaaacttaaagacacagctggcaaatgtcaaagctggactttgaactaagatctaacaccaaaaccatgcttgatgcatagtagggccagtgatttatttttttttttaatattaggtaatagcaagtaatatgcccagagacatgatgggctgacaaagtattgacgggtcttgttcttactgtcccttctatgccccagtgctcaacttccccttaacccattccttatccttccccaccaccattccacccccaataaagtcacccaagacaggaaaaattgttaactattttcagaatactttggtaaagttgaggaaggggaaggaaacaaagtcttccagagcagagggggaaaatccctcttttgatgaaacatcctgtgtagcaactgtgaagcctggatttccccaggatgaggttagagtagcaggctgctgcttgtcacatggcctcagttcaaagtcacacctgtgggggcctcccgtaaaatttacctatatatggccctccacaaagccacaaacacagaactcaaaatggcattcaccacttctgagatgctgaacaggaaggaatagcactgtttttacaaattaagtgcacagtatatgtcacaaggaggaaataaaccctatgagtttgaacttgcacatcctctcaatactgaaagattaattttggtggctgaggttaataatacggttattcgtgtttggatatgaatgtaactcgaccgattgggaaagcaggtgctagattgatgtaccatgcctgagacccatgagtcattgtcactgatttacaagctggccttgccatgaaaatggaagccagagccaactctatgtcatacaatttatgccattcactaaaattatagataatttcagcctgtgcatttgcaaaacagtctatgccatttttgctttaaacatcttttgtacttggtctctctgacttgtctaaataagtattatcattcataataaccattaccaatccattatgcaacatcatgaaaatatatacagcttttagatttaatccatgaaataaagcctatgacttctgcttgcatctttgataaacggccaagttctcacagctgttatgatttcaattatgaagaaaattggaacttttgcattcttcagtggctaaaaatcactcagaaaaaaacacttgttcacataagctatttttttccctcgtgtgtatcatgagccttgggtctgattagtgtagttgattaaagcaatgtgccaaaaggcaaagggcccttgttaaagcccaaggaaggtcagctagattaacttcccaagtttactgaaaatctgttctattagtagtcttcagccaaattaggcaagggagtacaaacagatcagtacaaatccagtctttaatgctagcaaaatgtagctcaaaccacagttaacattgatacaaggtcaataatgtcatcttcccatacagagacagatgacacacatgcagaagcatcttagaaacacctgctctcctccgcctttttttttttttttttttttttttagatggagagtccctctgtcgcccaggctggagtacagtagtgaaatcccagctcactgcaacctgggcctcctgggttcaagtggttctcctgcctcagcctccccagtagctgggattacagtcatgtgccacgacgcccagatagtttttatatttttagtagagacagggtttcaccatgttggccaggctggtctcaaactacctgcctcggccttatttacaggttttgtctcctcatatacaaccaatctcaacatagagaactccctaactctgatccaggtaggctctccctcatcaagagattaagagttctgaagttaaatgaactacaaaatgaactacagtttataatccattgcctcacatccaaagtgcttcctctccctttctttttatccccctctcccttcaactactattctctgaagcttttcagttctctcaaatcttaattttatttttttcctccacaagaacaaacttggtaaataaccaagattgttcgtggtttcaggctcctctttttaatcatttttctcatgtcagtaatgagagctcctgagttaatattatgctttcccaaacctggaatcctcgtcttttttgcagaagaagaatcaagcgtattgtacgaaatctcaagcatatttatccttaacaaggtcaaagtcagaaaccttaatccaaaaccataaacctcctgcagaaaaaatctctggaattcaactctctctcgtctattctttattcctactgataccacttttgtgattgaaacatgaaacagatcctcatctcctgaagatgatatatagaaattgttttaaatgccttgtgaaaacccttaataacccgaattctgttccccagttgagctatattttccttgctccaaatttaccatgtcattccaggcctccaggcctttggttatttgtcccatctgtctgggcttctcttccccgcccttccttaccttactaacttactcatccttcacttcttagcttagatttctcttctgctgagaagccttcactggcccctacatcgtcagctatgggaaccctcttatgtgtagtctctatctccccctcttctagcacttgtcacagtgtgttgtaactgcgtggttgcttggattttccccctgtcctggaaacacagcctagggtgcttactgccaagcttatgatagaaactctcaataaacaccagctgagagaataaaccaaggctttgctgtgtgctgggagaggattcagcattctggtatccgtaaccctgttacataggtggtcactacctgaaaggtctgctttcatgctggtgtcagatttgcttgttttaaaaataactcagggctgctgatacatgcaattctaagccaagaagagaaccgtaatggtcatcaatttctttctttcttttttgttaccaccaagttaatgcatttaacgttttctaatctacaaagacctataacctctgctccccacgttacttaactagagagctacctatctgctactcatcaaacccagccagagatgccaagttcctgaattttttttctcacatagaaatctagatgaatcccctgaaatggtcattttaaaatcaagtcaaaaggaaaacaacaggaaatactcactagagtaaaagagaaaagtgaatcgaggacagacttgtgtatttacaactctcaaggccaatgaacattggaaaagcaaactaaaatgatagatagcaagctgtggaatttggcttgaccttaaagaggattttaatatgctcttatatcactgtctgctactcaaggtcgataagaaaagcgtggttttcttacggaacagagctgagtcacttatataataccagtgcatttcagttgattgtgatgattttttcaagagatgatgtcacacaaattgagttttgcttgaatcttgcctaaaaatagtttgatttatttactaggtcaaaaagacaaggggatctaacatcaatgacaagtaaaaatagaaagatttatttatcctgaacactatggacaaatgtgtgtctcagcacatttaggtgtttatccaaggctctttgtgtaagtagaatgaaccagaagcaatttactatatgtgaataagaaatatcaaggtgatattaatggtttgtatttcccttttctgtagaagatttgtaagaagagtcttttcaggtccccaaaggtaaactttaggattaaattatatggttttaagaaattatcactaaatctttcccccattttttttaacccttaaacatttttgtttgaaacagggtctcactctgttgttcaggctgcagtgcagtggcaagatcatggctcactgcagacttgacctcctgggctcaagctgtcctgcctcagcctctcaggtagctgggactataggtgtgcactactatacacggctaatttatttcatcgtattttttgtagagacagggtctcactatgttgcccaggctagttttgggttcctgggctcaagcaatcatcctgccttgggctcccaaagttctgggattacaggtgtgagccattgcacccagcccttagaatcttcatatttttgtttaatttgttctttgtagagtagttttcactacagggatgttacttggtaaattaaattctatcatttcaattaacaacccaagaaaaatatatgtataatgataaactttgaggaaaaagagaaataactgcaaaaaaaatgaattggcatgcagttaaactttgcttatcccttaaattttgttcctgcttatagatttttagtagttcatacaaagtcttcttttaaaattttaaaagtctcaaaactactaaaacaggatattattttagtggaaaatagccatatggtttctgggaaggattttactaaaggaataaatttaattagaagcaggaaagatttggttacatacaacaaaagccaacaaaatatgctcaaccccaagggtaagtgtaactgctggctagagatttccaggagaggacagggagtagttttcctagaatattttatgtcctaaatagcctggatgaagtcccttattcccttccagactcatcactgggaacgcggcacactggtgggctatgattccctggagagcttatgaaataaaaatcaagtgagctacgagtgcagccagaaacttgctttacccacaagtcctgaccctgaaacttaatttttgtgacttgaattgtgtctctctgtttaaaatttatttatttagagatgaggttttactctgtcacccaggctggagtgcagtggtgcaatcattgttcactgcatcctcaatctcccaggctcaagcaatccttccatctcagcctcccgagtagctgggactacaggtgggtgccatcacgcctggctaatttttaaaattttctgtagtgatgggagtctttctacgtgacccaggctggtcttgaacttctgggctcaagcgatcctcccacctctgtctcccaaagtgttgcgataacaggcgtgagccaccatgcccagctaaattatgtttctaaatacagcagaactatgtacttcgtgataggtaaagctattgtttggttgattcttagagaagagaaagggagtccatgctatctctttccacactctaaatcctgagatataaatctttagattcttgatcctcacccctggaagagaggtcagcagtgactcgaacaggggtgacctcctggctctaggagccccaggaaacaggattggaaacatggaagtactcctggaggagaaggatttagcttcctggttatcaggctctctggctgctcacacaatgtgcgcgttgcacagacagtaagccagttataatcgaactctttcacatgaaattcttctcttgggaacaagggcttgatcaggatctttttgggagagtgtgctgattttagctttcagctaacgtagacattctctctctgttagcacaagaaacaaatctggttcatttttgtaaatttaacaaccgagactcagatttaaaaaaaaattgattgcgccactgctctccagcctgggcaacagagtgagattccacctcaaaaaaaaaaaaaaaaaaaaaaaagccgcagacaggattgtaaggtaatttaaatctacatagaaataattcatctaagtttatttagtctgatcatttgttttacgtgctttctcaaggataacatggttgaaaatttagtgaaaaataaggactattgtgggtgataagcttaggaatcaccagacacctctctccagagaccataatacatcatgccaagagcaaaaaactgggagaaatgagcaatttgaagtactgttattttaatccccataagcctatataaaattttttttgatataaattaaaagaaaccagaaatctataaagccatctggctgatttaagtatattttttatagcatctttttaagaaagatcagaaaaactcaagacaatataaaagtatgtcagtatggaaactattcctagctgatcattttacttccaagccttctgggcttcaaagggacagctcaacaattttgagaagaaatataaaagtaacaacacaccttcttgagcctaacagatggagtaagacatttgaaatgctgaacaagagacatgggtcagaatccatcccagaattgtatgaagccagcttaattaaaagtgctttctaggctgaagcagagcatcacttgagctcaggagttcgtcttttgtttttctttttttttttttctttttgtggagaacggggtctcgctatattgcccaggcaggtctcgaactcctgggctcaagctatcgtctcgcctcttgcctccctgagagctgggattacagacatgagccaccgcgcccagctgagctcaggagttcgaaaccagactgagcaacagcgagaccttgtctctactaaaatttaaaaaagaaaaaaaacaattagctgggcatggtggtgaaagcctgtagtcccagctacttggagggctgaggattgcttgagcccaggaaatcgaggctgcagtgagccctgattgtgccactgcactccagcctgggcaacagagtgagaccttgtctcaaaaaaataaaaaatttttttctacagtgcccctctattattgtctttgtaatttattgtcttcctcctttgtaaaggaggaagaagaggcagtaaccttatatttaattatgtcaacaactcagtgttaattcttctgtttgcagcaccgtggctaataacttcaaatcgcatggatccttccagaggactctggcttcactaggcctttaaaacagcacacagtgccttggcttcagcatttggtcgctgactaagcacctttcaagctgccttcaattgaaagacggacagcggactctgaggaaatccttgctcagccaaatgtatcccatatgagagggcaaacttaatgagaatcagtccctggcatgcagcgcctctggaatgtgcgtgatttacagccagcatgggctacagagttttctgtcctagtctctccttttctgtcctagtctctcctttttttttttttcaaaaaaaaaaaaatgcatcaacaaagtatcaattttagctaataaaggcaaaaagaaaaaagagcacactaactttagcacatgtatgcaaggtcccgggaggagataagaaaatgaacacattcgattcacaactgcaaggagcttagagaatacatggacacgcacacacatatcacacagggcagagcaaactgattgacaggcagaagtacaaagtgctgtgggagcataaatattgtgttttccattttcctccaagtgcctttatttgtagcaatggaatggtctcatggtgcaaaatcatatttgtgatgctgcctggcttcctatcaatagggtggagttgtacctgttcactttctacgagtgaggctcctggtgagtatggtgttttccccaaacgcacaagtaatagattaatatgggattgaaacatttaaacgatataaagaaagctaatgtcctccttgactcatctcctccacctaatcactggccagttctaatccctggaaggtggtaatcaccattgtcatttgatatacatacttccacgtcttttaatttacatttacccacacatatatactcacactcatagataaacacacatatatacagacaagaagaaagaaatacaaagtttaaaaaatgtgataatggtatatacatgttcatcttcaacttgcttttctagcataatataccatgggatatgtcaatatatacaaatctcattttttttttcttttttgagacagagttttgctcttgttgcccaggttagagtgcagtggcgccatctcggctcactgcaacctccgcctcccgggttcaagcaattctccagcctcaacctcccgagtagctgagattgcaggcatgcgccaccacgcctggctaattttttgtatttttagtagagacagggtttcaccatgttggccaggctggtctcaaactctgaccttaggtgatccacctgcctcggcctcccaaagtgctgggattacaggcgtgagccaccgtgcccggctacaaatctctttgtttttaatcactgtatagtgttctatggtatggatatgtcataattaataatgctctacaagtttataattttgttatctcctgatgtttccattttttcaccatttccaacattgcaatggatattactgtacctatctcagttatcacataagcaagtaattatctggggtagatgtggagacatggatttgctaaattaaaaggtaagagattcccagctgggctcagtggttcatgcctataatcccagcactttgggaggctgaggtgggtggatcacttgaggccaggagttcaagttgcagtgagccaacatcacgtcactgcactctagcctgggtgacagagtgagactctgtctcaaaaacaaacaaaggcaagagattttgattttttttttttttttttttttttgagatggagcctcgctcttgtcacctaggctggagtacaatggcatgatcctgggtcactacaacctccaccacctcccaggttcaagcgattctcctgcctcagtcttccaagtagctgggattacaggcgcccgccaccacacctggctaatttttgtatttttagtagagacagggtttcaccatgttgaccgggctggtcttgaactcctgacctcaggtgatctgccctcctcgacctccaaaagtgctgggattacaggcgtgagccactgtgccctgccttcagtcttcttgagttggctattactaggaagtatgagaaaaatgtccctctctgacagaatttgcccatttttctttctatttgttagttatttctttaaatatttccatgttatgttaagtgcatgaagatttgtgaatgttttatcttcttggtagatatttttcttcaacatgaaatattcctctttggtcctttttcctttttttttttttgtattttgtcgatatttatattgctaaaactactttccttgtattagactttatctggaacattattattttccaaattgccagatccttttacaaacatagtttacaatgtccccagcttttgctgtgatcattttggactatggtttccacatcaaacttatcatcctacctgccttctctttttcagagatacttaattatcccttatctacacaatggtatactttgtcttctagcacaattataagctaaagtgtgtgtgtgtctgtgtgtgtgtgtgtatgtgtgtgtgtgtcatttaaggcagaaagtagagatgacattacatggtcaggctgccatcttgatacgatcctatgttttccttaacaccagatttccttctccacctccacttcaaaactttcctttccttccagcttggttgatctagatactaaaggtgccgtgggagatacaatacagagtagagtttgtgaatacgtttagtcagcatacacctctcgaaaaactacttttggtctccatctctttgtggcctataagttagtttcaggctgaatactacaacatgtgttccagtagcatgcattatttagtaacagcttacacagctctaagttatcatctttcccacctcattcccaggaagatttgtttaatttataagcagtccatttcagacagcactcctcgggatatcacaatattgctgttcttctgggtgattcattggcattatgaatacccttgtttcttccatgggtaaaacatgtttcaaggccactaactgggctattggcaaggcctggtacaaactaagtgcaatgtaactcttagcaatttgtgaccattaaacatagcatttataatgtgctagttttaaagttgaacaaaacaacaacaacaacaaagcaacccacagcccgtgtctacggccataccaccctgaacacgcctgatctcagaagctaagcaggatcggacctggctggtacttggatgggagactgtttgggaataccaggtgctgtaggcttcgctgggcgtggtggctcatgcctgtaatccccgcactttgggaggccgaggcaggcagatcacctgaggttgggagttcaagaccagcctgaccaacatggagaaaccctgtccaggcatggtggcgcatgcctgtaatgccagctattcgcaaggctgaggcaggagaatcacttgaacccaggaggcaggggttactgtgagctgagatcgtgccattgcaccccagcctgggcaacaacagctaaacttcatctcaaaaaaacccaacaaacaaaacaaaacaaaaaacccacaattagttcataaaagacttgcacttaatttgccttcttattttatttaaaacattcttacctcgttttctatattttatctttacatatagaatacagagtttaattttattgtacttttccttttacctccctttttttcttgtttattttcacttataggtcattaaatgccaagcataggatctcagacgaaaaagggattcagggttaactagctgaggcctatcatatgatgtttgagaggttttgtggcttgcctgaattcctccattgacctgtggcagagctggcacaagaatatgggtcacctgactccagcacatgcacatcaatttacgtttacaaaagagtttttaaaatacaatctcatctactaactactacaaaactactggaaagaaacctgacggtgagtacatattacctcaatttttataggagagaacactgagcaggacaaatgaattaatgatttgcctaaaataatctgcatcgggagatgtcaggagaacaacctggggtctttactaccggcttctgcatctcacagcctctccaccttctcaccttgcaacttcactttctaaaaggacagagttgccttttcaatgatttatttcatcatttcataatttcatccctataaaaacacaaaatatagattttttttttttttgagacagggtctggctctgttacccaggctggagtgctgtggtgccatcttggttcactgcaccctcctcattcctgggctcaagcaatgctcctacctcagcctcccaagtggctaggaacacaggaatccaccaccatgctcagctaattttattttatttatttgtagagacgagttggtctcaaactcctgggctcaagccatccaccccccttggcttccctggggttacaggcatgagccactgtgccctgctgatgcatattttaacgattaaaataataataataaaaaaaacccacctggcatggtggctcacacctgtaatgccagcactttgggaggccgaggcaggcgaatcacctgaggtcaggagtttgagaatagccttgccaacatggtgaaactctgtctctactaaaaacacaaaaattcgccaggcgtggtggcgggtgcctgtaatcccagctacttaggaggctgaggcaggagaatcacttgaacctgggaggcagagattctagtaagccgagatcgcgccactgcgctttccagcctgggtgacagggcgagactccatctcaaaaataaaataaaataaataaaaaggcttaggcctgtaatccgaacacccaagcgggggcagatctcttgaacccagaagtttgataccaacctgtctccacaaaaaataaaataaaataaaataaaattagctgggcatagtggtgcatggggcgtgtagtcccagctacttgggaggctgaggtgggaccactgcttgagccctggaggtcgaggctgcagtgagccatgattgcaccactacactctagcctgggcagtagagcaaaaccttgtctcaaaaaaaaagtaataaaataaagtatgtgtcattttgatttgtgataaccttaggaaaaagccagcaaagtctgggaaccaggtaatcgattgcaaattggagaatgatttacctgctatctaagataaaggaaaagggtaaatcacaatgttgctttaaattcctttcagctttgtttattgtttccttttgtgtggaatttcactgttgcattgatttaaacccagctcctatcaaatgggacatagagtaggccctcaagtaaacatttagcactaggcatgtgtgctctgtataggatatgtagaaccctctctctgcttctaagtcataaatagttctttagagtctaagaaattggcaaactcaggctgggcgcagtggctcaggcctgtaataccagcattttgggaggctgaggcaggcagatcacttgaggtccggagttcaagaccagcctggccaacatggtgaaaccccatctctactaaaaaaaaaaaaaaaaattacccgggtgtggtgtcagatgcctgtaatcccggctactcaggaggctgaggcaggagaattgcttgaacctgggaggtggaggttgcagtgagctgagatctcgtcactgcactccaacctgggagagctgtgtccattcatttacatattatctatggctgctttccctagaagggcagagctaaatagaagttagagactgtattttaggcaaaggctaaaatatttactatctggccgtttagataaaaagttgactctatcccttgcatcaggagcgataaatagatgctcttgcatttagcgtctttattgtttttcatgacaaacctagagttgaaccaacatctggctaaaaagcaaatgcaccatgacaaatgttcatggatcagcaaagtgctaacccagttatggaagtctaatatagtgttacagagtcacaggcttagctaatatgtaaatcagcaaacatgagcaataatgatttatatttgcatggcattctatagattatgaaacatttcatatcaatctcatttgatttttccaataaccgtagaaagtagacaagtaggctgggcattgtgcctcatacctataatcccagcattttgggaggatcacttgaagccaggagttcaagaccagcctggtcagtatgacaacaccctgtttctacaaaaaaaattttttttttttaattagccaggtttgttggcgtatgcctgtggtcttatttacttgggagggttgaggtgggaggatcacttgaacctaggagtttgaggtaacagtgagttatgattgcactactgcactcaagtcagggttacagagcaagactctgtccccctgtctccctgtccccgacccccaccccccccaaaaaaagggccggcgtagtggctcatgcctgtaatcccagcaatttggaaagccgacgcaggtggattacctgaggttgggagtttgacaccagcctgaccaacatagagaaaccctgtttctattaaaaatacaaaaattagccaggcgtggtgttgggtgcctgtaatcccagctactcgggagactgaggcagaagaattacttgaactcaggaagcggaggttgcagtgagccgagatcgtgccattgcactccagtctgggcaacaagagtgaaactcaaaaaaaaaaaaaaaagaaagaaagaaagtagacaaattatgaaacagattcagcgacattgcgtgataactcagagtgaaaaggaactcagatttaatgtcttcagtcttttagcagctaaatgattattttatctctggaaaatggttaccttgctaaaaataaaaaaggtgagcggttattaacgtttatcattctatgatgcactgacttggaagatcacttacaattaactgtactttgtaataacatgttctgtcttctaaatattgtatttttatgtcagtatgatggtaaaaataatataagcattttatataatggttttaaaaatcaaaataaatatgggcctaattaagttataagttaaaaatataatcttaaatttttgaaatcttagaaactgcaagatgaatcagttatctggttttcttggattaacaaaatttttaaaaaacaactcttggagtagcagggaaaataagtcttagtaaaaatgtgagtatatatgagcttgagaaaaataatgaaaagtatacatagtgctctgtaaatggatcaaatcgtgttgaactaaatatttcaatggaagctacgaacatgtagatgactattacaatcgttgtatcatctaagacttgatctcctgtgtgatcaaaccacttctgaggaattgccagtttaccaacacattgctgtatcagtcttggacccacgtaaaacattaatacaacatactgcatgattcagctagatgacattctggaaaaggcaaatctatggagacagtaaaaagatcagtggttgctaggggtcagggtaaggaggggatgaatagtggagggcagaggatttttagggcagtgaaacttaactgtatgatactgtaatggtggatgcatgttattatacattagtccaaacccatagaatgtataacaccaagagtgaactctaacataaaactctgctagggaatgttgatggcaaagtaggttatacgtgcatggggacaagcgtatatgggtaatctctgtaccttctgctcaatgttgctgtgaacttaaagctgctctaaaatataaagcctactttaaaaaaataacataatgagctaacaaagaccacaattctaggtcttcctcagaagctttataaatatgcattaaaaaattattttttgggtatactctggcagaaatacaagaaaaacaaaggcccagaatttttccaggagaatagatccagagcgaacatgaacttacttcacacccagattgagtttcccatgaacatgactcgttctcctgagggagaacccctctttggaaagcatgttcacccaggcatgtttgacacaaggaagactcgaagtctggctcccctggagggatgtgcaccatggaggagccggtgtacttcaggctgggactctgatgcttgtccacactgaccattgggctcttgatccaccttcgtacctgcaatgtgcaaaaggaaagaaaaaacaaatgtgtttgactccctttgatgtttattggggatttggtgggaaatctggtgggatgggagctcatgaaaggagaactcggtctcacaacctgtctatctttcaaactcaacacaattcgaattggtcaatgctgttcagtctctttcctagagtatgcattacatggctggtcatttcatcttgctgagtctgtctccgcatttttttttcacattatttttttcttttctttttcctcctgcttccagtggggttagaatttttttctttttagagataggggggtttcactctgttgcccaggctggtcttggtgttaaaagatcctcctggaccagcctgccaacatgatgaaaccccatctctactaaaaataccaaaattagccaggcctggtggtacacgcctataatctcagctgcttgggagaatcgcttgaacctgggaagcggaggttgcagtgagctgagatagccccgctgcactccagcctgggtgacagagcaagactgtctccaaccacaacaacaacacaacaacaacaaaccctcaaaacccaaaaacaaacaaaaacaattaccctggccaggcgagatggtttatatctaaatagcactttgggaggccaaggcaggaggactgctttagcccaggagtttgagaccagcctgggcaaaatagcgaaactttgtctctacgaaaaaaataacttttttttttttttaaagaaaaagatccttttgcctcttaaagtgttgggatcacaggtataagtcactgtgcccagcctgtctcctcatttgtaagattcaggtaataatatttcctcccaagctgtgaaaatgctaccatgttttacaatgttcaagtactttgcctggcacatgtttggtgcccaatagatagtgactattttactttgacccttattattatgattatgatgacagaaatttagttcacacatttctaaggtgaattactagttattcttacaagggaaaatactaatctcatagtttacaatctaatccattgctaagcaaatacatattcactattattattgttattgagacaggatcttcctctgtcacccaggatggaatgcagtggcctaatcatggctcactgcagtcttgaactgctgggctcaagcaatcctctcacctcagcctctggagtagctgagaccacaggctcgcaccatcacactactaatttttttttttttttgtagagatgaggtctcactaagttgcgcaggctggtatcaaactcctgggctcaagtgatcctcccgcctcccaaagtgttgggattacaggcatgagccactgaatccggcccatatatactactgcacaactttgattataaaagaaattgcttctggctaagaaattagctcaagtttgtttttaaagttctaaaactcaccacttgtcttgcttgcttgtaaaatccctataagatacagaaagaagtataaagctattctaatattaacaggcatggtatttatacagcatttcaaaaatcaaggcactttttaaagtgtttgatgtgtatagtttttaatcctcagaacaggcagggtgaggtggctcacacctgtaatcccagcactttaaactttgggaggctaaggcaggcaggtcacttgaggccaggattttgggaccagcctagccaacatagcaaaaccccatctctacaaaagaaaataaataagtaaatgaagaataaaaaattaattaattagtcctcagaaaagttttataagaaaggtactattttcaatcccattatacagatggaaaaacaaacgcatagagatgtgaagcaaatttccccagggcacagtgttgttatggagtaaaggcgggatccaggcaccttgaatccagagtttataaacatgcaattttcttttctttctttttttttttttttgagacagagtctcgctctgttgcccctggctggagtacagtggcgcgatctcagctcactgcaagctctgcctcctgggttcacgccattctcctgcctcagcctcccgagtagctgggactacaggcacctgccaccatgcctggctaattttttgtatttttagtagagaccgggtttcatcgtgttagccaggatggtctcgatctcctgacctcatgatccgcccaccttggcctcccatagtgctggtattacaggcttgagccactgcgcctggccatgagcatgcaattttctaagaagcactgaagtgttgttaagacttatggtcactggtgcttgaaatttattttgatttactatttcactttcatgctcttcaaaactcctgaggattcttttatattcaaccaattagtgaaattagcctatagcaaaaggacaaagaagtaaaatcacagtactgaattttagttagtgatgctacaattattattattattatttttgttgttgttgttgttaaagggtcttgttttgttccccagattggagtgcattggcacgatgacagctcactgcagccttaacctcctaggctcaagcgatcctcccacctcagccctcccaagtagctgggactacaggcgtgcaccaccatgactggctaattatttttaaattgttttgtagagacagggtcttgctatattgcccagactggtcttaaactcctggccttaggcgatcctcccactttggcttcccaaagtgttgggattacaagtgtgagccaccatgcccagcctgcaattaactttttaaaaaacactgaggataaactaaaattgcaatagcaataatgtttaagcaatttattatattacttgatagaatattttgctatcactaaaattaagtattatgaagactgtgaaaatatgaaaaatatttagaacataattatatgagaaaagccaaatacaaaactgtttaattgctataatcacaaatgtaaaaacatatgtactaactataggccgggtgcagtggctcacgcctgtaatcccagcactttgggaggtcgaggcaggcagatcacctgagcccaggagttcaagaccagcctggtcaacatgacaaaaccccatctctacaaaaaacacaaaaattagctgggtgtagtgttgggcacctgtaatcccagctactcaggaggctgaggcaggagaatcgcttgacccctggaggtggaggttgtggtgaaccaagatcatgccattgcactccagcctgggcaacaagagtgaaaactctgtctcaaaaaacaaacaaacaaacaaacaaaaaaaatatatatatacacatatatattttatatatacatatatattttatatacacatatatattttatatatatacatatatatttatacatatacatatatacatatacatatatattttatatatatacatatatatatatacatatatatatacacagaaacactatagacataaagtaggagagttaagaggcaaaatagaaactgctgtgtttattgttagtatcatgggtgttttatctgtttttacaactcttcgtactttaacttttaaaagaataatattttatcagaatcataaatgtatatatatatatacatttctttaaaaaatagagtctcaccatgttggtcaagccaagctggttagaactcctgggctcaagtgttcccctcccagctcagcctcccaaaatgctgggattacaggcgtgagctaccacatccagccacaagtgtcttttaattgctttatttatttatttctttattcatttatttatatttattaagatggagtctctgattgtcacccaggctggagtgcagtggcgcgatctcagctcactgcagcctcctcctccctggttcaagtgattctcctccctcagcctcctgagtggctggaattacaggcaccgtgcccccacgcccagctaatttttgtatttttagtagagacggggttttgctatgttggccaggccggtcttgaactcctgatctcgggtgatccacccacctcagcctcccaaagggctggtaatacaggcgtgagcaactgcacctggcctatatgtactcttttcaatagccatttaaaatatctttgtgaggccggttgtggtggctcacacctgtaatcccagcactttgggtttgggaggctgaggcgtgtggatcacctgatctcaggagttcaagaccagcctgaccaacatggtgaaaccctgactctcctaaaaatacaaaaattagctgggcgtggtggtgcacacccgtaaccccagctgctccagaggctgaagcagaagaacggcttgaacctcggaggcagaggttgcagtgagcctgagatcatggcactgcattccagcctgggtgaaagaaggagactctgtctcaaaaaaaataaaatatctttttgagtttactatcctaaagttaaaattttgggtttccttaaatatttctgtcactatagggccccttaagcatgttagtaggtatattaagaatgtttcgctgattcattaatggaagtctaaatgaaactttaaaagtttgagactccaatagaatgtatcttcttaatgttagtactaaatgtgtttttgatcagtctaaaaagtgttcaatttcattagagatggataatgttttttattattcttattcagatagttttgggcttgaagtctggtaactgttcttgctttgtctccaacgttgtagtttaaaatcaatctttttactctggcttactttcaatgtctcttttgccaagtagatttaactttagggttactgtgaacaggatttaaacagatgataaatctattcaaatatatttgtaagttgtatgcctggactaagaatctttgtatcttgaaatgtatatctcccctgactccctgaacacccgcactctagagcttgagttatggccaacaaaataaaattttttttaaatattcttttttcatgttatttttatttctttttgttttttatttttatattttctttttcttttttttaatatgttacagtctgaatatgttcatagtgacttttctgtttgtttggttggttttttttacagagatacagtctcactctattccctttgttggagggctgtggcacgatcatagctcacttcaaccaagagctcctaggctcaagctatcctctcgcctcagcctcccagttacctgggactacagatgcgcgccaccacgttcggctatttattttttggagagacggtgtctcattatgttgcccaggctggtcttgaactcctggtctcaagtgatcctcctgccttggcatcccaaagctctgggattacagacatgagccattacacctggccagaataaaattattaaagggacatactatttatttaataaaataagtaaactataagtaagaaggaaaataaagcatatgaatgatcaggatcattgcgggtggagggctcaattttaaacagtatgagccaggatactatcggatactccctctctgtccacacagaatgtagcaagggatatggagaaatactccctttctccagaagcatcagagaaaaagtgttacttacaaaaatgaatccagcaacacatttctaaccggactgttgctgaattttactgcatgctttgtcttaaaaaggttttgtctccattggcttagtccttatactggcttcaacgtgtcccttctttatgactccttgacacttttcaccagctttgaagcctcacaagtgatttttacaggcccaattaaggacagagtttacgatgtttgcttgctcttgagagagtggctggaccgacccagtgaatgcacaggagttaggcaaggtgcccttcaaaactgctgagtagagaaatcctcccacggcccctcggggaattcaagctacaactggcccattgtgtttcctcaggctgcggattgctttactggagggagtagctgactgtgagtggctttgggagcccttcataacaatggctggaggagagctgcagcagctgtgtgtgcgagaaacacgaatgcccggatgccagcggcagcctgggctcctgggcctcctgggccacctgggccctagttttattcagagctacacaactgtttgtgaagcgcattgtaaacaaacatagacggggtgagacatcctctttatcctgaataaatcaagaattcccaggccgggcgctgtggctcatgcctgtaatcccagtactttgggaggaggcgggcggatcacgaggtcagtagatcgagaccatcctggctaacacggtgaaaccccgtctctactaaaaatacaaaaaaaattgccgggcgtagtggagggtgcctgtagtcccagctactcgggaggctgaggcaggagaatggcgtgaacccgggaggcggagcttgcagtgagctgagatcgcgccactgcactccagcctgggcgacagagcgagactctgtctcaaaaaaaaaaaaaaaaaaaattccctcacttggggtttataggagactgttctccaaaccacaccagacttttagaagcaactacctctacagataccggggtgaaccagtaaggcccttcatttaactagacagaaactgagtgaacagtgggtaaacaaaatattcaaccaaattctttgctaaatccagtccaccttggttttattaatgtctttacttggaaaaaaaaaaaaaaaaagccatccaaaagcaatccctcagtctagaaaattgccagatgtgattaaagagattggctggcttctagggattttccacttgtggttttttcctattatctaagagcaaacagatattactattaatttaaaatagtttagctgataatgatatcaaccgatacaggaaaattatagagagtttaggtacttaggtgtgaactcaggtggcaacacctactctcattggcccccgtccttttagggggaagagctgactctcttaaaaagccaagagagcttgaagttgccttctgtaatttccaaacaggcattttttttttttaattatagagaactgactttgcttacttgacgcctcaataactttcaatttcgagagagtcagcccagttttctagtgaaattacttggataggtcaatagattataaaaagggaggccaggtgaggtggaggccgaggcaggtggatcatttgaggccaggtgttaaagaccaggctggccaacatggtgaaaccccgtttctactgaaaacacaaaaattagccaccatggtggcgtccacctgtaatcccagctactagggaggctgaggcaggagaatcccttgaacccaggagccggaggtggcagtgagccaagatcgtgccactgcactccagcctggatgaaagagtgagactctgtctcaaaaaaaaaaaaaaagagagagagaaagtaagagacctgcatgcctatgcctctcccagagggtgcatgctagcaggttagttacggcatgagtgtaatttaggagaaggctcctggaagcaaattcatctcacactgatactggagcctgaagctgcttcatagcatgtctcctaaaatataacagtgctgtaatattcagtaatattaatcagatatcttcaccccagctatatgtcatcatcatgtatctgtcttttctctctctcttttttttttttgagacggagttgtacttttgttgaccaggctggagcgcaatggcgcgatctcagctcactgcaacctccgcctcccgggttcaagcaattctcctgcttcagcctcccgagtagctgggattacagacgtgtgtcaccacatccagctagttttgtatttttagtagagacagggtttctccatgttcgtcaggctgatctcgaactcctgacctcaggtgatccatccaccttggcctcccaatcccaagcctgttgggattacaggcgtgagccaccgcaccaggcctattactgtcttttctctagtgtttgtagtgtttattgcttgtataaaacaacaggacttttatgctaactggtcttgatattaagcctatgtcacctttccaactggatcataagcatgagaatagcttcttaggccttaggaaaaaaaaaaattccagaggctagtgtatgggcttacaaacaaactaggtaataaaaataggaatctcttgattgcttttaatatttacttatagatctcaacaagttttgctaacatcctccatcaaggtaatacagattttctatttaaatatttctctttaacacgcaagacctatcctggagcaggcaccctgagaagatggagtgacttttagaattccctgaccttctatgctgttgtccttgggatctcccagtcctttcctctcaccttgacctagttgcatcctcttctagattctcaggggccaacctgtgtctccaggcctagtccggaggatggagtggtggggaggactctggggaagtgggaaaacggagacgcaatgcgtccatgtaccctatttaatgttgctgctcacagcaggcagcaccccagctccgtctcttcagaggacagtgcttgcctgttcttctagctcagtaagtataaagtctccctcctcatcctccccattgaggaatccaccccaccctgtcccaccccaccccaccctacactgccaagtgttaaatagataaagtgcaggaattcatcaacgtacgtttttctttggaaatacaggtgaagtttttctcatttctttaaattgtgggactctgccaggtgcggtggctcatgcctgtcgtcccagtgctttgggaggccgaggcaggcagatcacctaaggtcaggagtttgagaccagtctggccaacatatagtgaaactccatctctactaaaaatacaaaaattagtcgggcgcgggggcacatgcctgtaattccagctacttgggagactgaggcaggagaatcacttgaacctaggtggcggaggttgcagtgagccgagattgcaccactagactccagtctgcagagtgaaactgtctcaaaaaaaaaaaaaaattgtgggactcattcttttcgtttgaatttgtctttcctcgatatgtactttttttagatataaaaaattgttttaaaaagagaaagtaggaaaattattttaggtactatctctacgggacagtgtatgttatttgcttttggaaattaaggctcagggaaaatagaaatgctggtgtaatcagtggagaagaacctggctatcctgtccgtcaaaatccactgagctttggaaacaacttcctcccctctttcctccaagaaatccccttttccagtgttttttttgtttgtttattttaggttcaagggtacatgtgaaggtttgttacacaggtaagctcatgacaccgggatttgttgtacagattatttcatcacccaggaattaagcctagtacccaatagttatcttttgtgctcttctccctcctcccactcttcaccctccagtagaccccagtatctgttgtttccttctttgtattcatgtaagttctcattccagtgtttttctgtttgtttgtttttttgagatggagtcttgctctgttgcctaggctggagtgcagtgatgcgatcttggctcactgcaacctccacctcccaggttcaagcaattctcctgcctcagcctcccgagtaactaggactacaggcacacaccaccacacccagctgagttttgtatttttagtagagacagggtttcaccatgttgaccaggctggtctcgaactcctgacctcaggcaatctgcctgcctcgacctcccaaagtgctgggattacaggcatgagccaccgtgcccagccttttttttttttttcttgagacggactcttgctctgttgcccaggctggagtgcagtagtatgatctcagctcaccgcaacctcccgttcctgggttcaaggaattctcctgcctcagtctcctgagtaactgggatcacaagtgtgcaccaccatgaccagctaattttttttttttttttttgtatttttagtagagatggggtttcaccatgttgaccaggctggtctcaaacttctgacctcaggttatctgcccaccttggcctcccagagtgctgggattacaggcgtgagccactgcgcctggcctcattccagtgttgttgttgtttttttaactgtctctctctctctaggctactgtctctcagcatattaaacaccttgttcttgcaatatctctaaaagctagcgaacagactgcaagcaaaacatcctctttacacccacaaactcttcctttttcccgcagccacctttcaccaccacccaactcttctctcttagccgagcttcatgaaaaaataatctccatttcctcatctcacattttctcctcaacccatttgctcattaaatggcaatttgttcattaaatggtatttatggattgcttaatatttgcaaggactaaagcgaagaacataataacaaaagtctcatttcataaaatgaagcttgcacaaagatgccaataaacctcattgtcaaatccaatagacatttctctgtgcttacttcatttgcatatactctgcagcatttaaaagctttcacaaaggttcaacaactatttgcctggcattatgtggttgggacagaaagaaatttaatgttgaccatcgaaagaggatgcttgcatttcagaggggctgatacatgagactgcggtttatcacagcaggtctaccctccccagagctcagtttctgcccttgtaaaatggagataataattatgcctactttacaagggttttgtgaggactaaatgagatgatgcaggtaagcccagtgcttgacaccaggtgaatccttcacaaatatttgctattgtggttatggcttcattccatggaaagagttttatacaaagggccattggagaaaagatggagggtacttggtccagtcaggaaaaatcagggaaggctttctggtggaagtgatggttaagttgaatcttaaaagctgagttacactttgggaggccgaggtgggcggatcacgaggtcaggagatcgaaaccatcccggctaaaacggtgaaaccccgtctctactaaaaaaaatacaaaaaattagccgggcgtagtggtgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaaagctgagttaaaggaagccaggtgaagagaaatgggaaagatatttctagtagaggggatggcagaagcccaaatacagaggcaagaatctgctgagatgaatagaaaacaagctccaaaaaggagaggcaagaactaaagctggatagaaagtttaggtcatggggcaatgaggggaccctgaagtatttatttttatttatttatttacttactatttagggatggggtctcgctgtgttgcccaggctgatcttgacctcctgggctccagtgattctcctgccttagccttccgaagagctggggttacaagcatgagccgctgcacccagctcactgaagtattttaagcaggagagtaggatggtcaaatgtgtttttctttttctttttttttgagacagagtctcactctgtaacccaggctggagtgcagtggtgcgatcttggctcactgcaacctccgcctcccaggttcaagagattctcctgcctcagcctcccaagtagctgggattacaggtgcctgccaccacacccggctaattttttgtatttttagtagagatggggtttcaccatgttatccaggctgatcttgaactcccaatctcaggtgatccaccacctcggcctcccaaagccctaggattataggcgtgagccaccgtgcccagcctcaaatgtgtttttcaatacagtatgaaggacggatttaagatggtcaagatcaaaggagctagatgagagtcaggaatggattagaaaagaaaggtaagggccaaacaagaatagtagctttgggaatggaaaggaggaaacaataatcaaatctacttttagctctcaagactatatcctcttctccatccaagtacaggttgagcatcttaaatctaaaaatccaaaatctgaaatgcttcgacatctgaagctctttgagtgtggacaagatgttcaaagaaaatactcattggagctttttggattttcagattaaagatgctcaaccagtaattataatgcaagtattccaaaatctgaaaaaaaaaaaaaaacccaaatctgaaatacttctggttccaagcattttggataagagagactcagcttgtatcttctcgattcctaaagccattccttaaatggtattgcccttttagtcttttcttttcttttcttttcttttcttttcttttgagatggagtctcactctgtcacccaggctggagtgcagtggcgcaatcttggctcactgcagcctctgccttccaggttcaagtgaatctttcacctcagcctccaagtaactgggattacaggcctgcaccaccatgccctgctaatttttgtattttagtagagacggggtttcaccgtgttgaccaagttagtcttgaactcaggttcaaggttcaaggtatccacccaccttggcctcccaaagtgctggtattacaggcgtgagccacagcgcctggccatctttttttaaaaaataaaaataatctgtggctgggtgcattggctcacctcatctcttaaaaaaataagtaaataaaataaaataatttgttatttaaattgattgatcagtcgattgtagaggtggagtgtcactatgttgcccacactggtcttaaactcctggcctcaagtgatctgcccaccttggcctcccaaagtgttgggattacaggtgtgacccactgtgtccagcctccctttttaatcttaacctcactgataccacagcttctttccaaatgcaaaagctgtcttgttgctacctagctttaaactcctcagtttggttcctcatctctagcagcagtggctttcaaacctgtttcatcaggattgatgtattataagaaagcccatatgactgaaacaattggttccccactaaaacctatcctttttacatgaaatgcactgacatctcctattctattctttcaaaatgctgattgcaatctattgaactgatttcatgaaccactaatgggtgccacacaaattgaaaaacgctcatctaaatggtaaaatctaaatatcttggcctgggagaccaagtctcctagggtctggacgcctatcttctattgtgcccggaatgcatccagacctccattatatcatttactttgcagttctcttaaagattgttctcctgaatctttgattcccttgaccagccttgtccacctggaaactcctgctctaagtcacaaacttgggaaagccattgtctggcttcttacccattctttcatccatttgggtattcatttgtttaagtgggagcacacattcattgctttgcttgtgtatttcccttattagaatgtgagtttcataaggactgagatattattttctctcatatattcagtagtgggacatttataatttcttctgtgtgttccctcttcctagcttattcctgctctattttctgtctgtgttcactttgtgttgaagctcacaaggaaagagactcactattacatccccagagcttagcacaactcccaacatacaggcaatgctgaagaaatggttgctgattggctccatgctaggtatttttcaaggcacagggaatgacaaataagaggcaattctgtctttaggaactcagagccttgcaggaaagcccaacaaggaaatcaacaattggaagacagtgttaaagcgagcatgagttcatctctggggagaagtaggaccgggctgtgatggggataggtgaaatgcagcattttggagagagaggaaagcatgtttcaaagcatgctcatagagagggccaaccttggggtgagtatgtgtggcaagccagaaagccaaaaagctaagtgggtcagacatcaaatgacttgaatgtttggatactgaaatgtcatccttaactcacagggagggtacgctgaaggattctaaatgttagcatgatctgatcagatttgctatcttctaaatgaattgggcccaggggaaaagcatcctaggttagaggaataagcactgtccacagattagatggaccccacagattgaggccccttctggagacagtgcttattccaggggtctccaaacccgggtaacacaggacagctttaaaaatgcaggctcagctgtgcatggtggctcacacctataatcccagcactttggaaggctgaggtgggtggatagtttgagctcaggtgttctagactagcctgggcaacatggtaaaaccccaacactacaaaaaatacaaattagccaagcatggtggtgtgtgcctgtaatcccagctactcaggatgctgaggtgggaggagtgcttgagcccaggaggttgaggctgcagtgaactgtgattgtgccactgcactccagcctggcaagagactcttgtctcaaaaaaaaccacaaaaacaaaaacaaaaaccagaaccaaaaaacccagggtgaggtgcagtggctcacgcctgtaaccccagcactttgggaggaggccaaggcaggcatctctactaaaactacaaaaattagctggtgtggtagtgggtgcctttaatcccagctactcgggaggctgaggcagaagaattgcttgaacctgggaggtggaagttgtggtgagctgagatcgtaccactgcactccagcctgggtgacacagcaagattctgtcttgaaaaaacaaaccaaccaacaaacaaaaaccgaaccaacaaaaaaaggaaataaaaattaaaatgtagtcttaccagtggcttttaacatttttaaattttattttcaagctctatgtgacctagatgaagggcagggaaggctaaatggagcacgaaatgaccagggtcctggaggtgtgagaggtgggcagacccaggcaggtgtgagaggtgggcagacctgggttttttgggcaatgggaggaggtatcactataaaataagacagagtggaaatgccatcctacagcctcacttggagctctctacagtattgttcctcaaagacatcttcctttcttcctttctccactcccctaagtcccccacatctaaaataacaccatatagctcttaaactccgtaataacctaggtatattatgaattaaataggtttctatgggtaagaataaggttaagtgtggagcagaaagggttactaaacagcaagtataatattgttttttctattattctgaggttaagcagtcaatttacaagtgatttggatttcctcacaatttactgaacaaagaagaaaatctaagatataaaaagggttttctacagaaatgaataataaactgaattaagagaattggattccagttctagcttcgtaactaccttgagcaagacactgaattcatgtgaacttgaaggcgcttatccgtaaaatgatgatcttggagcatccaagaagtcctttccgactgtgtcacagattcaaagctcttcgttccctgaagtcctgctactgtgacttggaactctctgtttctatggtgtgcagcactcagcacaagtttgttgaatgaacaaatgatcaaatgacatttgcccttccctgcctgacattccagtcacattcttccataactttgcatttcttccattagataaataaacaaacgcaaaaaatccacaaggcttttaagataattttatgcccttaagggcagttgtttaaaaatctatttaaaacacaaagataaagactgaatgaaagtctcattattagagcgctgtacattgcttaattaaattgaaagtggtaaatgaaaggtaagatgattaacatccaaactggggtcttattaccactctctgatgttactgcttgttcgttgagtcctcttataaaagaaattgcacagtacactcaatttcagttttatacaaaaacagctttcctccaaattatgcttgtgctgtattggtaatggtttctatttctgtattctatttttttttctcacttcatgttttataaatgaagaaaatgttaaggtttaattgttccctgaaaacaggaggacagtcaaagctaacaaaaagatatctatgaagtacctattatgtccaaggattgtgtgaggttctgaaattatggaagataaaagaatgtattgagaataaattggaaatgttcaaagatcctatggaaattgctggaattaaaaaaggctcagttttcaaccatagaatcagaagcacaagaaaaaaaaaaccaaagaggaaaagaaaactggctgtgacctccgtacaattgagacagaggaaaatgactgttaacatgaatctgtgtaaatggagaaggaaaaaggatgcatttcaggacagctacatttaaataatcaaaataatttaaaaagtgtaggcaaggtagtgagacttcctttctacagaaaaaattaactggatgtggtggcatgcacctggagtcctagctactaaggaggttgaagcaggaagatcacttaaactcagaagttcaaggttactggctgggagcagtggctcatgcatgtagtctcagcactttgggaagcctacatgggtggatcacttgaggtcaggagttcaagactagcctggccaacatggtgaaaccccgtctttattaaaaatacaaaaattagctggacgtggtggtgcgtgcctgtagttccagctactcaggaggctgaggcaaagaatcacttgaacccgggaggtagagattgcagtgagctgagatggtgccactgcactccaacgtgggcaatagagtgagatcctgtctcaaaataaataaataaataaataaataaataaaataaaggcaagagtaaaaatcaaagaaacattcttgcaacattatccttggtgataccacaccctacagatatgctgtattcttttaatagatatcaatgaactgacttgttaaagaaagaaagtggaaatgtagtatataacccaaaatgcattacattaatatggccctcattaatcccctcccccccaaaaatagcaagtcattctgctatatgggagaatttcatacatgaaattttacaaggataggtgatttataggaacttctgattattatgctttttgccattcttttattataaaaccagcactcaaaaagaatcaggtattggttctacatacgaatttgaaatgagcaggtgtgcagtaagcactatattacagtctggttaagtaaaatataaacacttagctttgcttagaaagcctactgttgggaaaagctgggtgtggtggcttatgcctgcaatctaatcccaatactttgggaggttgaggtggagggatttcttgaggccaagaggtcgagaccagccggggcaacatagtgagatctcatctctacaataagataaaaaaatatagctgagaatagtgatgcacacctgtagtcccagacactcagaaggctgaggtggaagggttgcttgagcccaggaggttgaggctgcagtgagccacgatcatgccattgcactccagcctgggcaacaggcagaatgagacactgtctcaaaaaaaaaaaaaaaaaaaaagttgtttcttcctggcccattccatcttcaaagtgccttttctctgtataaggacatatcttccacatagggtatagttcctagtaccatttgattacctatcttactcacggctgtcttgaaggcaaacagaaattcctaagtatttgttgaataaatagatgagtaaaggagtgaatagatgctttgtggtggtaatttagcttatttttaaaatatatatattttttaatttttttgtagagacaaggtctcactatattgcccaggctagtctcaaactaccgggctcaagcgattctcccaccttggcttcccaatgtactgagattacaggcatgagccacctcgcctggccaatttagcttcttcatttgtgttcctccctagattgtaaattctttatggattctttatggataaatatttcactggacatctttatgttgcttgtaatgccaagcacagtatcttgcatgcatgacactgttcaacacatatttgttgtattaattgaaagtgtgtgcctgtcaccctgcgaggtctgaatgaaatagcagatccaggccaggtgcagtggctcacacctgtaatcccagcactttgggaggccaaggcaggcggatcactttaggtcaggagttcaaggccagcctggccaacatggtgaaaccccatctctactaaaaatacaaaaaaattagctgggcgtggtggtgtgcaccagtaaccccagctacttgagggctgaggcaggagaatcacttaaacccgaaaggcagaggttgcagtgagccaagatcgcaccattgcactccagcctgggtgacgagcgaaactccatctccaaaaaaaccagaaacaaaataccagatccaatctttggaaatttcacaccctcatctgctcaagcttcctggaatctggattataaccatgttttaaagtccccattccaactttcttatccacctacccgttcatagcttagtttttggtcattttagtgtttatcttagtattttagtactgttagaagatctgatttcaagtgttgtttctaccacctattagatgtgtggtcttgagcaactaatttaatctctaaatctattttctcatccattaagagtactgagtatatctatgtaacaagtggtaaggatgagtaggtggtagtaaaagagaggcatctgaatcctctgcaagcatttaaaagaaaaatacatatatgagttacttaatgttgtaattattcacagttagctttccaaagataaaactggctaccaatttgttctttttttttttttttagagacagattctcagtcggtctcccaggcaggagtgcagtggcgtaatcacagctcactgcagccttgaatcccatggctcaaatgaccctcccatcttagcctattgagtagctgggactacaggtgcaccaccacacccagctaacttttaaattttttgtagagatgggggtctcactatgttgcccagggtggtttcaaattcgtggtcttaaatgatcctcccgtctcggcctccgggatcaggcacaagccaccaagcctggtccaattctgatatgctataaccagaactggactaggagagttgctcacgtgcctaataaggtttaactatatacttatatacttaactatatacttatgtttgtttgcatttgagccatgataggcccactcaattttctccttgtgggatgagagagactggtttaaaagcagttcaagtggaaaattcctggagttttaaattccctctaagccttataggaaatgtataatccattctctggactacttgggtaggttatatcagtagaagcattgaggccagaaaaacagaggtgataccctgacctctgtcgtgttgagtcagatctggagtactggctctagacttgttctgattttatttaattttatttatttatttattttgagacagggtctcactctgtcactcaagctggagtgcagtggcatgtgttcttctgattgtaataggggtattgacaaactaggaacgctctaagagcagatagaacagtgaaggagattgaaatggttaatttgtgtgtcagctttacaatcagttaacttctaaaagagtttatcagtgagcatgctggctcatgcctgtagtcccagcacttgggaggccaaggagggcggatcacttgaggtcaggagttcgagaccagcctggccaacatggtgaaaccccctctctgctaaaaatacaaaaaattagctgggcatggtggcgcacacctgtaattccagctactcgggagtctgaggcaggagaatcacttgaacctgggaggcggaggttgcagtgagctgagatcacaccaccgcactccagcctgggcaacagagtgagactccatctcaaaaaaaaaaataaaataaaagagtttatctttggtaatttgggtggtccttatctaatcaattgaaaagcattaagagtaaagctgaggttttcctgaggaataataaattatgcctcaagactgcagcctaagacttctggcctgccccacagatttcagacttgccatctccacagctgcatgagccaattcattgaaataaatctcttcatatatatcatctaatgattctatttctctggagaaccctaactgatacagagatcacactagaaagatagagataaaaactcagaaaggccaggacaacagtttttgaatatttgaatagctgctatgtgaaagatgagccaatggatggcggtaatgggaagacatatttgggcttcccatgtaccaaaacttaaatgtgtcttttgtttaaagaaggcagctgagccggtccaagtgcaatggtgtttacaactgattgatcacaaccaattacagatttctttgttccttctccactcccgctgcttcacctaactagccttaaacatacatatatacaggctgggtgcggtggctcacacctgtaatcctagcactttgggaggctgaggcgggtagatcacttgaggtcaggagttcaagatcagcctggccaacatggtgaaaccccgtctctactaaaaatacaaaaattagctgggcgtggtggcacgtgcctgtaatcccagttactcaggaggctgaggtgagagaattgcttgaacccagagggtggaggttgcagtgagcgaagatcacgccactggactgcagcctcagtggcagagtgaaactctgccttaaaaaaaaaacaaacataaatacatatacatatgaagaaggcagctgccctacagaggacacatcaaagaagtctggccgggcacagtgactcacgcctgtaatcccagcacattgggaggccaaggtgggaggatcatttgagcctgggagtttgagatcagcttgggcaatacagtgagaccttgtctctacaaaaaataaaaattagccaggcatggtggcaaacacctgcagtcccaggtactcaggaggccgaggtgggaggatctcttgagcccagaaggtcaaggctgcagtgaagttgaggctgcaatgagccatgatcgcagcactgcactccagcctgggcaacagaacaagacgctgtcccctgccaccaccaaaaaaaaaaaaaaaaaaaaaaaaaaaaaaaaagcctgaccaatctttcactcttttaagtgccaaaataatgcattttgggtttcaggcattaaatgagtcccttccttatagctctttatctctttacaattttatttccagtttggtgttcatctggggtattatgctattttatcagtgccaatccattcctttatatgttcaaatattctttttgtttatttgtttgttttcgagatggagtctcactctgtcacccaggctgcagtgcagtggctcaatctcagctcactgcaacctctgcctcccaggttcaagcaattctcctgtctcagcctcccaggtagctgggactacaggtgcacaccaccacgcctggcaatttttgtatttttagtagagacagggtttcaccatgttgaacagggtggtctcgaacaccagacctcaagccatctgcccacctccttggcctctcaaagtgctgggattaaaggcctgagccactgcagccggcccatcacatcagtcttatgcctttacatactcagagcttagctcacacttagaagtgagaacatatgatatttggctttttctttctttctttctttcttttttttttttgagatagagtctcactctatcgcccaggctggagtacaatggaatgatctcagttcactgccaccccacctcctaggttcaagcgattctcctgcctcaacctcctaagtagctgggactacaggtgcacaccactacacctagttaatttttgtatttttagttgagacagggtttcaccaacaggccagtttggtctctaactcctgacctcaggtgatctgcctgccttggcctcccaaagttctgagattacaggcatgagccaccacacccagccaatatttggttttccattcccgagttatttcacttagaataatggcctccagctacacccaagttgtggcaaaagacattattttgttctttgttatggctgagtagtattccttggtgtgtatatatcacattttttttatccactcattggctgatgggcagttaggatggttctgtatctttacaattgcgaattgtgctgctataaatatgcatgttcatgtgtctttttcgtgtaatgacttcttttcttttgggtagagacccagtagtgggattgctgaatcaaatggtagttctacttatagttctttaaggaatttctctactgttttccatagtggttgcactagtttacattcccaccagcagtgtaaaagtgctcccttttggctgggctcggtggctcacgcctgtaatcccagcactttgggaggccgaggtgggcagattgcctgaggtcggcagattgcctgaggtcaggagttcgagaccagcctggctaacatgttgaaaccccatctttactaaaaatacaaaaaattagccaagcatggtggtgcatgcctgtagtcccagctactcaggaggctgaggaaggaaaatcacttgaaccagggaggcagaggttgcagcgagctgagatcctgccactgcactccagcctgggcgacagagtgagactctgcctcaaaaaaaaaaaaaaaaaaaggtggtcccttttcaccacatccgcaccagcatcaatttttttttttttttactttttcataatggccattcttgcaggagtaaagtggtatctaattgtggttttaatttgcatttccctgataattagtgatgctgagcatttttttcatatgtttgctggctgtttgtatatctccttttgagaattgtctattcatgtcctttgttgactttttgatggggtttttttttctttcagttttcgtttccttgtaacacatctattctgtaaggataaagatgtctgtaaaataagagaccattaacttgtgctaaaggtcagtattttttttaagggataaaaagataaaatttgctgggaaacaaatgttaggaacaactgactggtattggctgagaggacggagttgctgaagagtttgccttccaaggtggactgtcccacttcaccagtaattttcttgtgaaaagtgttgactaaaaccaaaccaaacaaaaataagtttttaaagaattaaagtgagttttctttagaagtcttattgcaggctgtagactgatgactacagtctggaagtagtttgtagagaggtttcgttagtaacctgttttggctaatattttaatctatttatatacaggtggtggaggtttagtatgtataaaattgtattagatttgtttagaagttatattaaagtagaattatattaaggtttgaacgtaagagtatatttgggctgcgcctcgtggctcatgcctgtaatcccaacactttaggaggcctgtctctacaaaaaataaaataattagctgggcatggtggtgcacacctgtagtcccaactgcttgggaggctgaggtaggaggacctcctgagcctgggagattaaggctgcagtaagccgtgattgccactgcactccagcgtgggtgacagagcacagagcaagaccttgtctaaaaacaaaatacaatatttttttttttttttttttttgagacggagtctcgctgagtgcagtggcgcgatctcggctcactgcaagctccgcctcccgggttcaagccattctcctgcctcagcctccagattagctgggactacaggctgggacacgatgcccggctaatttttttgtattttttagtagagacggggcttccccgtgttagccaggatggtctcaatctcctgaccttgtgatccgcccgcctcagcctcccaaagtgctgagattacaggcgtgagccactgtgcctggcctaaaaacacaaatttttaaaaaagagtatatttagttatctggttataggttatagaagtataattattaattttgttagacattattttgtgtgtagaaaaagacaaggactagggctttttattttttaaggaatatagtgatttaggtaaagagaggttgggggcatttgggagttgtatgtcttattttgttttgtctctacagtattttcttggagaagtctttttttgttttgttttttgagacggagtgtcacagtggtaccatcttggctcactgctacccccaccttctgggttcaagcaattttctagcctcagcctcccaagtagctgggacttcaggcacatgtcaccatgcccagctaatttttgtgtttttggtagagatggggtttcaccatgttggccagactggtctcaaatttgtgacctcaaatgatccacctgcctcgggctcccagatagctgggattacaggcatgagccaccactcccagccttggagaattatatgttatagagtcaggagttttgtaaaattatgttggcaagtagaaatgaataaatataatttttttatgtttgttattttgtcctataaatttttttgttataaattaattgtctggttgtatttataagattaatgattgtttatatagataagaaggctttttttttttttttaaggaagattggtaattttgagttgtaggagtaaggaatgagtattgggcctagtgtgtatatttgtctatttattggaaaatacgttttggattgtatttattttttatttactgtgatttggttttttatatttaatataatattttaataagactactataaggatagtataggttgtgtataatagtatatatttaatagtattaaagtgagttgtagattggaaaatgtgataatgacttaataaagttagaatatcaatttgtacattttaagatgaattgtgtgtttttgtatttacatgtattagagtttttttatggaaagtaattttgtactatgcaagagacataggggaccctgtgctctattttgttttgttgttaaagtatcttttggagagctgtatgttgtcacagagtcaggagctttgtgaagttactttgttggcaagcagaaatgagtaaacatagcttttcatgtttgttattttgtcttacacaaagatgccatctccttacctaacctaagatgtgactctaatagataaaatgataaggaacataaactaagacaagagatctcttgggatgtcttcagatcatgagggctaaacatgactcagaccggaaggttagtgtttaccaagacccttcttacagctggggaaaatgaaggcaaattaagtttagcctaagctaaaacaggagcaacttggttatggtaaaaagagatattgccctatgggaagggctactacaagaattctttccatacttaaacttcagtagcaatctgacaagtttttaagtggagtctgaatgtaaaacattcagagagaacccttggtcagtagcaggatagaggttgcaataaacacagagaactagtggcatttcaaggaacagtgaggagacaggtctggttgaagcagaagctcttttgtgagatcagtagaaaatacgcctggagaaaaagcctgtttaaaactaaacatcttttccaagggtaaaacataaaatccttgaaattaggctttctaatgggcaaagagatgtcttcaaccattttatgatgagaaatacattggttcatcctcagaggtctctgaacaaaaaggggaacacatgtgaaggtagtcatgagggagcctctgtgaatcataaggagaactgattgcaaaaccagaagccagcagaaacaaaacaattcataaaattacagaggcggtattcggaagttctaaatacttttttttccatctcagaaatgcttggtatcctaataatattttctttgtgatacgttttctatactcttagtaattttccctggtcttgatctcatcattaaagaggatgaaaccaacaccaggaaatgtccataagcaggaaaccacatttttattccatcactcataaagcatcattcataataatcagtgtcagtttagctatagcaacagatgctaacatacacatagtaagagcctacaaaggctcttttaaatgtcagtttaatttaaaccttaacctcagattttttccacagatacagtgagaaaccacaaagatcctcctgtcctaatgctccctccatactctgcaataaaagttcttgttttggaaatagagaaacctgtctgaatcagcagtcttggcttgctgtgtcctccatgaccacaccacatgttccatacctttagccttcataggggctggaaaaaactctgtctcccttgtctacccattttcactgtggagttcggctgcacatttcaggtggaaaggaggtagtgtactaaaattgcaaagtatttcttttaattggcaatgaatttaaacaatattcattgattcttccactatgaacaagctagtgttccctgggggataaacagatgaataattggataagcctttactactcaggaagtgtatagtctagaggagtgcagtccaataggaatagaatataaaccacagacacaatgtaaatgttctaatggacacattaagtgaagtaaaaagaaacatgaaattaatttcaaacatatactttatttaactcaatgtacccccaacattatcattctaaattgtacttaatataaaattattaatgaaatattttatattctctttttttttccatactgtgtttaaaatctggtatgtattttacatctaaagtacatctcgattcagactagccacaattcaggtgctcaatagtcacatgtagctggtggctaccacatcagaccctataggtctcatatgtagcagagaaaaagacatacagaggctgaggcgagcggatcacttgagcacaggagttcaagaccagcctgggcgacacagtgagacctctgtctctacaaaaaataaaaaagtagctatgtggcctggtgcagtggttcatgcttgtaatcccagcactttgggaggctgaggcgggtggatcacatgagatcaagagttcaagaccagccttaccaacatggtgaaaccccatctctactaaaaaaatacaaaaattagctgggcgtggtggcaggcacttgtaatcccactactcaggaggctgaggcaggaggattgtttgaacccgtgagggggaggttacagtgagccgagaccacgccattgcactccagcctgggcaacaagagcaaagctccttctcaaaaaaaaaaaaaaaaaaaaaaaattagctatgcatgttggcatacatctgtagtcctagctactcaggaggctgaggtgggaggattgtttgagcgcaggagttcgaggctgcactgagctatgatcttgccactacactccagcctgagtgacacagcaagaccctgcctctaaaaaaaaaagaaaagaaaagaaaagaaaagaaaaagacttgttggagcctactcccactctgtggagtgtacttttgtttcaataaatctgtgattttctgtcaaaaaaaaaaaacaaagacaaatgacagcaatacaagctccatttggtttgggatgaggaggacattttccatggaagagatggcacttgaaattaatgttccaaataatggttgtgagttgagcaagcagagacagaaaaaatgaagagtgtagttcacagtgaaggacccgtagaagcaataacttaggggaggaaaatggcagggcgctgcagctctgttcaatacatggagcttctcattgtgcctcagataatgacagaacttcttaaggaggcctgcgaagtcctagctagtttattttctactttgctgttcaaacatattccctattttcaggctctctgcttgagccacagaagtctctgggccacctcctataaactactcatgtcttcccacccagggctttacatgtgcagggccctgcctggaacttatctggtttggcccatcattgtttctagcacctagcagagggctcagcacatattcagtcctcaaaaaatatattgaagtgaatggatgagtgatttgagaggcaggtagggaagaagatgatgagaaggcaggaaaggttgcttgagggcttgttgctgagggccttgggtgccacattaagggtttgcaatgaattcagtgagcaaaccaggtccatgcctctaatctacatcttaataggacttgcatattagatactgagctgcagctcagccacgtgtgggatgatttggagtgaaaggtaggcagtgaagcgccctgttaggagccctctgaaggagtccagaggagaatcaatcaggcctccttactgtagcagagcggtggatgtaggcattagttacacacttaaaataaaaattacaggaggctgttgaactaagctcctgcactaggccccaacagaccggactaaaaatcaaaatggagtcacctatgctacagttccacatcagcaaacccaaactaagttgttatctgaccttacgagaaatccaaagagagataacagccaatatcccacacagcccagtttcagtcttcagttggcatgataataaagccttctttgctttgatccttatgcaagaaaagtggcctaaagacacctaatgttaatcagttgtttttctattgttctgtctccctgttctgcctcacaaggaaagtagccttaaaatgacgaataactctttgttctttgtttctttcttcaggcctcctctgtctatataaagctaatcccctttgcttagctgattggaacacttattctattttatgggatgaactgttgcctgattctaaaattgcaataaagccaactgaaatctttaaactacatttgtggccaggcacgatgggtcacgcctgtaatccaacaactttgggaggccaagacaggcagatcacttgaggtcaggagttcgagaccagcctgaccaacatggtgaaactccgtctctactaaaaatacacatacaaaaaatagccaggcatggtggcacgtgcttttaatcccagctattcaggaggctgagggacaagccttgaacccaggaggcggaggttacagtgaactgagatcacaccgttgcactccaacctgggtgacagagcaagactctctctcaaaaaaaaaaaaaacactagattttttgaaattttgttttttgacacatattatggcaagacaacaaatcattttgtagaaattgtacactcttagaggtgaagcaaacttttgccattttatagacaaagaaagtgagactcgttttacagatgaggaaagtgacacccagagaagttcctttagtgaaacctcaaagacttcattactctgcacaaatggaatttgttttgaaatgaagcccagggggccgggcgcggtggctcatgcctgtaatcccaaaactctgggaggccgaggcgggtggatcacctgaagtcaggagttcaagaccagcctggccaacatggtgaaaccccgtctctgctaaaaatacaaaaactagctgggggtggtggctggcgcctgtaatcccagctactcgggaggctgacgcaggagaatagcttgaacccaggaggcagaggctgcagtgagccgagattgcgccactgcactccagcctgggtgacaaagtgagactgtctcaaaaaaaaagaaaatgaagcccaggaataggttatatgttctaggagaaggaattattttacaaacattagattaagtagatacagaaaagtgagagaaaaagatgaaaaggatccaaaatgcatttgaataggaaagaaatggctgtaaaaagcttttggcagtagacatgactgaccttaaaacacttaagctagtcacttactctatcaagaattctgacttgaacagtcacttaaatatttccgtcttttaaagaaggttggaagtactactgatacatcttcccaatgatcaaaatgtcagagttctcacttgacagaataaaaaaagacaaaagagggaaattaaatgacagcaccatgggcacggaaggtgattccctaaatcgtatatcatcttcataattggataactctcttgtttccagactgtgctttcagataaactccctgttttcatctgtgtgccataaaagacacgaagagggagagaatatttttaagttctgaagaattaagctcctgcaatctgtactttaggatctagataatgtaaaatggctcataatttgccagtttctaataagctgtacaaatctcactattacattgaaaacaatttgtatatttcaaaaaatgtcttaaatagttacaacttaccaagataacattgcaaaggagtattagccttaatatttcaagaggctttgctggtcaatgtccccaaatggtaaaaacttaaggttagaggcaaatgagagagttagatcagtgtttatttatttgccaaactactattaaaaagaaaaacaagcaaaaacacctaggctgtatgattgacattcatacagccttgattagatagaagtttcactttacaaacaggttttgacattgtgtagataaaactttgatatcaaacctttaaacctcaagatttgataatatttactttaataagaacttctatcttctacttaaatgtcaaaaagaacagaaatcagaccacttactaaaaggaagcagacttggaatccacattggttatctttcgtgagttaggaaaaagttaatagtataaggccaaactcaaggaagcctgaatattaagatgatttatggagacactgaagacataaatcagatataattatctgatttacaaaaactagtcatttcacctcctcaaatggcctcataattccttgatgacgcatggcagaaaagtgctcatgtcaaactaaaatgcagacaaatggaaagataaatggccacatcccagtaacaatttgacatcccattattcctcttgaggatttcacctgtgtacatccagaaggtgctaggtgaatgaaaggcattcggtttttaggattttagcaacacacatgagaaaaggttcacttttgcgcccactgacaatcagatgaagattcaggtcatgttgcaagtttttctgaacatgtggctgtgcagatagctcaggtcctgagcaaaaacaacagcaaagaaccctttggcagtgaagcctatcttggcctctgatcccttggtccttcctactcaccttcctgtctttatttttcttcagcacgtttcccatctaatatactgtgctgtattttttttcattgtgatgaaatatacatcacataaaatttaccactttagccatttttaagtgtgcagtttggtcacattagtacaatgacgttgttgagcaaccatcaccgctatccagtctccaaaactgttttcatcttcccaaactgaagctccatacccatgaaatagtaattcctcatcccccttcttccctagtccctggcaaggaccattctactttctgtctataaatgggactactctaagtacctcatgtaaattgaattatacagcatttgtccttttgtgaccaagtattttacttataaatttgtgtttattttatttcatttttgaaatggaggctcactttgttacccaggctggagtgcaatggcattatctcggctcactgcaaccctcgcctccagggttcaagtgattctcctggctcagcctcctgagtagctgggattacagatgtgcaccacccccccaaccagctaatttttgtatttttagtagagacggggtttcaccatgttgaccaggctggtctcgaactcctgatcctccccccttggcctcccaaagtgctgggaatacaggcgtgagctaccacgcccagccagtgaatctttattaatgtgttagataacaaagtctagaggaaagctaataattactgtaaatttctcagtaatgatgagcataaacgatatggtgccttgaacaactgtcatatgacatgaaaatatctatgatttttattagtgacaaaattgcaggtcctggtaaaacgattgtggtttttggctacatttataattggagagactagatttcagctagagatgagtgaaaatgaatatgtaattttttttttcatccaagttctgaatttcctccattgacattctcctgccccccaagggatgtctggatgctgggttaagagcccttggctgggtagctggatagtgcagttggggaagagtaagctattctgcatggttggagaatggagtccaatggatgaggaaggagaagcaggagaaagaagaagagacgagggggcagagagctgagccagggccccatctcagctatataaatataagggtaaggaattagggctctgttttgagagtcacaataaaccactgacatattttaagcacagggatatcaaggtcccacttgtattttagaaagcccttctaggaccaggtgtggtggctcaaacctgtaatcccagcactttgggacgccaaggcaggtggataacctgaggtcaggagttcgagacaagcctggccatcatggcgaaaccttgtctctactaaaaatacaaaaattagctgggcatggtggtgcgtgcctgtaatcccagctactgggggactgaggcaggaggatcgcttgaacctgggacccggaggttgcagtgagctgagatcgtgccactgcactctagcctagacaacagagtgagactccatctcagaaaaaaaaaaaaaaagccctatagatggcaacctggaggattctatggggaatagttgcaggaggccaggagcaggacagtagcaagaggccattaaaaagatggtagcagttctccaggtaaggttcaaggtggcctgagcttgggaaatggcaatgcagacagtcagtaaggacatgggagtgggaacccatggcaatttagaaggtagaattaaaagtggattctcttttactcctaggatgaagaatctgaatgtaagcatgagaacaaagaagttcacttcaattttctcaagttcctgctgtaacagatggtcagcatagaatgctcagcgaaaaaccacagtagttgccagagaagtcatgtgatgtaatgggaagagaatctcaaatgtcatcagtcgacgtgagtcttcttatctgtgtgaccatggggaagttacttatgcttcctcatgaccagtatcctcactggcaaagcaaggctaaggacaccagcattcctgagttgtgagtcacaagggagagatgatcattggacattttgtaaatttttcattttgtttatcatattattgtttttataggcgagatattgctgtgttggccgggctggagtgcagtggggcaattttagctcactgcagcatccaacttctggttcaagcaatcctctcacttcagccttccaagtagttaggactacaggcatatgctgctgtgctcagctaactttttcattttttgtagagacaggatctcactttggaaggcagctatgctcaccactacactgccaacaccaggatctcactttgttgcccaagctggtcttgaactcccggactcaagcaaccctcttgcctcagcctcctaaagtgctgagattacaggcgtgaaccacaccatgcctggcccattttgtcaattaagtgttttggaaatgctacttgttcattataatcaatcagtaaaggataattattgtagaaattagtatttactaagagttgaaaaagcattcagctcttttttttttggcagagctagctgaggttttattttggaccaaaaaaaaaaaaaaaaaaaaaacagttgaattgttttgtagctggaggcatgggcaagggggggtccccaagcagtaaacttccccgcacgtgggctgagggctaggactgagcctcaggtgggtctcctgttccctgtcctaccctgcacaggggcctccctcctgggctctggggcagccgcaagaggggcaggctgggaggggctgccatggctgttcactcgggcaggacatcagaggacttggacaccagcttcccattgcgggtctcgatcttcttcacaaccacagccctggtggagctgatgtggctgaaggagctagagttcaggccgtagctgaggctgggacttgtgaggcccccataggctgagcacagaccacctgcatagccgctggtggtcttcgtatggatactcacattctgtatcccagactccagccggcatttctagccctccagcagcttcctgtaggttgcgatctcaatgtccagggccagcttgacgttcatcagctcctggtacacacgcagctatcgcgccatgtcctgctaggcccgctgcagggcggcctccagctcagacagcttggcgttggcatccttaacagccagctccccatgctgctcggcatctgcgatggcagtctccagggaagccctctggcctttgagaccctcagtctcagcctggagccagctgatgttccggttcatcttggagatctctgtcttgtttttgagacagagtctcactctgtcgcccaggctggagtgcagtggcacgatctcggctcactgcaagctccgcctcccaggttcaagggattctcctgcctcagtctcctgagtagctgcaattacaggcgtgcaccaccaccccaggctaatttttgtatttttagtagagacagggtttcaccctgttggtcaggctggtcttgaacttctgacctcgtgatcagcctgcctcggcctcccaaagtgctgggattacaggcgtgagccactgcgcccggcctagatctcagtctttgtatgctgcaggtcatccccgtgcttcccagccagcatctgcagctcctcatatttgatctggtacatgctctcagcctcactccggctgcggttggtgatctcctcgtactgcgccttgacctcagtgatgatgccgtccatgtccggggagcggctgttgtccatggacagcatcacagacgtatccgagatctgggactgcagctcccgatctcttcatacagctgcctcaggaagttgatctcgtcagtcagcccttccaggtgagactccagctctaccttgttcatgtaagcttcatccacatccttcttgatgaggacagattcattctccatctctgtaagcttattgatctcatcctcaccagcccctgcatgttgccaagctctgcctccagcttcagcttctcctggccccgagtctccagctgccgcctaaggttgttgaagtagctctcgaacatgttgtccatgttgctccaagctgtcttctgctgctgcaggaggctccacttggtctctagcatcttgttctgctgctccaggaaccgtaccttgcctatgaaggaggcaaacttgttgctgagggtcttgatcttccccttcttttgggtgcgcaggcctggatgttgggatccacctccagattaagtgggctcagcaggctctggttgactgtgacggcagtgatgcctcccatgccgctggccccaccatagcctccacccaggctaccctggaagctgctgctgcccactcaggaggagcttgaggagctgatgcaggtactgggcccactcgtgtaggagcggctgctgaaggcccgggggccagagatggacaacttgtaggacttctgggtcaccctgatggacatggtggaggcaggagtggaggcaggcgggctgaaccaggcagagattccagaaggagtgaagaagctgcttcttgatagcattcagctcttatttatttatttatttatttatttatttatttgagatggagtctctctccgtcgcccaggctggagtgcagtggctcaatctcggctcactgcaacctctacctccttggttcatgtgattctcctgcctcagcctcctgagtagctgggattacaggcatgcactaccatgcccagctaatttttgtatttttagtagagcaggggtttcaccatgctggccagaatggtctcaatctcctgacctcgtgatccacctgcctcgacctgccaaagtgctgggattacaggtgtgagccacagcacccagctctcagctcttaatttaattgcatttaaagaaagcaatctgtgcaattcacagtagctggcagccaggataacccagggaaacctcatccttacaaaaaaattacaaaaaaaaaaaaaaaagccaggcatggcagctcatgcctatagttccagctactctggaggctgaggtgcaaggatcgcttgagccagtgaggtcgaggatgcagtgagctgtgattgtgccactgccttctagtctcggcagcagagctagaccttatctcaaacaaaacaaacaaaacaaaaaaaataatagctgagtaagtgtcatagatcacatggaacaaaagctggctctggaaacatatgcagaatttagctaagtgtggagtaagggtgaaattgtgagcaaaacaagcttcctgagagatcagaggtggggagttatgccaagaagtgaagggagtgaggtaaggtatgctgatgtgtgcagaacagggaggactttgaaaactatgcagagtggttggctgacatacagtaaaactcataacaagtatgctcattagcataattattaaactctggcttagtaaaccacttaaaaaaaaagatttccaatgtggaaatactcaatgtttggatatgcctgttcattctagtttaggcatttccttctgacaggtttttagagcctctggtagcttttccaatccctgtgactttttttttttttttgccctgagtttggaggagtcggataatgaaatttaaactaaagcatgttagcatcacctatactcaagaaggtccaaatacctcaattcttcacaaaataaaatgcttttttaattcaaaaaaagaaagtaagtcaaaaagagagagagaaaaaaaacacacagcagataactgagaaaataagagagtttattgccactaaaaaaggaacctggcttctaacatcatatttgccatttctctatgtgactctagggaagtacttttctctctcaatgccttcttccctcaggaaaaccttattactatgagaaagatgttaatttgtctaaagtgctgtaattttttcatggggatgttaaggagggaaaggcagggagaaagaagatggggagagatgagttaagagatgagttaaggtgaaagatggtggtggcaggcggggcgcaatggctcacgcctgtaatcccagcactttgggaggccgagacgggcagatcacgaggtcagaagattaagaccatcctggctaacatggtgaaaccccaactctactaaaaattcaaaaaaattagccaggcgtgtggcgggcgcctgtagtcctagctactcgggaggctgtggcaggagaatggcatgaacccgggaggcggaggttgcagtgagccgagatcgcgccactgcactccagcctgggcaacagcgcaagactctgtctcaaaaaaaaaaaaaaaaagaaagaaagatggtggtggcttgcaccaagggataggccctggagataaagagaaaggagttaaaaataaatgtttggtttttttttttttttttggagatggagtctcgctctgttgcccaggctggagtgcaatggcatgatctcggctcactacaacctccacctcctgggttcaagcaattctcctgcctcagcctcccgagtagctgggattacaggcatgcgccaccacacccggctaatttttgtatttttagtagagaggggggtttcaccatcttggctaggctggtcttgaactcctgacctcgggtgatctacccgcctcggcctcccaaagtggtaggattacaggcgtgagccaccgcgcctggccaagaaatgtattttggaagtaaacacagtagaatatgctgatgaattgcactgacgttgggagaaaagaaagagaaataatttctagatttctcactctcacaaatgagttatgtagtagtatcatttactgaaatagagaaaaataggaagaaaaatcaagagttgggttttgaacaggactagctcaagatgtgtgtgagacatttcaatgggaatgtttagtaaacaattgggaacagaggtctggcattcaggcaactaagtttctgaataacagattacatttaaagcacaggaatgaatgaacctgtgtgtggaggaggagggagagtggatgggaaagtgagaaagatggagaactacagtaagagggaaagggcaaaaagatgttcagaggctggtgagccaaggactgagtttgagccatccccacattattggtaagacagagcaggaaggcctgaaaggaaactaagaaatcacccacaagtaggaggagaggctggagtgctgggccacagaagccacaactgagtattccaaggaggagcggtccacaggaaggaccaccttttcttctcttctcttttctcttttcttctcttctcttctcttctcttctcttctcttctcttctcttctcttctcttcccttctcttctcttttctttttgagacagggtcttactctgttgtccaggctggagtgtagtggtgtgatcatggctcactgcaacctcaaccttctgggctcaagcgatcttcccacctcagcctcccgagtaactgggaatacaggcatgtgccaccagcctggctattttttttattattatttcctggagacctgagggtcttgctgtgttgcccaggctggtcttgaactcctgggctcaagcaatcctcccatctttacctcccaaagcactgggattattggcatgagccaccactgctctggtaaactgaaagggaaagttaagatatggatggataagtgtcaagaaggcaaaagaaatacgaaacaaaagagcttgatagtaaagaaaacagaaggatggaatgccctccaagtttttgaggccttaatgagaaatattttagtgaatggggaataataaagagattctaaagatcattcagagtgttgatgagttacatggattatgattttgaatttcaaatggactttaagtctttatgtaagacagattagaaaacaaaatttcacattaaattgattaaattaggtcaaaactcatcaataactaattatacattggacataagtatttccatatctttttgtccctcagtgccttgtgcatatgtaactaaaaaagcagagtaatttggtgtcatttgatttaatgagatcctgcgcaaatgaaatacctttttaacactgaagttagaccattgcagtgctccagggacaactatctatagaagataaattaattatgttcactacttcctaagcctatagaaacaactaaataactaaatgagagaatcaacctgttgatgatgtgcaggtcttttgagaaatgacctttaatcaataaaatcccagagcacagaggtttcatagcagcttgtcttcagaccgactcatcagtaaaatcacaacttacaccacaacaaaacgttcagaaaagtaagctatagaggtaggtcataattttgaggtctgtcttgataatatctaacatattttgagtgcttagtgcgtaccaggcattggggctaaatactttacatgcgttaggtcatttaatcctcataacagttctttgaggtattattgttattattattattattttattattttgagacagagtctcactctgtcgcccaggctggagtgtagtggggtgatcttggctcactgcaacctccacctcccgggttcaagcaattctcctgcctcagcctccccactagctgagactacaggtgtgcgctatcatgcctggctaatttttatgtttttagtcgagaaagggtttcaccatgttgaccaggctgatctcgaaattctaacctcaagtgatccacccacttcagcctcccaaagtgtcaggattacaggcatgagccaccgtgcccagcctgaggtattattattaaatccattttacagataagccttagaaagttaaggcttagaggccaggcacagtggctcacgcctataatcccagcactttgggaggctgaggtgggcggatcacgaggtcaggagatcgagtccatcctggctaacacggtgacacccatctctactaaaaataccgaaaattagcggggcgtggtggcaggcgcctgtaatcccagctactcaggaggctgaggcaggagaatggcgtgaacctgggaggcggagcttgcagtgagccaagatggcgccactgcactccagcctgggtgacagagcaagactctgtctcaaaaagaaaaaagaaaaaaaaagatagttaaggcttagaatattaaatgccttgcccgatgttaccatgctcggaaacaatttagttaagaggccaacactgtttgtctgatctcgtattaggagtccttaatgttcttctcctgtaaatgttcagatttaaaaaaaagatcatagataaattcagtacagttggatacagtttgaaaaattattttatattttagtgaaatagaaagttttagccaggtgtagtagtgctgggtgcctgttgtcctagctactcgagaggctgaggtgggaccatgacttgagccaaggaggttgaggctgcagtgagctatgatccagccactggactccagcctgagcgacacagcacgattctgtctccaagaaaaaaaaaaagaaaagaaaagaaaagaaagaaactttgacacagtttctctttgccactcttcatattgagaggtgaagtttattttccttccccttgaatctgggctggcccaatgacgttttgttttgttttgtttttgattaataaaatgcagcagaagtcacactatatgacacccaggactcggccttatgagatcgtcagcttccacaggctctcttgaagcactccctgttagaagccggcagccatctaagtctatcttaagaacatgttactgtgaggatgcccaagctatgtggagagagaaagaggccaatagagatgcactgacaccaaacaagaagctttctcggactttctggctcagctcaaccaccagctgaatgcagccaaggaaagactcagccaacgtcacagggagcagaaccctccaaatgagtgacactgaattcctaatccacagaatcatgagtaaataaatgacagtagcttttgctcatcaaattctgggtagtttgctttgcaataatagtaacataaatttagtagagttggacacaatttgaaagaaatacaggctgggtgcggatgctcacgcctgcaatcccagcactttgggaggctgaggtgggaggatcactcgaggtcaggagtttgagaccagcaaggccaacaaggtgaaaccacgtctctactaaagatataaaagttagccgggtgtggtggcagactgaggcaggagaattgcttgaatctgggaggcggaggttgcagtgagtggagattgcaccactgcattccagcctgggcaatagggaggatcacttgagtcttgaagttcaaggttaaagtgagcaatcatcgcaccactactctccagtctgggggacagagcaagatcctgtctcagagagagagagagagaaagagaaagaaaaggaaagaacaaagagaaaaaaaaacaaggcagtttacaatgaaaaacacataagaggagagtgaaaataaaaacacaagattaaaaccaagttcagtgactaagaagttatttctaaagatttgtccaatttgttcactgaaatttatatttaaatttacctttgagtttcctggcaactgaggcaaacctaagagattatatcatgctaaatgtgatttccttcagaaaagaaaaatctttaacctactactaaattattaagagcactttactacatggatccctttacagggaacagtgaatgatagagaagacaatgacttcagaagagatgatatttaaccaggcacggttgctcacacctgcaatcccaaaacactttgggaggccaagacgggtggctcacctgaggtcaggagtttgagaccagcctggtcaacatggtgaaacccccatctccactaaaaatacaaaaattagctgggcatggtggctggtgcttgtaggcccacctactctggaggctgaggcacaagaatcacttgaaccccagaggcggaggttgcagtgaaccaaaatcgcgcccactgcactccagccagcctgggcaacagagtgatacttcatctcaaaaaaaaaaaaaaaaaaaaaaagggaaagaaaacccggtttctactaaaaatacaaaaattagcccagcgtggtggtgtgtgtttatagtcccagctacttgggtggctgaggcaaaagaatcacttgaacccaggaagcagagattgcagtgagccatgatcgcaccactgcacccaagtctgggtgacagagcgagaccctgtctcaaaaaaaaaaaaaaaatgttatttacaatacagatgtgtctcagatgatggaatttaaaaaaatttattcaatgtattttgctgttttttcagagatggggttttgttctgttgcccaggctagagtacagtggtgtgactatggctcactgcagcctccacctcctggactcaagtgatcctcccacctcagcctcccaaagtgctggaattacagggatgagccatcatgtctagcacatgatggaactttaacataaaccaaacagaataaaatgcaaagaactttcaatttctatatgagttttcagattaactcccctctttctcctccatagaccttaggcatttcaccatcttttggctttctgtttcaacatatacttattgataaccccccaggggccaggtcctgagggtttaattgtatgtaaaagagaaggaaggtccttgtcctcatagagctcatagtccaggaggacattaattaatgctgaaggcattcattaaaaagctttaccaatatgcaattgcaaactgacaggtgccataaaaaatagcacaaggccgggcgcggtggctcaaagtgcctgtaatctcagcactttgggaggccgaggtgggtggatcacctgaggtcaagagttcgagacctgcctggccaacatggtgaaaccccatctctactaaaaatacaaaaattagctgggcatgatggtgcatgcctgtaatgccagctactcaggaggctgaggcagaagaattgcttgaacccgggaggcggaggttgcagtgagccaagatcgcaacactgcactccagcctgagcaacagagtgagactccgtttcaaaaaaaaagaaaaaacacacaaggagctataatgagcatgttatggagggacacaatccaagtttctggggaagggagttggggagtgaaggaagcttgtgatttcttttttcctttagagacagggtctcactctatctcccaggctggagtacagtggtggcatcatggcttactgcaacctccaccttctgggttcaagtgatcctggcacctcagcctcctgagtagctgggactacaggcactcaccaccacacctggctaattttttaatttttttgtagagatggggttttgccatgttccccagctggtctcgaatccgctcgcctcagcctcccaaagtgctgggattacagatgttagccactgagctcgacctggaagcttatgatttcttattttctctttcccaccttaaaacctgacacatcaaagtgctcaattcatgttggctgttgatgatgagaatacaaagaaataaaagggggggggggcggaatttcaacactaattctgaaataaattctgaatctgttatttcaaaggatattaactttagaaatgaagacacattagaaatttgcattgctctgagttttgtaaaagaatgaaatgtataatgcaagacataactgccaaggtactagatgaaaaaaaaattatacattctgaaattccatctgatagagatcagttctgaagggttaatctcaattgcctgatttaatgtgtttgctttgcaccagatgaataataattagcaatggcttcaccaacttattagtgacaacgtagagaaggtgtgggcccttttacgtaaaagctgactaatagacaaataaattagatatgactgttttgccaaagctgataactaaggccctgtatacaatgagtgccaagtcctggttgtttctacgtaacatttaatctttgaaggcaagtggttgaaggagaaagcaattatattgacgttcgttgtagaaattcatttacagattgttactacaattgtccctcagtctctgcgggggattgattccaggacccctgcagatcctaaaatccatagatgctcaaccccctgatataaaatggcatcgcatttgcatatagccaatgcataccctccctaacatttaaaatgatctctagattgcttataatagcaaatacaacataaatgctatgtaaatagttgttatactgtattgcttagggaagaatgacaagaagaaaggtatgtacgtgttcagtacagatgaaaccatcctctttttttcccaaatatttgacctgcagttggttgaatccacagatgtggaacccgtgaatacctggaagcagttaaaatcactccaagattttctttaaattcttctcttcatcaatactctctctattccaccaagtaatgatatcataattacacatggtagctcttccccaagacccttgattaaattgtttttattgattcatcaagcatatattattgagcgtctactacacaccaggcacacagacagaactgtgaacaaggcagacaaggtcctgcacccagcacgtgtatattctaggtttcagagaagctatgtgaggctgtgaagaggattcttttttaatgtctttatttttatactacccctccacagccttaccccaatcttttaaaccacaccggaagctatgtactcatcgtttttttcctgtaattttttttacagtacaacctaaataaatactggcccagaaagattcagagttcaaagaaaattcagctgctttcggaaagatcattctatgggaaagatcacatttctgagtaataaacattataaatacatattccgatttatttttaattctcaaactattaactttcatttttcccctctggcatattttaatttttgtcctacagggacttgagtctaaatatgttttaacaatttgggggacttttcttttttcaccttgctatttctagagactaaaatctttgagctaccaaggtctttcaaactggctgatgtcactctaacaaactcagagatagcaagatgttccttaagccactgggttagaacgagaatcctttgttttctatgggcacaatcctaggaatgtttcttctcttttttttgagacagagtctctctctgtcacccagcctggcgtgaagtggtgccctctcagctcactgcaacctccaccccccgggttcaagtgatcctcctgcctcagcctcctgagtagctgggattacaggtgcacgccaccacaccctgctaatttttgtatttttagtagagacaagatttcaccgtgttggccaggctggtctcaaactcctgacctcaggtgatccacccgcctcagccttccaaagtgctaggattacaggcgtttgctaccgtgcccggcaagcctaggaatatttcacttcatgcttttctcttttgccttgctgtgagcttatcctccagagacaacagagagagagaaagagagagagacaggagagagaaagtggaagaaccacatgaccagtcatttcccgaagcaaatggcgttttgggtgaatgccctgacctaggagggaaaaagaggccaaggttaccctaatgttacagaagtagctaagtgaattcttctccgaaaaacgtcacagcaggctctagaaagcaattagagtaatattttggcacctcgaactaccaaatagaagattcctctactgctctagttacatctttgattttcatttccctttgttgtaaatacttacaatgtcatttcagaatgctgcagagaaatagatgtgagagtaaacaaactataataataatcctttctccacatgccatggcagctgcaggaggaggccaacgcagcaccgaacttgccttactgtctgcttttcctgtcctcctcctcctgcacctccttcacctcctccacctccttctcctccactttcccacatggtcttttataaatttgccagcatcactgtgcagtttgccagagaaacctggccacttgctgggtaagcctgctcttagaccaaggaccagggtaggtcactgctgctgtcctcatttctgggccagaaggattcactgagagtgaggtccagaaccacctgctttcccattacagaggatgtggatctctatagagacactgcgtatcccttcagttaaagctcttcgaagactctttttaccctgcgagctgaactttcttgagccccatagaatggataaaaatcttcatccccaggttggtgaggagccaatgatttcacgctcaaacaagctgacaagctaggaatcctagctttccttagcaggcaggaaacagcatcccactcataagtcaggagtcttttctgccaatgttaggaatgttgatatttacctttatttttggacttatttctaaaaaaaattaactagtatgtaaaaaaaaatcacactttaaaaatatgcttctacaatatttgctctagcgaactatctttagcttgacctaaattactaattaaacttttctattgatccaattcccattactgttcctgcctttatgctttcatattcggaaatctccaacatgcattttgatggctccaccccccacgttcctcactcctgccccctcattttggttttgctttaccttgttaagcacttacagatcataaaatatgggtgagctcagaatatctcttactccagtgttacatatggcacccgcatttcagcaccagccctttaaaaaatggtgcagaatttcaaggaactcagctacactttccattcaaaatccctcccaagcactgtagctaagagcctatctcaggattttcttgagagctgctggggaggcaaaatatctatctaacgaaaatggctcatcatccacattctgcagtactgagactaattccccagcactgccaaacctagactgctgaactccctcatccaaactctctaagacttagtggtcaaagtgccaaaggcatccgtcttactcacactctgtggctcctaagaccatgctgaaaagtgaggataagtaataattgaaagacatttttaggattctagttgggaggatacataatgcagatactatatagtttttgtttgtttgtttgttttttgagatgctgtctcactgtgttatccagcctggagtacaatggcgtgatcttggctcactgccacctccgcctcccaggttcaagtgactctcctgcctaggcctcctgagaagctgggattacaggtgcccaccaccactcccagctaatttttgtatttttagtagagacgggatttcaccatgttggccaggctggcctcaaactcctgacctcaggtgatctgcctgccttggcctcccaaaatgctgggattaaaggtgtgagccactgtgcccagcctactatatattactgaagttagtaattcatattaatgcaaaataaaaggagattagtgaatcactgctacgtctgtcttgtttggcctgacaagaaaagtatcatagaagagaaggtgtgttatgggcattggatcagcaaataagctgaggtcaagcttccctaagtacccaccagctctgaaggggaagtgacagcttgtctttgagccagatttaggttacatttcagtcttaatttatatctaatccatatctaaacatagagagaaataaaatgcattagatttctgagccaccaaagcctgtttaaaggaagacggaggaggaaggagaagagggcaatgacttaggggcaagtaatagaaggatttgttcttttattttatgcattcttttattcaacaaatatgttttgacaagtaggggatacagtgaacaaggtaactggttttctgtccttaaagaccttccagccagttgtggtggctcatgcttgtaatcccagcactttgggaggccaaggcttgtggatcacctgaggtcaggagttggaaaccagcctggccaacatggtgaaaccctgtctctactaaaaaaaaaaatacaaaaaaattagctgtgcatggtggtgcacacctgtaatccctgctactcaggaggctgaggcaggagaattgcttgaacctaggagccagaggttgcagtgagatgagatggtgccactgcactccagcctgggtgacagagtgagactgtatgaaaaaacaacaaaacaaaaaaccttcctgccctgtgggagctacagaggaataagcagtactaatgtaacaatgcagtgtcactgggaccatgtgctgtgttgtgggcgcaggctcaagaggaactcaaacagcttagattttagccattccgaagaaagcacagtagcagccactggagtctccgccgtgttccgggaagcatgatcaaacatatcttgaaaaaatctaaagcagacttcagatttgttagaaagcattcctaccgctctcagtagtgacttggagaatctacctcttcatagctaaggctataacaacatcaacaacaacaacaacaaaacacctctttgggttgtcttcacaagtagtttccaattcagtagagccaatcctgcaacagtattggcatcatcgcagtgcactccagtgacgcaaatggaaagactgctgctggtaaacgaactacctgaatttgaattctggctatacctcttcctaggtctacgatttttaacaaatcagttaacctctgaccctcagtttccttggctataaaatgggcataatgaaggattgtgagagttacctgagtaaagtgctttgaacggtgctgctcaataatgttatccctctgagaagacatcgaaagtttcccataagaaaagggcctttgttattccaatttggatactttaagcaggcaaaatagaacagtaaaaggaaaacaaatgtaaagggatgctgtttatgaaatagttgtgaagaataagcacttcagaggagcttaatttaacttctcagctctgctagagtaaacattgtaaccagactaaaaacctttcctttgttcctgcagttattagagaaaggaggaggccagagaagtcatatcatttcacttctctgaacttcaccctggattatttaatgttgacaggcattcgggatgtatagagattaaggacacagactctggagcctggtgctgggatccaaaccctgatcctgtcactaactagctatgtgacttggggcaagttcttcaacttctgtacacctcagtttcttcatctatgaaatcacaataataaaagtacctatctcaggtatttttatatatgataatttttttttttccttgagatggagtctcactctgtcatcccagctggagtgcagtggcgagacctcagctcactacaacctccgcctccctggttcaagcgattctcctgcttcagcctcctgagtagctgggattatgggcgcctgccatcacacctggttcatttttgtatttttagtagagacagggtttcaccacgttggccaggttggtctcgaactcctgactttaagtgatctgcctgcctaaccctcccaaagttctggcattacaggcgtgagccaacgcgcccagcctgtgtatgatgatttaaatgtgtaatgtacttaaagctcttagaaccatgcccagcaatattaatgccatttaagtcatagttattagaaaagctactgttattaaagaataatgcaaggaattgttcaaatgcatataatcataaaatagagagtcaaggctgggcacagtgggtggctcacacctgaaatgtcaacactttgggacgctcccttgagcccagaaactcgagaccagccagggcaacatagtgagaccttgtctctgcaaacaaccaaccaaccaaacaaacaaacaaaaataacaacaacaaaaatacagagtcaaaatggaacggtcttgtcaaagttggtagtcactatgccgttagtttcatgaagataaaacatggttattttgttcctactctatttgttgaaaaatgaatgaatgaggcatgaaagacttgactagtttgatgttgagaacttagcaaaaaggaaagcacacgagatctggaagtgaaaacccaaaacatgagtcctggcttaacctcattctaatttgacaggtgatttaccacaggtactcagtttcctcatctttgaaagagggaagtcagagggagaatttctgaggttcattccacatccaaaattctgcagcgttagatagcctttcgaattttacaaaaggtaatgtaatcatggctatggaagtttttttcacataccttgtgtatttccaaaaaggattatcgagttggagacaatgtcatttgtttgcgttttctaaatcattatgtaagaatctgagccacaaacagaacaaatctttaaatccatgaaaatggattacctttagctggactgacaacttttaaaactcttggattgggagaataaaactgataaggacatttttccattcatcttaaatgaatttttggagactcttaagagtaaaatataatccatatacatctaatgctaatttatcatgaacacttaaagaatgaaagtagaactcttatccagtttagttcagcaattctctgctaaatgaaattaagctgctttagttgagcttttaaaatatgaggatgagaagcataaatccaaaggattttgtagaactagcatccggactgtctttcttcagattatgttcctagaatctgggttccccagggcagcctctcattactgtcagtattaaggactagaaaggagctggaagaggcttggccgcttttataggtttttggtagtggcataaagatttcacttggttgggggaggggggtagggggacagaagagtctgttgtggaaactaaaagaaaagaaggggagagtggtctgaaatcaaaaagtctggattacgtatacaagctttgagttgaacaaggtttaaattttagctctgctactttttagttatgtgaccttgggcgaatggtttaatctctctaagtcacactttgcacatttaataatgtttcttaccttatagggttactgtgaatattaaatgagctaatacatgtaaagcattcctacccagaacatagtcagctctaataaatagtgactgacagacagctacaagggcagataacctatattctccttcagtttcttatgctccctctggaatgtctcagaagcataggaagcactgtttaagcctcctgcaatcaaaaatcattctttttaattagccctaatagaccctatggtttttttttttttttttccaaaatctattcatagtttaatgtgggctatggacaaaggttcactttgtaagactgtctagctaggttaaaaataaaatatgcagaaatgtgtggaacttcaacaatagaatataagaaaatgaattattctgaactgcaaacaaaggcattgtagtatatgaatgtgtatgtgaagtaaaagtttggaaagtataaacatcagtatggtaacagttactacatctgggaaagggagaaagattggagaggaggtgggatataccttattattgttttaatgttttatagatgtatttacatattgtttaactaaaaacaaacaaacaaaaaaagcaaagtcatgtacaagcagaaataaacatttagaatacagaatttgtggaataaaccaaagtagacaaaaatcaaagaatttatccctggggcattcaatgacttgatacaaggtcaccttctacttagttaactgtccttgaggagtaaggagagcgcaggggcaggagagatgtctgatcctgtctccagcaactgatagacccaggttagaagttagatgaagctgcctgccagttatcttggtagaaacttctttctgcatgtactcagataagacatcagtaccctgggtggttctctgcaaaattcaaggtctgcagagtcaccaactgaagtctattggtaaacttgcttttaagcaaaacaaaaccaaatggcaaattagtatttctattagtacattttgataacaaagaaaataaaagacaatttaaaatttatgtaacttaaatctacattgcttaagaacatctgactgaggagttttagaatatccccaataccatgaaataaatacagtaattaaaaggcaatagagtttaaatactggataatgggctatggcatttttaaaattagcaaaacatttgtttattattgaaaattagggctgggcctggtggtggacatctgtaatcccagcaatttgggaggctgaggcaggaggaccacttgagcccaaaaggtcaagaccaccctgggcaatatagcaagaccccgtctctaaaaaaaagaaaaagaaagaaagaaaattaattttcataaagggctcttcccttggaaagaaatattttagctacagagaaaaactaagaagccttgtggagctctgtgaagttgcactgacttgctttcacttagcttgcagctcactagtgagatttcacatggtactcccactccaagagcaggggccaggacaggttggtttcattttggtttgaatgcatatgctttggcccacagacttggagaaagattttgctttactgatgagaactcagtcaagggtgcttgggagccttcgctggccctctagctgggcctgacatgttgcctgcatttctagccttgccttcccagcttgcccatttggtgcagggagatagtccagcccaccctgaaattcactgtgttctgcggatgagttaactgaagggctgtgtttcaggagtggcacagaaaggacctgaatgaaaggaaggaggaatgaatggagagaaccattttggtggaattgccctagggtattaaataggatggggcaactggggactggaggatgttccttctcttacgttgcttaggaaacactgtccttaagagtgtcagtgtcattcctttaacaatcattcatttcttacctcccgcttgtgtataaatttgcagatttacacagaccaccagtgtggccatcccagtgaactgagtttattgtgaaatatacatgcaaaaaaatccttttttctcacctacaaccaatgcaacattattcatactttgagttgaagaataaggagtttaagaaataaatgcatacagcaacataaccctgaattatcactcaaatacagacctcccactgctctctcccaaaaaaaaaaaaaaaaaaaaaaaaaaaaaggcagttattctaagcaaaagcaaaaattgaggcaacttaaaatagacaattttaaatgctggattccatcatttctgtaaaaggtcattctactcctttgctatttataccacagatagagacacagcaaattattggctgaatggatttgggaaaccagaagctgctgcttctgacgaacgaagatgataatgcatcacttgagactgagtggatgaaaggtgtagaaaagttgaacccttcaaagatgagaggaagctgctaaattagcccctgactaaattactagccataattgtactcaagccagttctctttgcgactgccttgtaatctttgttgtggcttgagagagaaaaatccccattcccagctcaaacccgtttaaggcatctcagcccaaccccctcctcccaatgcaactcttcatagccccctgcccctcctccaacaaattctaatcaagtcaggtatagttctcagctttaccactgccatcagaagcacggcttacattaagggtttagcaacaaaacctcaggcttacttcaggcaaacattcaaaagcatttaagagaagcacagaaaacaaaagaaataagcaaaacctgtccttacccgcttcttaaaaaattggaaggctgagcatttcttgactgggaatccattcatgtctttgtttaccattttccaccgtggggaattcacagttatagatccaggttggcacccgcctggttagtgcatatctgtttccccggtttacctcctgcagacagttaatgaagactgagcgggatggagaatctagcggggctcagttcttcactcgcgcattctgcagcaccagctactgcagcaacctctccccactttcagttgccaccgacagcggcttttctccttccatcattgctccgaaacatatgcatcaccgctgcaggaccctgggggccggacggtgggatacggccaatctccggggagatgctgtggctcttaccgagcgggagaagggtacgcctccccgcccccagctacctggctgctcttccgcggccggcgcggggagcgagtcgctcttctccaggtgatgcgctcctggaggcggcttgagagaggagagttgtttttgattgtgcaagttccagtgggagctgtagttaagcagctgagagaaggagtaagaaagagcagaagccagagggagggagggagaacagcgccagaaaggcagagggagcgagaaggcgaggctggaagaagcaacggttcatgaatatct

SEQ ID NO: 702 - DNA, 44476 bp, Homo sapiens
tatacattctctctgagctggcactcaagcaccgtgggaccttggctggcttctggggagcaagagatccatttatgaatacttgatttctgactgctgggtgagctggagtgtggtttataaataccttgctatctttaaggtgggctttgccaaaagaatagggtgacagagatgaatttcagtcatgcaacgaaccctcgacacttggaaggtgacagagggtagatggtgacagacaccactttgtgccgttgaactgtgttggtaccgggcgtggcccaaacacctggaggggccccacaggtgggtcaggcttctgggctctggtcactgctctgtttggtttcaaatcatgtgactttggccttcttaaaaaaaaatctaaagaggctgggcatggtggctcatgcctgtaatccctgtactttgggaggccgaggtgggtggattgcttgagttgaggagtttgagaccagcctgaacaacatggcaagaccccatttctaccaaaaatcaaaaaaatagccaggcatggtggtgcgtgcctgtggtcccagctacttgggaggctgacatgggagaattgcttgagcccgggatgggattggggtggaggttgcaatgagccaagatcatgccactgtactccagcctggatgacagagtgagaccctgtctcaaaaaaaaaaaaaaaaaaacctaaacaactaaggccatggtgaagtaaacctatattcaaaacaagagtcacaaagtagaactaaatgtaaatatataccaagagttgccggtagtcaggagtctcgtgcagttgaccttgggctgctcagagtccctgctcaaggtcactctaattttgtcccaaatttgaacaaaccacttttattatttcaccataaatctcatacttttggccaaaggcttcttcggaacttattgacagcgatgacaaagcccctgaaggttttcttctttacgagggagtaactcttccatcagcacagccttccctgcttgtcagagggaggtctctctttcttgtgcttcctagacttgcctggtcatgccttttcttattttaaggctaatctcaaaagaaaaaatagtgtgagcaccacttgactgcctgaaatttcatgactctattttagagagtcattgcctcatcgccttgccgtaacccatgacaatgctcctcatttgcggtgattaagttgaaatttgcaggtaaaactttagcatgttcctcaaacatcagagctgaccctgggtctggtctcagccacagcagaaaatgtatttaagagctcccttgagcaggcagtgggaggggttgcagcaatgagcttagaagcagctgccacaggctgtctgagcactgtgagctgctgagctggtggcctcagccgaggtcgcgtggctccttcctttcttgcctagaccttggctattttatcaacagaaacggcagggaccagtgagcagagagctcagcaagctcatggcgcaagagtcgtggagctgtgacctccaccagggctgagaacggccccttataccgccagctcttggctgcctggaatctctcgggaacctccacggggccctgcacagcacaggccactgtggatacttctgggatttgtggctgaggagagaaacttaggaaagacaaatgtcacggccctttcacagcagacactggttgggcctgtgctgtggcctggaggcccagctttaaacggtctctcctttctcacatttttttatcttaggggtggggagacttttcacataacagcctttgaggttgtggggtgctatggtttggatgtttgtccccccaaacctcatggtgcaatcagatcccccgtgttggaggtggggcccagcgggaggagtctgggttatgggggcggatccctcatgaatggcttggtgccgttctggaggtggtgagacggttcttcctctgttagtctggtgagagctgcttgttaggaggagcctggcgtccctcccacgcttcctcttctgccctgtggtggctgcacgccggctcccttcacttcctaccaggagtggaagcagcctgaggccctcgctggaagcatatgctagcgccgtgctttctgtaccgcctgcagaaccatgagccaagtaaacccctttttttaatgaattgtccagcctcaggcattccttcacagcgacacaaataggctaagacactgggagaacacagagaataaattttgcgatatttggggagatgatgctgcctttactgttattataaataaagtttcggtgccgccaaagaaacagcccttgaatatcaattttttttttcttctcggcaagaccatttactgctatagaagggtgtgccctcacagatggagcaatggcgcacacctggacaagggaggggacggggttcttattcctgacgcacgtggcccctgctgctgtatcattcccctattggctagggttagaccgcacaggctaaactaattctgattggctgatttaaagagagtgatggggtgagtggtttggtgggaaaaatggttatggcagagcaggaaaacggaatgagtcagggtggggcaggaaatcggaatgagtcagggtggagcaggtgatcggaatgagtcagggtggagcaggtgatcggaatgagtcagggtggagcaggtgatcaaaaaaggttgctttatgaggaagttaagttaaaagtagaaggcaaataattgaacatactgacatactgattctttgaagagaaatttaggacttatatctaacactgtttttttcataataaagtgagaggggctgtggtttcaaacagcataggcctggggtcggactcatctgcattcacaacccgtccccctccctgttcattagctgaatgacattgggtgagagcctccgtcccgtctctgagttccttagcaatgggtataataatgtgtgactccaaggcttggagtacgggagatacgggaacagatatggagctatagagttcatgcttagagacatcagttcccttccttctgctcctggctcatggtacacacatgttttgaaaaccatgccaggcatctgacctcaatgcacgcaagcatttagctgctgggtcattggcagaaaagcctcaagcaggggttcagggaaggctttaattaagcttggcctgtgggggctgctgcctgggctggatctgctgtgaaacaagaggagcttgatgttctaggagaaatgcttggggcccaggaccatctgctggagggaaaagaatgagtattcccagagaaacagaccagtgctggggctgttccctggaattcaggttaagtgtcctgggcttgtgaactgggcacaaaagatgctgcaagtctttgctttgggaagctgtcaagggtcattgcccctctcagcctaaacctcttagcacctctccgacgatgcttttcactttggtggtgactgataactcttcttggttgttgagaagtttggatgaaaagctctaggtgtgtattatagtttcatgttgctgttattacaggtccttagtgtcttacagaatgcagatttctgatctcatggtctgtttggcagacctccaggtaggctcattggatccctctgctctgggtttcatgaggctgaaatcaaaatccaggtgggctgggttccccctcagaggctctgggagcatcctcttctgccttgttggggttgtgggcagaatccagctccttcagctggtgggactgagcaggggctgccctgacctcccaaggcctctctcaagtctctgcccatgagccctgaacttcagagctcagccatgatgtggcttctttcttttgaagcctgattcaaagtcacacttggattctttctgacttccttttctgctccacagttctgtttgcagccagagaaagtcgcctgcttttaaggccttgtgtgatgatgctgggcccacccagatcgtccagaattacccaggcccgtcttagggtctgtggcttcgttatgtctgcaaattctgctttgcatatatggtgagaaatacataggtctcaggattagagagcatgcattctggagcacaccctgctcacccagggtggaagtgtgtactccaaggccccgcaggcagttctttgtaattagcacatcctgctcaccacagggcggaagtgtttacgccaaggccctgcaggcaggtcatttgtaattagcacattcctagtcatgagtggatgctttaggaattagtggctgatgagatatacggactaatttcaaggcgccacctgcagcagaacctatgttacagcatgaagaacccctgatattctttttttatatataatttttattttacaaatgtattgggtatatgtgaaagtgtgttatgtgtatatgatggatggtgatcagcccagggcatttagggtgtccattacctgagtacaatccattcttctagcctgcagtcaccctactctcgaaagagaatagttcttgacacataaaactggtatgaaatccaaatttcagtgtccataaataaagttttgctggaacacaggtgccttcattcacttatgtaacgtctgaagctgctttgtgttgcagtggcgaggggatatagacctgcaaagtgtttattactggggggcctggcaatgctgcgacccccagtgtgatggaagagcactagcttcggagtcagaggaagacatgagttcactttccatggggagtatggaaacatagtgcctgcactgtaaggtggttttagcggcagaaataccattgtacccagcaatcccattactgggtatatacccaaagaaatgtaaatcattctgttacaaagacacatgcatgcacctgttcactgcagtactatccatgatagcaaagacatagaaccaacctaaatgctcatcaatgatagactggataaagaaaacatggtgcgtatataccatggaatactatgcagccataaaagatgagatcatgtcctttgtaggaacatgaatggagctggaagccatcatcctcagcaaactaacatgggaacagaaaaccaaacactgcatgttctcgcttataagtgggagctgaacagggagaacacatagacatgttggggggaacatcacacactggggcctgtcggaagtcgggaggagggagagcatcagtgatgaagaatagctaatgggtgctgggcttaatacctaggtgatgggttgatctgtgcagcaaaccaccatggcacacgtttacctacggaacaaacctgcacatcctgcacatgtacccctgaacttaaaagttggaaaaaaaaaaagactctatgtcagaaacagtatctgcctggtgcacagtaggtcttcaatggtaagtagccaaatagatggttttgcagtgtcattgagggtttcctatgttgatgaatggttactgaaaatttctaagatcactactaaaaattgatattacctctaaggtcattaataagaaaggatattgaaataatggatccttttctataacatgcacaaacatgctttgtaaaaccacacacctgtgctgtctggcagaactttctgtaatgatggaaaatctcttctgttctgttcagtatagtagccatcagccacatgtaacttcctagcatgtaaaatgtggctcatatgactgaagaactggattttgaatgtcattagatttaaatttaaataccatgtatagcaagtggttcccacgtcagtgcaaccatggaacacttagacacccactgccagcaccaaaccatgtgagcctcgtacccagcaccttgtggtgggacatctctcttagttaaaggtctgtcttttttgcctaaagacaaagtagtagaaaaggatatgagtggctgcagagcaaacggtggctgaattttatacccctgccaccactttgccacccctgctgcttctatgaaatggaagcagtttattcaaccagaggccaatgtgcctttgaaacttatctctatggtggctcctctgtaggattttacaagggtctgtttgttttgcgtttatctcaaggtaacacattttaaacacatttgagtagcagggtcttaactacaaatggagcttggccaagagaataataaaaacagtttaaggaaatatttcttggaagctgctgaaaaggtatctttacaactcctgttctctagagaagcttgcaggcatgggggtcagtgagtggacatcgatttgtgggaaggctaaggacaaaggctatggagaatttttcaccccaagttaaattcatttctgccaattaaggcagatgtttcgggccaggtgttgtgactcatgcctgtaatcccagcattttgggaggctcaggtgggagaatcacttgaaaataggagttcaagacctgcccgggcaacatagtgagaccctgtctctacaaaaaaagtaaaaatatggtttggtgtggtggtgcgcacctgtaatcccagctactcagaggctgaggtgggaagatcacttgagcccaagagtttgaggctgcagtgagctatgatcgtgccactgcattccaacctgggcaacaaagaaagactctgtctccaaaaaaaaaaacaaaaccaaaacccccccccaaaccagatgtttccaaatgctcgatttcatttggaaacacaaacttagtcttgaaaactgttatgattttttgaggtaccacaaatggcacctcaaatatatataaatatattcaaaaatatttgtaatgagcttaaggaaagtgggttcacctagtttgaataacaggtttgatgagtcagcctgcctgttgacctcgggtggtgcctgtcgcagcgagacggatcctggaaagggcctgtctgcttggcggcatcagctgtagatggcatcgctacactgactaatgttttctgaagacgagcttttatttatttcccaaagagaaacatttccagagggagcattcttttccctttttttttgtttttgaagtactgagttgaagtgtttttttttaaattttattttaagttctgggatacatgtgcggatgtgcatgtttgctacgtaggtaaacgtgtgccatggtggtttgcggcacagatcaacccatcacctaggtgttaatccccacatgcattagctatttgtcctgatgctcctcctccccccacccccgacaggccggagtatgtgatgttccccttcctgcgtccgtgtgttctcatcgttcagctcccacttatgagtgagaacatgtggtgtttggttttctcttcctgcgttagtttgctgaggataatggcttccagatctacccaggttcctgcaaaggacatgatctcattcctttttatggctgcatagtattccatggtctatatgtaccacattttctttatccagtctatcattgatgggcatttgggttgattccgtgtctttgctattgtgaatagtgctgcaatgaacatatgcgtgcatgtatctttatagtagaactatttatattcctttgggtatatacccagtaatgggattgctgggtcaaattgaagtgttttactaagttgaatgtgagcttcagtggggtggggctacacagagtgaagtgtggaggctgctggtaccttgagaaagggtataaatgcttttctctttcttttgatctctttctctgttgaatttacagcctctggtatatgcatgtaagatggaatgctctgtgtaggttatcggaggcacaccaaaggaaaagatgaaagactgtatgcacaaaaggccagcctgcacctcccgtgccctctgcttcccagggaagccgatcaatacagatggagtgggtcatgccccacgttaccaggacccctggcttctcccaccacaggggggtggctgggagggaacattacattaattacttaggcaaaatgcctgagcgctctgtaccggggcatagtgagcttgctggagctgatggggaaaaagttaagctgtttccagagaaccgctggtgtatccagtgttttgtagtgacttagcgtatcacacagtcggcaagcctctgctgtgtgcccgtgactggcccagcactgcgtgattttgcgtggagcagaggacaatgatgaaggggtgtgtgcagggggagcccgtggacttggtgagacccacaggccacagccaggctgcttagtctgtaacccgcccacgctgcagcctcagcatctacacccttcgacccacagcctccctgtgtggagtgtgcatgtaatcaggagaggcagataataaatatatatgcccagccaggcttgtgctgtggcacagcaaacagggcagcgcgcagtcagcatcacccagccttgatgagcacgccgcgatgctgctacgagctctgtgaagacgcgattttaattccagccagtcggtaggttgtgtgtctgtgtggcggtttagcaccgtttcaaattctgcattgcatggtgggggcgacggtggtgggtgagctctgcgtcgtaatcttttcggagctcttccagcacagtccagtcaaatcctctttgacgacaggcctgttccacacctgtgctgctcagcagggaggccgcaggtgcctagggagcacacaaaatgtggtcagaacaaaggaggaactggattttgagttttatataatttcaagtaactgaaaagtttaaatgtgttaaatacctaggtgtggccactggcttccagattggacaatatgggtcccagcaaaggcaccatcagctcctgtggttccctggatcattggcctccctgcctgcacccatggtctcccctgcctggttgtctgtccttccctataccacccagcctggcatccacccctaaagggaggttcctgagcccgcagagctcactgagcgtgtgtcttcagtcccccgctgcacctcgagggggcctctgtcacggcattccctgggatggtcaccacctcgtctgtcccctccactgcaccacgagccgctgaagagcaagtgcatgctcagccccgggcatggcgtctgtgcatctgggagctctgcacacggtgctgaatgaatgagcacagaaccaggtggagtttgtttaaccaacactcccgtgacactcatcgagctccagcgctcttccaggggctttccgctatcagtcacgtttggatacatcgcggttggccatatggttcactttgcagctgcgggctgtgacaacttacttgatctgtcaaagacgcgttccttttcacttgtagcatgtgaatgataccaaaatcacaggttgttctgacgatcgaaatgagataaactgtatgaacagcgcacgacattcctgtgaactcacagtaaatgttagggggttcactaaggacacactggtgaatggaacaaaacttactgccagtgtggagtgcgcatctaatccggaaaggcagataataaataaatacatttttttgagactgagtttcacttttgttgcccaggctggagtgcaatggcacaatctcggctcaccgcaacctccgccttccgggttcaagtgattctcctgcctcagcctcccgagtagctgggattacaggcatgcgccaccatgcctggctaatctttgtatattcagtagagatggggtttctctatattggttaggctggtcttgaactcccgacctcaggtgatctgcccgcctcggcctcccaaagtgctgggattacaggtgtgagccaccgcatcaggacgataataaatattacagagaagcagtgacatgtatgctcatattatttgggaacaaagatgggcccggataaggggtgttgggatgcctgggggccgtgggggctgacctgtaaataggagatcagggcagtgttgctgaggaggtgattgtcaggcaaaagcttggagggaggcaaggagcaaacacacagctgtgtggggaagagcattcctggcaaagggaaccacctttgccaagttgcagaggcaggacagaagggaaagggccctaagtgagggaggtgcttgtggccaaggtgaggagagcagctttcattctgagtgaacagggaatgacttttgtttctgaaagcttgctctggggctgggctaaggacggcttgtagacaggcagggacacatgtgttggggatatttcattacccaggagggagacggtgctggtgtctctcctctccctctctgcctctgtgagtgtgtaatatgcataatgtgtatgactttttttttttttttttttttttttttgagatggagtcttgctctgtcacccagactggagtgcagtggtgcaatctcggctcaccgcaaactccgcctcctgggttcaagtgattctcctgcctcagcgtcccaagtagctgggattacagacacctgccaccacgcctggctgatttttttatttttagtagagacggggtttctctatattagccagggtggtctcgaactcctgacctcaggtgatctgcccacctcagcctcccaaagtgttgggattacaggagtgagccaccgcgcctggccatgtgtatgactttgattgtgaaaagtttcaaacataccccaggtgggtaaaaatatcagatggtccctgaatattcccactgtccagcagtaacaatggtcaccagcacacgcccatctcgcttcacctttgccctcatacacttccttccttctcagacagtttagaagataattccggccaggcacagtggctcacacatgtaatcccagcactttgggaggccaaggagggtggatcacctaaggtcaggagtttgagaccagcttggccaacatggtgaaacctcatctctactaaaaatacagtaattccggccaggtgtggtggctcacgcctgtaatcccagcactttgggaggccgaggtgggtggatcacgaagtcaggagatggagaccatcctggccagcatggtaaaaccccgtctctactaaaaatacaaaaaaattagccaggcgtggtggcaggttcttgtaatctcagctactcgggagtctgaggcaggagaattgcttgaacccaggaggcggcggttgcagtgagctgagatcatgccgctgcactccagcctgggtaacagagcaagactccgtctcaaaaaaaaccctcccaaaacaaaaattagccgggcgtggtggcaggcacctgtaatcccagctacttgggaggctgaggcaggagaatcgcttgaacctgggaggtggaggttgcagtgagccgagattgcgccgctgcactccagcctgggtgacagagggagactccatctcaaaaataaataaataaataaagataattccatgttctgggtccagtgggcaggtggacaggatgctgcacagactgggtgcgaggaaggggtctgaaggtgccaccaaggcttttgctggagcgaccaggaggatggggctgctcctcccggaggtgggaggctgcgatggggcaggctgaggaagagccagagctgaggcttggacctgtcggctttgagatttgattcaacgtccaaggggagatgttttgagttgtcagatggaaattcatgtcgggaaggtgctatgcatttggggataattggagtgtggatgatcttaggagcaatgactctggttgacatcaccaggggatgagggcgcaggaggaggagactccagtgagcccagaggcttcagcacaaaagaaccagcgaatcaggatgtcgggagcgccttccagcccgcaggtgtgaccaaatcaccctggaggggctgttcccattcgtgctcctgaccacagactatggaagtgcctgtttgctttaagaaagtgtccgtttcatagacaaaatggtattttagaattaattatattcctgtaatttcaaggaagagctgacttctcatatccatggactgtttgtattccttcttttgtgaatgaacataattcttagtgaggtgtttttgtgtagtttttctctttcaccatgaggggtagagaaaagggctaggaacagacgccacctcttggcttaggggcggggaggctctggggtcaggccagactctcccttcctccctcacggtctctttccatttctccaagtctctgctttctcaacctcaacatgagggtgctggggagttgggctaagtcccgtgttaggacccgccatggccgcatggccccgaatctccctcgctggccccgtctctgtggctcagtctctgctggctccagagcgtggcctggcctgcgcgtcagtggacgtctgttcccgtgtgggggtgttcttgtgggcgggtgggctctgctgtttcccacgtctagccagggcctgccacccagggtctcaatacatgtgttttgaatggcttcaaagactattaaaagcaagttattattttcaaaattaaaataatctctctcttttaaacaataaaataaaattttgcattttgtggcgatagggtttgtatagctagtgatattttatttttaaatactttagaaggaagccatgttctaattccttccccgtttcagcgtgtttaagcaaagtctctttttagttcaacctcattgagcagagggcacctgtcaggtacagttgacagtacatccagttctgtcactgcctgacttttgaaagtctcaaatcttagcgtcaggagcctagacggggcctcactcactcccgcagcccccaaggttgaccgagctgccctctcccttccaggaagcacggctgatgctccgaaggagggaagactgacccggtttctggacttcacccagctgatggacatggcatctgaatccgtaggaggaaaagtaagtgggtctctcatggccaaacaagggttgaaggcatccgtgctaagggcacaactcaccagtgcagagaacctcatgcaagaatcaacaagaatcaggctgaagtgttggcctgcccaaggaaacccgttagcgagaaagacttccaaagaatttatcttaaattggtgacaattctcagcaaggacaatactgccttagattttgtgtgtttcactagaggacagactgtggtcctctgctctagataggcaggcggtcctctagctctagttagatctgaggtcctctagctggagttaaatcggaggtcctctggctctggttagataggaggtcctctggctctggttagataggaggtcctctggctctggttagatgggaggtcctctggctctagttagatgggaggtcctctggctctggttagatgggaggtcccctggctctatttagatccgaggtcctctggctctatttagatccgaggtcctctggctctagttagacctgtggtcctctggctctggttagatgggaggtcctctggctctggttagatcggaggtcctctggctctggttagatgggaggtcctctggctctggttagatgggaggtcctctggctctggttagattggaggtcctctggctctggttagatgggaggtcctctggctctggttagatgggaggtcctctggctctggttagatgggaggtcctctggctctatttagatccgaggtcctctggctctatttagatccgaggtcctctggctctatttagatccgaggtcctctggctctagttagatccgaggtcctctggctctagttagacctgtggtcctctggctctggttagatgggaggtcctctggctgtggttagatcggaggtcctctggctctagttagattggaggtcctctggctctggttagatgggaggtcctctgggtctggttagatgggaggtccccaggctctgattagatgggaggtcctctggttctggttagataggaggtcctctggctctggttagatgggaggtcctctggctctggttagatgggaggtcctctggctctggttagatcggaagtcctctggctctggttagataggaggtcctctggctctggttagatgggaggtcctctggctctatttagatccgaggtcctctggctctagttagacctgtggtcctctggctctggttagatgggaggtcctctggctctggttagatcggaggtcctctggctctagttagatcggaggtcctctggctctggttagatgggaggtcctctgggtctggttagataggaggtcctctggttctggttagatgggaggtcccctggctctggttagatgggaggtcctctggttctggttagataggaggtcctctggctctggttagatgggaggtcctctggctctggttagatgggaggtcctctggctctggttagatcggaagtcctctggctctggttagatcggaagtcctctggctctggttagataggaggtcctctggctctggttagatcggaggtcctctggctgtagttagacctgtggtcctctggctctagtgtgtaatgagggtcacctggagaactcattaaacataatgtgcagaggcgctggggtgcaggctgtgctcagaagcagtgtgtctggtacagaaagggaagaccctgtgcctgcccccaggaagctacactctagcagggagacagatgtaagtccagaccagccctgtgactggcacaatgccagggtgctgggggagcacatggactccagccatgggtagcctgggggaattggggtgggaggggtggggatgggccagctgagtgctgctggaggcagcttgctggagagcagctggcgggcagggatgaggtgcagggtggttctggcagaggtgtctgcgaggagagcaagggagcccacatgctccaggtggctcagtgtttcaagaacacgctgcgcgtttgtgagaagagttgggagcacgagtctggagaggtaggagaggccccatgtgccctgtgaagccttctgctgaggagccacagagagatctggagcaagggggatcctgatatgtccacctacctgccatttgaaccctggaacaggtcaacctcagcacatcaggtcttccctctgctctgccactcaaacagccagcagctctgaaacagctcgtccttcctgcctttcgaactcctgggctggagtcagagcctggggcagggtgccctccaggctgcagtgaccacagagtcctggcttgggtggagtgaccacagcctgttttgctcaggaaaatctgatttaccttgtattctggatgtacaattagtatcattgacctcactctcaaaatgatcctgctttggtggatgaatgaccaggacagcccacctgcagggtgacctatggcggcccttgtgggtgaacacagaggccccaaccgcatacgtaacccagagcttttttggtcattgctcggtttgtaaaagtagcacgaaacctctggttcatgaaaaaaagaaagttggtttatttgcttcttgagtgtaagatgttagtgctcttacctccagatggtaaaggagaatcggaaaaaagggtgggaagagaagaagaaggaggaggcagacaatgaaatggaagcatttcaaggcatcatggcttaactgcagattctgtcgcttcccctaggtgatttcacgttttctttttacttcatctcataatgtttcactagggaatgaaataaaatggtatcagatttatggttgctttatctttctttctttctttctttgtctagattttatttgcaacagatgacttttttgctcctgcagaaaacctcataaaggtattgtaaattgacattctgcaatgtaaagggttgatgtagagaaatctatgccgccttgttattaaaatctccctgtatatttgggatggagtcatgtgatgtacactggcaaattagcatattagaatgttagaaagacatgcaaatcagcatgaactcatgccaaaacatagcagagacagggatctgagcaagtaatttgggactgcattgtttcctggggaaaattctgaggtcctcaaatactgctcttctgggtaaggtgaatttcatcatttgtgttgggaagaaaatggatctatgtcttgaattttctgggaaatgttttacctgcctaattataaaagtgcaggacagcttattaaaaaaatagagaaaatgctgacgaacatagggaagaaatggcggccctgctggcgtcctgctcctccgtcatacccagtgtggagatgcgaactcttgtgcgtggagagacaaacacaggtgcacattgagctaatgcccacgtacagcattcatgactggcctccattgtgggcagcggccatctggttaccctggtgaaatggttgctctctgtctgggcaggacctggctgggtccagagcaagctgaagtatggccctgagaaggcaccttacagtgttaacttacctattccccaggagaaagtgaaaataaaatgagaaagggcaacatgaattaactttttctaggtcacacagttactaaatgccaaagctcttaccattttaccacaggtccggtctttgaaacactgaaatgcatgtctaccttgacctagttgttccacagatttacatcgtttgcacaagtgggcaaaaaaataggtagaaaacattcattctggtattgtttggagaggagataaccaacctaagtgttcattgattgatagggaactaaagaaattatagctcttccagatatggactattatgtggctactagaatgaggtaggcctggcactgtggctcacacctgtaatcccagcactttgggaagccaaggcaggaggatcacttgagcctaggagtttgggaccagcctgggcaacagagcaagaccccatttctgaaaataaaaaatattatccaggcatggctatgtgtacctgtagtccccgctactcagaaggctgagctgggaggattgcttgagcccaagacgttgaggttgcagtgagccatcatcatgccactgcactccagcctgggtgacagagtaagaccctgtcaaaaaaaaaaaaaaaaaagcaagctctccattcactggcaacaagagagatccatgtatattttatgagtgtaaaacagagtttgaaggcgcacacatcaaacagtgagatgtgattatctgtgaagagagaggtgggcttggaaatggggtgggagagagggtagggcactatttcttagattttatacttgagcatatatatatatatatacacacacacacatataaacacttacacactacatatgtgtatatatagtcacgctataacatcacacgagacacatatatttctcctttttgaaaaaaataacattacagataaatgtaaagttcaccgttcacctccaacttgagtgccagtccacgccctccctttccaccattcacactgttgtaggatgggaaaatactttaggctgttggggctgctgaagcaaaatactgcagatgggtggtggcttaaacacagtgatttcttgaagttctgggggctggaagtctgagaccgagcctgagacagtagcagctccagcatctggtgagggccctcttgggatggccacctgccgctgattccctcaggtgacagagaagagaggggaagcaggccatctcctgcctcctcccacatgggcactcatcccatcatgggggctccacccttgtgacctaatcacctcccaaagtcctcatctccgaataccatcactctggggattaggtttcaacatacaaattttggtgggggacaaacattcagtctgttgcagagaattcttctaatgtattttatacacttaaatacacatatattcgtaaatatataagatattttgtattctaaatttatatacatattttcacaaagcacttagcattctgcacactttttttggtgggggtggggcaggatctcgctgtgatcaggctgtcaggctggggtgcagtggcacggtcatggctcactgcagcctcgacttcctgggcacaagcgatcctcctgcctcactgggactacaggcatactccactgtgcccagcgaatttttaaattttttgtagagatgaggtctctagctcctgggctcaagcagtcctcctgcctcggcctcccaaatggctgggattacaggcgtgagccaccgtgcccggccctaaacctgcttttctcactgcgtgtttgtgaatgccattggtgctgatgtgtgtagacccaggccaccctcttagctgccgaataataactgtccatgtcatcgtggtccattttatggccccctttccttgttgatgcacatttaggttgatgacattttgcacgtattgaaaacatccttgtacaagtgtgtgcacgtgtgtcggtttatccctgggaccagtccttggtttctctctctctctctctttttttttgagacagagtctcactctgttgcccaggctggagtgcagtggcatgatctcggctcaccacaacctccacctcctgggttcaagtgattctcctgcctcagcctcccaagtagctgggactacaggcacccgccaccacgcccagctaatttttgtatttttagtagagagggggtttcaccatgttggccaggctggtctcgaactcctgacctcaggtgatccgccctccttggcctcccaaagtgctgggattacaggtgtaagccaccgcacctgactagtttttctctttttttaaggaacacacatttttaaggaacatcacatggcatgagccagttttacaacagggctgttttcctgccactggttcagtagcgtgtgtccccagcttccctcacaccgttcagtgtcagtccaatcacaacagcagcagtagcagcaacacacctgaaacaatcaacctacccccaaaactaaacaccaaaaagtttggggccttggaggtctggggtttaagtgggaggtgtacctccttctctccttctgggttcagagcagagttttgcaattcctgatgagtaatggaaaggctggagtgtgtgctgtctttaagatgtgatttgattgtaataacattcaaaataccatcaactttcatgtataatgctaaatactgggcacttactatgtgccaggcacatttaaggttgacaacagccagaggcggtcaatagcacgatggctgtttgcctttgacagaggaggagcactgaggcacaggaaggtgggtaccgttggccacgggtcccctgcctgggaggctgggcaggttgtcacaccagggagtctggcgggatccctggttggcgtctcatgcatcagcttccatcagagcatccctgccgccctgggtcctgctacccctagtcccttcctctgctcctgcctggggagattccctaagcagtaacgtaagatcctccttgcacgacttgatggaaacagggaaagtatccccatgctgggccagcataacgatttctgagcatccacgctatttgagggtctttcatgtcggctattccaacttcatgacactcctgcgaggatgcgtgtatcctcctcattctggaagatgaagaagtgtgctcagctgtctaaggaggctgtgtggggcatcagagaccatgcatttcctcagggggttgcagagtgtgctgtgtggtttcacctggaccctgagcgtccagcctactcttcctatgactttggatgaattcctgattgaatagtctacctggcctgcttggaaatctgaccagcctctctcactttaatacccatgtaggttgctgttgggaattgcatttgtgcggcccacagagtgcctggtgatgtggttgtacctgctgctatcagtggtcaattctgtgtgctgaggcccacaaagaagtcacatttctttctctgaagatgataaaagcggaggcatctctcaatctggaaggggctagctgggcatgaaggtggtggcagaggctcccctagaccccggtttgcaccgttcctctggcactgtgggacagaagtggacttgctggaagccaggagatcacatgaatgttaatgatcaccttgttgtggtctttgccctagagtgacagcccgtgcttcaaagagcatgaatatacggagtttgggaaatggatggatggctgggagaccaggaggaaaaggattccaggtaataacaacggttcgttcatcgaagtgcagctgacactgcaaagttaaaaacgcaggctgtggcaaagccagtgtccgttttgggtcagctttaacatggggccctggaatgctctgtaatcttggatgtccttatctgaacatcaggctctaagtcaggaaggggcagcgtgagcccgggtcactgacgtcccaccaggcacaaagggtgagaagcacgttgtcgggaaaatgaaaaccctggtgaggtctgcggatggaaaaaagagtggattctcactgagcaatgtggcaggcattaggcagcgtgcatcttctgggtccttactacagtcctctggagtaggtctctttatccccgtttaaccgccatggaaacagattcctggactcagcccagggcacactgctagcaagataagctggggactgggccagggtctgtcctcaacactgtacctgctgtcttttacgattttatgcaatttttattcattgctattactcagtctcaatcaaaatataccttctgaagttgaagaaaagcaaacaaatccaggcattaggttgataattggatttttacttgccactatctcaagtattacagaaatatttgatatttctagttttctaactttctacagtacttgaagcagtattagtttctaacaaatctggacattttaaggtgagttaatatctggcagtaaataaccaagaactcaatagtggcagacttgacttcaagactctgaaggctttggtagatgcaggcaggtgtctgaccagtggtggggctggaggctggagggtgctgtgtcagttcctgagcttgagaggacaatgaacacagtgtctgcaggagaaccagctctgcttactacctgctgagcttggtgaggtgctttctacatcgcacactcagtctaagctttatggaagctaacggcatccctaatttacagttgagaaaatgagattctctactgtaagaggtaaataatttgccaaggacagtcataggaaatgatccatttggaaccagaatcaggtcttcctggatcccagcctgtgcattttctcttctggctagaactgaggattttcgttggggaatggtggtcacatgtggccaggttatgagagatcctacagtcatattagctaagaaccgccctgaacagttttttctgtgatggacggaatggcccctgctgtgggtcaggtgcatgtggggtgcactgcctcgcatgcagcatctgctgtgttggccctaacgagactgctcttgtcctctgtgttgcgcaggtcacgactggtgtgtcctcaggctggggatccaaggagtcatccggggcttcgacgtggacgtttcttacttcacgggagattacgctcctcgagtgtccattcaagcagcaaacttggaagaaggtgcgttaggaaccactgtccccaaaatgagaattatgggtcacatggctcctctggccagccacagccccacaactgctcactttccctaccacccagacagcttcaggcgcttgactaaggctactttactgtaacggggctgtaggaccaggactcctagtagagcgctctgtggtttttgatttgtggcttaatagtgttaacagccagatatagattttatcattcccacggtccttcagcttcacgcagaggcaggccatcatccctggaacgtgggtgagcaggttgctggtgggcgggagggagtggtttgtgcctcagatgacccgggtgatgtggacccaggtctgggacagctgtggggtgagcagcaccagccctgctttgggctgtcccagtgtgtgtgatgggggagctgctatggcattttaggcaagggttcctatctgcatcttggaatgctggacctatgaatcctgcaggctctataaatgagacgtattctgtgaaagggccatatacacagagcagacctcaggtgctgaagaagccaagaaaccaaagaaagaggctgacaaatccagtctgttggtaacgggtattttattgggggaacttacggacagaagcgtggccttgggcagcagcgagatgggtaaatctctgcactgttactgcccggactcagggctcacatgctgtagggaaagggtctgcgtgctccagcgggacaactgaaggcagcctccagaacagggaagagggcggtgtgcgtcacagcctctgatttgtgcgataatatcaaggttgacatgttctggactaaggacagtaaatcaagttggaagcaggacgtgttcacaggattgaggctaatcagacattgacatggcagattcgcatccaagatggagtcactttgtctccacagactttctgtatttttattcctttgttaccatctgatgttgactttagcattaattaaaaaaaatatacaattatgtgtgtgtttatacatgtacttagggaagataagtcaatgtgggttggcaagtttacactgaacatgctatgtgcacagcgctgcatgaggctctgtggacacgaacgggccctgctccctgaagatggctggggcacctgaacaggaaatgatgctacaagagatgctactctaaaagcggaaatgaccagtgacaaacgagtaagattgtttcggcaagcccctcaactgcccatgagtgcttctatttctgaattgccccagtatcaattctaaggatgccactgggagaggtggtgtttctggaattgaccttgtaatagtccaactttgaaaactctagcgatgtgataaacttgttgaagtttgagctaacttggagatgacatttactgtttgacaagcaaatgtagtatcaaacatcttgtactattttttgaaatgactgttaatatattaaatattgaggaacttcaacaagtgtgtctattactttgatcatttgatacttcgaaatatctttagtgttatttgcaaagcgagaattaccatacaaaccaccaagagagtagattccctttgattttgaaccctaatcttaatcctgaatggtcattccaactacagataaactaccagaaatcccagaaagaggaaccaggacaggagctgcagccactcctgaggagtttgaagccattgctgaggtacatctcccccaaatgaattgggtcttgtcaccaattattaggagagtagggaaactgctctgcacacctggctgtgcaaggcgattctttgggacgcccagccctgatgctccccacatcatttgcttacccactgtggccttgcaaacgtctcagtggttcatcaacctgggaagagtgagcatcatggcccaaaggcttctcaaagggttccaccagcacccatctgcaaatggctgctggccccgataagcacacatacagaaactgatagtaagcgtttaaacactttttataccaacttgatgtaacttgaagtaacgtttgtgtttggagaatttaataaaagaaacgggggaaaaaaataaatagggcttgtgttttggtacattcttgtttttttaatgtttatttagtaatagtttgtattgttttttacagaaatgttgatccataacagacaggaaagtaaataacaggaacagtaaacagggccgttagtttgagaagtgctaacctagagaaaatggttgcaaggctcaggccagcagatttccccagaggtcatggagcatggcagtagccttggtttttatttgaatgttcacctcaccacacctcaaggtgaagacatttggaggggtctgagatcttgtccttcatttgcaagcatctgccaccatcacccactggctgttttgatcagtgaaaacaaaacaggcctttattctgttttttattaaacatggggcttgatatgtactatttttattaaagtgtttcattaggtatccatcattatttatttatttgtttgtttattttttgggacggagtctcgctctgtggcccaggctggagtgcaggggcgcgatctcggctcactgcaagctccgcctcccaggttcacgccattctcctgcctcagcctcccgagtagctgggactacaggcgcccgccaccacgcccggctaattttttgtatttctagtacagacggggtttcaccgtgttagccaggatggtctcgatctcctgaccttgtgatccgcccgcctcggcctcccaaggtgctgggattacaggcgtgagccaccgtgcccggcatccatcattaatttttattccaaagtatctccacaccttaagtgccacagaggcaataggatgacagaatttattgttttcaagagcaattgctgacatttctatatttattgctagctaaaatccgacgactggagttacttggttcccatgactgagcttaagccaggaaaccctgcttccggccacaactattttcttgtcaattcccagcagagatggactcatatcagactcaacattttcccaggtaatcgtgacatggacttatcaccagttccatggcttctttattttatgttgacatgtttataaaatataaaatgacttgctctttccttcttggtaattgatctctctagcatttcaggattgtaatttctcctttttatgctctagaaaattcttgttttaatccacacatcaataggtggttattgaaaaattatcaagtaaattaggatgtggtggaactaagttgtattaggttagatagatcctaactagatttcacaagtatgttatattagcagctgaagtggtatgtacaaatgactcattttattttttaatagctttattgtgatataattaacatgcagttcacccatttgaagtgtacaatcaatgatgtatagcatatgcatagacacgtgcaaccatcaccatacctttagaacatttttatcatctcagaaagaaaccccatatcctttagctatcatccctcatcttccctatcccaaagcaaccactaatttgctttttgtcttgatagttttgactattttggacatttcatataagtaggaattatataatattggtcttttgtgtctgactttttccacttagtataatgttttcaagattcatccatgttgtaacatgtattaacactttctttctttttgtgtaaggctaatataggttgagcatctcaaatctgaaagccccaaaatttgaaatgttccaaaatccaaaactttttgagtgctgacatgatgctcaaaggaaatgctcactggaatatttcagattttggatttgggacactctaccagtaagtataatgcaaatatttaaaaaaactgaaatccaaacacttctggtctcaagcatttcagataagggatactcaaccactaccacattttgtttacccgttcattagttgacagacacttgtttccatctgctggctattttgaacaatgctgctgtaaacatttgtgtacaagattttgtgtggatatatgctttcttttgttgagtgtatgcctaagactggactttctgggtcatatgataactctgtgtttaactgtttgaagaattactaggcttttccgaaagtgctgcactattttacattcttaacagccacgtaaaggagtgctgatttctccctgcctttcccagcactctctgtcttactttttgtttatagtcatcctagtggatgtgaggtggtgtctcattgtggttttgatgtgcatttccctgatgactaatgaggaggaacatcttttcatatgtttattggccatttgtatgttttatttggaaaaatttctcttcagatctctattcacttgtcttaaatttcaacaggtttttgggggaacaggtggtgtttggttacatggataagttctttagtggtgatttctgagattttggtgcacccatcaccagagcagtgtacactgtatccaatgtgtagcctgttatccctcaccccccacccttccccacattgtatcattcttatgtctttgcatcctaatagcttagctcccacttataactgagaacatatgatgtttgcttttccattcctgaactacttcatttagaataatggtctccaactccatccaggttgctgtgaatgccattatttcattcctttttatggctgcatagtattccatggtatatgtatatataccatattttcttttttaaaatattttcaattatgggcacatagtaggtatatatatatttatggggtacatgaaatgttttaacacaggcatgcaatgaataataatcacatcatggagaatgaggtatccatccccaatccattgtgtatatataccacttttaaaatctattcctctgttaatgggcacttactttgatttcatattttggctgtgacattgtaaacagtgtcacagtaaacttggaagtgcagatatctcttcaatatattgatttactttcttttggatatatacacagtagtgagattgctggatgaatctattgttgttctatttttagttttttgaggagttttcatagttttccatagtgagtgtactaatttacattctcaccaatagtgtacatgggcttcactttctccacatcctcgctagcatccactattcccccgtctttttaaataaaagcggtattactctgctctcacgttgctataaagatactacctgagactgggtaacttacaaacaaaagaggtttaattaactcacagttctacatgactggggaggcctcaggaaacttacaatcatggcagaaagagaaggcgaagcaaggcatgtcttacatggcagcaggatcgagagagagagagagagacagagagagagagagacagagacagacagacagagagagacagagaaagggggaagagccacttttaaacatcagatctcacaagaactccctatcagaagaacagcatggggaaaaccaccccatcatccaatcacctctaagcaggtccctccctggacatgtggggattacaattagagatgaggtttgagtggggatacagaaccagaccatgtcaaaagccatttcaactgaggtggtatgacatttcattgtggttttgagttgcatttttctgatgattagagatgttgagcatttaaaaaatatacctgttgcccatttgtatgccttcttttgagaaatatctattcagaacttttgcccatttataaattattttttttgctactgagttgttagctattgagttgtccttatatattcttgttattaatcccttcttagatggatagtttgcaaatatatttttttccaactctatgggttgtcactccactttgttatttcctttgacagcagccttttagcttgatgtaatcccatttgtctgtttttcctgttgttgcctgtgcttttgaggtcttacacacaaatatttgccaagaccaatgtcctagagcatttccccaaggttttcttctagaatgttcatagttttaggtcttagatttaagtttttcatccattttgatttcattttgcataaggtgagagataggagtctagtttcattcttcggcatgcagttatctagtttccccagcaccatttactgaagagactgttccccattgcgtgttcttggtgcctttattgagaatgagttggctgtaaatgtgttgatttatatctgggttctctattgtgttgtctgtttttatgccataaccattctgatttgcttatatagcttcatagtacattttgaagtcaggtagtgtgatgccttcagctttgtttttttgctttggttattcagggtctttcatttaaattttactttttaaaaatatttctgagaagaatatcattggtattttaatagggattgaattgaatctgtaaattgctttggatagtactgtcattttaacaatattaattctttcaatctaggagcacggaacatctttccattttttctgtgtcctcttcaatatatttcaccagtgttttatagttttccttgtatagctctttcacttcgtaggataaatggattcctcagtattttatagtttttgtagctattgtatatgcgattgccttcttgttttattttgtagattattcactgttggtgtgtataaatgctactgacttttgtatgttgaatttgtatcctgaaaatctactgaattagtttatcagttctaatagtttttgggtggagtctaggtttttctaagtataagatcatattgtctatgaagaaggagaacttcacttctttcttttcaatttggatgccatttatttctcttgcataattgctccagccaggacttccaatattatgttaataaaagcggtgaaagtgggcatccttgtcttgttccggatcttagagaaaaggctttcattttttgtccattaagtatgatgttacctgtgggtttgtcatatgtggcttttgttattttgaggtagtttttttttctatacccaatttattgagggtttttttcttatcatgaagtgacgttaaattttatcaaatgctttccagcatttatcgaaatgatcatatggtttttgttcttggttcagttagtgatgtgtcatgtttattgattcatgtatgttgagacatgcttgccttcctggaatgaattccacttgatcatggtgagtgatctgtttattgtgttgttaaattcagtttgctggtattttgttgaggatttttgcatctatgtccatcagtgatattaacctgtagttttctttttttgttgttgtctttgtctggttttggtatcagggtaatactggccttgtagaatgagtttggaagtactcctgcttcaattttcttgaagagtttgagtaaaattggtattagttattccttttatgtttggtagaattcagcagggaagccattaggtcctggaattttctttaatgggagactttttaaatttcagcttttatctcatcattcattattggtttattaaggttttctatttcttcatggttcaatcttggtagattgtatgtgtccagaaatgtatccatttcttctaggttttccaatttgttggtatgtagttgttcataatagtctctaattgatctttgtaattctgtggtcacatttccttttggctgagtacagtggactttattgatggtatgtgacaggatgtggctccctaggcccctctcttttcagggggcctggcatggaaactgtgtcagggggagattctcagtatggtgggagagtgagtgtggcagggactccctagcagctgagaacctctctaatcttcttgtgctcttgctggggctggtggtccaggggctcttactctttggaggccatgtggaccatgaggcctccactaccctgttgccaaattcattgtcataccagggaataagcttgacaaagtagtcattgagggaaatgccagccccagcatcaaagctggaagagtgaatgtctgttaaagtcagaggagacaacctggcactcactatagcccaagatgcccttgagggggccctccaatgcctgcttcaccgcctttttgatggtgtcatatttgtcaagtttctccagatggcaagtcaggtccaaaatgacacagaggtggggatatggaacaccatgctagtgagcttccattcagcttggggatgacctttccaacagctttggcagtgcaagtagatgcagagatgatgttctgtagagccctgtggccatcctgccaacgtttccaagaaggggcacccatggtcttcggagtggtagtgattgcataggctgtggtcatgagtccctccatagtgccaaagttgtcatggatgaccttggccagaagggctaagtagtaggtggtgtatgaggcactactaaggatcttgaggttgttttcatacttctcatgattcacaccccacataaacataaggggcatcagcagagggggcagagatggtggctcttttggcttacccctctaagtgagcctcagccttctccatggtaatggagattctagtgggctcaacaacataatcagcaccgctgtcatttcactcgattttgggggggatcttgctcctggaagataatgatgggatttccattgatgtcagtcttctcattctgagccttgatgatactgtggaacttgccatgggtggaagcctactggaacatgtaggccaggtagttgaggtcaatgaaggcatcattgatgatgacaatatccactttgccagagctaaaagcagccttggtgaccaggtgcttaatgtggccaaatttgtttactctggccttcattttcaccttgttgcctcaggaacccagctggcactgcataaaaatatgcaggtgtctgtcaaatggaaaagagaagagagccagtctcattttttatgtatccttctctatttctgattttttggggtcttttctctttgtaattagtctagctaaaggtccatcacttttgtttctttttaaaaaaacaagttttttgttttgttgatcctctgtattattttagttgccatttatttatcctctgatctttatttttttcttctactagtaattttgggattggtttatacttgcttttctagtttattgagatgcattgttatattaatttgaagtctttctacttctttggtataggtatttattgctataaacttccctcttagtactgcctttgttgtatcccatatatttttgtatgttgtatttccattttcatttgtttcaagcatttttaaaatttccttcttaattactgacccatttgttgttcaggagcatgttgtttaatttacatgtgtttgtgtattttccaatgtgtctcttattattgatttctagttttattccattatggtcagaaaagatacttgatatgatttctacttttttgaatttgtttagacttgctttatggcccaagacatggcctattctagagaatgttccatgtgctgatgaaaagaatgcatattctgcagcagttgggtaaaatgttctgtaatgtcagttagggccattagatctagtgtgtagttcaacttcactatttctttgttgattttctgtctggacgatttgtccattactgaaagtgaggtgttgaagtcccctactattattgtattgcagtctatttatccctttagatctattaatgtttgctttatataagacttgaaagctctggtgttggacacatagatattcataattgacccatttatcattatacagtgtcttgtctttttttttttttaacagtctttgatttgtagtctattttatctgatataagtgtagctactcctgctcttttttggcctctggttgcatgagatatctttttccatcctttcactgtcagcctatttgtgtctttataggtcaagtgggtttcttgtaggcagcatatagttgggccttgtttcttagtccattaagcaacagtataccttttatttggaacattgagtccatttacattcagtattgtcatcagtaagagcttactgtcattttgttgcttgttttctgatcccctccccttcccttcccttccctcccccctcccctccccctccccctcccctcccccctcccctccccctcccctcccccctcccctcccccctcccctcccccctcccctcccctccccctcccctcccctcccctcccctcccccctcccctcccctcccccctcccctcccctcccccttcccctccccccctcccctcccctcccctcccctccctttcctttccttttctttctttctgccttagtggttaactaattttctctgatagtatgttttaattgacttttatttttagcaaatctattataggtttttgcactgtggttaccatgaggcttataaaaacatcttataacaagttattttaaagagatgtcaactcatcttagatcacaaagaaaaaaatagaaataaacaaagaaaaacaaaaaaaaactctacatttttaactttatccctcctcccacattttgacttcatgttgtctcaatttgcatgtttttatattgcctatcttttaacacctgttaaagatatcaacaaaaagattattatttttgatagatttgtcttttggacttcatactagagttatgagtgaattacacactataattacagtgttggagtattctgagttcgttaatgcacttaattttactagtgggttttataaattcaaatgttttctttttgcacattagtgttttttttttttcaaatggaagaactttagcatttcatttaagactggtggtggtgaattctctcagctcttgtttatccaggaaagattttctctctctttcatatttgaaagatagcttttctagatacaatattcttggatggcagtatttttttctttcagcactttaaaatgtcatcccacttctttttggcctgtatggttatcattgagaagtctgttgtcagatgaattgaagcttctttatgttatttgcttcttttctcttgctgcttttaggatatttttatccttgactttttttttttttcttgagacagggtctcactttgtcacccaggctggagtccagtggtgcaatcacaggtcactgcagcttcaacctcctttggctcagatgattctcccacatcagcatcccaagtagctgggaccactggtgcacaccaccatgcctggctaatttttgtatttgtttttttttttgtagaaatggggttttaccatgttgcccaggctggtctcaaaatcctgggctcaagcaatccacccaccttgacctcccaaagtgctggaattataggcatgagccatcatacccagcctgtccttgacctttaggattttttatatgccttggagtagtcttatttggatacaatccatttctttgagctttctgtaccaggatatttatgtctttatcaagttttgaaaagttttctattatttctttgaataagctttctaccccttgctcttgctcaactccctcctcaacaccaataattcttagatttgatcttttgaggtaatattttatatcttgtaagcaatctttattccttttcatttttttctcctctgtgtatttttaaatagcccattttgagctcactgattctttcctctgcttgcttcattctattcttaagagcctctaatgaattttttggttcagcaaatacgtttttccattcaaagttttctgtttgattttaaaaaattattgaaattttgttaaatttctctgataaacttctaagctgcttttgtgtgttatctttgaggtcactgagtttccttaaaactgctattttgaattattgatcacagagttcatatatcactgtcttattatgatcagtcactggttccttgctttgtccatttggggatgtcatagttctttgctgttgtttcttatgggtatacatctatgcctgtgcattgaagcattagttatttattccagtcttttctttctgggttgtttcagtttttgttgaatatatttgcttagatgtagggagtgtccaatattttagcttccctgggccacattggaagaggaagaattgtcttgggccacacataaaatgccctaacactaacgatagctgatgagccaaaaaaattttgcaaaacaatctcatactgttttaagaaagtttatggatttgtgttgggccacattcaaagccaccatgggcttcataagacccactgcccatgtgttggacaagcttagcttagagaatcattataaatttcctgttgattttatttcctgctaggtagctgcctacttttcagcactagatggcaccttaagtccaggattgcttcatttgtagtaagcaatcaaattactgcccatcagaataggggaggtcccagggagcatattctagtggtgtgggaaggttagctaggtgtttgtctctaggggacctgtggaacaaacctcctacaacatggtgttgctgaacagcaactctgatttggtgtttcctctggctgagttacagggtttgcagggctggggatgtctcaccctcagtgtgaagcctccaccttatggatcatgagaatgggtcactgtggccccaatatctcaaggtaggaccctgtcccatgagtcagggctgggtcaaataaaggagcccccgcctctcaaccacactcacccagggcttagcctcagtaacaggcatataggggcaggatgagaagccctgatgtcctgcctctcctgggaagacagccctgcaaccatgggctgcacttgtttgcagtctccactttgctgatctgggagagggtgtgcaggtgaggtcttggttcaaataccgcagactctcactgttcttactgaattttagcagatattcttgaatagatgttgctgaattttccgtatgcccttaggaccatttccagagacctgaagtgttttcccatccctcaacccccctaaattttaccagctccactgaggaacaggacagcaaagctctcctgctgtcatgccagaagtggttctctggaaccttattttagatgcaatgtttctctggttatgatgctttaaagtgagacatgaaaatggaaagatctaaacacgtttactaatattaattactcactgaaataatctattctaaaaacagtgcaagaaaatgaatgagcaaagcttacaagagagtcagaccttttccccacttgttaatttaacatacactgtggaataactactttgagctacagactgagcattggccataaaatcattttcctgacaatgtgtagggcagaaccaacagagtgtatgcttcatgaagaaagggctgtgagtccagattgtcatttttgtacacctgacacttagcacagcatggggaacacaggagaagctccataactatttgttgttagatttgacagagtccttgtccttatgaagtgaataacccagtgggagacagataagaaaaataactttggaaagaggccgaggtgggcagatcacctgaggtcaggagttcaagaccagcctggccaacatggggaaaccttgtctctactaaaaatacaaaaattagccaggtgtggtggcgggtgcctgtaatcccggctagttgggaggctgaggcagcagaatcgcctgaacccgggaggcggaggttgcagtgagccgagatcgtgccactgcattccagcctgggcaaccagagtgagactctgtctcaaaaagaaaacaaaagaaaaaaaacaaaaaactgcaaaatagtgatacatacaacaaaagtattttggtagagccataaacatttctatttgactatttctgatccaccaaaatagcaactttatatgtccaacccaatttgtacaggattcacgagttgagggagggtctaaaatagtttctgagtggaagccctgcttttctgggttgaatatgaagggtccctaagcacatgaaagctctttcctaattggtcagcattgatggcctgaagaggagagatgggcaatgcctgcatgcagatttcatgtcccagctcttactggcatctttaattgctccatgaggattccacctgggatccaggtgtaaagggaaaggaagctggggaaacctggctgatgttacagggacacactgggtgggaatgggttggtttaaatgagatgtactcagaggatgaagagtcatttctgggattccttggcagctgtgactaaaagcaagtttggatattaactctgtaaagaagaatcttattttttaaaatgtgaaatcgacttcactttcaacagacgaatatcttctatgccattaaagccaattataatatttaatgaactagaatggcagtgatattactctcataacccggctcctgctgaatgactccctctaggatattttctagggttttatgccaatgaagtttttggttttatttgttgtaaatagcaagacttccattgttttaccaaaaaattttcagatcactcattttcactaaatttgtaaaataaaaacatatagggcatgttttagtacaatattttgattaaattaattttctatattaaaaatgcttggtttccaccttctagcaattaatattcgaagaaacaaaacattcgttctactagaatcagatgctgtgagttgattttggtagctatttgctgctctgcagacctaatttcaggctgctgtggttctcagcagcaatttgattttgtgaatattatcttttgtattctgaatcacattgctaagcagggtggtgttgtaaaaataaaaacataaggttctcttgtctgagtctgtgtgggagtcagcgatgcttatttctagcacgaaacattatctgtatggtgaatttcccgaatgctgtttgaccttggagttgttcatttaatgaaaaaaacttcaatgcctactatgtgcccagacctcttctaggtagagacgatacaagagtggtacagaagtgaacaacacaggtaagtggtctggcctacaaggatttcgcattctgggtattggagactgattttagcaggaacttaaaaagataatttcaggctgtgattagagctctggagtaaataacaaagagatatgataaaatgtaacctggggagtcaggcagtggctgaatggaggagggaggagacaacttcagagcatgagagggaagacttttctgaggccatgcctttaaggtgaggaacataagtaatcttttggagagctgggaaagttgttctggtacagggtaatatcaagtgcaaaggccctggggcagtgggcttgttgtatttgagaaacagcaggtgggtgtggccaaagcctaccaagagatgacactggagaagacaggagggtcctgtagtgtatgatacacaagcagccatttttacaaacaataactaaggcacctttccttttcagatggtggaattgcacgacttagagtattcggtactggacaaaaagactggactgcaactgaccccaaagaacctgcagacctagtggccatcgcttttgggggtgtctgtgtaggatttagtaatgctaagtttgggcacccaaacaatataataggtaagatgatattcttggagctggcttatttaggaagtctgggtaccggcattaaataccccaatatggtcagagtgatttaaaaggaaaggcacatctcaaagcacagcagtggatgagattaatcttccatgtgtaggatttgatgcctttatgacatgaaataagtcaacattaccaatttttctacctaattttggcctaagtagctgctttaaaaggaaaagtaaaatttaactaaccctatgattgtttgtgaatttactgaaacattaactttaatgaaaataacttatgtagcaatgctcagatgcataagatctgtaatttaattacagcaatgtattcatcctcatagttaaaatcatgcagtttaccattcaacaatgttattttctgtaggagttggcggggcaaagtctatggcggatggttgggaaactgcaagaaggctggaccggccaccaatattagaagtaagaagttaaaaataactatggtttaaagtttttcttaaaagtattttttggaactttttcttttaaataaacttttgcacattttagaaacctcatatgcattgttctaaatgctaattactatgatttatattttccaaatttcccactgttttcataatatcagggcagagactcagaagcccaaacatactggtcattgccagctacgccaatgcatttttggaacattcctctgtttcttcaataaagaaacaaaaggagctgcgatttaataatacaaaagttatgaataaatgtgttgggagatctggggaagaaccactagtttagcaatgtttgatatctgtgtatctcaggattacaccacttatgtgaacttgtgatggacagggcgctctagagtccatgcagctgtttaatttggccagtaactaatttgagatagagaaaccaagatgaagtgaaacaaaaaatacaatgcctttcaatttgcaaatcccaccaaaaacttggtcagaaaagtgccctccccttcctaagttagatttcatgtcacctgatgctttgagatatcaatgaacagactctccgttctcaaaactaaggtttgaacgcacatcatgtatcagtataggtttgaccaacaaaatatgtaccttaaaaggtcaaaacaaactaattagaggaactatggactggaatagacgaagattgctgcacgtataacattttgcagggatctataattgacatagaaatttagaaaaacgtatctgggacccaatgaactcacaaattggcaagagacatttaagaaatgatagcaaagaggcaatttacatgaaagtgatttacacatcaggccacaggaaacactcttctatagtaagaaataaaagaaacacgtcaacctttttcacctgttggttttcgggactggtttcttgaatgactccaagttcgtttaccattttcttctcttctgaattccagaatgatgagaatggcattctcttggttccgggttgtgaatgggcagttttccgattggcacatcctggagtaataactcgaattgaaattgacacaaaatattttgaaggtaaatgcaaagccataaagaagtaccctataattggtttgtttattctaaagactgagttctatggaagtgggactgaggacactggactttcggtgtggattccccgtttaagctgtgtaattttgagcatgctactttaacccttagaactctgtctgtctgtctatctatctatctatctatctatctatctatctatctatctatcttttatttatttttttgagatggagtcttgctgtgtcgcccagcctggagtgcagtggcgcaatctcagctcactgcaacctccacctccagggtccaagcgattctcctgcctcagcctcccgagtagctgggattacaggcatcctagacaatacccagctaattttgtatttttagtagagatgggtttttgccatgttggccaggctggtctcgaactcctgacctcaggtgattcacccgtcgcagcctcccaaagtgctgggattacaggcctgagccactgcgcccgacccttatttatttatttttgagatggagtcttgctttgtcacccaggttggagtgcagtggcatgatcttggctcactgcaacctctgcctcctgggttcaagcgattcttcctgcctctgcctcctgagtagctgggattacaggtgcccgccatcatgcctggctaatttttgtattgttagtagagacggggtttcaccatgttgaccaggctggtcttgaactcctgacctcaggtgatacgcccgtctcggcctcccaaagtggtgggattacaggtgtgagaccatgcccagccaaccctttgaactttagtaactcctctataaaattcacatttgggctggatgacccccaaagtcacacaagattccatgacactgtccggctctttaccatagaggctctgcatcccccttggaaaaagagcctgtgaaaagcaccgggatgggaggcacctttttacagagaagggtcctaagcagattgaccggggaaggggagtgaccatttcttccccaggcttcacttttaaggcagtggtttacacatttttaaaaccgtacacctctatgtgtttaaaaaatatttggacaaacaaccttgatattctgtatttactttcttatgaaatacatatgtgtattattaagacaattcaaaagaagttggtacacttctacaattgttatgtgacattttataaatactggattgagtattccacgttagccatctttgaataaatagtggcattttgtattcatgttttgggtgagtggtttttatttttatttatttatttatttaattatactttaagttttagggtacatgtgtacaacgtgcgggtttgttacatatatatacatgtgccatgttggtgtgctgcactgggtgagtggtttttaaatgtcttgggaattattgtgactttactcaattactaaccattatatcaaattcaaggccaggctcatcattaacagtagtgcctataattatttcaagaagtcttggtaattttaacttattttggaaagacggcattttatctgttttttcttttaactattattttaggttcaagggtaaatgtgcaggtttgttatataggtaaacttgtgtcatggggttttggtgtacagattattttatcacgtaggtatcaagtatggtacccgataagtatttttgcctgatctccctcctcccaccctccaccttcaattatgccccagtgtccatgtgttcccattatttagctgccacttatgtaaacatatagtatttggttttctgttcctgcgttagtttgccaagaataatgctctccagctgcatccatgttgctgcaaaggacattatctcattcctttttgtggctgcatagtattccatgttgtatatgtatcatattttctttagccagtctacaattgatggacatttaggttgattccacgtctttgctattgtgaacagtgctgcaatgaacatacatgtgcatgtctttatggcagaatgatttatattcctttgggtatatgccaaataatgggattgccgagtccaatggtaattctgtttttagttctttgaggaatcgccacaacactttccacaatggctgaactaatttacactcccaccagcagggtatatatgttcccttttctccacaaccttgtcaacaactgttattttttgattttttcataacagccattctgactgggagattgtatctcccagtggttttgatttgcatttctctaatgattagtgatgtcagccattttttcatatgcttgttggctgcatgtatgtcttcttttgaaaagcatttgtttatgtccttggccaactttttaatggggttgttttttgcttgtaaatttgtttaaattccttatagattctggatattagacctttgaaagaaccataggttgcaaatattttctcccattccgtaggttgtctgtttactctgctgatagtttattttgctgtgcagaagctctttagtttaattagatcccatttgtcattttttttgcttttgttgcaattgtttttggcattttcatcatgaaatctttgccagttcctatgtccagaatggtatttcctaagttatcttccagggtgtttatagttttgggttttacatttaagcctttaatcaatcttgagttgatttttgtatatggtgtaaggaaggggtcctgtttcaatcttctgcatatggctagcccattatcccagcaccatttattgaattgggattcatttccccattgcttgtttttttaagactgcattttagatctggttatgtggccatggtttttacttttcaatgtggctgactgagggtcaggtgaaatggcagttctggattttcttgttcatacatacttgcattttttatggtatctttaatccacagttctctgcatgaatggtttaaaataacttacttatttttgtgagggatgctttagttaaaactagataacaaacagtaaatccacttaagcagacacccaaaactgcaacaggtcatgaatctaccactgtcaaacactcaggatacctctggtacatacaatatgatgactgtaatggaaatgagggagcatggcagtatccacttatagcaataatatagtaggttatatcaaatacacaaagcttaatatacacatacatatgtatgtatatcagacaaatagaaatagcagctctaatgttctctacttgcatcctttgtgtccgtatgcaccccaggggcatgttcgcccaccctggagactaccgttttaagagatgggccacaaagggggcatgtgagccacagtctcctcttttccagggttcttgattagcagctcctcctctgttgatcctaaagagctccagtagaagttctctcttctcaaagagagtgggacctttccctcaaggtcctctaaccccactgagcccacgattcctatgatattccaaagagagaagaatctcaggaccatatactctcacctgaagatgactcagaaatccccaaatacacgtgtgtggctggtgcccagcgctagctaacataaaactcagtatttccttttgattgtcatgttaaaaaatatgtcataggaaaatattttccagcttcataataatttcagatgagccacatagcagtctgcaagtaattaaatctgcaattgaggaagcttatcaaatacattcagatttcaaagtgagaacgctatacatgcaaattgaaatgcgccagccccttcacatatggcggactgcttctgagtcctctgaaaaagaaatgtctatttcatgagacaatctgagcctcacaaaccggtttgttccttccctcacatacttcatacctttgcttttgctcaggaagagcagggacttgttttttgctgggtttttgatcttattaaaaaagcatgatatcctatacgccaaactgagtgcaaatgcgggcagaaaatcacgctgtgttttgctccaacaggcaatgctcctgacagctgtaaagtggatgggtgcatcctgacaactcaggaagaagaagccgtgatcaggcaaaagtggattctcccggcccacaagtggaaaccactgcttccagtgaccaaggttcgtgtggcatgttattcggatccagcactcagactgtgctatttccctaagattctcttttgaaggattaggatacgctccaaagtttctgctcagtttaatggtaaaacgaatgaggtttaaaacccctatctgcaaactttaagaagaaaggctctatttctctccacttttgtatttccaaattttattagaacaaaattgttaaatgttcagaatacatacgtggaaacatgtctctgcatcatgtttaactttgtagaaggggcgactagcacatttaaagctctaatggcgtgtccacctgcaggatggatgctctgagatattccacaagtgtcttctttgatttagaaagagggtcaggctagaggtgagagctgctcccatgtaaagataggaaataatctccgggagagaccaagatggtctcttccttcattttcttatcaatttgcttatgtataatcaactattagaaacaactgatgggcatttaggttgcccatcaattgtttattggggcctgcttattcatgtattatttgggcatcctatccctactagcagattttcatggaaagcccaattatcatcaattaataacttattttaaagccccttcggttaagtctaagccaaaggtttgcccgggccgtgggctcattcggccacacatgtcctgttaacagactaggacctctgcatctgcttgcttttcagttgtctcccaaccaaagtcatctgttcgatagcctgaccctagagctccaagatgtcatcactcacgccaggctcaccatcgtccccgacgggggagtgagccgccttcggctccggggcttccccagctccatctgcctcctgaggccccgggagaagcccatgttgaagttctcggtgagcttcaaagcaaacccttaacacacacaaagccccggtgtcggacacacagcagtaatttcccagtcatagtcttcttttcaaatgttttgaacacctggtgatttaataaagtggtcgtctcacaa

SEQ ID NO: 703 - DNA, 57528 bp, Homo sapiens
gcagccctcggcagacggccaatggcggcggtgctcggggcgctcggggcgacgcggcgcttgttggcggcgctgcgaggccagagcctagggctagcggccatggtgagtgcacagcggccgcgtgggtgggggtccggggtcggggggcggtgcgaggcccggcggcgtcggctgagggaccagcgggactggggcgaacccggcgtgggccgagccttggagctcgggcgtcgggtcaccgcgtcccgggactgaccacctgtccggtgcgccgctcagagaccggggtggccgcagcctccgccacttgcccttgactttacacttccgccgaagcctacgaacttgccaaccggaaacaaatgggaacgaattttgttcagcaactacaaaaggcagatgtgaaaagtagttgcagaacaattcggtgcccgctgccgctcgttgtgctgaggacgaacggcgctgcgggcctggctccctatggcggctccctgctcgcgcttcactccaaggggaacccacagaggttttggaggagttattaataaattgtcttttttggtgacatattgacttttctttccttttccaaggggccgtcagttttcctgctgtagaaattaatattttggagtaaatggagggaaagttttaacatgcagcaccacctagtggaaaagtggtgcgttaaactcaccatctcattttaagttgcattttaaccgcccatttcagtttgaaatgttttgttttgttttgttttttcgacacggagtctcgctgtatcgccgagcccggagtggagtggcgcgatctcggctcactgcaacctccatctcctgggttcacgctattctcctgcctcaccctcccgagtagctgcgattacaggcgcgtgccatttcgcccaggtaattttttatatttttagtagagaggggttttcgccatgttggccaggctagtctcgaactcctgacctcaggtgatctacctgcctcggcctcccaaagtgctgggattacaggcgcgagccactgcgcctggcctgaaattctttaatagaagaatttttttttttttttttttttttttttgagaaggagaatcacgccgtcacccaggctggagtgcagtggcgcgatctcggcgtattgcaagctccgcctcccgggttcacgccattttcctgcctcagcctcccgagtagctgggacaacaggcgcccgtcgccacgcccggctaatttttttgtatttttagtagaggcggggtttcaccgtgttagccaggatggtctcgatctcctgacctcgtcatccaccctcctcggcctcccaaagtgctgtaatagaagaaatttaaaatagctcgaagacggaggaagataggcactccgccgcttcttgtccacgaaggggagaacacaagttgagtgcctactgtcacctaggcgtgtcttcaggcgtactctgccccaggtgctagtgatccagtaagattagggtgttctgggaaggaatgagtcaacagacatgatttgagcgctgccccatgccaggctcaatgctaggtaccctcacattcaagatctgtaatctaagcctttcaaaaaatcttggcaggtagatattataatatccccactacagacagaaggatcccggaattcagaaaagcggagtttagtatcccacagctaaaagtaacaaagttaggccttagatctagtttactctcttcaaatcctagcctaccccccatcccctgaaaaaattaagcccaccaccaagggttctgctgtgaatgtgccctcatgggggcctttgatgttatgtagatgaagtggctccatttcccagtcctgggtgtggtccctgctgctgggcaggtgtctgttgtgggcataaagtgcataccactgatcttagcggggatgtggatggtccagcactcagagaaaacagctcagtgtgttctacagactccaggttcctgccttattacaggcagcatgtttaatggttttctttgcagctactcagtgtggacacacataattctgtttcttttccaaaattctctgagttgacaaaataagtgtttaataagaatttcagaattctttctttttttttgagacggagtctcgctctgttgcccagactggagtgcagtggtgcggtcttggcgcactgcaactttgcctcctgggttcaagcgattctcctgcctcagcctcctgagtagctgagactataggcgcgtgccaccacgcttggctaatttttgtatttttagtagagacgggtttcaccatcttggccaggctggcctcgaactcctgaccttgtgatctgctcgcctcggcctcccaaagtgctgggattacaggcatgagccaccacgcctggccaagaattttagatttcttatgatagatgtatgtgtaagtttttcagaactgtcactggaaaactgatgaatgaatctcttttgattttttttttttaattgagtcggagtttcactctgttgcccaggctggagtgcagtggcacgatctcggctcactgcaacctctatcatccgggttcaaatgattctccttcctcagcctcctgagtagcagggactacaggcgcctgccaccacgcccagctaattttttgtatttttagtagagatggggtttcaccatcttggccaggctggtcttgaactcctgccctcgtgatccacccacctcggcctcccaaagtgctgggattacaggtgtgagccaccacgcccggacttttttttttttttttaagagacagggtctcactctgttgcccaggctggaatgcagtggtgatcatagctcactgcagcctcagtcatctggtctcaagtgatcctcccacctcagcctcccaagtagctgagactatggacatggtccaccacacccggctattttttaaaatttttttgtagagacgaggtctcattgcgttgcccaggctagtcttcaactcctggcctaaaatgatcctcccacctcagcttcccaaagtgccaggattacagatgtgagccactgtgcccagccctagtaaatgtttttttttttttttttgagacagagtttcactctgttgcccaggctggatggctgggattacaggcgtgtgccaccatgcccaactaatctagtaagtggtttttaacaacaagcttttgcatatttttgtttaattaaaaagtattctctgctgggcacagtggctcacgcctgtaatcccagcactttgggaggctaaggtgggcggatccctcgaggtcaggagtttgcaactagcctagccaacatgtgaaaccctgtctctactaaaaatacaaaatgttagctgggcgtggtggcatgcacctgtaatcacagctactcaggaggctgaggcagaagagtcgcttgaacctgggaggcagaggttgcagtgagctgagatcacaccactgcactccagcctgggtgacagagcaagacttggtctcaaaaaaaaaaaaaaaaaaggtactctcattctttccttttgttagttgtggggaagaatagccgacctagcaaagaagaaaaactagaaaactgatttattagtatttttttcttcatagaaaaagttgtctaaaggtaaaatctttttcctctcttaatattagtgataaatgattttgggatttctgaagtgggagtgagttgcagcttaatggcagagaatccagggaatgcagcttagcccacagttgccctttgatgaggagccttcactaatgttcatctttctgggtgacagcctctctctcacctgagcctacagtaactctgcaagtaggtaaggcaagaagtattgcctggaatgagaaccctgctttcctgacttctagtcaagtgtccatatcttctctctggccctgatgtttaaagttatttcagttaaaaaaccaatagcatgggaagtgtgggcctgttaaccaacagaacctggctttgtgaatgtcatccccaggatgcgtagaaacaggccagacagtgcacacaagtgctttggactgggcagtactctggccaaactatggagagagtttgtctgactggtgctctgagaagagggcttcataaacccaccccactgaggccagggctttttacctgtagtccagaggatctgtggacccccagaagttagataaaatcctatgtaaatgtgcatttgtttttccccatccggggattggttttcattagatgtgacaggagatggtaattccaaatagttaaaaccatctttcattcctttgttctcaaaagacagaccaaaacaaggctggctctgtacaaaataagctgtctctatggtatgttccctctggcccccttactgctgcctcaaacgtcacagttcagcttctctggcttattagagatataacagagagtagtgaaggctactgaggtgatgtagggccatccaaagagcaatagaccaggagtttggagccttgaattttaattctggtcctgccaatagacttgccacaagtcctagaattctgcagtgtccaagatggccggtggtaatagtcaatctttgttgtatctgtaataaaccacagaagggccgggcgcagtcactcatgcctgtaattccagcactttgggaggtccaggtgggcagatcacttgagctcaggaattcaaggccagcctgagcaacatggtgaaaatccctctctaccaaaaatacaaaaaattagttgggtgtggtggtgtgcacctgtagtcccagctacttgggaggctgaggtgggaggatcatttgagcccaggaggcggaggttgcagtgagctgtgattgcaccactacgctccagcctgggcgacagagcgagaccctgtctcgaaacaaccaaccaaccaaccagagaagctgaattgtgaagtttgaggcagcagtaagggagccagaggtgacatgccatggaggcagcttattttgcacagagctagccttgctttggtctctttaagagaacaaaggaatgaaagatggttagaatttgttgcctttcagacttttctacatctctgcttaaggtaaggagccataagtttgagtttgagtaaacttgtacattttcagatatgaaatgtgttctcttcatagtcatcaggtactcacaggttgactgcagaggagaggaaccaagctatacttgaccttaaagcagcaggatggtcggaattaagtgagagagatgccatctacaaagaattctccttccacaattttaatcaggtaattgttataaattcttgctagggctgtggtctattttagtcaccttaggccataacactttctgattctgccagttgtctggtcccatgtagatctaggattcaactcttcccttctttaagaattcagtgatagagtgacatccttgttgacagttgctaccacccacctgggtggtgtttagctctgggggaagagggtggtttgtgttacttggaaaacaaattctgaaaccactattgctttggtatggtgttggttaggatatgtagtttcttttgaaatttcaaataacattaaaagagagtgtaagccttttattattgattattattttttgagacagggtcttgctctgttgcccaggctggagtacagtggtatgattgtggcttactgctgcctcgacctcctgggctcaggtgatcctcccaccttagcctcctgagtagctgggactacaggcatgtgccatgcccagctaatttttgcattgtttggagaggcagggtctggctatgttgcccagactggtctcaaattcctggcctcaagcgatcctcctgccttggcctcccaatgtgctgggaatagagatatgagccactgtgcccagcctgagctttttatacttatcagaaaggggcatgaataaaactggttgaggaagatgtacctgcttgacttattttccctgactttttctgggccgttggtaatttttctttcttcctgcagttaaatttctatctctcagtcatctcccaggctgcacccttttccctgactggcttatttttctccagcccagtagccagatcctgaaccttttcttaaaacctgacctcccccttggaagtcagctttaacaaggtaactgttccattagggacccaccctgtttagagagtcatctcccatgacttaaccttcagttattacaccactgcatttgtaaaaggtaaatgcttttgactattttgtttgttcagttagtttggtaatcctttggacagatttattgtttttatttatattgggtgtcggcatctagaagtcagagaccatgtttgcttaaataactctctattgtacccaacacagttctgggtacaaacaggcatttgataaatgcagacattgattacagtgtttgctagtttctagaagggtgtgtgaggaccagatttgcaccaaagaaaccttcggcatgttttcctagtaaatgtcattggctccactgagctgcatgcccgattctgttctctatccatctggctgccagcctctgctgtgagtctccaactcctaaggaaacctggaccaagcagactccctgtccccgctgccccacgtgctcaacagctcttgttaggggcttagcacgctgtggctggtggcagggaatcccattggtacagtaagcctgtgcataagctctaggtagcattttccaagcttattaaaattcttacatatgtacagcttgacttctttaaacctggcctaatttattgggcttgaacatgtggcttaaagtactcgaatggtgttgcctcaggccctgcctatgattcagtcctccagcaccattctgaccttgcgctcagggtgactttcagcaatggtagggaagcatactggattgattgtaacattattcactggggcatttaattaagtagactttttttttcccattcacccaacttttaggaaaaagaggcagatgacaagaaaatcagctgatgtcagggaatgtattcagagaaccaacactgagattatatccgggggtcagttttcccactaggctcctatgacttctgcgtgtaccatggcctgtaatggtaactggtgtcctgacagttgtcagtgccctccagcgaaacacaactaggaacacacctacagtcgaacaagttgagcttattgcttattgctgtgagggagagtgcacaccaaagggcaccgtggggtgagcccatataggatttgggctgtggtagtgatttggggactttactctggattagatgctgtcaggaaatgggcaactctgtcatttggtattttaataaatcgtatctatagggagagtagattaaagcagtgccaaagctgaaactgaagaagaagcaatagtcactcattagctgggagaggaggatgtttggtattttgtggcttggacaatgttcatgttttgtctgtgttcaggtattgcagagtggtcttgtttttgtcttcatccatcatggtcacagagtggccttgtctggtgttgatgttgatgttcgaaaggagagcaccaaggactggttgatagtaccaggccagcgcccaggtgtcaggagttggttttctcttgctcacaactcgtgagtagagtagtgaccctctggcgctgatgggtcctcattcatctttcatttaggacagaaaagccattgttttttattgtaacaacagcataacattaaaataggatggtgtaagtaaaaaaaatttccaatcgcaactacttttatttttctctgttctcttctggtctttctccatgggtatgtttgtttgccaagtatgccagagcatgccagttatacatgtggttacatttaaaaaaattttttaaattttatcatgaaatatttattaattcaacaaagatttattaagcattttctgtgtgctaggtgctactctaagctcatacagctcccatcccagtgggaaaataaacaataaacagatgaataggaaatataatttcagctagtgatgagtaccctgaagaataaagtagggaattggagtggagggggacagaggcactcttggaggtagagtggtctggaaagtcctctctggggaggggatctctgaggcctgaataatgtgaaggagctcagcacatggtgatccaagggaagagctttccagctggagaacagcaagcacagagtttccaaagcagaatgaccttggcatgattgagccagaagcagaaggccagtgtggagtggagcaggcgaggagacgaggggaagggtcagagcatgggggccttcttggcgtggtgaggagtttggattttattctgtgaaggaaagctaatggaggatttcaggcagagaagtgtcatcctgtggctgtgttctaaaaaatcaccctggctgttctgctcagaataggcggtaggaaggtcagagtggaagcaggcagactctgtagaacactgttgcagatgtctagaccggggatgatgggggtcttatggaggtatcagtggggatggagagaaatgtagggttccacatattttgaaagtagaataatcaagacttgctgaatgattggatgtgtgataggggagggtcaaggatggcaccaaggttttggttcaagctatagtgtaaagggtagtgccactggagccatttactgagctgtggaagatggggtgcaaggtggggggcaggggtatggaggtgagaatcctgttttcacatgtcaggtttgaggtacttattagtcatccaaatggagttattgggttaggaggtgggtgtaagaggctggagttcaggctgagacagcagtttgtgagttgtcagaggggatcactgtgagagcatggtccagttaggcaggagaggacaggatcagatgggcagtggaggcacagcgatgatatgtccattgtggtttagatgccaataggccgttacattcatcctgggaaaaagagggccattctctcctgattgcttttgttttttagtgagatcatcaattgagagcaagtaggggtggaagggaagagtgttggagacctggggagataagagaaggagtggaatagtcattttggagactaagatagtgaaaaaacttgagaaacgtggctggttgctaagcagttctcagtgtcactacagatttggggtcaaacatttaaagtgaacattttgtatgttttttttcctgctgtgttccgctgctgtgcacaagctggagtagatgcagagttgggcttaacaaggactgaacttttgctaaatgaatgcaatggaggaacagagggacaagggaaaaaagggagggacagaaacgctggcccttggagtctcggcagggtagggaagtacagttgtgatggggaggtgatagtgatgagctgagagtgtcatttgacatcatctatttttttttttttcagatggagtttcactcttgtcacccagtctggagtacaatggtgcgatcttggctcactgcaacctccacctcccagattcaagtgattcttctgcctcagcctccagagtagctgggattacaggcgcccgccatcatgcccagctaattttttgtatttatagtagagatggggttttgccatgttggccaggctggtcttgaattcctgacctcaggtgatctgcccgcctcggcctaccaaagtgttgggattacaggcatgagccactgcacccagttgacatcatctttttgaagggaaattgagcaatgcctatcaacttttaaaactcacataccagagccgggcgcggtggctcacatctgtaatcccagcactttgggaagctgaggtaggtggatcacgaagtcaggagttcgagaccagcctgaccaacctggtgaaaccctgtctctaccaaaaatacaaaaattaaccaggcgtggtggcgtgcgcctgtaatcccagctactcaggaggctgagggaggagaatcgcttgaacctgggaggcggaggttgcagtgagccgagatcacaccatttcactccagcctgggtgacaaagcgagactgtgtctcaaaaaaagaaaaaaaaggacatatccattgtcctaacctagaaatttatcttctaaatattgttctgcatgtatgcaaataggatgtatggggatgtctattaaagcctgatgggcctctaattttttttttttttttttttttttttttgagacagggtctaattctgttgcccaggctggagtgcagtggtgtggtcatgactcactgcagccttgaactccctgggctcaggcgatcatcccacctcagcctcctgagtagctggtactacaggtgtgtgccaccatgcctggctaatttttgaatttttttttgcagaaagggggtttctccatgttgcccaggctggtcttgaactcctgggctcaagtgatcctcctgcctcagcctctcaaagtattggggttataggcatgagccgctgcaccaggcctctaattttttattgtgagcagccatttccatgagcatatgcacaccatggtgagaacatatctcccttgctgcaaccctgccctcagtggggtttaagggaggcctgttgtgctccatatactcatagcaatggcagcacctctcctggcctgagctctacagactggacaaagccacagtcagaactaaagacaccctctccctgaaagagtgtgacccacacttggtggtgtcatattggaaaaaaatttgggggccaggcacgatggctcacgcctgtaatcccagaactctgggaggccgagttgagtgggttgcttgagccaaggagtttgaggctagcctgggcaacacaaggagactccatctctacaaaaataaaaattagccaagagtggtggcatgcacctgtggtctcagttacatgggagggaggctagggttggagaatcatttgaacccaggaggtagaggctgcagtgagctgtgattgcactaccacactccaggctgagcgaaagtgtgagactatctcaaaaaaaaaatctttgctgaatatagggttaaaaaattcattttgtttgtattgctcaataggttatgagcatttttcagttctttagtctttttatttttaatacaattttcaggagtatgattttacttggttgggtgtcacagttaaatgatttgctaatgtagtttgtgtacagtggtatcacaagtttgctttagtcttcatttcttttgctgctatgaaaaatgaactattttggaaatatttcagtgaccgtggatgaaaaacctatttcttgaagctttgagttattccaggtttactataagaataaatagcccccaaaacacatttgaacttcttttctctcagagttttattctaaggtatggttagttccaaataatccaaattcattggatagctcagatggatacaaatacttggagattataagtacggagttttcaagggattctcctagcataggtggatgaagtagccataggtgtcagttgctgttagcctcctgtttccacccttggtggtggtacatgggctctgcagtgcgtcaatggacagtatgttggtgacagacagtgactctgtgagcagacagagcatggcagtggtgggactcgaggcagggagtttccacactaggagtgcttggacccagacagggtgggattggcatttgtaaaggaactttgcttttttgttgttcctgtagacagaaggtgggagaggtctgcaagtgacatataaacttaggtgtttggtaactgcaggatgtctgtgttgaaagaacaaaatgtcaggtagaaatgtgggtgtgagagtcccataaagacagattttgttatgcattgacatgtatgggatgaactggaagcttacaaaatccgaggagattttaagtttaaaagtaggtgcagaaggtgaggctttggaacctaggaaatagctactacaggtgccagcaggtggagccctccagggcaggagcccagccgggccaggcggcaacacccctttctgccccccagaaggctgtccctgttctttcacttctgaatacctggggctacccttgttcagcatggaaataagctcaggatcaggaacaggtaagcggcagtggctgggcgcttgggtgaatgataaattttgtgtgtaggacatgaggagtttccaatggtgattcaggaggaagggaccaagctttgtgagaatcagcggtggttctctgcggaggagctcctgggccctgtctgtgctttcttcggtgggcctgcccagcagggcattcagtcatattggatggaatcatatgagctggttgatattcagggcaaagtccaagctttattggttttgtatcttgttcatcaccctcaccttttggttgctgtgctgctgccactgaagctttctggagctgcagcgggagggaggaggagttctctgggtgcccaggctgggttggtggtgctctgcacatcctagcagcagtagcaccatatgtgactttggggttcgtaaaatgtttcttttcctgtgtccacagagactcctgtgtagagcagttcaaagttacttttgctgccttactttataaaaatgttttattgaggaatttgataataggcttatggtgaacattttgaaacacttagtgaagtcaaaggcttgatgataccagaagaaagacaactgctgatgaaagtcttaacaatcctccacagaatattggtggaagtctcgatagctctcattgtgaatgaattagtttgggtttgattgttctttgttgtgcacatcaaagttatgagtgagtaatgcatctgtgcactctttaaagaggatattctacctgtggaggatagggaagcactcccaaagaggatgcctgtggcctgggcatcatataggttagaaaatgtcattttgtgctgggcatggtggctcacacctgtaatcccagcactttgggaggccgaagcaggcgggtcaccagaggtcaggagttcgacaccagcctggccaaaatggcgaaaccccttctctactaaaaatacaaaaatcagctgggcgtggtagaaggtgcctgtaataccagctacttgggaggctgaggcaggagaatggcttgaacccgggaggcggaggttgcagtgagcagagatcacggcactgcactccagcctgggcgacagagtactccatctcaaaaaataaaataaaataaaaattaaaaaatgtcgttttgatttgaaagtataagctagtgtttgtgtgtctggcaccaggtaaagtgaaaactcgtatggctgtcacacacactgttgcatttaacatgtgctcatgattggctttgtaaccacagcagactagaaacctgagaaagtgttcatagttttcattggaatagaatagagacactcatattttagcaaactttacctaaagtgtgagaagctagtaaaaatatctgtgtagtgttcatgttggtgttccctttggagttcttcctgagcaggaccacgctgatgctcccaggaggtggctagaatgtcagtgttggcgtccaccagggtagggaaataagagcctgaaatgttatcatttggagctttgttgctgctgattgtgtcgtacagtaggtctagacctggcgtgtatttgtaaaagcgcatgcaacagatagatgaggagaaatgtaaaacaggtgtcaacaatgcaaatatgacaccacactgcagtgtgaaaacaccatggtccttacaccaccctttaataaaaatggacttttaactgcataatttgctcttagtcatgtagtaaatcttctgtttacagaacttagcctgagtattttgttaaagtcaagcagccaagaagtataatttcctcaacagtctttgtcttgcccttttacagatggagtaaaatcaggtgtgtaaaaaataaaaaagcagtttgagctgacgtgaaaggtatttcagatttatgctttgcagatgatattggtatgattaatgcattcattgcttttttttattgcttttcacagataatgtacatgatgcatggaaaatgttgtgggtttaaatctgtgccaggtttagactgtgaatatcaacagatgttatcatataagtaccataattattataaaataaaaaatttgtcatgaaatgcagtgacataaatttcatttatgtaaattgctttcattagtataaaaccttagtgtagctgttagggtctgtgaagcactttagatgagattaacttggtataaagtggtcacaaatgggttgctttaaatttaactgacaagaaaataacacccaaaacttaggaaattgctgaggcatttgcctgcattgctggtaccgcttaaataggttgactgtgaattaataacaatagactgctggctcaataattgcagaaaataattgaaaggagaccttaaataataacttaaaagtattttggtcttgctcatttctgttctgtttctgtttttcgttagtatgcctgcccaccgcttcagtactgccattatcaatagctttcgggtttgcactgcagttttgtccatagttgtggtgctttagggccatgacacagaacttgcatttagatgtgtcagaatacaaatattgggtgcctgatggagcagctgtagtggctgagcagtgctgcactcacattcctgtggctgggtagcggccagttgctttctgccctcaggagggattcggtccagcggtgtgggcaggtggctgaggttcttcttcctggctttgagctctccatgttttgctctttttcttacatccttttaaacaaaacaaagcagtaatattctctcccctgtgttgcagagaattactattatgttgcgcttttgatctaggttagagtggggcattctgactcatttactgaatttcgcagaaagacactaaacaagattgagatcatggaattacttgtggtcatactgggtcatgtcacagttaccagatgcaagactcacatccctggttcccacagcaacatttttagatcctactgtgacatagaaaggttgtttttttgattttgttgttttaggcgagatcttgttttccaaggactacttgctggattagttttctcccttaaatgggttttaccatacttcccagaggaagggaatattcgccagctgaaacaaacaaagctgtacttgtttgggagtagcccaggtatcactgttgagcaatcaaaggtcatttaattgtatcattaaaatcaatcctatcaaaacagcaaatgctgctaatgactctgtttgcttgtgtgctctctgccaacagggcaggatggaggcttttttttttttttgagacggagtctcgctctgtcggctaggctggagtgcaatggtgtgatcttggctcactgcaacctccacctcctaggttcaagcgattctcccacctcagcctctcaagtagctgggattagaggcacctgccaccaagcctggctaattttttgtatttttagtagagatggtgtttcaccaacatggccaacatggccaggctgtacttgaactcctgagctcaagtgatccgcccgccttggcctcccaaagtgttgggaatacaggcgttgagcccagctgctgaggctttttgctatatcatacatcaaactgacttcaagtgccctgtcctcgccatcgcagccctgtcggtggacatgcaccaggtgggtggagcagccccaggctggctgggccaggagtcacatggtgtggttctgtcaggattcgtgaacccagcagagctgttgggcttatatccactgaggggctagtgctggtctggatccaagaggtggaaggaggaagatgcaacagaaggacctggtttcgtttctgcccagaagatctcctagttttgctggggaggtggcacatctgaattgtacaaggtgattgatttttttcagcttaccatgttagtcaggtactagaatgtgaagtgctgtgctaataagccacaggaggtgcacttcagggtggctgctgcctggagaaggggagttttgagttggttcttgaagatctggtatgtggttgtaagggaaggcactaagggaggggttagcaggtgacataggtctaggacagggagtaagaggacatactttgtctgcagtgtgttgggaaataagggccctaaaatgggttcagtgagctgggccacagagtacaggggggttcctgtggcgtactctcctggggtagctttcccaccagtttagggtgtctgaaagcaaactcttgtctctctaactgtccttcaaatggcttgttcctctcagtagccacaccagcatcctctcaagcacctagacctgaaacggaagaattatcctggtgatttgttaccaagaactggtcagtcgtcctgtagtgcctttcacaggactgtgctgctggcctggatacagctgccttccctctagagttctggtaggagcttcctggccacatgttacctttaggctcttcctgcttccactggcctgcgtgccactttgtcatgaccaagttggtctctgctcagataatctcactgccttccaattatattttatagggcatgcttcatcttctcagaggttttcaaagctgcccacagcccagccctaagcctacctcgcattactctgcaagaagcctctttgctcagagattagaactgcaatgttcatgagaggtcacctactcatccctttcactgaagaagtggggaaaacaaggctcagacagggtgagtaccttgaccaaggccacaaaaattagtgtccatgcaggaattggaaccaaggcccttttcatctcagttcagtggtttttttgtttttgttttgttttgtttttagagatggggtcttgttcggtcacccaggttgcagcctggaactcctgggctcaagcgatcctcctgcctcagtctcttgtgtagctgggattacaggtgtgagccaccacacccagctcctcagttcagttcttttcttcctttattcaaactgttcttctcctttccatgccccatctcacactatcctgccccttctgttcacatcccacctatttctagaaagtttttcttgatttttatgcacttaacaataaacagttatcaaacacttactgtaggctagacactatgccagacactggggtatcagttaacaaagccgatactgtccttatcctcacagagcatacagtatagtgggggagggagaatgtaaacaaagaaaaaagttaatgtatcattacaagttatgctaagtgccaggaaggaaaatctttttttttttttttttgagacggagtctcgctctgtcacccaggctggagtgcagtggcgtgatctgggctcactgcaagctccgcctcctgggttcacgctattctcctgcctcagcctcccgagtagctgggattacaggtgcccgccaccacgcccagctaattttttgtatttatttatttatttttttagtagacacggggtttcaccgtgttagccaggatggtctcgatctcctgacctcgtgatccacccacctccgcctcccaaagtgctgggattacaggcgtgagccacctgcccggccctaggaaggaaaatcttaacagcaaatggttagtgaacacttaaactatgggtcatggcactatgggaaggactttacatgtattcattcatttaatcttcacagaactctgtgaaatagatttcccaaattttacagaggaggaaactgagacttgctaagtgacttgcccaaggtctcacagctagtaagtgtggagtcaggattggattccaggcaatccatactgttagtggctcagatactgcctctgcatcagaaaggagtgctgtgagagagaataatgggaagacctaattctctttgaggagcatggttagggaaggcctaaccatggtgagaatagtgttaacgtcattagggtgagaagaaagagaaataagccgaggatgtctttgattgtgtagtaggggtggaaggtgattttgtcggaatgggaggtgattcctagggggttgtttgatcctgtttcgtgtaggaatagaaggtggagcgctgctagggctgtgataatgaagggcaagataaagtgaaaggtaaagaaccgtgtgagggtgggactatctactgagtagcctcctcagattcattggaccagatctgttccgatgtatgggacggcggatagcaggtttgtaattactgtggcccctcagaaggatatttggcctcatgggaggacatagcccatgaaggctgttgctatagttgtaagtaggaggatgatgccaatgtttcaggtttctaggtaaagaaatgagccgtaatataggcctcggccgatgtgtaggaagaggcagatgaagaatattgaggcgccattggcgtgaaggtagcggatgattcagccataatttacgtctcgggtgatatgggcgatcgatgagaaggcggttgaagcgtctggtgagtagtgtatggctaggaatagtcctgtggtgatttggaggattaggcaggcaccaagaagtgagccgaagtttcatcatgcggagatattggatggggtggggaggtcgataaatgagcggttaattaattttatcaaggggttaattttgcgtattggggtcattagtgttcttgtagttgaaatacaatgatggtttttcatatcattggtcgtggttgtagcccgtgcaagaataatgatgtatgctttatttctgttgagtgtgggtttagtaatggggtttgtggggttttcttctaagccttctcctatttatgggggtttagtattgattgttagtggtgtgattgggtgtgttattattctgaattacgggggaggttacatgggtttaatggtttttttaatttatttggggggaatgatggttgtttttggatatactacagcggtggctattgaggagtatcctgaggcatgggggtcaggggttgaggtcttggtaagtgttttagtggggttggtgatggaagtaggattagtgttatgggtgaaagagtatgatggggtggtggttgtggtaaattttaatagtgtgggaagttgaataatttatgaaggagaagggtcagggctgattcgggaggatcctattggtgcgggggctttgtatgattatgggcgttgattagtagtagttactggttgaacattgtttgttggtgtgtatattgtactagagattgctcgggggaatagattatgtgattaggagtagggttaggatgagtgggaagaagaaagagaggaaataaagtttgattatgcctttttgggttgaggtgatgatggaggcggagatttggtgttgtgagattgttttaggtagtagcttttctagtcaggccaggtctaggaggagtaggggtaggttttggcttgtaagaaggcctagataagggactgtgcggtgtatgatactagggtaaaatccgagtatattagagaagtaaaatgtatacagtggggattttattttgagtttgttggttaggtagttgagatctagggctgttagaagtcctagggaagtgacgcctagggctgtgagttttaagtaaagtgggattgtcatttggggggtggatgtggggagaatgctgttggtgatgagaaaccctgcaaataggcttccgattgttaggcgtttaatggggtttagtagggtggggttgttttcgttaatgttagtgagggctgggaagcgaggctgacctgttagggtgagaagaattattcgagtgctataggcgcttgtcagggaggtggcgatgagagtaatagacagggctcaggcgtttgtgtatgatatgtttgcggtttcgatgatgtggtctttggagtagaaacctgtgaggaagggtattcctgccaatgctaggttgccaatggtgagggaggttgaagtaagaggtatggttttgagtagtcctcctatttttcgaatatcttgttcattgttgaggttgtggatgatggatccggagcatataaatagtatggctttgaagaaggcgtgggtacagatgtgcaggaatgctaggtgtggttggttgatgccgattgtgactattataagtcctagttggcttgaagtggagaaggccacgatttttttgatgtcattttgtgtaagggcgcagactgctgcgaacagagtggtgatagcgcctaggcatagtgtgagagtttggattagtgggttattctctgctagggggtggaagcggatgagtaggaagactcctgctacaactatagtgcttgagtggagtagggctgagacaggggtggggccttctatggctgaggggagtcaggggtgaaggcctaattgagctgatttgcctgctgctgctaggaggaagcctagtagtggggtgaggcttggattagcacttaggagggttatttgttgtgggtctcatgagttggagtgtaggagaaatcatgctagggcaaggatgaaaccgatgtcgccgatacggttgtataggattgcttgaatagctgctgtgttggcatctgctcgggcgtatcatcaactaatgagtaaaaaggatataattcctacgccttctcagccgatgaatagctggaataggttgttagcagtgactaggattagtatggtgattaggaagatgagtaggtatttgaagaattgattaatgtttgggtctgagcttatatatcatagtgagaattctatgatggatcacgtaacgaacagtgctacagggataaatattatggagaaataatctagtttgaagcttagggagagttgggttgtttgggttgttgcccagtgtcagtttgagataatgacttcttggtctaggtatatgaatattgttgtggggaagagactaataacaagggtggatgcgataatggattttacttaatggggatatgagttttttttattagggttaatgagggtggtaaggatagggggaattaaggaagttagggctagggtgggtatagtagcgtacatggttattacttttatttggagttgcaccaaaatttttggggcctaagaccaacggatggctgttatcctttaaaagttgagaaagccatgttgttagacatggggatatgagttagcagttcttatgcgctttctcggtaaataaggggtcgtgagcctctgttgtcagattcacaatctgatgttttggttaaactatatttacaggaggaaaacccggtaatgatatcggggttgagggataggaggaggataggggataggtgtatgaacatgagagtgttttctcgtgtgaatgagggttttatgttgttaatgtggtggctgagcgagcctcattgtgttgtggtaaatatgtagagggagtatagggctgtgattagtatgttgagtcctgtaagtaggagagtgatatttgatcaggagaatgtggttactagcacagagagttctcctagtaggttaatagtggggggtaaggcgagattagtgaggcttgctagaagtcatcaaaaggctattagtgggagtagggtttgaagtccttgagagagaattatgatgcgactgtgggtacgttcgtagtttgagtttgctaggcagaatagtaatgaggatgtaagtccgtgggcgactatgagaatgactgcgccggtgaagcttcagggggtttggatgaggatggctgttactacgagggctatgtggctgattgaagagtatgcaatgagcgattttaggtctgtttgtcgcaggcagatggagcttgttataattatgcctcacagggatagtacaaggaaggggtaggctatatgttttgtcagggggttgagaatgagtgtgaggcgtattataccatagccgcctaattttaagagtactgcagcaagtactattgacccagcgatgggggcttcgacatgggctttagggagccataggtggagaccgtaaagaggtatttttactataaaagctattgtgtacgctagccatattaagttattggctcaggagtttgatagttcttgggcagtaagagtgagtaatagaatattcagtgagcctagggtgttgtgggtgtagattagtgcgatgagtagggggagggagcctactagggtgtagaataggaagtatgtacctgcgttcaggcgttctggttggttgcctcatcgggtgatgatagccagggtggggataagtgtggtttcgaagaagatataaaatatgattagttctatggctgtgaatgtcataattaaggagatttgtagggagattagtatagagaggtagagtttttttcgtgatagtggttcattggataagtggcgttggcttgccatgattgtgaggggcaggagtcaggtagttagtattaggaggggggtcgttagggggtcggaggagaaggataaggagcagctaaataggttgttgttgatttggttgaaaaatagtagggggatggtgctaataattaggctgtgagtggttgtgttgattcaaattatgtgttttttggagagtcatgtcagtggtagtaatataattgttgggacaattagttttagcattggagtaggcttaggttatgtacgtagtctaggccatacgtgttggagattgagactagtagggctaggcctactgctgccttgcaggcagcaaagactagtatggcgataggtacaatattggctaagagggagtgggtgttgagggttatgagagtggctataatgaatagtgatagtattattccttctaggcatagtagggaggatatcaggtgtgagcgatatactagtattcctagaagtgagatggtaaattctagtataatatttatgtaaatgagaggcatttggtaaatatgattatcataatttaatgagtcgaaatcattcgttttgtttgaactatataccaattcggctcagtctaaccctttttataatcattcgtaggccagacttagggctaggatgatgattaataagagggacgatgtgactattagtggtaagttagttgtttgtagggctcatggcaagggtaaaaggagtgaagggtattaagaatgacttccaggctgggcgcggtggctcacgcctgtaatcctagcactttgggaggccaagacaggcagatcacgagatcaggagattgagaccatcctggctaacgtggtgaaaccccgtctctactaaaaatacaaaaaaattagccaggcgtggtggcgggcgcctgtagtcccagctacttgggaggctgaggcaggagaatggtgtaaacccgggaggcagagcttgcagtaagccaagatcgtgccactccagcctaggcaacatgactcccagatttcgggcctggaggaaaggaggaaataggtggctggaagtgatatttactgagctggggaagtgtgggagaggaatgggtttgggatgcagggatcaagatttctggtttggacactgtttaaggagtgctgtgagacatccaaatgtcaacttccagaaaatttatgtctgaattagaaagccagaggtgaggtctgggttggagataattggagaatcataggtatttatggaaaaaagccaaggtaatagatgagatgactcaagaagaaattatagtgtgagaagagaggatggctcaggacttggtccatttaggggtgagttagaagaggaggagttggcaaagacaagaaagatttgttagataaatggaaaaaggctgttggctcttgcctgtaatcccagcattttgggaggccaaggcgggagaattgcttgaggccaggagtttgaggctgcagtgagctatgattgtgctactgcactgcaacctgggtaatagagcgagaccttgtctcaaaaaaaaaaaaaaaaaagggaagaaaatcaggtcaatgtcatgtcacagaatccaaaagaagatggtgtttcaaaaggagggaagtatgaattctgctgagacaccaagtaagatgagtaccaggggatgcccattggaggaagcagcatggaggacatcagtgaccgtagcaaagttggtttcggtgggtggggcacaggacagcctggagaggaggtggagatcttatgctttatacagacctggtagtctcagacattagtctgttgtcttttctttccatttagaattcattcctagacttatacttgtttgtggtgttctttcagacttattttttaaattaaaaacattgtttttagagatggggtcttcctctgtcatctagccttgagtacagtggtgtgatcatagctcactgcagtctccaactcctgggctcaagtgatccgcctgcctcagcctcccaagtagcttggactacaggcacatgccaccatgcctggctaatttttaaaacattttttgtagagacaaggtctcgctatgttgcctaagttggtcttgaaatcctgacctcaacagtcctcccaccccaccctctcaaagtattgggattacaggcatgagccatcgttcccagcccagccttgttttgatattaattaagcatcttagagctttgatatagggcctatcaatattagagctagaaaggatggggcaactgaagcccaggggtaatgtagtttgcccagggtgacaacgaactagtggcaaagttaggacaagactaaatgcaacttagattatgaacagggtcatgtaactgtttactcatgtctctctccagctaaggtataagcagcttgaggacagagacttggattgtacctgtgtacatctcccatagtacctagcccagggttacctagttgtattttgaatgcatgagggcccatgattaggttccccatgggtgatcctagtcagtgcacttagtcccaggggaacatagtgtttcatctttttgttccctgtaggatacatacaaccctttctcaccagggacttttcctctccctcatctccttactcctagatatcgatgattcctaatggtgaccagcttatctggctgctaagttgctgtgtctgagagatgagagagggtgctctgcattgccacagggtgcttcccagaacagcagcattgattgtgcctttgttctgcatgcagtactgagacatcagagaagaaaatggctgctcatggtgtctctagtcagttgtctccaaccatgagagagactaagactggcattcagtattttagcaccacggtttcagccacccacaactacagccacaatcggatgagaatattgatgtcctgagggccagtggcagatactcgaccaaataccacactgggaggctgccacaggcctgttcgctggctatccattaggcattcatttctgtttcaagacaattctttaatctcaaattctttctttccctttccttttctgtgaccactggtccagcgttcttggctgatttttctttttctttttgttttttgagacagagtcttgctctgttgcccacgctggaatgcagtggcatgatcgtggctcactgcaaccttcacctcccaggttcacgccattctcccacctcagcctaccgagtagctgggactacaggcacccaccaccatgcccggctaatttttttttatttttagtaaagacagggtttcaccgtgttagccaggatggtctcgatctcctgacctcgtaatctgcctgccttggcctcccagcactttggccaccgcgccggccttctttttcttttttttgaatcataacttggtggtgtgctataaagaaaagctaaaatatattggcagtaatttgaggaattaattttagaaatttggatataaaaatgttgctttaaggtcattctgtacacaggtaactcttaatattgcatcatttacctgaaatgcagccaaatcagttttctttgtgacagattagagggttacaaagtattttatgaactaatgagtgtttgagtgtctattgggtatagtagctcattgttaggtgacctatgaactaacataggttgtttcattgaagcttcccagaagcctcctaaggttaggtgttcgtattcccattttgctaatggtggaaaagtcagggaagttaaagagcttgctcaaacttccagaggaagtgggcagtgggaccatcattccaaggccagatatcccaccctaaggtgactgctcttctcttaacacaagtctgtattttgaagaattgtagaataacaaaggatatggattgcagttttgtttaggaatgtcttagagctttgaatgggcaactctgctattcagaattgaatctgttctgtttaggaagaaatgtttattttggagtgcttaaaggaggcgtatgttatttgcatgttttgaagaaaaagattgccagctactgaaaggaatttgacttgtaaattgctacatggttccctatgccctaccctgaaagcattagtttataatactggattgatcaatgatcagttctaagtctgttacagattggaggtgagcatctatctagaggggaaagtcacttccagataggtctgcagagagcagctgaaaactttatttggagaagtggaactctgcatacagaagataaacatcgaagccactaaccgtatagctgtggatacagatgcatagaagagagggccattttaattctgagtttctttaaacaatttttttttgtttctttttattattttttaagagatggggtctctgttgcttagattggagtgcagcgacgtgatcgtagcttactgtagcctcaaattactgggctcaagcgatcctcctacctccgcctcctgagtagctgggactatagatgcatgccacattgcctggctaatttttttttttatttgagttgtagtcttgctctgtcacccaggctggaatgcagtggtgcgatctcagctcactgcaacctccgtctcctgggttcaagcaattctcctgcttcagcctctcaagtagctgggattacagggatgcgccaccacgctcagctaatttttgtatttttagtagcaacatggattcaccatgttggccaggctggtcttgaactcctgacctcaagtgatcccccctgccttctcaggcagggattatagatgtgagccaccatgcccacccctggcaaattttttaattttacttttttttgtggagatgggatctcactatgttgcccaggctggtcttgaattcctggcctcaagcgatcctcccatcttggcctcccaaagtgctgtgattacaggcgagagtcaccacacctggccaattcggagtttcttaaactatgattctgttatgtaagcttgtgggtgagtctcttccatttttctatgtgtttaaaactgtgagctttaaatagaagggtttaacatttataggtcactcatactccacagagatccacatccaccaggcctctcattctaataggaatgataccctcctgttaacatttgagtggcatgttcagctggtaaataaatttttttttatgattgcataatatgttttataatttggaaaacagaaaagtataaagaagaaaaatatacctgtaatctttctgctcacttaaaaacgctgtgaatgtgcatttgtgtgaatgtttatgtatgtatatatatttgggatcatattatagatatttttggtcagttgcttctttcatttcatgtatagtgaatattttcacatcagtaaaatattttacctcatgattttttgttttgttttttgagacagggtctcactgtgtcacctatgcaggattcagtagtgccatcttggctcactgcagcctctatcttctgggctcagatgatcctcctacctcagcctcctgagtagctgggactacaggcatgcgccaccacacccggctaatttttgtattttttgtagagactgggttttgccatattgcgcaggctggtcttgaactcctgggttcaagcagtccacccacctcagcctcccaaagttctgggactgtaggcatgagccactgcagctggcttaccacacgattttgaatggtgggagatatataaattattccattgaacaaaaaagccatatttaatttagccaatccctttctacggtaaccatcctcacagaagaggctttgtgagcccaccttttctaaatgctccgtattaatgctgtcagttggacacaaaagtgtcagggagctgtactgggtagttcttgctaaatatactcaggatctccatgcccattgagatcaggaatagatccagtcacctgttaaaaaagtaaatagaaatcatcacctagatagaattgatccattgaagctaaaaaatcaagcccttcaagttacttgagacagccagaaggaaaatgttatgttatagggctttgtagccaccattctcacagcttagtgcaatggtgtaggaaatattttcacagaaatatttctcttttagagagttttttcggataaagaaggcttgtttaattcaggaagagttatttcataggaaattaaatctttgtaaatcctctatcacatttccacacttgctagttctgtggcaaatgatggctttcgagtggttcaggaagggtttcctgaaagcaaacaattccatgttttatacatatttgtgtttttatttttgaattggataagtaagggacatgtactttcccctttgtatttgtctctgggtgatattgctggttctcaaactcagaatggtaattaattacttataatgattttaaaaaaaaaaatttcacttggtgaaaatgttttcttgggcccgatgaatgaccccaaagaacttttacaacacaaccagtaatgttgggcaggtgctggagagtggctgctgcttagagatcagtaattgttacatcatggtttggtatgctccgtggtgtctaatcaggtcgtgtgcttgggaaccatgaaataattctcttttcaagtcttagtgcatcattttttctgacattgatcaaagattggaaaactagtattatatttgtagccacggtattcataactgtcttacattcttaatctttcggctttttggttgaaatacatctatgcctcttaaatattgaaggcataatatcctttaacctacaactgcagagttaaaatgaattttatgtgaaatatttagttgtggaccacatcttcagctttttatatgccacagtggtcttgtttttttcccttccattgtctgatagtgaggtcattttcagtcctctgagaaattctattcccagccagatgcggctcatatattaaaagtagcacctgtggctaatatcacagcagcttaccataaatttacatggtaactaggattatatctgtcaagactgttaaaaaacatctagatttaatttgatttccagtattgtagaagctatccaacattttgcttcataactatattttaaaagttaaaaatcactccattgttaagttttatagcactcctagtgcccattaagttgatttgttcaatggaggtcagagtaaagcaacttggctacattaagatcggaaaccaacccatttgtgacaaatttagtcctttcgtgtgaatcttctcaatgtttctgcactgattggattcaggtgtagcttatgtcagtagcatttaacctcaaaagaatgagcaatctgattgggttgttgtaaattatgaagcattttgcttttgctggtttaaatgtaactgttgactctgctgcccgtgcctgactgcgccactgcatctgcctaaacaggagtggtttgggtttgaagacatcttagaaaattgggtacatgccctcatccctttccctcctttatgtgaccttcctaaactcctttattccccattatcctttgagtcatctcccacatgttacgatttgcacacctgcagttataaaattattttggggtgtcattatatcatgttgttcaccaactttccagcatttatgaatgcaataatgattcactgtaaatcaaaataatttacaagttacagagaatctgctcctacaaataagaattgaatgatgaatttctttggtgtcctctcatttgacaaagaaactgataacatatttctttgtatttgtaaaatttagctagcagtccagaatggaattaaaagtataagttcaactttctggaaattttgtgttttaaaacatgttaaaaaatataaaccagttaagaaataagcaaagtctgtttcctcattaatagttgcaattggcttggcagtcatcttgctcctgaatgagacagttgtcatgttaagtgttggcgccgaggctagggcagcgtgcgtagccctgagtggaaatgcctgctttaagctggaactcagtgtggaggttctttctgctctgttgatctttctggagggaagttgtaagcttctttggcctgggtctcactaaggaagtggaacggcagccaagaattattatgctgaaaatgttgtggtgatagaaaaaagatgattagaagtgaggctaaaattataatttaatatgttaccaagtgtaattagtcacttaacagtataagaaaataccattaataactgatgtggaaccttgtaaaatatttcttggcgaattttaatgtcttttttgtgtacttaggatcagttgagccccgtgggtaacttgggtgccctgtttgtgaccctggcttgctgtgcaggttccccttggacatctgtggagaggaagagtaagaaggagatggctgtgcccagccccggcctctcacacagccttctggattgttttacctctgctccttcactccttaatagctctctgtggttaacctttctgtcctcctcagtcgcactggacgctccttgaggaacgggagctgtgaccagggccagagcccaggaaggtgctgggtacagagcagcagattggtaactgtttatatcacatgctttcaggaacagactgttgggaagattctgggatttccagacatgttaaaggtttcagatcctgtgtggaaagcagaaacgtaagaaactgataacttgttttgctgaccatgatcctttttctcttcaggtcatccattgcagtatgattttgtttctaaaggtatcagttaatgttctgaaggggacaggattcatgacatgctggtgataaggctgcttgccaggtagctacctttaagatccccgaatttagcctaaaagggcccaggagctgcatctgtccagtggccaaagacagaaccttagaaggttgattttgagaatagaagacctgcttgttttcagggagaagcattatttctctcttcaactcagagatgagttaaatcctaaaatgatcattgaagtgcacattgccagattttgtcactcattagtgccctattaccttaggtataggaaaaatggctataatttaaaaccaaatgagccaattttatagcactaaataggtataaactacttctgtgtgcattgacttaaaaggcaatgtttagcttggttctttcataattaacattccatgttgaaaaataaaaactggtattgactttatttttatttagaatttcgttttaagctatgtaaaatagtattgcatatttgttttttcagatttcagattataatacataagtaaagcatttatttcttctaatgaaatccttatttagcaaattttggctattataataatatggttactattggatgaacagatatatccattttacatgaaaatatttttttcattccatctacagatatttctttttaaaatacatgcaacttttcccttactaaaaaagatgaattttatttgagaaatcagttactttggtattctgagactaggttataaatctaatattgcagtgttttaggactataattaagaataggttctgctggtaaatgttggaaagaggcaaagaagaaagttacaatacattgcctatttaccaattaaccattacctgccaaaagcacatcagactcacacagcggacatccgctaatccagtggttagctgttccgggctctaatgcacactgttttacacgttaacggttttgaagttccaggccaaagctgacctttcacatgtgctccgttcacagtaggaatctccactcactgcttcctgtcagaatggattatggtgacacagcccagggcccactttggctgcaattaagtttttgatcagaattatttcgttcacaaacaatcacatttgttaaaatgttacatctgccctgagaaccactggcagactctcagtttatcagtctgatgcaagcgtaagtcttcatttgtttttcataaaatggcaaaccatcttatacatgttatttaattttatttttttcttttgttggtttctgcctttcatttcattgggcttggaaggaaactgtgtcttgaaattagtctgaagccgcttgaagactttgggaatttgaatggaattgcttttggtgcagaacaaaattatccagttgggagccaagactcaaatattatttccaaaaattgttagtggtggttctgtttctcacacgaggaaacgttttagccttgtgagtgtggggcttgaagctctgcttcttggtctgcagtgcctgtagctgccatgcctacgatgtcgctgccttttggtatttatcataaggcatgtctccagatccgtcattgttgccatcgactttggtgccagaagtgaaaccagtcctgcttcagtagacttgcctctcatgcctctttgcctcccttttagaagtcattttctcactaaggaacagcagcagagacactgaaggaaccttttctctgaatgaccattttttgtttataaaatgatgtgggtattgatggaacttctgaattttatagctgattttcaccatatgacgagggtgtcctctcacccttttgtgaccttcctattctggagaagagtctgtgtgcttgggagctttatgtgttgggtggggtactttgggaacacaggattagagtttggattagagtttgacttagaatggaaattaacctttgacttaattgtgtgtgagagtggagaagggggaggggatagagttaggaggctgtgaagttaggaatgcttgaatgctgtctgagaggtttagaaattttaattactttaaaaaatatatacttagaatactgttaaaggaatttttaccaggttttaaaatattgcattaaaactcaaactatttcccatttgttttgacgtaaccaaactcatttattactaactcataaagttacaaggggcaaaagaaaggtgttgtacaaaaaaccattttagccataattttttaagcttttaaataaagcagggcctagctgcacatctaaaatccaaagactttacttaaatgggataatgtaagtactggttatattaatatagccttcatattgtcagatttgtgagcacgcataaatctgttttcttaaatgtattattataattgttttttactcttttaaaaatcatgtttggaatatacctgactatacttactatttaaaggaaatatatttaaagaaaatattgaatagtatattttgaaagaaaaccccaacatgtaaccttccaaaaatagacattcctaaggtactgtcatcattcagtaccgtcctgtcttcttaaaaagtggtacacagacagaaggtgcagaatttgtatcttattacaagctcatgttaatgtagtcattttttattttcaggttttgatgttttgttgtttttttttttttgagattctgaagtttttagaagtttgtatttataactttttaagcccatgtaatgcatatggggcatctgctgggccataggaggaatcttcacttttggagggtgtttttagggaaatcggaagcagtcaggagaaagaatggtgcatagtgcccctgtctgttcaaaaaaaccagaggctcctaaaatcctgtgtagcatctaccatgtacagacaacctccattcttaaaactttaaatgcatctaaggaagggacagccttctgcctgcaatgagcaacagcttcacatgagacacccaagaaggttcaaaaatactctttctggaaaggctgatacagacatctgtgacttggggtctgcctcacagtatatgaaactgaaagatagattggacacttaactaccttaaagttttactagagcttgtaaagacacttccgaggtcccaaagaggtcctttatgccagacagagccctctagattctttcccaaccaccatgaaaaaccagccctctcttcctaaacaatgtaattgctggcataaggagacccccactctgtaataagaaatttttttttttttttaaatcaccaggaacatggcacttttttccttatgttggccatcaggtcacacagcgggaagaacacctatcattggtccacccacttcttcccattatgggaaggctgaggctgagagggagaagtaactctcccaggcgaaagagctagacctgcacccaggtacaccttcctttctctatctgtggacttctggtgtcacaggactatttgagtaattttccattatactctgcatggcccagagagatttaaagttaaagcagagtaccacttttgtaaataaaatgaaatcaaactctaacaattgtaaggcatgattttccaagcctccggggtttagggcaagtaactgctgccgtccctgccggctccaaccctgttggtctcctgaggcctggttctctgggttgtacatttcttttagaaccaccccagtttatttctgaccttgtgcccacatcccatagtcatggtgcagcatatatatttttttttttaataaccctggatgtgcaggtggtcatatttcctaaggtttcaataaagaatgtatctcagaacaccagggtaggaatggctcttaagtttgcactgggtgcttgaggtaagattaggcagacccagagggtagtggagactttgaccttatcatgaaactctttaaatatcataattttgaaaacataagatatgaggtatttcagagcagtactctattctctaggcactaaagatagaagtgaatgaagctcttttttcctgacttctcagcctcctcacaatcccttggtgagtggccctcttttggacaagtgcaggggctgagtgtggaggttgagtgtcatgtccacagacacatgtgacaggaagaagtattttgagcataagaacttggttcctggccgggcatggtggttcacgcctgtaatcccagcactttggaaggccgaggaaggtggatcatgaggtcgagaccatcctggccaacacggtgaaatcccgtctctactaaaagtacaaaaattagcgtggtggcgcatgcctgtaatcccagctactccggaggctgaggcaggagaatcgcttgaaccagggagttggaggttgcagtgagccaagatcacgccactgcactcgagcctgggcaatagagcgagagtccatctcaaggaaaaaaaaaaaaaaaaaaaaaagaacttggttcctgagaagtctactttgaggatctttccacagcacacactgcctgcaccttggaggatttgatgatgatatccttgccatttcagttttggtaggtagattatttgttctgacaggtttaattgtcattgttttggcacactagactgttaatacctgaattaattggttgctttaataggtgttcagctaaaagaggacttcatcatattatctaatgtttccactgggagttgaaaaaagggattttaaaaaactttttcatttattccataaatccccaagtatagaattgctcttctaattttgcccctgaaactgcaatgtatgttgatagagagttcaaagatctttatattcagaaggcctggcttttaaaagatatatttggtatacatgtctctcttctacatgaaaccataaaatggtttctaaaagagacagttactcgctgtatgtgagactgtgaagcttctaaaaataagtaaagaaaaccatggtgccacatggagaatgagtcggatgttttaatagtatttagtgattcaggatacacaattaaatgaatattataacagttttggaaaaaagggcacagggaaaaaaactacgtaataattttttctttttctaaaacctgttatactttatctcttgtaattaaatttaaaaaataagattatgggggctgggtgtggtggctcacgcctgtaatcccagcactttgggaggccggggcgggtggatcacgaggtcaggagattgagaccatcctggctaacacggtgaaagcccgtctctactaaaaaagtaccaaaaaaaaaaaaaagttagccgggcgtggtggcgggtgcctgtagtcccagctacttgggggggctgaggcaggagaatggcgtgaacccgggaggcggagcttgcagtgagccaagatcatgccactgcactccagcctgggcaatagagcaaggctctgtctcaaaaaaaaaaaaaaaaaaaagattgtaggaaacttatttttgctaaaatttacttttaagtaaaagaaaaaaaaaatggaaaaagtataatctgacatcagggatttgtacctaaagatgcacacatggaggctttggagctggacataggggacttgaatttgcatcccagcctcactttttatgaggtgcgtgactttgggcaagtgatttaacccctcagagcctcagttctcttctctgtaaaataggaatgataaacctgttcacagggctgcagtaagtacctggtccagagtagttattttataaatgctcattatattttcccctcctcttcttcatcctagaactgaatgatgagaatcagtggtcagagtaatgactctgagatacactcagatccatagtcagcaagaatcaagttatgttcagaaggtactacttgatcagaaaagaggctattcaggtattgccattgagatgatgaaaataaaaaagtaatttatgattaataccaaaatagaaggtaatcagagatatcctgttccttgtgtatactagatgataatattattagttttaaatttgaacattactgtgtatgtgagggcactgtgctgtgtgattggttcatatcatctcatcttacctagatgggaaatgcagcccagccaagtcatacagcctgcttaaggtctgggttgagagcccaggttttggattcctggtctgatgctctttccatcatattgcattgtttctgataaagtaaatgtatttttaaaatgtcttattcctttgcaaatcaaatacataaataaagtaactatcatttattaatttccttattgatggacatttagagtctttctcatggttttagtacggtcagttctgtaacaagcatcctatgtctccttgtgcataagtgtaagagtttccatacagcataaatctagaaatggaattgctgggataacttctggtacatggattaataaaaatgaaaaaccaggattatgagaaggtctgggcttgatgacattcacattatagcccagggacaggctgtttgtcatcagaaaaccccttccattcatgaggccatagaaatccatggtgaccgaagcacttgtgacttcggagcagtgtgatctgattttgaagtggttttgaaaactggggacggtatacataaggtgcaaagatcacggaaacatgaattagcaagtggggcctcagtctaggttacgagtgctttaggacaaaaaataatcacttttaaggaaaagtcactgttgatagcactcagaatgccaccagtattgcagatttgtaatctattactttaaacttttacaaatgctcatggtgtaaagttcagacccaagttactgaatgtctgttgcctgaaaaggatacttcaaaattatattttccctttaatttcctgaatcaaaaggctccaggttgtgacagaaatgtcactacttgctgtctccattcctgtacagagacccacaagagactgaaaaatggtgttggtcaagttgtcttgggttctgtgccttctgggaccggtaggaatgcagtgtggactgcagtggagctggggttggggagcaaatgcctggtctgctagtactgtctcatccacttgtgttttagtaatctcattgctttcagtggagggatcctattttacactgatctttatgagcaaagataattatatatatttgcctgggtaagcaaattaataaacttgtaacaaagtgtatcagaccatttctttggcaagacctactagaacagtttgtgaagcagagctgcttccaatggagcatgaaaagctttgaaaattctcagcaacagcagaaagcaacatttgaaaccacccttaaaaaattgttttcctcttccccaaccaagtttataaaaatttggtcagacaggcgttttgttttgatttaaaatattttcagtgaattgttatctgccgaatgcacatgtgttcctgcactttttctttcatgattgaaactttaaacccttcccttaagttcccctaaaaacctccctgtgcctagtaaggttttgcatgtgtgaggagggtgaaggtatttggaccttggagaaactttgcaatttgaaatctgcctatgcagttgtacaccagaaatgaacatggtcaatgccatattgtgctctttgtctttttcttctaccaagattcctcacccctaggagacgttggttaatataggcatttcggtttggttaatctgatcatgagtgcccgtgagcatggcatgaggcatgattgaagcagttataaaaatttggctcagagttaagccctataatttgttttaaagaattacctcttcagtgacattaaaaaaaaaaacacaacaacccaaaaacaacaaccaaaagactgtggtttataacaccacacctggtccagattgtactggatgaatccatatttgctttgccataaatgattttgagggtggaattcttggactgttttctatcttataaacccttgacattgtactggtacctgtatgctcacaaacctcctgacatgggaaagaccggctcagcctcccactgaaatgtaggttggctgcatttattctgcatgttcctagaatgaggaaatgatatgacaataaacagaaatgcccttgctgaagagagaagggaagctggtgtttatctggtcaggtggtttagattagctgtgatgcagctttgtattatgttactttaaatcattgtgtcccaacaggacataaattatgaagattgttacagtatgtttcatcctatgtaagatcaacaaattggaataattttttataggaaaatcacagtgcttttggcaaggctattgaagcctttaatttgacttgagtatgtctcaaatattattgcttaatatataaagtatgatttgcataaggtatgaaataataaacttgtaaaaacaaaagggaagaatttccctgtagcagttgcatcaaatggcagtgcactcctcctccagcagtgtgctttttttgccctgatggtttagagccagttgcatgactttcctctgatgggattgcaaatgagctgagcagtctttgcagagatggagctttgctgtgtgctgcgtgcctgtcaaccctacctgcacagagaaggtgattgctccgtggcagaacagaatgggagcctgctctgaggaggagaaaacaaatgatcttgtttatatacactcaggaaaacaaaccatttttctttctttcaggatattgtgaattacttatataaaaaaagccaacctctccagaaacttcctagatcaacagctgaagttaagataatttatatagaaatgcggaaaaatttgacttaagaatttattattttaaatgttttctctcttcattgctattttctgaattactagcataatttgtgaatttttgacacagagacttaaaatttttcatttatattcaagattcagctaagtttggctacacagaacaaattttctagattttaaaaaagtggcataaaattactttatgtatgattccagcaaattggaaccgcttcagtgtcccaaagaagcacattttctgcgcaaagcactgtgcatttttgtgagacctcctcacacccagtagtgatgttaagaagtaacagagcctcagatttacagagtagtagaggcaagagaggtttaggatttgctgaaggccatagaatgagacatagctaggattagcatttttcaggatataaggataccacccaccagactttgtctttgataccaaaaatagggtttaagtgctaagcttactttcctttctttgtggctataagccctggtatttttctttaacaaataattaaaattattattaaataaataaatatacttaaataagattgtttaaaacaaaaacaaaaaatccctactttccatctataagggtaggaatgtttctctccttaagcctacccttataggttgggtaggcttaaggagagaaaaataacaggttaaggataaatcctgaatatatttgtggtttccttcagctcgatgtctgaagattctcacaggttcagggactattccaagtttgcaacctgtgtgtggattttgaaacaaatacagacaacttatgagacggtttctttgctgggcttcttgcttgacacagttttctgaaacatggctctggcaggcttttttcttccatggacacattgctgccgtttatcactgaagttcctctgtggagttaccaggagctaatatttggatgatgtacttttcttgcagaaaatattagcaaatgttgcagaaactgtgctttaaaaacttttaaaaggggaatggattcccagtttaaaaataagcaaaagaaaggataaacatgatttcattgatggtgtgcaactgctttagaacatcagatattttgtgatgtgaaatgggatgatactctattttacaaaatgtgtactgcttatagaaaatgtatttactgtaccactaagccaaacttaggtgttgctttgtttccttaaaatattttttgagtcgctgtggctgccccacagatgatgggggagtaggcattctttctgcccagagcacttgttctcttcctccacccttttggttgttattgtagcatcttgactttcagcttaacacatcccaacttaagcagaagcccttttgccttctctctctttaaaactagatccatagaaattatttttattacagtaatagggcaagatagttttatgtcatatataaactggaattatgtagtgttagtagtagttatgtctcctgaaaggaaccagttgattataaagaagaaaagttagggagtagactgtcattttgcatgctattaaaaaaaaaaattttttttttttttgagatggagttttgctcttgttgcccaggctggagtgccatagtgcgataatggctcattgcaatccctgcctcctgggttcaagcgattatcctgcctcagcctcccgagtagctgggattacaggcatgtgccaccacacttggctaattttgtgtttttagtagagacggggtttactccatgttggtcaggctggtctcaaacccctgacctcaggtaatctgcctgccttggtctcccaaagtgctggggttacagccatcgcgcccggcctcaattttttttttttttttttttttgagacggagtctcgctctgtcacccaggctggagtgcagtggcgcagtcttggctcactgcaagctcctgggttcatgccattctcctgcctcagcctcccgagtaggtggcactacaggtgcccactaccacgcctggctaattttttgtatttttagtagagacagggtttcaccatgttagccaggattgtcttgatctcctgaccttatgatccacccgcctcggcctcccaaagtgctgagattacagatgtgagccaccgcgctcggccccctgacctcaatttttaaaaatatatttgggcaggtactttgtgtatcttagtggttcggaagcacaaagttgaagcctatgaagtcgttttttttttatataaagtagaatttcttataattttataatgatgacagtaccaaggagcttaaatacaatttttaaaaggattgctaaaacaaaactaactaaactttggtaatctttgcaatacctctcacctcataagactctgaaagccaacaaataaggattatcagcagattagggaagaaaacctccaacaggacttttctgaggcagctgattggcaataatgaacagccccagtgaattgcaaagcatcacaagttattttgacaccagggaactctggtaaggggcttctcttggggtggttttaaaaccagtgcttctgtttgctttaggagaaaagaatgggtagaaaactggtgaaatgtgctaattcaaaactgaaagattgtgagaaatttaagaaagagctaatcagactgggcaattggtctgcccaatagtagctgatgaagatatggcgaaatgaatttaaacttaggtgcagaggaatttggaaaccggtagtgtctcttcagggaaaagatactcatagctagtgatcaccttggccagaatgtctttttggtatacatcagctgtgtgaactctatctagttagagaactttcactaaaaatgaaacagaaatgaagggccttttggtaaaatcgtgtgtagagtttttttttgtggatgtaaaccctgccacctggagaatagtggatttatattaatatactcctatctaagaggagttttcctagcctgggaattcagtagaaatttactgatgtattgaaagtcctaattctgcaaaagaaagttgttttgcaccttgcttttcatttaacagtatatgttgaagatggtaccatgtcattagctaaagagttgccatattttttcaattggctgtgtaggctattatggcaattgccaagaatagtgacttgaagcttttttttttttttttaaaaggctctaaaatgctacagtatgaaaacagcttttgaaagcagtgtttagaagtgagcatgctatctcacaggtgttgacctgttcagtgacatttaaaaaatgtacttattaccatgagctaagggggactcatttcgtctggggcctggaagagcaggcagctttttcagtagcttgtggatgttgtcttcagtgcctggagaagccagttttaatttcatagttggatattcttggcctgagttattggaaatgttgagctctgtggcggatcaagtagatggcaagtagactagtggcttaggattggtgggagttgtgtctgcccccagacacacaagggactgcacagggaatggtcctcaagcaggcctttagccccacttcctcagggagacatgagtcacctgcttggctgagatgctcgctgacagattgccagttccgcaaggaaatcttcccgtgccgacacccactcagagaaacagtgctaaagatgtttctggttttctgagccttgtaaaggtgaatttctttggccttcaaattggtcttctgctaggtttggaaaggaattcttcctttccaggccacagacactataatatcaaagtgttattgatgatgataataatcactagcattaactgagttcttaatagagtgccaggcatactgtaaagtatattacatgaattagctccttttacgtatggggaaactgaaactcgtttcaaaagttaagtaacttttctgaggtcatatagctagtgaatagcagagctaggaactgaacttagttgaccagtgtgctaaaaatatgtctgacagtccagagaaaaaaagcatggattaaatacatctttggttggatctgttcctcacagtttagttgagaatattcttgtgttgcctacaattaaaatctgacgtttcctttgcagcggctagaacagttaacagtgttccacgtgaaagtcttggtgagacatgtaatcatgttctgtggcaaagaatgcctttacttggtgcactagacagtgtttatgtgattgataagtcaccaacaccaggggaaggtcctgtcctgtgacatgtgcgtgcttggcaatgatcttgccttgcattttgcttaataattttcattatttttaattaaagttgaagaagtgcagactctagctgaaattaaggtaggttgtgttgccggaatctggtaattactttaattgatcacaagatagtttccttgatcaccaattagagtaaattgctgatcatgtttcaagacgtgaagaaatgcccaaactgatttatgtaatagtgttttcatttgtaatcagacataaatatcatttccttccatagcaattgtgttttataaaagaagggttataggcctacaaacataatggtgattcataaacaatagatgtctaattcattgaattagtaaaggaagtatttagaggcttaatggagattgtactggggaaattactttggagtagctggtgctcattttcttagtgggagatatgttcttttttagtgcataattaaaatagtctataatcaaaatataaaaggcagctgatttaaagaatgtatatcaaagagacttgctctgagtaacgaaagatttgtattgtaagtatgtgctagaagtcttagaactttaataaatcatacatgttatttgactgaagctgtattttaaattcagggtgctgttaaacatttcacagattgatgcacgatttttgtcttggttttgtgcatctgatagtctttcatagtttcatggaataaaatgaaacaaaaggaactttaagaaaaattaaagttcccaaagaatacttgatttggggttcatggaaaaatctttaattgctgatggtttggagatttccaaatgacaaacttcattggcccaatttactgtgattgtattgcttacattccttaaaatggtagagtaacttaaaaagtcatacttcatcatacattcattgacttgttcataaaatgtttgtaatttgcaatagaggaaagactgaaactattatcagccattatacgttatttgttggccatatgtttgtttgaaatggctgtggctcaacagaacatggctcatagacaaactatgctgtaaattggcactaaaaacccacctaaacaggtaggcatatgttaagaagttaacatgagccaaaatattttaatgtgaaccaggttatgtacattaaaggattccagctccctttacagtgggaacttcatttgcatgttgttcatttttttcccaaactaatttttaaaaaatagatcaggtatacacatggtacgaattcaaaaggtaccaaagaatgtaggaagtcttcctgtttgtgattctcaaccatccagttcccactctccactctcctcatctttcaccattgctcccatcattcttgtatatccttccagagatattaatgcatacacaagcatataatttcttttctttcctttttatatgcttcatgaactattgttatgcatatattttttttcatttagtaatgtatcttagaggtacttccatgtcagaggataaatggtttccttgttctgcttaatggctgcatagtattccagtgtgtaaatgtaccataatctttctaatcagttccctgttgatggagattttgctgtttcaagtctatagctattacaggcagtgctgcaattacctttcttgtaatttatgagtatgtctgcagcacaaattcctagaagtattgtttggtctaaaggcatggacattttcagttttgacagataatgtcagattgccttccatgatgatgatatcaacttatattcaccagcagcatgtgagaataccttttcttctatatcctcaccaacagaatattagcaaatattttgatctttttcaagctaataggtttaacttagtttttaatttgtatttaccatgattgagattgagcagtttttatgtttcagaaccatttgaatttcttttctgttatctattatgtcctttgctcatttaaaaaatggtggttggtctcattaatatgtaggagctttttatatgctaaggaagtatatactgcaaatataatttgttgtttatcttttgcttttgtttgttggattttattaccatacagaaaaaattttttttgcctgtcttcttcctgcagtacagaaaaaaatttttcgtgtagtaagatttatctatttcttagtagtagttttttaaagttttcaggaaatagaatttataaatttcttgttaagttactcttagattgtttttcggtgccattttaaatgatatcttttcttcggtatattttctaattggttattgtttgtatgagaagctgttgactttttttttttttttgtcttattcttgactttaatgggaattctagcatttccctataaagaatgatgctaagaaaaatgatgctgcctttggactgagaatatattctatcgtattaaggaaggatgcatctattcctatctatcagcattccagagaatgttttcagtactatttctactttttggaattgattgagattttctttgtggactaatatatgtttaatttctgtgaatatttgatgagcgctttaaaagtgttattctcagtttttagagtttaaagtatagcaattagctctacctttaaaattatgtttgtttgtttaatctgtcatgggttaagagatgtaagttaggctaagtgcagtggcgcatgcctgtaatcctgccacttacaggtttagaggctgaggtgggaagattacttgaggccaggagttcaagaccaggctgggcaacataacaagaccccatttctacaaaaatttaaaaaaattagccaggcataatggcacttgcctgtagtcctagctacttgggaggctgagataggatggatcccgtgagcccaggagttcaaggttgcagtaagctatattcgtgccactgcattccaacctgggagatagagcgagaccctgtctcttaaaaaaaaaaaaaaaagttaattaaagtctccaactataaatgtttctatttattcctatatttcctacatgggcttattcaatgccatgttattatttgtagtgtagatatttgtaattatttaatcttcattggtggatgcaaatttataaatgcaaattacccgcttcaggacttttaatgttttgccctaaattagcctgttcaatataatttattaacaagtttttttttttgcatttgcttatgtgcttttatttttaatgattgaattttgctttgtgatccagcgtgaaagttttctctttattttgattggttggatttatgttctttacatttattgattgcacagatgagtttagtcttataaaacatggcagaaccaaaatacttttttcttccttattttaaattatgatatggactgtgttttctttgtttcattttaattatgtttttctttacttaactgggaatgtttatatttttattttgattcttgtggatactattataactatatataggtatataacttgatagtaccttatggataatatagtatatcgtatatatatataatacctatatatagtattatatacatatatatgtactattatacctatgtatggtatctacaagatcctataaaattatatacctataattttacatagaaaatatagtcttctatttctggctgggcattgtggctcacacctgtaatcgcggcactttggaaggccgaggcgggcggatcacttgaggtcaggagttcaagaccagctgggccaacatggcgaaatcctgtctctactaaaaatacaaaaacaaaaattagccgggtgtggtggcacgtgcctatagtcctagctacttgggaggctgaggcaggagaattgcttgaacctgggaggcggaggttgcagtgagctgagattgtgccactgcactccagcctgggcgacagagtgagactccatcttaataacaacaacaaaaaaagaaaatatagtcttctatttctttatatagcatttatggtcccccctcaaagcaatattgaaataatattttctcctactttttgttcactgtttaattttagtttatattatttttcagtcctagtgcttatgtttaattaattaattaatcagatacagagtcttgctctgtcacccaggttggcgtgcagtggagtatgatcatagctcactgcagcctcagattcctgggctcgacggatcccccaacctcaacctcctgagtagctaggactacaggtgcatgccaccatgcccagctaatttttaaaattttttttgtagagatagggtctcactatgtttcccaagctggtcttgagcttctagcctcaagcagttcttcaaccttggattcccaaagcgctgggattacaggcatgaaccattgtgcccagccttagtacttaagttttacacatttaagtatacttatgtctctaacttgatctttcatctttcaaagattttgtttacttttatataccttcttcatcttgtcctttctcttttaaactcctttaatagtttataacatttgcattccattctgtaactgtaattcccacagttgttttaaatgtattcctagaactgaatgaatatattgcttactgctaatacctttggtatagtttctccattcatctcttagttacttatagttcatcctttaatagtttcctcaagaaggatgagtgataattattccctgacttattgtatttctaaaatgtctgtcttttgcatttatttttgaaaagtagcttagctgggtataaaattcctggttttcaactttcatttcttaaagtttttgtaggtattgcccctctgacttctaatgttgaatgttggtatgtgaatgtttgaagtcagcagaatctttttttttttttgagacagggttttgctctgtcacccaggctggagtgcagtggtgcgatcttggctcactgcaacctctgcctcctgggttccagtgattctcctgcctcagcctcctgagtagctgggagtacaggtgcgcactgccacatccagctaatttttgtatttttagtagagatggggtttctccatgttggccaggctggtctctaactcctgacctcaagtgatgcgcctgcctcggcttcccaaagtgctgggattacaggtgtgagccactgtgtctggccagattcttttcatccttattgatgaattgatctttttgattagatgccaaaaggattttttaatcttccgagtttaactttgctacagtatatatatatatatatgattgaaatattacaatttatagatttaaaccctttatttttggaaaacttattttttttttaaatttttatccccaagtgttctgagtcatagaaagttttcttaaattacactctaattttgggggtttcgtatttttgttcagttaaatagcaacaatggtttttttttttttttttgagatggagtcttgctctgtcgtcaggctggagtgcagtggtgcgatcttggctcactgcaacctctgcctcctgggttcaagtgattctcctgcctcaacctcccgagtagctgggactacaggcacacgccaccatgcccagccaatttttgtatttttagtagaaatggggtttcaccatgttggccaggatggtctcgatctcttgacctcaggtgatctgcctgcctctgcctccaaaagtgctgggataacaggcatgagccaccacgcccagccaacaatgatctttatgttagatctcctttgtttgtccttacatttattcttttctagttcttctaaactcttgttgatttctatttcattttgcccattttctggatcctgtcctcttgggtctcttactgggttgttagtggtgtctattctgcttctggctgtttctagctttcctgtcttttagttagctcaaagcctttgagctggaatcccataagcaagtaactaagactgtaaaaagaaatctttgaaagaaggagcagatgcttttcaccatctgctaagtcagctgtttggcattgtatcttcttcattgtattccagataatcaaactttcgtttgagttttgccttttttctctcttattcagtcatctaaattccttggagtagttctttgagtgtatattttgaaagaagtttttaatttgtggatttaaaaatacatattttggggattggttggttctgttatatggaagaaggattatggaattgtctttttgcttccagagcagattattattttccccggggaagaattaagaataaatcctgtgtaaatggtttatcaggctttgtagtattttattaaatgcaaatattatgtgacagttgaagggaaatatgcaaagctgagaaaaatacaaatttgaggggttttgatgtgtcataaaagttttttaattgtatgtagatatggtagatgttttttctttgatcagtatgcctcttaggctgtggctgtgtttcctttcaagccttatatctgtgatggaatagattttgctactatactgatggcatgccagtggtcaaagatttgaggaccacttctgtgttccgatcatccacttgatccacttggctaatgggaaatggcaaggaattgtaggcatcactttagacattttagaatgacatggttcaaagaaattgtggccacagggtgtaagaacttgggcagtgactgtgcactcataatttcttgccattaagctgctttccccagtcagtgtgcatcaggatgttaccccacaatgtattatctgttcgtttgctctacatgtgcgagtctctatttatgacaactggaaaaaggaaagagccattcttctggaagacagcaactagaatcttagattctcaagcccatggagagcttttcaccactcattgtgttttgtaaggtttaccttgtgtagtttggtcagaagcagtagtgacagcagtatgtgccattaccgatctcttattctgtaccaagtgctgtgctaagtacctttatataccttatctcattgtttattagaatgtaatcacatgacttttaaaattattgtctccattttactgataagaaaactgagagggccaggcatggtggctcacgcctatattcccagcactttgggaggctgagacaggtggatcatgaggtcaggagttcaagaccagcctggccaagatagtgaaaccctgtctctgctaaaactacaaaaattagccaggcgtggtggcaggtgcctgtaatcccagctgctcaggatgctgaggagaatcgcttcaatccgggatgcaaaggctgccgtgagccaagataatcccactgcactccagcctgggcagcagagtgagactctgtctcaaaaagaaaaaagaaaactgagactgatagttaaattgcatgataattaagtgatagaatcaggatttgaatccaggactccctggctcaaaaggccatgcccttaacaattgcattgctgtctatcagtgatgttgattagcattgtacatcttctaatgctaaacaagaataaggcattataggcagagtagaaattctccttatacgtagtttaatgtgggttaactctatgtttgaataattagaacagactttcatggctgggcatggtggcatgcacctgtagtcccagctccttgggaggctgaggcaggaggatcccttgagtgatcccttgagctcaggaggttgaggctacagtgatctatgattgtgcctgtgaacagcccctgcattccaccagcctgggcaacatagtgagaccctgtctctataaaaataaaaaacaggcttttgtcccttcccttcacataatctagacaatcagattatgagatgagaagggctgggaaagtgaatattgtttttccacagataattccatacatggtcaaatggattttgcttgaactttctcccttttcctatagggaaaaccttcaggcctcaaatgtcaacatggaaacttttatcccaaataaaattggctccgagagaggtaccatagtgaatgatatagaattgtttaaaatggcatcttctgtatttctcactgttaactaggaaatacacacttaggtcatttggtgatcccaaaaacatggcttgactaacatcatattggtttttctggataggggtaatgaagttaaatatttgtttacgtgggtgtaatgggtattgccctgtgaatgccactctaactttgtaattcatgtgccattaccctaagagtcttaccaagtatttgtgcattctggaacaatagagacagactctcctattgtttgcagttaccttcataaaaaattgaaaacaaacaaaaaaatgagttttttccttcttctgaagacaagtttaccttctgcttaacaaaattgtttccactccccgtgtggtataaagacagagccccgtcagtccacacttagtcgtgtgactggtttgcagccctctgctcatttcctggcttgccttctgccctgaggtgggtgcactgtcaccttgaaatggcagtgcagggcagtagcaggaagaacccaagcaggcaagctgggcttctgtttcactctaggtgccaatagtctttgatttgttcctgtcctgcctgggaggtgagatgaagaagttgttcatttctgctggtgcttttgcttaagacaccctcaggagacctttttccatagtcttgtgggttgccttagttagcaacccaatcactaaaaacaaaaggaacagagctgcaagaaaagtggctcctaatatttggagccaggtagtgagacccagagcactgggttgaagggaaattattcccgtgctattttgtagagtcttgtcctgaggacaattaaatagtccagacgggtcactaggtgagaccaatttcctggtttgtttactcgagcctgatagtttttcaccatccagcagtaggtcacagtcctgctgcactgtgaccccagaggcctgcagagagcagtcctttcatagttgatttccacaggcttccctaaggatccttgcctgcctttatgtggttggattgctctgttgtgtctctcaggcttagggtagaggacaatgtcagtaattactcttgacttcatcttatgcaggcatttggctttatgtcccgagttgccctacaagcagagaagatgaatcatcacccagaatggttcaatgtatacaacaaggtaactaaactgccttatttgggaatcaccttaattatggagtttaagaaacttctttcttccttgtcatcttgtgcagctaaatgtcattgtacttaagaaagtcttatcctttctctcagaatccctgtgtattattgcaaattagtaacacattttcaggtctgctcctaagaacagtgaataagctctttattttcatgcttgtctttctactgaagctaatatgagaaagttgggccaaatgaggctcctgaattaaaccggagtatcagccatgcagatacgtttcaaaacttaaggtaaattattgaaagaaatggtagcaaatcagatagatatggcctcatttatctcgttgaaatatttttactcaagaactgtgctttgaaaactattaaattttgtatcctgcgtaggaaatgaccttatttaagacaaaggacagactaaaaagttttgagggaacacagtgagaagaaccttgttcctcccaaagtgtccttgcctttatggtcatgccatttgaaatgtcttatcatctagatttctatgaagtcttctctgtgaaaatctttgaaaaaagagaatttcacaatactcacgtgacttaatagaataactcagagcaccttggtaccaggctaaacttttctttgctatttgcttctctttgctcgtaattttgcttttactttataatcagttcatcaagaaacagcattccatcctttactcccatttccctaatttagaaatgtgctttttttttttttttttttttttttgagttggagtctggctctgttgcccaggctggagtgcagtgctgcgatctcagctcactgcagcctccacctcccgggttcaagcgattctgctgcctcagcctcccgagtagctgggatcacaggcgtgcagggtaacttttatatttttagtagatacggggtttcaccatgttggccagggtggtctcaaactcctgaactcaggtgatccggcctcccaaagtgctgagattacaggtgtgagccaccatgcccagccaaaatgtgctttttaaacgttgctgctaagatattacatttgatagcttggtttttctcagtggcctgaaaatagttgatgtaattaaagtaacgagagttcaattggaacctcagtctctctttttatttaaagaaacaagatttgagattctggcagctgcattgcctcttcatggaagagaactttttatttcaaggtggctgttgagccaggcctaatgtagactatgcccctggagttcgctgggttttggaaatgttttgcttattcataatgtagtattttctaaatcatttaatccccctaattctcaaatatgaatgttgaataatagactgatttctgaactgccaaaggaaaataaccatgatttgctgctcagagttttaaaaactgcttttctttttcttaggtccagataactctcacctcacatgactgtggtgaactgaccaaaaaagatgtgaagctggccaagtttattgaaaaagcagctgcttctgtgtgatttcttccaaaatacatgtaaaatcttgtacacatcttagctgcaatgtatgttgaaggaaatttatgtgaacaaatagagttgttctttttctcttttttttaagacagagtgttgctctgtcgcccaggccagagtgcagtggtatgatctcggctcactgtaacctccgcctcccaggttcaggtgattctcctgcctcagcctcctgagtagctgggattacaagcacgtgtcaccacgcctggctaatttttgtatttttagtatagacagggttttaccacgttggtcaggctggtctcgaactcctgacctcgtgatccgcctgcctcagcctcccaaagtgctgggattacaggcatgagccaccatgcctggctgttgaattgttcttaaggcatcatatctagaagcaaagaaaaaagaaaaataacaatttaagttgtgtaaattgtttgcctttatatattacatttggtaaaatcagtgcttaaatacgcaatgatttaaactggaacctgaggtatttttcatgctatctaatcatatacctaagataaaccaacccagttacttatattaataatattcagaaagagaagtggcttttttttttttttgagacggagtcttgctctgtcaccaggctggagtgcagtggcgggatctcggctcactgcaacctctgcctcccaggttcaaatgattctcctgccacagcctcccgagtagctgggactataggcacgtgccactgcgcctagctaatttttgtatttttagtagagatggggtttcattatgttggccaggatggtctcgatctactgacctcgtgatccacctgcctccacctccgaaagtgttgggatcacaggcatgagccaccgcgcttggccagaagtggcattcttaaattcaagaaattgggatggggagtattcacacattttataacccagaaattcaagcaattctggtgactacaaatgcattgttttggagaatagttgtaaggtggaaaaagaattaggaactcgacagatagtgagttttaactttaaataacaattcttcttttgttttgttttgtttgagacggggtctcgctctgctgcccaggctggagtgcagtggcaggatcacggtttattgcagccttaacctcctgggctcaagcagttctccctcctcagcctccagagtagctgggactataggcaagtgccaccacgcctgactaatttttaaattttttgtagagatggggtctcccatcttgcccaggctggccttgaactcttgggctcaagcaagcctcccacctctgcctcccaaagtccaaggattacaggtgtgagccattgcccccagccagtataacagtttgtgtgtgtgtgtgtgtgtgtgtgtgtgtgtgtgtttgacacggggtctcattctgttgcccaggcagtagtgtagtggtgcgaccatggctcactgtagtcttgacttctcaggctcaagtgatcctctcacctcagcctcctgagtagcagcggttacaggcatgcatcaccacacctggcttatttttaaaacttttttgtggagacagggtcttactatgttgccatggctggtctagaacttctgggctcgagtaatcctcctgccttggcctctcaaaatgttgggattacaggtgtgagccactgtgtcataacaattattttaaaatttttatttatttatttttaataattatacaagatggagtctcactatgttgcccaggctggtcttgaatgcctgggctcaaatgatcttcctgccttgaccccccaaagtgctgggattacaggcgtgagccactgcgcctggcctataacaattcttatgaagctaaagttgatttggattttagctgccgttactacttatataattaattagattaaacaagtcacaaaaattgga

SEQ ID NO: 704 - DNA, 1126124 bp, Homo sapiens
tgccggaatctcgcgagagctcccgggggccgttgggtagcgtcttcgctgttgcccttagggacggctgtgggcctgctgggggtgggggcccgaagcgccagagatggctgctcagcgagggatgcccagctccgccgtgagggtcctggaagaggcgttgggcatgggtttgacggcagccggggacgcgagggacacggcggacgcggtggcggctgagggcgcctactacctggaacgtatccttcccgtggaggcgcggcccgctgcgctggcgggtaatgggtgttgggacgaaggcgagggcctcccactggcggcgccttttgagccttggggccactccggaggagcctctgttggacttcaaggtgctgtttttgccaccacagtcttcctgagagccactcactgaatttctcgcccttagtagcccagggtgtcctgtacctgttagaagagttgggagaccttccaaggcctcatacttagtaaccactcagtacattttggatggagggttgctttttatgttaagacagcacaacaaattgcttcaaccctcctttcaaataatgggtttcctaaataagccctcaatctttcagaaagccgtcccaataaattcaacggaggaacgttaggagactagggaaagacctctgccattggactttaaggagctgaagctcagaatacccaacccacgatcctgttcgatggtccagttaatgcttaaatgcttagttttgatagcattatcttcctgagtagttccaagtttgactacttaataataaatactaatagtatagttgcttttttttcttgagcaaataaataatgatctggtgagctacacagctcagagatattaggaataaagcagatggtgattagcgatttttatcggaagtaccagaaaaattgaataacaatgtgtggataattaggtccactatttcttgtgtaaggctttagaacttctttcctctagttatatagattaattcctactagggagacggggagggttcatgagaaaaagacatgtaactcctttattcagggaggtaagaaagagatgattatctgttcagttcttaaagataccaaggaaactccaaaatctgccaaatcttatttgtttgtccaactgtaatcctctccaggtttaattcaagatttcagaaatccagcaatgattcatttcgtgagctttgacaagccgattaacctgtcctgactcaggctcagtacacatccacactacagagagctttgaagaatttagctgaaagattaaagaaaatatgtagtattttattgggtgcaaaaacgacttttacaggaatagaaatttgaatcgcttgaaatgaatttgaaagaaatatatgggtgctttagtgtcataaatgaggttttatactgttttcgtagatgtaacaggcagtcttttccagtgatattcctctttaacaacgattttcataattcttcctaagcttatctatatccagtgcccttgctactgaatggtaaccaggcatcttgtaattttgtttgcattaaaattatttccgtgaacacatagtttaattgttaacatgagattgacacaatgaggtaactttttgcaaacatctttgtgaaataaatggtaggagtctaacataacacaactttcagcaatgaaaatcaggtttacttaatgtgcagggagatcactgagtcacacctgccaagatgtagcagtttgcaaacctgtcttacaaagactttttcaaataatcacacttatttgaactttaacacatataagcaactgtaactttttaggattttactaaccgttgtgtgaattatccaacccatttgcttttcttctttctttggttgactgactgctattttgtattttaaccaaatggtagtcaggggatacacagttaaacatttaaccagtttattttgctatattccatgctgagggaagaggtttagtcatttcaactctcagttgaaatgaagtttgaggattacttgtgaataccaattattcctgtatccctgggcactcttcacatggttaattaagagttgcctgtgtaatgttgtttgacattgtttcttaaggcaattatgatagttgccaaagtgagacttcctttggtttaaagtctttgctttcaggtaatttaattgagctatcatggtgggtaaataaaagttataatatgcacagatgaatcagaaatctgatgtcctctgcttcgcacatatactcaatcacttctaatctactgcatttggcctggatttcccttatttatcactcaacagatgctcctagtacattagacaatgagctatcaatatcgagcaagactttgaaagaagttgacttgaattctttaggaaatctcccacttttctgcttttaaatactcaattatgaagagtatgaatagactaatgtccaaaccagaaacagccaggatccatcttgtgggggacattaatgaaggtcccatgtcctttataatggtttacacactgggttcaggaaaaagagttcttaccctgcaacaccctttccctgtaatctcctagctgtaacagtgccacctatttctcttctaaggaacccagaatatcattgcttttatgttttagacttcaacaaggtgagatacaaatatacattgttcttagctattgtcagaacactaagaaattgagttatggagtatatgaatcctctctagaacccatcattagaaaaatacttgcagcattataaactataaggtgagattttagctatgtgatagatatgtaaagggtcaagtaggtatctccagaacctagaaagaaggttgattgtcttttgtgaatgaatgaatcccttattagaaatcaacacaacttgggtgaggttttcaactgtagtagtgaggaagggctgcctattaatgtatggctgcagacatttgggactgcctagttccaattggaaggccagcatgaatttgtactaagaaagctaagggttaattgactttgttgttccttgtctaaagagactttgttcaaggaatagtaaatgaatacatggaccctaggaaagtggagcttcaaggtattgtttttgttacatacctccctcaatatggacatctggctcctctagcttttgattatttcctctctctgggcattctaatactaaggatttggctttttagatggtaggtgtaagtttactggccaatgaaaaaggctccccaacccccagcagcaatttctgagagttcagtaagtttaagccagttctgtgaagctaatcagctctgaatggagtcccaaagtcaactctttctgaaactccaaaattaaggactctagaccctgaaatatgaggatcacactagactgatgcccttatctgagatactgaggactgtaattgaagtagcaagcctgtagataaatatcttaacttctaccatgctacctttaaaaaaaattattatttttttagagatgaggtattgctctgctacccaggcttgagtacagtggcatgatcatagctcactgcaacttcaaattcctgggctcgagcaatcttcccacctcagcttcctgagtagcggggactgcagatgtgcggcaccatacccagctaattttgtttgtttgtttttgtttttggtagagacgggggtctcactctgctattcagattggtctcgaactcctgtgctcaaggcatcctactgccttggcctcccaaagtgctgggattacagacatgagccactgtaccaggctgctgtcttcttaagtaacagttctatctagtctttcattgccatagtaatgttgactgataactttaattaaaattgaagttttccttattttattttattttttgagacggagtctcgctctgtctcccaggctggagtgtagtggcacgatctcggctcactgcaagctctgcctcccggattcgtgccattctgctgccccagcctcccgagtagctgggactacaggcatctgccaccacacctggctaatttttttttttttgtattttcagtagagacggggtttcactgtgttagccaggatggtctcgatctcctgacttcgtgatccatccgcctcagcctcccaaagtgctgggattacaggtgtgagccaccgcacctgtcctttcctttttttaaatttactgtatggtttttaactttttttttttttaaagctaaacattgtagttgagtaagtaaaacatttagaaaggtggatgcatagatttctttttcttttttaaaactaacattctcttagatacatgtgttaaccactttttcttctgttataaaatggtacttctctgaaatgtttgtagtattataattgttctgaaccctaaagtgtatttcttatcactggaacttaatttgtgcatgggttcttagatattagaacatacataccccgtgtatattcaaatgaaaaggatacacaacctgcatatagacagactaagaactatgttactaaatccagagtgttgatatttacttgtgtaaaagtcataggctatttggagagaaaaaaaatgtgttttgctctgtgtcctttagtcaggcgttaatgtgcatatgactcacctggggagctttaaataaatattctaattcaataagtctggcaagggggctgagattctgcattgctaagaagcttcctggtgctgcggttgctgctggtctaaggactgtaattgaagtagcaaggctgtagataaatatcttaatctctagcctttatattttcagatagaaatatcacatgtggagtccatatctttggatctcctggcttagaagttggaaagacttataccaccagctgccatgagcactgagtcttacatgctgaacaaaagttattttccagttatgaaggtagaagatatgcaacagctatgtaggacaggggtggccagtacatttccactcttgccaattctgttgaattggtagtggctccctggtataggatattaataagaattctgagtcctcatgaagactgtgtggtaaaaactgcagggagcaattggcaaaagggaatgtgaccacaagcatgccagctaccttccatttttgtctgtattattcagttaacttatttaaactggccttcctaagaaagggaccaagactatgatatttgctatttacagtatttttatttcaacttaataagtaaaatgttgatcatggaagatccaggctagattttagattgagtctgtgtacgttggctctgcagtgatggcaaggattacaaaatgatttctgtctatagtagctttgggaaatcatgtaaaatataattagctatatgtttcactccagttcttcataaagatgctgctactgctggcagtaaacactacctacaaatgcagcagtggaagagaccagtgtgtaaggtactttgctgctcacatctgaaaattattcattggtttctggctctggtccatttgcagaatgttatttgtctccccctcataccaattggcacctcaagctctgcgccattaggccaaccaaaatgtctcaccgaggtttctggcagttgtgttctctgtagtactgtgatgggcttagggctccctggcagtttcagtgtgggtgttacattttcccattttctgaaaagatcgagaatatcaggatctggtgcaggctctgctagtgcagaaactatgagatagttcacccatggtgactaaataccaggaaactaattcatgctatgaaactcacgagtgctactaaattccttccagagcaaatgcagatttgggaggaatgggagcctcagtctgtgtctaggttatgactagaaatacagaacctggcctggacttggatggtactgtgggctgtggcttcagggcagggagaaaaggggagccatggacactaccccaggcaagaacaatctagaaaacaaggcacagtattaagtgtcaagtcaaggccaagtgtgcagataggtaagaaccagatatgaggggaacagacagggcagaaaaaaattttggaactgaaattcaccagtgttcttcgaaggaatactaggcagttagagggaagggagttttgtgagggctcaaaggcagcttgacattaagaaactggatttaggccagaatgctagcttattatttcagtgaaagaataactttgcatgagaactgtgattagcttaattgtatggatgtttcctggagagtaggatcacctaagagattaaattacagatgagaaagttgctccgtgaaagtagaaccagagtgtacagagttttatcattcttgacgaattaaccttttctactctggcaagattgttatccaaaacaatgctttccaaagtttttcacatacagtactccatcacatcctacttcactctgccttttttaccgtcccaagggccaaggggattgatatctctacactgcactattctttttatgagaacccaagaatgtcatttctctcaggctttggaaccagatattcctggatatctgttgagaaactcatctgttttcattgggtcgatacagagatggtatctgattccatgtccctttttaccctggttactgggaagcttagagtcaaatctgggggttatttttgaccaatcttatgagacctatggtatctgctgcatcttaatcatatttctataatgctatttccttttctcctccaatttccacattcattaattgttacattttgtatagtgtgtgtatttgcaaactgtagcagaatcactttaggatcagtttgtgcacctgtccctactgccagctagctagccaggtaaacagatgcgtacaaacataagtgtcaaagtacatttatgtctttaataacattgtgacatttaaactgagttgcctttgggaaattttaaatataaattatattgtggatacataaaaatcaatcaaagtatgtatcttcctagtttgattgttttgtccactacctgacgtattgtcccatcagtctcttgcccttggttagatttcgttttgagtctgtagcctgtagctcttttctacttctctttcctctgggggtcttcaaattgagctatttatgtgatttgatttacctgttattaatataacacttgaaagtttttggaaaaaaataggtgagttcattacctaggatattggtaaaaaagttgtgtattcctattgtgtcactgtagaaacagtactatgtagcagcaaatttatggcatttgtatctcaggaatttatctttgtcattcacagctgtgtgatcttgggcaaatcttttaatctctgattcagtttcttcatttttaatttagagatgggtatatctgtgctgtttgacctcactgggttgtgtgagaataaatatagttttggtccatgtgaaaatacttttaagctttataaaatggtagttatgtactctcttaatcttttttgattgtgggaaagtaatacatttaggtgataaaaagccattgtctagaatatttgctgggtaggagtatgtaagtgttgattgatattttctatgcttcgaggacaaatcactttttttctactctatattgccatgtgacatcttcctcatataatcttatcagcggttggcttatttacaactttaaagtctatccagaagcttttagagtatttacttctttttgaaattattatgatgtgaacatggtgaaggatggcattgcttttctggagacatacaaatgaccgcttacaaaattactttctaggagctgtctctcagaaggggtcatgctttttcatagaaaagaggctgacttcctctagctgaaccttcggaaattttatctcattatataaaactatcagaggccgggtgcggtggctcacgcctgtaatcccagcactttgggaggccgaggcgggcggatcatgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaacaaaaaaaacaaaaaaaaacaaaactatcagaaagatataaatctataactggagggaaatttaaaatgtcttttatttattcattttaacatatgggggaacagaggcatgagaaatttaaaagatttttttttccatagatactcatctctttccagagtgagaaaagaaatgacaacaaacacttgtatatcatttactataagccaggcactaatctaaatgctttacatatattgactcttaacattcttatagtatggaaggaagccagtctctaaaataaaatgacaccctgatatggtttggctctgtgtccccaccctaatctcaccttgaattgtaataatccgtatgtgtcaagggcaggaccttgtagaggtaattggatcatagggccagtttcccccatgctgctcttgtgataatgagtgagtatcgcaagatctcatggttttgtaagtgtctggcatttccactgcttgcacccattctctctttcatggtgccctgtgaagaagtgccttccgccatgattgtaagtttcctgaggtatcctcagccatgcagaactatgagtcaattaaacctcttttccttataaattacccagtcttgggtatttcttcatagcagcatgagaatgaactaatacgcatccagtgagccccacctcctaatattcatgctcttgtgtaatcctcacacactgagtagacgtgacccatgtaaccagtgggatattgaagaaatgatgtgtgacttctgatgtttggttagaaaagctattgtggcatccacattgttttcttggactgcttattctgggggtagttagcccaccatatcttgaggatgctcaagcagcctgtggagagacccacatggggaagaactgaggtcttctgggaaactagtacattgtcagtgagctgccatggaaatggatcctgttgcctcatctcagccttcagatgactctaattctcctgttattttgactatgacatgagagacccccaagtcagattctaccagataaaccactactgagcccttgacccagagaaactacaatataataaatgcttattgttcctttttcagcgttattgagttgtaattgacaacattacatatattctaggtgtacaacatattttgatttacatatacattgtgaaatgattaccacacccaagctaattaacctatttacctcatatagttaccttttcacttttatattacttgtggtgagaatatttaagatctactctctttacaaatttcaagtgacactccattattattagccatagttactgtgctatacattaggtctccataaattcttcatcttataactgaatgtttgtgcaacgttgatgaacatccccccattttccctaccctctattcattggtaactccccttctaatgtctgtttctgtagagttggaattttttttagattccacatataagtgagactatgcagtatttgtctttctgtatctaacatttcacttagcatgaccttcaggttcagtatctggagtagggtgttaaataagaagtaacagagtagctttgaaactggggattagggagatgttggaaatactttgttagtgaaagataaaatacctcgaacagattgctagtagaagccttatgatctttaaagaggctgatggcaaggaattagagagtgaggcaaatactattagaatctgttctacagtaatagataattaataaaggaggtattttactccttgtagtatttaatatggatgaattaaggttatggaatagactgcaagtatgcaactatttttttgtttaatcatttaactagctatttttgagcctaattacttttcactatgttattaggagaggcacttattcatgttttacaataaaatactgaccttttgacagatacctggtatctgaggattggtcataatggaatggggcttaagtgtccctgcaagggatagggataagacatacaggatgattacttgtgatggagcttagtagcagtaataaatttataggtttagatctctgtggaaaataattggcaaacactttatgtatttatgtagcacagaaaacccacacagaacatggagaggcaatataatatggtgaaacctaaacatctgggctcttttaggtcctagctgtggaaccttatgcctctgattcttgatttgtaaaatagagttatagttccagcctcataggcaggatgaggatgaaattagttaatacatggaaaacacttagaacagttcctgtctcctattaaatactgtgtaagtgttatctgttcttgttataagcaacagaagttgttatataccctttcagctaatgcttggtaaacaatgccagagacattttataatcagcagcaaaatgaaaactaggctaatcttatctttgattttcataaccattaccatgcattaaagtgtttaattcacacattttaaacttggcataaccgagtcagtgtaatcgaaaaaaatgtaaacctaacaataataacaacaacaacaacaagcattgctggtgtgtgctgtgatttaacataaaatattgtcttgaagttttcatatgtaattagagtaacttatagtttttgaaagtcttaaagcagttctcttagaattattttatgttagaatcatttccattgatatttaatttcttcagtatttatgaaattttgaattatgattgctatatactttatattcacttaaaaattaagttatctttcctataaagataatttaaaaatggagatacatggaaaagtaaaatttaaattttactgataaaagcattgatatgtgtttttttcttaaatattggcgtgcatttgttttgttcattcacaatactttaaaccaaataaagtcacattttattcatgtactgtgaatagttaactcaggagctctggaaaattcattgtggtttaagatgaatttgaaaaagttactgttttttcttacctgtttctaattcacgctaccttatgatattatgtatattttcacaagccttcatagaatcaagtttgaaatcattagatagatagtaaacagtcaaaagacagatagcaatgtaggttttcatggatttgagttgtgaaaaataatgaagtattttatttttaaatatctagatttataggctatatggggaagacaaattttttaaagattaaattatatatatttaccaacttcctggtgagatagttgaatccaatactatatttgaaggtcaaatcaatttttgtgcaataattttattctatattttttgagattaaaacttgacaagatattcagaggtcaccataactgaagcatctgaagatgactatgaatatgaagaggtaacatgttaattttaggtgtttattctgtaaatttattgcagtcattctcatgaaatgctcattttattttctgaaacatgtaagaaccattcttttttcttaagagataccagtttttcaactgaatttagctagtatcagctgattaagaatgagatgtgaaaattctgtttaaacatttaaattggaaaatacatctgattcttttgattttcctgttaatcgtccttcaggttcagctccttattacctgccttgtagattcctaccataaactgttatctctgttcaggaggcacttccttcctgtcatccagtctgctcttgtcaaggattcctagattcccactgctcagttgaagcggaggccttatgcatccttccagcttaacagtatttctatctaatgtggttcctatctcaaagctttcctttaattcattgttcccgagacctatcattacttcggacacttggaggataaaatcactggtagatgacagaggctgtgaatgaaactgtgtggaaataagcctggcgagcctgggtgagcaagagacaggatgaaaattggagacaggctttttattactggtaaaatggagattatgtgtaccacatgaagttcctgaatgagttaataaatgtaaaaggcctaaaccagtgatcagtacataagaagcgtgtgttaagtcttaactgtcattaatcataattgcaatccatcacgtcctttcaagattttaatgctcagtgagttttattttttaataaacgagagattttcagttgctagtagttctgaaaaagtgatggtggaaagcacttgagatggggcaagaatggtgatatttagatagccttattattttttcagcagaattgttagattacattttctattatagataaaagcagttgcccacaaactaatcctgaatttattagaagtgacgtttattgacatttacaaggaagtcagaagaaagcagttattcatttttcatggatcttcagaatgacatggtattttacataaagtatttctttgatcctttgatttgtgaagcaaaattatttctgaagtgaaataaagtattttatatttctgctcactcttcctatccttctctttctctgtgatctagataccagatgacaattttagcatcccagaaggtgaagaagatctggcaaaagcaattcagatggcccaagaacaggctacagatactgaaattttggtgagaatttgaacactagtgtagtctatagtttagtggtagtgctttttatatgaagtttggaaagtcttttaaatgtaaatactagtgtagctcagtcatctgttatatcattttcatctctgtttatttgtgatcaagccttcactttaaggtaagcagtcatatttactcttttttggattgccattctccacatcatggtcactcttgcatgactttgtatcaagtgacaccttctctctgaactctgattaatctcactggaggataaaccaataattttcaacatttatgtttagaatttagtgtcatatacaagttctacagtctgttttgtaaacattttgtgtttttttacatgaaagtattaatcttacagggaatgcttaatatggctttcttgtgaggcttatgaactaattatgttaaggaatgtggtgggggatgttttttgattataatacaatgaactaaaagtgcataaaactgatggcattcctctaaaattgaaaactcattaaaattgtgaaccatttaatatgatggcaaaaatatttttaaaaatgttttattttgtaccaacattaagaagcatgctttctttcagtgtttaacccctttactacagagaaatgtgaaggaatttgtgaaactcctttttggttgcagatttgccttcctcagtgtggaattgtatgtgagactttactgcatattataccatatcattctttccatattctgtagacttcttcaatgtagaagtccaataactccttttcaaaatgtctgtccactcaaaattggaataaaagctctagaggaagattttttcaggccagaattaattgcattctgttgtaaatggagggctgcagctcatagtaaatgacattctctaatgaatcccatggacatagcttcttcttggtagacacaaagtgaaatctattccatagacttagtctgttggatatctcaaagcaataatttgtaggaatagttttaaaatgtatgaatagcattttcagtgacatgcaactgatatgtttattcatttatcatcatcctcttgctttacatcactaaggattttgacaaattctttatgtaccactcatttgtatcggtatttggtaaagtacatgtggctaatacagtgcttggcacatagttggcactaaataaatagcagttaaataagagaatggataagtggatcattgaatgaaaaaactgaacaaaactgtaattgcttccttctgctatcatggtcgaaagtgtttgtaatgcaaagataaatcagaggaaagttgaggaagaaatacattgtagtagctgttgtatctactgagccaaatatcagtaattcttcttttatcaatttattggaagcttttctttatcataaccttacatgagttaacattcttgatttctggcatgtctgtagctgattgactctcatttagcttctttttacctcattttaaaaaattctttggaggaacagtattatgctgaaaattcacagaagttgtccttaagctgttaaatatggattcattttatcataagcatattagttatattttttaatttgctttttatttctaaagtatgttaatcttcagtaatttgaattgtgctatgggctttctcttttaaagaatacttattgcttgttaaatccattttttgttctgatcttatatatattcataaacaagatatattttcttctctgttaaaggatacagtaatctctatgcacagaactcttaaaattttcattgaagattgcaagtaaatggttatgatactattaggaaagttaagttgaaataatgtaaattatcttatttgttaaaatattaacaaaaaatgacttattgcgacttattgaatagttgacatttaaatacattcttgttcttatgatttccttttttttttttttgagacggagtctcactctgtcgcccaggctggagtccagtggcgcaatcttggctcactgcaagctctgcttcccaagtagctgggactacaggcacctgccaccacaccgagctaattttttttttttttgtatttttagtagagacggggtttcaccatgttagccaggttggtctcgatctcctgacctcgtgatccacctgcctcagcctcccaaagtgctgggattacaggtgtgagccaccacactgggccaagttcttatgatttcctttaaatgtgggtagtatagattaaatatttgagaattgattgcatggtttgctttataaattttaaattgtgtatttgatactatccgttttcttagtgggttcaatgatctgaattctgaattaaataattttcattatatttaaagttattcttgaaaaatattgagaagataggaaatgttattaatctataacagttatgtagtttgattatactatcagtagtttcttgaaatttaagtattttacaggtatgaatacaagtaaaggtaggattatatatatgttcgttagattgtgtctgtgtgtctgtatgtattacttagggatatttgtatgtaaatatatgaaaagaaaggtctacttacattgaagctgggtctccccttctaaattctgagcctttttataagtgtatttttgccatttttttggataattcttcagcctctttggttattgatagtttattctgttaattttcaaggtacaatctcagaggtcttttatactgctgtaattacgtaatgacttctaatttttataaatgtagaattttgatctttaaatatgacagtagcaagacacccaagtcatataattgttcaattccctgatgcttttcctcctcctgctaccccttttcctcctctttcttctcccttccctcctcctccttttcttcctcttcctcctgagaatttaagtagaatttatggaatttctttggaataattaactatttttggagaagactaattgatgactgacccaagcgagaatgttctttaccatatgtatcaatagttctcaaagtattgtgggagatcttttggggtccccaagaccccttttagggaatttatgttgtctttcattttccaactacacacctgctggaggattctcctcatgtagctcaactgagacaacatatcacaacaggtcaaatgcagaaaaaaatatggggatctagctgttcctctaaatactaaaaagatttgtaaaaatttgtaacagtgtcactcttctcattagttctttttctgttttggaaaatgtagttagtttttattaaaaaaattctgtctatgttatctgtgtagaagttttgctatagttattttaaagtaaataaatgaatattttaaaatttaatatccaatatataattcttgataggtataactcagataaataagtgctgtctggagtactcaataatttttaatagtataaagtgttgcgagaacataaagtttgagacattttatagaattctattctcagaaattttcaaatatgttaagaattaatataaaaaagttctcttgctattatgttaatataccaaaatatagtctaggattaataaatatgtattccttttatttagatcttaatctcacgagggattaatattaggttggtgcaaaagtaattgtggctataccattacttttaacggaaaaaaacgcaattacttttgcatcaacctataccattatgttaactctcacatcataatgctaatggattaaattcttaaacaattttcattacttttagactcaattactagtctcaagaaaaagagctgtttgtcattattgaattcccattctctccatgtacacacttaattttagttagagacccaggctccttgtactcaaagccatgtctacagattatccaagccaatatatttgacttaatgtgaattaaggagttgatgaaatgaagccccaaataaagtaacatttaagttttaagaccacttggatttcattgtttatttttttgtttctcactggtcaactaaagttgtcaaaggaactcacattaaaacagttcaaaatttgtcaagatacttaattttaatatgtggtttagcacttctttgcaattcaacatttaattagttcttaagtctggaaagttttatgtcctcaacatctttcatatccttctctttaccttcatcctcacttagtctaccttaaagctaccctctttcttttctcatctgagctacagcatgctgctggtactatgcttccttctattcccacctaaaagatgtgtctaatgcaaatttcagtttatctcccctctacgtaaattcccaatgtgtctacccttccacctgcctttgccttcttgatatgcttcctgtttagtttttccactttatctttggccctttctccgtaagaccctgagccttaatggattgaattgtcactccttgtttttgcctcagatgttttcttgccttgaatattggtttatctttctttatctgttgtatttcctcatcgtctgtaacgttcaacctaatagtctccttaacatagccttcattcacatatctaaggcaagggaaatattcttctccattgtgtatcacttcacctagcagatttctattgttgcaatcataacacaatatagaatcctgtctacttagaaaatgtcaactttagaatgttcatagacaaaatgaagctatgtgctagagctaccattgtttgtcctcaacagatttctgggtcacatgtggctagagtaatttttgatcattcagcagtctgcaaagtgagaccatgtttcgctagtttgtagattgcttgcttttttgtgcttattctgtggtgttttgttaacctcataattaagttagttaaaagccgtaatgagagttgtatataatgtataatagggataaaagtgtaacttaaatttcttaagtatacataatggttgcatgtatgatatctgtggatacctgagtaggattttgtaatcaaaatttgtaacaaaagagcttctgtattataatgttttgtttttgctaaatgaaccgttcagttcctcaagacagaactgtcttcttcatgtttaattcccagcacctttcatggtacctggtacatgggagatgttcaccaattatatgttgaataaatatcctacgtaaaggtaaaagagatattcatgatcacattagagcttggaaggggtgtgtgtgtgtgtgtgtgtgtgtgtgtgtgtgtgtgttgtgtataaatgcagaagaactataaattgaggtatatttacaagcttatacattttattgtacagtataaataagaaccaacacagtttaaggtggtcgtatttcttttctgtgggaatgcttcaaggtgtgtgcatggtgcacattcaggaagacacagaatgcaaacatttatttgaaagggcaggaatctgccaggtgtgttgcaaccgtacatacaacaaacatcctttaacctgcccataagtgtctttagaaatgagaatagatacaccctcctgctgtctgtcttccttttcctgttttccaagttccttccaacaatcagcctaaaatatcattttcaaatttattgaccaaaaaaactgaggtagcatttattgttgtataatgaatgttcacttccaactatattttgccctgaccttacaattatatataatttcctgtgctagtaaccagcacactgcaaagacttgaaggcagacatcttgtactctgctagtttggtatctcccatgacatttgaattggcatcctgtacttcttatgtaatgtctttttaataatctttggaagaatagtccagttttttttttaatttttaatttttgaggatacatactaggtacatatatttatcgggtacataagatattttgatacaggtgtacaatgtgcaataatcacagggtaaatggggttctatcaactcaagcatttatatttctttatattacaaacaatccaattatactcattaatttaaaaattactataaattattgttgaatgtagtcactctcgtgctatcaaatactagatcttactcattctgactatatttttgtacccattaaccatcccctctcccctccccagcctctggtaattattgctctagactctgccttcgtgagttcaattgttttactttctagcccccacaaataagtgagaacatgtgaagtttgtctttctgtgcctgacttattccacttacataatgatgtccaggcccatccatgttgttggaaatgacaggatctcattctttttgatggctgaatagtactttattacataaatgtagcacatttcctttctgcactcacctgttgatggatacttaggttgcctccaaatcttagttattgtgaatagtgctgagataaacacaatagtgcagatatattttcgatatactgatttcctttcttttgagtatattcctggtagtaggattgctgaatcatattaaataactcttacttttagtttttttggggaacatctaacctgttctttatagtggttgtactaatttacatttccactaatggtgtacgagggttactttttctccacatccttgccagcattcattattggctatctttcagataaaagccattttaactggggtgagatgatagctcattgtagttttgattggcatttttctgatgatcaatgatattgagcacctttttatttaactgtttgccatttgtatatcttcttttgagaaatgtctattctgatcttttgcccattttaaaattactttttttctttagagttgtttgagctccttatatattctgattattaatcccttttcagatggatagtttgcatatattttctcccattctatgggtagtcccttcacattattgattgtttcctttgctgtgcaaaactttttaactgatgtgatcccatttgtctattacttgtcttggatgcctgtgcttgtgaagtattgctcaagaaatttttgcccagaccagtgtcctgaagagtttcttttgggagttttctcttagaaggtccacggtttgagggtgtaaatttaagtctttaatccattttgatttgattttgtgtatgacaagggataggggtctagtttgattcttctggatatggatatccagttttcccatcaccattcatcgaagacactgtcttttcccctaatgtatgttcttgatacctttgtcgaaaatgagttcactgtagacgtatggatgtgtttctgtgtgctctgttctgttggtctatgtatctgtttttatactagtaccatactgttttgtttactatagctctgtagtataatttgatgtcacataatgtgattcgtgcagtttccttcttgttcaggatagctttggctaatgtgggacttttttggttccatataaattgtaggattattttttctgtttctatgaagaatgtcattggcattttattttgttggggattccactgaatttgtaaattgctttggatagtattgacattttggcagtattgattcttctaatccatgaacatggactatcttttcattttgttgtttctttttcgatttctttcatcagtattttatagctttcattgtagagagatctcacttgattggttaagttaacttctaggtatattatttgtaactatttgtaaatgtgttttctttcttgatatctttaccagattgttaactgtcagcatatagaaatactactgattttgatatgttgatttcatattctgcagctttactgactttatcagtccttttggtgaataggtttttttcgagtataacatcatagcatttgcaaacaaggataatttgacttcttcctttctgatttggatgccctttatttccttcccttgtcagattgctctacctaggacttccagtactatgttgaataatagtggtgacgatgggcatccttgttatgtttcagatcttggaggaaaggctttcaggttttccccattcagtgtgatactacctgtgggtctgtcatatatggcgtttactgtgttgaggtatgtttcttctatctccatgttttttgagggtttctatcatgaagggatgttgaattttatcaaatgcttttttcagcatgaattgaaaggataatatgatttttgatcttcattcttttgttatgatgtatcacattgatagatttgcataagttgaaccatccttgcattccaaggatgaatcccacttggtcatgatgatgacctttttaatgtgttgttgaattaaattggctaatacggtgttgaggattttgcatctatgttcatcaggaatattggccttttaacatgtctttgtctggccttgatatcagggtaatactggcctcatagaatgagttttgaagtactcccttttcttgtgatttttagaaaagtttgagtagggttggaattagttcctttttaaaatgttttatacaattcagcagtgaagccattgtgtccagagctttcctttgctgggagcctttttattatggcatcaatcttgttattggtctgtttggcttttggatttcttcatgttacaatcttggtaggttgtatgtgtccaggaatttatccatttcttctaggctttccaatttactggcacgtagttgctcattgtagcctccaatgatcctttaaaatttctttggtattggttgtgatgtcccctttttcctcttgattatatttatttgagtctactttaaaaaaatttttttttggctaatgttttgtcaattttgtttatcttttgaaaaaaccaacatttgttttattgatctattgtattgttttgttcatttgaatttcatttatttctgctctgatgttcattatttttctttcctctttactcttctctcctcaagtggaaggaaggagtctctcggggttaggggaggtgtggcacaagcactcacttggctgccctggctggtatctcactaagtcatgtgctcctaatgtccactggctctgagcccagcatagcatcataacttgccaaagaattacagtccatgtggtgtagactgcctttcaagtttatttagtaccccagaaccctttagcccgtggtggtgaggctttctggaactcaggttctgactgctgggatgggcaagtcccctcttgctagggctggttgaaatgctccctctgggtgatggctgagttctgcctggtgttgctttctgccatgatgatgcagcactattttcgaatgtaaaaaattccataattactacagtctccctcccacaggacagagattttctctccatgccacttggccactgccaggggatgggggaggtgtggtgtcagcaactcaagactgtcttttctgccttcttcagtgcctctttcagcaatatgaagttaaagcctggtattgtgattactcacttgatttttggttcttatgaagttgcctttttgtgtgaatagttcttcagtttggtgttcctgcagggttaatgatcagaggtgtctattcagccatcttgaactgcctccttccaaattattctttttgaactttacaaaagtaattttacactctacccctttgtcaggatttttctgtagccccaaaatttgcctcaactcaccactattgtgaatgtcatagcagctatcagtaataaacatcagtgttgaattttgtttttttttattttttttactttattattattatactttaagttttagggtacatgtgcacaatgtgcaggttagttacatatgtatacatgtgccatgctggtgtgctgcacccactaactcgtcatctagcattaggtatatctcccaatgctatccctcccccctccccccaccccacaacagtccccagagtgtgatgttccccttcctgtgtccatgtgttctcattgttcagttcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgctacattttcttaatccagtctatcattgttggacatttgggttggttccaagtctttgctattgtgaataatgcagcaataaacatagcagcatgatttatagtccttttggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccagcacctgttgtttcctgactttttaatgattgtcgaattttgtatagcacttttggaaagaatttttggggcagcaaagatcctctttcctcattggatttccatgtaaacattctgtgcattctgtgtaacctgttgtataaccattaacagcttgggaaagagaaggcgaaaggaaaatttgctgctgagtttctgtaggtgagaatagatctgcttattcaaatagtcagcaaacaaattagagacttcttgccaatgcgaagaaaatgacagcactcaagagacgatgattgttttatttttttaattttatttttattgagcaacacttcattccataaaatagaattagtattccctattccttggtatttttaaaaaactaccaattattttatttattttgtacactgacttacatgatataataatttttatggctgtactaatttcatttgttgcttgctgaaatgtcttcatttttctagttttaggtctgctaagatgttctgtcagaatactacatacagtttgagtatcttttatccaaaatgcttgggaccatagtatttcagattttggattttttttcagatgttggaatatttgcaaatacatatcaatgataatgatattttgaaaatatgatttagtgttattcaagtgcaaagcttgaggatagccacctgggaaacacagtctccaaaagaatgagtgagtgttccatagtggggaagttttcacttatataggcagaaacagaagttaacagggttgcaacattttccatacaaggtcattacatagtttgtaatgatttgattgattacagcttgctacattccaaggaagattgctttgacattctgcaaggaagggcagtgttctaaagtggtcttatatctggtggtattccgtgttttgtaatcatttttaggacagtaatgaagacatttaatctataattgaagaagcagaagttgcagcttcatgctatgtggctcaggccacatagtcccgttcctctcaagccttaacaaatataaagttccaaaagctataggtttggattatttagtttgacatatacactaagatctcttggggctgggacccagttataaacatgaaattcatttatgttccatatacaccttgtacacacagcctgaaggtaattttatacaatattttaaataattttgtatatgaaacaaagtttgtgttaagtacttgcatgtggaattttttacctgtggtatcatgttggtgcttcagaatttttggctattggagcatttcagattttggattttcggattagggattgctcaacttgtactttaggttttgagggccatgaggactctgtggcaactagtcaactatctcatgtagtgcaaatgcatccatacataatatgtaaacaaatgggcatgggcatgctgtgctctaacaaactttatttataagaactgttagctgacccctgatctagttgatagactgactgacttccatgtggaatactagtgtaagctcctgttgtcactaattattttctccatagtgtttctaaaagtcatggtactaaaattactgtatttctttttaaatgataattaaaagcattaaaaggtccatgcattctttttttcttttttttgattaacatgctatgtgctattgaaagggcaaacctaccttcttactatcctttagacaatccaatcacactcctgctgcagggcctttgcacttgctgatgcagatacaaaccggaacataagacactctgcctctttgtctagatttatgctcagataacagttttatcaatgacatcttcaccaccctaaatacgtagcaacccagcttcacataaatacttgtcctacacttggttctatctttagtcctctactttctccccaccccaaggtacttagtaccatctgtcatagtatatgttttttatttagttattcatattctgtctccatccacttgactaatagataggaggacagagatttgtttgctttcatctgctttatccccagtaattaaaatattaatggttcctggcatataacagtcaacaaacattgttgaaaaaaaatgaatggatgaatgaatgagtcgaaggcttatctatatcattaattaatgctttgatgttttcagaataaataaatgcacgtttaaatttcaggaacggaaaacagttcttccttcaaagcatgcagtacctgaagtaatagaagactttctctgcaatttcttgatcaaaatgggaatgaccagaactcttgattgctttcagtctgaatggtaaacaattatgtagataaatagttctcttaaaattctaacatttaacatatacacttttaagtgtcttaggagactttgaaatgactcagcctatgaaaaatgactagaaacttttcccatctccagccctgaaaccacaacacacacacacacacacacacacacacacacacacacacacacacacacacacaaatcagaatagcagttacaaagacatttttattaaacatctttcccaaatatttaagtttaagtaatttttaaaaaatcaagacacttgaatatctcctggagttataaaacacaaagatattttatgaaaacatttcctaatatttttgtataattattgagagtatttcctgtatttagacattatactaaacagtcctgctttacttccttgttttatttatagtgtaatggcttgtctttttctactcacatagctgattaattatatttctatgaatattcttcagttagaagtaagtggaattgtattttgaatatcacttaaacaaaatattttcttgttataattgaaaattttaataactagttatgaaaatcagtaggtgtacctttattcctttgttataataataatgtcaccaggcatattttcagtttcctgacattgtttaaataaatttattaaatgattagctatgaaaatgtatttgaactttaatagctattgcatattctagaaagggggattaatatgatacctaaagatgtttataattaggactaattcctaattttaaataaatttgcaatgtatggataatttgcgatttttactcatccagctgtggtataaatttttattttttgctttttttggttctcatcttctgagaacatgcacataagcgcagtcagtttcattattttaaattgcacatgtaatgttaataaattctatgaggagaattatttttcattaatacagtctaagaaaaacaaagttcagtggaagaaaaataatactgcttctcttaaatttggaaatagtgtgaattatttaaaataattttttataaaaatatccctaagaaatataataattacaaatgtactagaaaatatattttttgtaaaagtaggtagatgattaatttacagtgctaataaagtgaaagattaatatgattcacttaactttctgtgttcaacaatgtgtgttaggacatgtgatgcttatatgttaggccagtccaaagtgtaaaatgattttcttagaataatctggatccaagtatactgttaacaattcggtgactattgtcatattttccttttagatttagcaatctgaattgatgagatgaaattttaggaaactaagattactgttagtattaggatttaaagtcctcccaaactaagcatactagtcataagataaaattggtataacgcatttctttatgagtttagaatatcgtggttcaagtaattttatccttatccctagctgccagtttgcaatgagattacattgtattgaataccttatttcatatgaaacattttttattttgattagaaaactttacctattctacatagtaaaattataggaatattaaatatattattttttatcatttttaccacaggaaaaaacacttagaatatatcatttgctatgaattcacttaatctttcaaaacatgaccaaacaaggattttcctttgttagtttgttaaaataagcaaacaaacaaaacactgggcagtaaaatttgatataggttctttcactcctcaagcagaaaatgcaatagatcctttaaatcgagggttagaaaactaagatccttgggccaaatctggcctgcttcctgatttttaaaataaaatcttattggaacacagatataacctttctttaggtattgtatatggctgctttcactctgtaaaagcaaagttaattagtcacaacaggagagatatggcctgtaaatatagttttgccaattctaaaatatttattctctgaccctttacagaaaagagttgccagaacatagtaggaatttgttctatgaaccactgaaaagtttccattgcaggtttagtcgatggttcaattctatttatatgcctattttagaattctcaatgggcaatggtaatttctcaggggggaaaaattaaagaagaaattaaaatggagaaaatatgataatctaattccagtacccttacctgagcatatgtcatccatctgtcttcctacactgactgttcccctattaacattgtcagaactactcaccctaaagatacattcttactttttttgcctcttactacacttctttttaaaccatttttccctttccagccaatattttgaaaacagagtttaaattttttttctttcttcacctttttacttcgtattcaacacttagttctctccagtttggcctattcgcaccatttcactgaaggtagggtggcaatgaaaatgccatcaaaagtaatagtacaattatttataacatttaattactaatttaattttttttaataatggaagagattgtaaattaagagtatatttcattaatttgcatgaaagaaatattgcagcttttagacaataaaatttgtcataacatttaatcacttaaatgtgagcagtgcagttacaactttctggggatggttaagttttaaagccagagcctagaattaaaattacctttgatatagcccttatgttgcccaagtatgtacaggaaatatgtgtggtgttgtgtatacattaatgactcccagtgaacactacacaaatatttgttcctttgtcatttgatcttactgctgtttcttcaattaatgagaacttggcttctagttatatgtcccataagaatattttttccccattcattattaagtttaacacaggaatgtagtgactcttctacataacataaaagttagcaaaagctaatttttgctatgttacattatgatacatttgaccactataaatacatctgcacagatttatgtactatgatattaagagagcagccatttaggtgagtatttaatttaaatttttaaaacaaaattaataacatgtttattaaatatgagggatttaaaaatatttaagaaggtgaagccttaggcttatcactcagaaatttactttgtatcatttttattgatatagtatattctcatgcattatttcatttacttctcccaacaactgtatctagcaggtagccacagccatatttctattttacgggtaaggaaaggggatagggagattaggaaatctcatcagtgagtgtcaccaagtcatagccagtaagtggcagagtcaacctaggacatactgatcttaaagaccagtctcctaaccacagggctatattgtgcaattatacaagagaatctttgaaaaaattaataaaggtgccttttggcttggctggatactaaaaggacttcagaaaatattaatttagaattcaaatttgtgcctattttctatattggtttgaggaatcttggggccagtaataaacatgtcagccatgctatatttttcctgagagggactgtctggttctaagtgatagtcgcgatagtgctggggattctgacatcctcggtttgtacaggaattaaaataattttgtctgtgttggtaatgtatttccctaaatctttatgaaaacatggaggaaaagttctcattataggcttcgtataaggagattataatcaagatgacctttcccctgtcttttacatcctatgccttgggtgccaccatgagggaaaaataatccttattcttctgacaccatttctgtttttactggaattctgtcataatattcatcatttatggcagtgggtcttaaatgcttttgttatgtggacaaaattttatgaaatttctatgcactttctccctgaaattcatatatattctccatttctacataattctaagtagttgatggatctcctggtaaatattaagataattaatgcagttttattagtgataattttattggcaatttcattaagagcaaattatatttcaaatttctaatagttatggcaatcttttttcccacctgaacacttttgagtcttattttaagagtgagtgaaaaagaagaaaaaataaaaagtcaggatatttgttaaaacaaaacaaaacaacagatacatacaaactgaagcaaaccacaaaaacattatgtatgagaattcagattttattgagaagtatacttctgtagtttgtgcattaaaattcctaattacttgtattattatctaaaaatgagcctgaagtcatctttcatatttttacatggatggcagaaaatttacctgataaataatttttgaatgtcctgagatatatactatgtaataaatgttgtatttggatttgtgcttcttttatcacatactattttatttatagtatttaatttagaggaaaaactattaaatcacttttttcctcatagaaaatttctctagtggtttttcctcattaaataaagcaaggtgctgaaaaccaattttatggtcagaaaaagcctatgtcttctcttctgagataagtatatcacattcctagtacagattacttactgaatttatgattcaattgatacctatttcctgttttatgaattgtggcaaatataatggaatattgattcaattatcttaatcttcaggatattctatgggggggtcctcttgctctttttttagaaaaaatcagataaagtatataacacaaaatatgtgactttataaatatgtaacattattatgatttataatatgaaactactgataatttataattagctctaatatttagctcatctagagtaagctttgtagggatttattaataaccttattacttgaaatatttttctgtgctcaaattgttttttttaactttattgattgccatacacagggattaaaattgtaattatttacaatctgcaattgattctctgatgttgcttcttatttgactgagaaaatagaagttccatcactcccacctccctctttaccaccctgctgcctctggcctcaggtattcttctcttctccctcagactctaatgttatctgaagccaactctcatcttgtctgcttgataccagcccctctcacagacttaaggatactgcttttgtaatcgtcccgcttttacctccattgtcagttttttccctcttggctgagtcattcccataagcatacagatgcacaatatctcacattttaaaaaaggaagagaagaaccgccctagatttcatatcttcttctaagttcatcttgattccctgtgctttgctttagagcatatctccttgaaaaaagtttgttgccacttcctcatttcctagtctctcagacgtactctcagtttggcttttatctgcatgactctattgaaaacttttttttttttaatagtgactttcacagtgccaacttcagtaattgattctcagtattcttttcagactcctggcagcattcgtcactgttgttcagttcttcctttttagaacactttcttcatttggcccctgggcacagctctcagattctcccactatttcacgggcctctcttgcttcgtcttttttggtagtgttttcttttcccctcaacctggaagcagtgtagtgtttatggctcactcctaggacctcttcatttctttctttctttactttcatttcccactgcctagctggtctttttcagtctcatgactttaaatagtatctataatgttgattaccaaatttaaattgccaaccctgacttttttcctgaactctgaacatgtatactcaacgtttgtcttcacttaaatgtctgctaggcatattacatttaacacgaatggaaacaatcccttgattactccagccactctgctcctcctgcatttgtccccacttagtaaataaatggctatctgttgctcagccaaaaaccctggagtcgcacttgccttctctcatttaccaacacctgacagttgatccatcagagagtcctgctggccccaccttgacagcatttctagaaggtacttctcataatctccactgctaccaacttctttcaagccaccatgctctctctttgactactgcaatagcctgctaactggtctctctgattctatgcttgctagactaatccctttaaaacataaatctggtcagtgtcacttatctcaaaaccttcctatggtttacttctgattcagagtaaaattgctttcctcactgtgactccctgctgttttcctgactcatctttcaccattctctccttggtcacttagttggcttcagttccagacactccaggtaccctggctgtttgttctttcttgtagttgccaaacacttccttggttcagggccattgcatttacttttccatctgccccagctgcttctctcccagctatccacataacacagtccctcatttcctttagatctctgttcagatatcactttgtcagtcatgtttgtcattcatgcccaccctatgtaaaatagcacaagcactcccatcagtgtttccacctcattcttcctatatctttcagacagcttatttaacttcatagaacttatcaccctccccactagaatggaaactccatgaaatagggacgtagacatttttgtcaattttaatattgtctagaccagtgcctggaacataggagatgttcagttattatattttatacaccatgatggtattggtacctagaagtcatattttattctaaaatatattatgactgttggacattttaacttataaatgtaatactgcaactaattactataacactccctgagacttaactttttgaattgtacataaattaagccaatttggcagaaagaaatgatataaacccttttgtttgattttatcctaggtatgagttaatacagaaaggagtgactgaacttagaactgttgggaatgttccagatgtctacacccagattatgcttttggaaaatgagaacaaaaatttaaagaaagatttgaagcactacaaacaagcagctgagtatgttattttttaaatgacattttcttctttttcttttggactaaataaaagagttgagtgaagctgatatatgtaatataccagagccttaatttttgaaaactgaatttttctagttgtaaagaatgtgagaggcttcattagcaaattaattaaacagatgatcagaactatcacaattataacttaccaacaagaagggaatgcaggtagttgtttaggagatggtacattttttatataacattcacttccttgtgtatttgatagtcttttcatggtttataacattttctcctgtaaagataggctaatttctgaaataataattaaatttatagaaagccgagaggaaattgctagtttattcctggtagaggaatttctgtatttgaaaattctccagaaggaataatataaactgtggactttgggtgataatgatatgtaggttcgtcagttgttaacaaatgtatccctctgttgggggctattgataatggggaaggctgtgcatgtgtgggagtaggaggtgtatgggacatctctgtaccttctaatcaattttgctatgaacttaaaactgctctaaaaataaagtttattaaaaaaaagttaattctctatactgttttccatacaggttgaactaatttacattcccaccaaccatgtatgagtgttctcttttctgcacgttctcaccaacatctgttatttttgactttttaataatagctgttctgactggtgtaagatgatatctcattgtggttttgacttcagtccagcagttccactactgggtatctactcagttgtataaaaattccacccacactcttacgtttattgcagtgctattgatgataacaaagtcatggaatcaacgtaagtgtccatcagcagatgatgggataaaaaatgtgacatttatatacaatggaatactattcagccataaaaatgaatgaaatcaggccttttgcagcaacatgggtggaactcgaggccctcacccttagtgaaatgactcagaaacagaaagtcaaaaaccacatattctcacttataagtaggagctaagcaataagtacatatggacatatagaatggaataatagatactggagactttaaaaggtgggagagttggaggaaagcaagtatgggtaaaatgtccactacttgggtgattggtacaccagaaacccagacttcatcactatgcaatatatccatgtaaaacaactgcacttttaccccttaatctataaaaataaaaaattttaaaaaagaaaatataaactatccataatttcaccacccagggccaaccacttaccattttgttgaatagcagccttgactttcctcaatgcatttatattaatgcatatttatgagtaacttttaaatataaactgcactaataccatattttgtaagttcctttttcattcaagagtacattattaatatattttatgaaaataaattttcttctaacttaaaagaaaattactgaaaggaaacctttgttttgtaatttcctggcataaatttattcatagaagagaagccagatctctccacacctttctttctttctgcaattaatggaagacatgcaattcctggtgaacaattttagataaacagccagtgttattctgacaaggaatgtgtgaatgcattaacttggggtgaatctgcttatctgaggcaatgttatatggaaaaatcaatgctcagatgtgaagcagagttcgtgttttatttattaattcatttttattaaatatagttaaagagggcctttctcacttaaagaatcatattaaaaccaaaattagattaatggaactaccatataggaacataatattgttaagatttttgataagtttaaagaaacatgccttttcattgagaagtagagaaaatatttaagctcttgtaaaagatggcagtaaataatttgtatgatatcatttattcaagtattatctgtacttgtagaaatgtttttgcaaggtatataaattttgtattgtctatggatgtaatgtaccatttagaattttatattttacattagaagtgtatgatgattcagaagaatatattactagaaccagtgttctctctattcttcattccatttctcaaaagtgttttgtactgtttgccctgttgctcactatgattttgtatattcatctaatggattcactgggaatttggtatagcatatttctcacagtgctgcctggcacactgtttcagttcctgatctcctttgaattattgcttgagtttgctaattttcttttaaatagatcaaagcagcctctttatgccataagtttagctccagtgacattgaatagtcattgtcaagtactggttgtttgttgaatattatgtttaatagcaataatacgaaataacatattactcatgcagattattaacttaatgttaaaagaagccaggattaaaatgtatcactcaaataaaacatcttgtcttactaacatatcagattatagttttaattttaacagtttatggctatttctcaaatctatctcattcaatagaacttaaaatctaaaaaattagacaaggaaaatttgtgtttgctttactctacttgacatggaagatttgaaaggaagctgcttgatccttagtagatgcttaatctttattttgttgagtggatattaagcatggtgtgctttcacagcacattttagtaaagtgcttccttatagcctggttctactgatacattcttagaaaatgtagaatgaagttttgtttcgttttgtcagtagttttttattgatacatcataattgtacatacatttatatatgataattgtacatgtgatattttgatacatatgtatcaaatacatttgtacatatgataattgtacatgtgttattttgattacatacatacaatgtgtagtaatcaaatcagagtatttagggtatccatcacctcaaacatttatgattttttgtgtgtgttgggaacatttcaaatctaactattttgaaatagatgataaattattgttaactgtagtcacgctactgtgatattgaacactagaagttaacccttctatctaactgtttgtatccattaaccaatttctcttcatctcccctttccacccaacgttccccacatacttcccagcctctggtaattatcattctccctgctacctccatgagatcaactattttagcttccacatgagtaaggacacgcaatatttgtctttctgtacctggcttatttctcttaacataatcatctctagtttcatctatgttcctgcaaattataggatttcattctttttttaaaaatggcttaataacattccattgtgtatatgtgccacatttgatttatttattcttctgttgatgggtacttaggttgattccacattcttggctattgtgaatagtgctgcaattaagttttgaaaaaagttttccgaactacatctgtcatgctaccagcctgccccaaatggtagtgtttaatcatctaggtttttcaatttgacttctgaggataattttcaaatagcaattagtaataaacatgagattccctatattgagcttgagctaatgtttgtatttttaggattaggatatttcttaaggcaaaataaaacaggcaaaatagaataggatatttcttaaggcaaaataaaatagatatcaaatacttttctaataataatttttaatacacaaaaaagtcaggttgcagatatgtattattcttgattatactaatagcatttagtgatgtatctaggaaaatcaaataaataatacagctataaaattaatatttatctgggggaaagttgccatggaaagagtattgatcttaaagttcaaatacctggcttctaatattctgttacttattaactcagtttattgaattactcccagttttcttattaacctgggaattattttgcatagtgttattaatttctatggaataatgtgataattaaatgagtcaagctatgttaaagagctttgtaaatcacagagtgctttgaaatgtcagctattatcaataactctaaatgctgtcatctctaagtttttattaatcacatcattaatattttttaaattcagcaacgatgaagtatgaagaaggaaatgaaaggagaaaatatttcccactaaaatatcatttgaattgccataattaaagcagggaattgtcattttctctgttgtcaacagtgtcaattttagactataggttttctctgtacctgctataaatatagattatctgtcttccaaaatataaagttgggaaaataactgttgagaacatttctgtatagatgtttttatggagaaaatgatcttattaaaaatttatagttacattggaagtaaaagtatttcccatactggatattgaagaacaatatttttctcagaaaaggagagcatacgttttctattgaaatgtagaccaattgttattttaaatgcaaaagtctaaagttgcacttaaagcaggtgaccacagttgcagagatttggtggttgacaccaacatggcacatgtatacatatgtaactaacttgcactttgtgcacatgtaccctaaaacttaaagtataataaaaataaataaataaataaataaaaaaaagtaaaaaaaaaagattataaaacaccacttagaattgtatctttcacagtttagacactatattcattcataaaccttgttttatttggtagttgtcatgccaaaagatttactttggtctgaagtttataaataactattatgagttttattaattaaaacctttttgcttgatcttcttgcctgttttcactagcattttatgtcttctttccatagtgtagacaatgcaaaaaaaaaaaaaaaaaaaaaacaaaaaactcgtttgggtgattgattcctgaaagcaccagtgtacttgaactttaacatcttgcagtctgactttcatttcactttttctcagttggccttggacacaagagaactgtttgacacccaaatttagcagtcttttttttccatttgtatatcctggtttttattcctatcttcccttagcatctgtgacatcatactgttctgcccctccttctaccttagtgacaggcttcttttccttttcttaactccaaacagttgatactctttaagtacattaggataactattgactacatgtgaatattgacaaatacaacatatattaggtagtggtaagtgctatgaagaaaaataacatgggtaaaggagacagacggggtgctgttttatgtaggattggtaaggggtggggcagggagcaggggagcacatcagaaacctgaagagactgagggaaaaagccaagtataaacttgggaaaatggaattccaggcagaggaaaaaggaagtataaagaggatgtggtgaagacaggttggcttgttagaggattagcaaggaggctatagtggctctaaccagtgggttagtggtagaggcctttgctagaaacttgctttttcccccaggtggcatgtgaagctaatagtttgagcagaagcatgtgaacaggcttctgcatggaaaaatgctcaatgttactaattgtcaaggaaatccaaatcaaaagtaaacgagaaatcacctcatacttttcaggatggctattattagaaaaacacaaacaatatgtccggcgcggtggcttacgcctgtaatcccagcactgtgggaggccgaggcgggcagatcacaaggtcaggagatcaagaccatcctggctaacatggtgaaaccccgtctcttctaaaaaatacaaaaaattagccgggcatggtggtgggtgtctgtagtcccagctactcgggaggctgaggcaggagaatggtgtgaacccaggaggcggagcttgcagtgagccgagatcatgccactgcactccagcctaggcgacagagcaagactccgtctcaaaaaaaaaatagaaaaatacaaacaataacaagtgttgatgtaaatgtggaagaattggaacccttgcacattactggtgggaatgcaagtggtgcagccaccactgaaaaccgaataaaggttcctcaaaaaattaaaattcaaactaccatatgatcaagaaatcccactcctgggtatttatttgaagtgaattgaattgaaaccaggatctgaggcagatattagcactcctgtgttcattacagcattattcacaacagccaaattatagaaacaacctaaatgttcattgacagatgaatgggtaaaaaaaatatggtacattcatgcaatgcaatactactcatcctttaaaaagagggaaattctgtaatatgtgaggacatgcatgaaccttgaggacactatggtaagtgaaataagacagtcacagagggatgattactgcatgattccccatatatgaggtatttaatatggtaaaattcatagaatcagagtagaatggtggtttccaggggatgacaggagaggaagatagggcattacaaatcaaagggcataaagttttaggtaaacaaaaatcagtgctacagatttgttatatatcattgtactacaaccaacaatagtgtattgtacacttaaaaattcgttaagagggtagatctcatgttaccttcttaccatatactcaaagaaagtaaacagtatagactaatgaacctcatagacctataggataatcaacactctacttttgtcattcttatttcacttctactcttacccattccctactgtacctcaagttattataatatataatttttacagttattttttgttatgctttatatacattgaagtatatgtcttagctatataattttggcaaacggataaactcttaaacatccacattcatctcaaggtagaacatttttatctatccagaagttttcctcatgtcccttctcagtcattctctgtcccagcaatcacttttaagaattttttcactttagattagttttgtttgagaatttcataaatggaatcacagtatattattgtgtttggcatcttatactcagcataaagtctgtacaatgtattatttttgcctgtatcagtaatttgttcctctttattgctaagtagtattctgttgtataatgtatactacaacttttttatcctttttccatttagttatttccaacagttggttattaaagataaaactgctgtgaacattgaggtacaaatatttggtgggaatatgttttcatttcttataaaaacttagtggaatttctggatcaaggggatagatggatgtttaactctgtatgaactgctcgtacatattcccacattcaagttggtccattttgctttctcagtaggaatacatgcgaattccagttgctccaaacagctactaacattgagtgttgttagtcttttcagttgtagccattttaactgttgtgttgtggcatcttgtatttttgatatgcattttctgtatacaaatgatattaaacataattttttttgctttttgaccattctaaaaagcattctacaaagcatttatcctgctttctgtatgtttatgttttttgcttgctgatcttataattgaattgtaagagttgtttgtatattctggatataagtgctttgttagaatattgtgaatattttctcccagtctgtggcttgtgtctttaatttatgaatggtgtctttgttgagcagacactataaattttaatgaagcatatcttatcttttttatggtatttattttgacattttgttgaatatatcattttctactataggtcacagagatattctgtgttttcttctaaaacgcttaaaatatagatttttatttcaacataggatctgttcttaagttttgtgcattgtgtgaggtagaagctagaagttaattttctttactataggaatacataattgttctggcaccatttcttgagaaaattatctttaagtctcatttaatttctttggcacttttattgaaaatcagttgaccctttagaataagtttgccaatttccacagacacgggtgatgtaggtgtgacataggatggggattaagttgaaaatataacttgattttggaaaaatatgtgtgtgtgtgtgtgtgtgtgtgcatatctattttttgaggggggaaggattgatactgtcacaagttttagtcctatttacatagcatatctctccatttaagttatatttaatttaatactttatatttatgaaggagcttgaaatttatgcccttcatattgaattatctaatgtttatattttgttgttgcattttcagttccatataatagagactatgttttgtgttcactatacccacggggcctatctctgtgcctggtacatagaaggagcttaagtgattgtgtgctattaaacttttggctctttagttaagcttttaataatttttagagcagttaattggtgatttttgcccctttcatggcatttatttggggtaggcattattttcttgggaatgtaaccagtcttgccgtattttgagtattgtcttcctttgccaggcttttacagtaaggaaatataatgcagaccagaaaggctttgttgagagccctgaagaaaataatactgattgggattactaacaggaagatgaaaaactgccatttaaaaaataatgacatactttattttacaatctgccagagagtataggcataaagaaaaccataattacatggcaattaatattgaggaaaaattaaggtggtttactaaggggcctttatttcactttcaaaatttacttctataaaaggtcaaagagtgcccagcttttgtgaagacccatttagttttatgactttcagaaacaaacactgtgaaaataaagataataatgaggcttataaaatttcatgctttagtgtttaggtaattgcttgttaaattaagaaggtatttttttctggacgtgaatatacccctttcttttttggttaggatataatgaaagtttttctctaatctggttgaattccattttggccatccaacagttattccaatataaaatttagtgggttaaataaattcatttataaccaattgaagataatggaatatttgctaattatgtaactactattatcagaaattactttgattcaattttttcatgtgagaaaaatatatgacaaagatagcctacttcgatgcaggtaaacaagaaaatgtttatatgctttactttgccaaattataacaagataatccaataaactcattattaaatgatcattcaaaaatacttaaaactgttcagttaataaaattattttaccatggatattcacttcaaaatatttttgagcatactattaaataatattcatatcatattgaaaatggagttttggggcaataattttatagttcgataagaatatctgtaccttaatattgcataattgaattgtagactttgatatgctggtttcctgaaatggagaagttaaataatcattgtaccattttattaagacaaagcatgtgcaaattgttttctttatgatgtacacatttaaatagaatgttccactgagtaactcttaacagcgttgtacttgaaacaatgtctgtttgctgtgtttttttttttttaacacaaagatgctctactaatgtgatgaggaaatattatatagtttaaaatattagctgcttatatgaatattttaaactttattctttagtacaacttttattttccatttattaagcagatgggcagcaggaaggtcataataggagaagcaccaccatgaaatgaatttaaattgttctactgaatagacttcattgtgcaaacagaaagaaagtccctgaaaaccaatttaatggtcagaaaaactttaaggtctaatacttcagtcaattcctatgctttgtttcctgggacgagcacaaataggcttctaatgtatatttaaaaagtgaattgatgcaatgctgcacatttatggttctgcttaagaaattttgcagcgttatttcttaaagtatttttaacatgttgtgggtttacatttcacataagataaaaataagctcatttatgtaattcaagtgactgaaattaagacaatttagtatactcaaaatagacgttcacaaaattttaaattcattttttaaaagatacacagtgttactaatattcacatatcctaatatttttggttgattagaagatatttacttactggcacactccttattgtaggaagataaatttagcgcttagaagaattgtgtgtgtctgttttactatactgaatagcagtattatgaaatgatgatgatgattatgagtacagaaacatttattgagtaatttagtatttgctatgtgcaagactatgtaagccactttactaaaatatttaattgaatacgctttgaagctcattatatgtccattttggaggtgctaaatttgatatttacagaggttatatagcttgacaaggtcacattgcaatgaagaatttcctatattgaatatgatattattatcatattagcattactccaatgaagtaaccatatctgttagctgattataaagacataatactggatttttatctatggttctaaaacaaatatagtattattttttagataaactcattcaacttgacatgctttagagctaacttgttttgatagcccgctcaggatattctgtacaacttttttttaaaaatacagggttaaaatgaatgttctaagatcttattcattattctttttgcaaattatttgaagagattcattgatcctttttcaaaacaatttatctcttctacacacagcctttctctatacttctaattgaaaatggaatcattttctaaatgagaattcaagtgaggttcttgtgctttcacaataaagtatcaactcaatcatttacttattttccattcactttacttaaattctctcctcctcttcacttagtactcagtaaggatgatgccaaacagtctgccatctcagggagatggcagagagtttctctctttttagtccatattcactagggaggtcttgtgtacctgagccttaggaatgaggacttttcctgtctctttgtccatcctctgtgttatggccaaactctgccttctatctgtagttggtctttgtaggagtttcatactgctacctcaggagtaggatacttctacttgctgtgatggaatattaaggcctaagatggttacctgttgattggtttggctgtgtccccacccaaatctcatcttgaattcccacgtgttgagggagggacctggtgggaggtaattgaatcatgggggcaggtctttccaatgctgttctcctgatagggaataataagtctcacgagatctgatggttttagaaaggggagtttccctgcacaagctctccttttttttgcctgccaccatccatgtaagatgtggcttgctctttttgtcttgcaccatgatagtgaggcctccccagccaagtggaactgtaagtccattaaacctctttttcttcccagtctcaggtatgtctttatcagcagtgtgaaaatggattaatacagtaaattggtaccagtatagtgggcattgctgaaaagataccagaaaatgtgaaagtgactttagaactgggtaacaggcagaggttggaacagtttggagggctcagaagcagacaggaaaatttgggaaagtttggacctccctagagacttgttgaatggcgttgcccaaagtgctgataatgatatggacaaagaaatccaggctgagatgatctcagatggagatgaggaacttgttgggaactggagcaaaggtgactcttgttatgttttagcaaagagactggtgatattttgcccctgtcctagagatttgtggaactttgcacttgagagagatgatttaggttattatctggtggaagaaattgctaagcatcaaagcgttcaagaggtgacttgggtgctgttaaaggcattcagtttcaaaagggaaacagagcataaaagtttggaaaatttgcagcttgatgatgtggtagagaaggaaatcccattttctggggagaaattcaagccagctgcagaaatttgcataagtaatgaggagctgaatgttaatcaccaagacaatggggaaaatgtctccagggcatgtcagagacctttgcgacaacccctgccatcacaagcccagaggcttaggaggaaaaaatagttctatgggctgggcctagggtccctctgctgtgtgcattctagggacttggtgccttgcatctcagctactccagccatgactaaaaggggccaaggtacagctcaggctgttgcttcagaggatcgaaacccaaagccttggcagcttccatgtgatgttgagcctgcaggtgcatggaagtcaagaattgaggtgtgtggcctctgcctagattttaaaagatgtatggaaacgcctggatgcccaggcagaagtttgcggcaggggtggggctctcatggagaacctctgctaaggcagtgcggaagggaaatatggggtgggagcccccacacagagtccctactggagcattgcctagtggagctgtgagaagagggccactatccgttataccccagaatgatggatccaccgacagcttgcactgtgcacctggaaaagccacagacactaaacaccagcccatgaaagcacccaggagggagggtgtaccttgtaaagccacaggggtggagcttcccaagaccacaggagcctacctcttgtatcagcgtgacctggatgtgagacatggagtcaaaggagatcattttggagctttaagatttgactaccctgctggattttgcacttgcatggggcttgtagtccctttgtttgggccaatttctcccatttggaatggctgtatttacccaatgcctgtagccccgttgtatctaggaagtaactaacttgcttttgattttacaggctcataggtggaagggacttgctttgtctcagataagactttggactgtggacttttgagttaatgctgaaaagagttaagattttgggggactgttgggaaggcattattgtgttttgcaatgtaaaacatgagatttgagaggggccaggtgtgcaatatggttggcccacccaaatctcatcttgaattcccatgtgttgtgggagggacccagtgggaggtaattgaatcatgggggcaggtctttctcgtgctgttcttgtgacagcaaataatcctcatgagatttgatggttttaaaaaggggagtttacctgcacaagctcacttttttttgcctgctgccatccatgtaagatgtgtttgctcctccttgccttcctccatgattgtgaggcctcccctgccatgtggaactgttaagtccattaaacctctttttcttcccagtctcaagtatgtctatgcacagtgtgaaaatggactaatacacctctccatctatcaggggtagagagtttttcttttacttttccttcacctgcaaagtatctttgcctgtgcctgtgtgttgccctttccccaggggcctcagaagtaggcactggtttgtgccttttctgcagcatgcctgggtcctgaggcccccattccaggcctgagctcccacataacatttctagacactttctgggctaaaagggaccccactgccttgaagggaagaacctgatcttggcaggatttaccgtcataagaatgtcattatttaatgatagagcagtcagttcagcaagaggatataacaattgtaaatatatatgcacccaacactggagcacccagatatataaagcaaatattattagagctaaagagagggagagatcgcaatacagtaatagctggagtcttcaacatcccattttcagtattggacaggtattccagacagaaaatcaacaaacatcagacttaatctgcaccatagaacaaatggacttgatagatatttccattctcaatgatagactatatgttaggttacagaacaagttttaaaacattcaaaaattgaaataatatcaaacatcttctctgaccacgatggaataaaactataaatcaacaagaagaggaattttggaaaccatatgaacatgtagaaatttaacagtatgctcctgaatgaccagtggatcagtgaaggaattaagaagaaaactgaaaaatttcttggaacaaatgatagtggaaacacaacataccataatctatgggatacagtgaaagcagtactaagaggggaatttataggcacttacataagtgcctttttcttcaaaaaagaagaaaaacttcaaataaattacctaatgattcatcttaaaaagctagcaaagcaagagcaaacctaacccaagattagtataaaaaataaataaaaaggaacagaatagaaataaatgaatttgaaatgaagaaagcaatacaaaagtcaaggaaacaaaaaatgttattcttttgaaaagataaacaaaatcaacaagtccttaggcagattaaagcacaaaaaaggaaaagacccaaataagtaaaatcagatggaaaaggaaacattacaactgggattgcagaatttcaaaggatcatcagtagctactatgaccaactacatgccaataaattggaaaatctaggggaaatggataaattcctagttagatacaagctaccagaattaaaccatgaagaaatacaaaatatgaatagaccaataacaataaacaagattgaagctgtaatatgaagtctcccagtaaagaaaataacaggacctgatggcttcactgcttaatcgtgccaagcatttaaagaactaacaccagtgttactcaaacaattccgaaaaatacaggaagagggaatcttttccaaactcatttacaagacccatattaccctgatacccaaaccaaagacacatctaaaaataaaaccacaggccagtatctctgatgttgattcaaaaatcaacaaaaataccagccagcggaattcaacaatatattaaaaagataattcatcatgaccaagtgggaattattccagggatgcaaggatgattcaacatatgcaagttaatcagtgtgatacattacatcaaaagaatgaacaacaaaaaccatatgttcatttcaattcatgctgagaaaaatttaatacaattcaacatccctttatgataaaaactctcaaaaaatttggtatggaaggaacatacctgaacacaataaacactatatttgtcatgccaccgtgtcatactgaatagggaaaacttaaaatcctttcctctaagatctgaaacatgaaaaggatgcccattgtcaccactattattcaatgtagtagtggaagtccaagcaatcagacaagagaaggaaataaatggcatataattggaaaggaaaaagtcaaattatccttgtttgcagatgatatgatcttatatttggaaaaacctaaagtatccaccaaaaaaatgatgagaactgataaattcagcaaggtttcaaggtacaacatcaacatacaaaaatcagtagcatttctgtatactaacagtgaataatctgaaaaagaaattagaaagtaatccaacttacaatagccatggataaaattagataggaagtaacaagcaaataaatgaaatatctctacaatgaaaactataaaacactgatgaaagaaattgaagaggacacagcaacatggaaagacattacatgtttatgggttctaagaatcaatattgttaaaatgtccatactaccctaagcaacctacaaattcagtgtgacccctatcaaaatacccatgagattcttcacagaaatagaaaatacaatcctaaaatttatgtagaatcacaaaagatccagaataggcaaagctatcctaagcaaagagaacaaaaccggaggaatcacattacctgacttcaaattatactacagaaatatagtaaccaaaacaacatggtactgacataaaaccaaacacatagaccaatggaacagaatagagaaccagaaacaaaaccacatacctacagtgaacacatttttgacataagtgccaagaacatacactgtggaaaaggcagtctcttcaataaatggtgctgggaaaactggatatctatatgaagaagaatcaaactggaatactatgtctcatcatgtgcaaaaatcaaatcaaaatgaaattcctaagagaaaactaaaagaaactctcaatgacattggtctaggcagaaatttcttgagtaataccctacaagcacaggcatccaaagaaaataatggacaaatggcatcacatcaagttaaaaagcttctgcatagaaaagggaataatcaacaaagtgaagagacaaacccatagaatgggagaaaatatttgcaaacgactcatctgataagattaataaccagaatatataagaaactctataggaaaaaagtctaatactccaattaaaaaaatggacaaaaaatttgaacagacttttctctaaagacatacaaatggcaaacaggtatatgagaaggtgttcaacatcattgatcatcaggcaaatatcagtcaaaactatgatgagctgtcatctcaccccagttaaaatggcttttatccaaaagacaggtaataatgctggcgaggatatggagaaaagggaacccttgtacgctgttggtgggattgtaaattagtacaaccactgtgaagaacagttcgcagttcctcaaaaatctaaaaatagatctaccatatgatccagcaatcttactgctgggtgtatatacccaaaagaaaggaaatcagtatatcaaagagatatctgcactcccatgtttgttgcagcactgttcacaatagccaggatttgaaagcaacctaagtgtctatcagcagatgaatggataaaggaaatgtagtacatatatgtaatggagaactgttcaaccgtaaaaatgaatgagattctgtcatttgcaacatggtggaactgaaggtcgttatgttaagtgaaataacccaggcatggaaagacaaatttcacatgttctcatttatctgtggaatctagaaatcaaaacaattgaactaatggagatagagagtagaaggatggttgccagagactgggaagggtagtgtgtgtgtgtgggtgagccagggatggttaatgggtacagaaaaaattagaatgaataagacctagtatttgttagcacaatagggtcactgtagtcataacttaattgtacatttaaaaataaccgaaagtaaaattcgattttttgtaacaggataaatgcttgaggggatggatgctctattttccatgattattacacatgcatgcctgtttcaaaatatctcatatactccatgaatatatacatctactatgtacccacaaaaattttaaaaagtaataattaaaaattatattttcatttagcaatatagataaatggttaaaactagaagtttgtaatattttggaagagatgaaagcatgcaaataacaagacaattcaaaaaggttgtcacaaacataatgaactgttcccaaagaatctcataatgaacttgagaaaattacatccctatctacaatctaaaaattggaagatggacatgtattcctattttaaatacaggctttattgttgttgaaatgcaaaactgtcctaaattgcactatcttttttgttaaagtgagtatatgtaactgttacactaaaaaatacactatatatatttaaaggaaaataaccattaatttttgtttttacaacagagacatcttgaccagaagcaatacaataacaaattagaaaagataaaaagcacttcattcaatatcagtatctatattatttctcaatttatgttgtcagcttatgttatttgtcaaattatattcttgatatacgcaaatgggttaaaatcagaaaagaataaattgtttatctaatcattcatatattcctcagatgatttttcaagactgaatgttcgaatcaataatttcttgcacgtataagattgttggcatgaaaatgaggttgaggtttaggtggagaaagttcaccatgagtattgtgagtcacctgaacattgtttatttacgtgtaatgaaaactacaaaattggcagtaaaataacagtagaggtcatttttaaaaaaatagggtgtgctgggaggtggggagaaagaaacttagggggtgagagtagccaagtttaccaaatagaaacagctccactctgtggctcccaccaagaaggatgaaaacagccagtgaattctgaatcttcagttgaggtaccaagcttttctcattgggactgactaggtggttggcgcaacccagggagagcaaagaagagcatcgagggcccacccaagagctgtgtgggcaaaggaagctttctcccccagccaaaggaggcggtgagggattgtgctacccctccctgaaaaccttgcttttgtcatggatccttgcaacctgcggatcaggagttccccttgcgagcccacgccaccagggccttgggtcccaagcacagaactgtaaagacatggcagctgcttgggtggctggccatttcagcaggcaccaagacacagtatttgcatactccagctctgggaactcccatgaggcaggatatctgtccactcctgtgggaagggggctgaagccagggggccaagtggcctcacttccacagaaccccacaagctaaaacacactggcttggaatccctgccagccaacgcagcaggtcagagactgcctaggaagacttaattccgagggcaggagggttggccaccatcactgcggctccagttggccattgtcccctgctgtaggtgccagtgagactgggtggtctggactaggagcaattccccacagcgcagcacagcagctgtgtcagttcatggctagactgcttccttaagtagaacactgatccattttttctcactgggtgaggcctctctgtgggaatttcagcatccctagacaggagtttatgaacagaactttgatatccctgagaggagccactaggaggggcagctacggtatcatggatcagtggtctttgtcttttctgcctgctggctctggagagtcaggggagcccagatgagggtgcagcacacccgctccaccaaggggcagccagactgcttatttaagcaggtgcctgatcccactcctgctgactaggtgagacctcccaacaggagtccacagataactcatatgggagaattccaactggcatcaggttggtgcccctctgggacacagcttccagaggaaggagctggcttccatctgtgctggtctgtagcctctgctggtgatacctccaggggtgggagggacccaggcaaatagggtctagagtggacctccagcaaactgcaacatccctgtagaagagggggcctgactgctaaaagaaaaacagaaaacaacaacaacatcaatgaaaaggaccccacaaaaacccatccaaaggtcagcaacctcaaagatcaaaggtagataaactcatgacgatgagaaagaatcaacacaaaaatcctgaaaactcaaaaagccagagtgcctcttctcctccaaatgattgcaacatgtctccagcaaaggcacagaactgggctgaggctgagatggatgaattgacagaagtaggcttcagaagatgggtaataatgaacttcactgagctaaagaattatgttctaactcattgcaaagaagctaagaaccatgataaaacattacaggagctgtttaccaacataactagtatagagaggaatataaattacctgatcaagctgagaaacacaacacgagaacttcacagtgcaataacaagcatcaatagccaaagagacgaagcagaagaaagggtatcagagcttgaagactatcttgctgaaataagacaggcagacaagaggagagaaaaaaagaatgaaaaggaatgaaaaaaacctctgagaactgtgtgattatgttaaaaaaccaaacctatgactgataggagtatctgaaagagacggagagaatggaaccaagttggaaaacacacttcaggatatcatccagaatttcctcaacctagcaagacaggccagtgttcaaattcaggaaacccagacaaccctagtaagatactacatgagaagatcaagcaaaagacacataatcatcagattctccagggctgaaataaaggaaaaaatgttaagggcagccagagagaaagtccaggtcacctataaagggaagcccatcagactaacagtggatctctgcagaaaccctacaagccagaagatagtgggggccaatattcgacactcttaaaagaatttccaacctagagtttcatatctggtcaaactcagcttcataagtgaaggagaaataaaatctttttcagacaagcaaatgctgagggaattcatcaccaccaggcctgccttgcaagcactcctgaaggaagcactaaatatggaagggaaaaaccattaccagccactacaaaaacacactgaagtacacagaccagtgacaatatgaggcaactacgcaaacaagtctacaaaataaccagctagcatcatagtgacaggatcaaattgatacataaaatattaaccttaaatgtaaatggactaaatgccccaattaaaagatgcagagtggcaagctggatagaggcaagattcattggtgtgctgtattcaagagacctatctcacatgcaaagacacacatagacttaatcccattactgggtatatacccaaaggaatataaatcattctgttacaaagacacatgcatgtgtatgttcattgcagcactatttacgatcacaaagacatggaatcaacccagatgcccatcaatgatagactggataaagaaaatgtggcacatatacaccatgaaatactatgcagccataaaaaggaatgggaccatgtcctttgtagcgacatggatggagttggaagccattatcctcagcaaactaatgcagtaacagaaaaccaaacactgcatgttctcacttataagtgggagctgaacaatcaaaacacatggacacaggaaagggaaccacacacactggcgcctgtcagggggtggagtatgtggttgggggaggtggagcattaggaaaaatagcgaacgtatgctgcgcttaatagctaggtgatgggttgataggtgcagtaaaccaccgtggcacatgtttacctatgtaacaaaccttcacaacttgcacctgtgccccagaacttaaaaaaaaaaaaaagaaaagaagaaagaaacttggaagaatggatcagagaccttgcaccatatgcctcatgtaatttgatcttcatcaagaagtcgttaatcaacatatgcttcattgagagccttactttatctcataaacatctttggtagcatcccatacgctgatcctcagtgattgacttctgacaccgcttaaagcagaaatctgttcgtgtgcatttattttatgtgaatcaaaattttgaaataattgtgacccagagaagtagatttcttctgtttcaatcctaatatgaggtatcagtccatttttcagaatggaaatgtgacagtgtcaatgctgtagcactttgtcagttatctgaggctgagaactactttttcattataaattatatttcacattattgtattgaaactaatatattatggaggtaagtgaaacattctcattaaatgttcacatagaacctgggattagaaagaatcctttagcttgctttatgccagaggtttgcagaagatatatcaagttgaaaaatttttctgtattacagcactgatattgaagaccattctcatcaagctatgaattatgtagtaatcagatccactgatgatatatatttattttataccatgaaatcttggttttctagaatttatatgctttcttttcccaattatcagaactgaataatctagtatattctctttaactttacattctaggaagttcagagttaaattccataaagtctttatttttaataattttgaattgtcatgtttcatatatttcaattttccaagccaaaaaggttctctttggaaatagatggtttatactttggacatgttctggcagcatacctttaattttcatttacttagatgaaatgtagatgaatcatatttttggaactacaggttttgccctttcatccttcacccccatacctaatatgaccttatacaaattatgtttgatgagaatcttcgatgagaattatagcaaaatatttgttttcctattatcttttgaatggcacaatactggatttgaactcaagactaaataatttttcgaaaaagaattagcagtgatttataaagttactatttttttttcagcaaagctagagaagatttgctgaaaattcagaaagaacgtgattttcatcgaatgcatcataagcgaatagtccaggaaaaaaacaaattaattaatgacctcaaagggtaagcttatacttgttggcatatttattaaagagttatttaatacatgttaagtaatttgattatgacaaagttttagacaaagttattaattccacggttattgagcataagatgagtaagttgcgacccttgctgtcaagggtctcagaaaatacttgtgtgtgtgaagtgggaggagttaagcagaaatatactgaaatacactgcattgttgctatgccacccaagagggccatcatcccaatacgactggagtgtgagagggctcaaggatttatttccacaggaattaaattctcaagtatgagtaagagtagacagtgaggaagtggggtccgcacagtgctctttgcagatagtacatcctctgcaaatgcaccaagacatgaaaaaacatgttacgttcatcaaattgtgtacatagagagtaaagtgcagctgtggtattgcagggataggggacatatctctaaatgactatgaatttgtaagtcttttagaaattattttgaaggcattattgagatttactttctctccttctttaccttcctcccctacaaaaacaagaaaataaatttacaatccttaaataaaattatattttgcttgctctaaggcagtgctatccaacagaactttttgtgatgatataaatactctgtatctgtactgtccaatacaatagcccctaaccatttatatttaaaaatataccatacttgttcaaattcctaatatgtttaaagaatacttttcacataaaattcatcattttagattacatgtttttttcgtatttcattatttcaggcaccctggtaaagaagcacacattactttgtaatacagctacacttggtgtatactcagatagcctttatttcttcatttaatcattaagaaaaacatctccatttaacaatctggatgaatcactaaagctcattttataaagacctaaaacaaaacttcaatgatgccatcaagtcacaaaactgggtatcaagttaatcagtcaaacacagtgaatactttgcccgatagctgcgcgattgcataataaatcagctataggacagagtgttttgatgccaggcaaagttggggtctgaaatctcttatgtcacattttacccaaatacattaatagtgtatccatatttcctttcattgtaaaccattaaatgtttaccttatttttctgtaaatttttcaactagtttgataataaattttacagtatttctttgtttgttgttttgttttgctttttagagtcagactctcattctgtcgcccattttagaatgcagtggtgagattaaggcatcctgtagccccaactcctgggttcaagcagtccttccgcctcagccttctgagtagctgggtctacaggtgcatgccaccatacccagctaaatttttttgttttaatttttttgtagtgatgggggtctcactttgttgatcaggttggttttgaactcctgggcaccagtgatcctctcagatcggcctcccaaagtgttggaattacaggcatgagtgaccaagcctggccagtatttcccatttaacacaagtatcttattatgaacgtgcttattttcagaattatctatagctaatattagaacttgcaaacagatgaattatgaagtacttatggactttataaaatagacacaccctttaaaatagattaaacagagtttttctagatgttgtttccttgttatattccagtgaaattctatgtgttgttaattcttttaacagaagatagtcaagccatatctcatgaatgagttaaattccaaagttagtaaaaaaagggaaattttgccatcaatattttctttaaaattcttcaaccatccacagattacagtatatatagttttgtgtatacaattctatatctgtgtgttgtatgtatttatgaatatgtaatgtttatggagattatagtatgcagcaaagtgtatatatattacatacatatgtatatatatatgacatatgtgtatatatatgttacatatatgtgtatatatatattacatatatgtatatatatattacatatatatgtattatatatatatataaacacacactaagctaatcagaaaggaggatagaactgtacatactacctaaatttttatttttgttactttttctgagtgtcatattaatacacattaaatgtatatataatgcaactgcactttaatacttaatttctattgctatcatcaatgaggtataatgtgatatccaaattaatgacgtttataaatactgctatgaaaatatagaaaataaaaagctctgttttaattattaatggaataaaatattattcttttggaggacttttggggaatttctgctttgggctatgtcattgtaaatagtatagaattagctctccaactggtactggactagctccccaaatgtaaggaactacatgactggacaaaatacatgaggcagttttttttttaagatggtggaaaattggcaaagcaggaccgtgatgcctaagagaagacaaacacaaaatgagcaggatgatcaacccacatatcttcctgaaggtacttttcagcccacagtttgaccagatataacccaagcagagcatggtggctttcagagctgaggaggcagagatcagagttcagggctgcagaggtagctggaacttgcagcatggtgtacacagaaggaaggaggtacatgaaatgtagcttaagaaatatctgtaatggttctcttcagtctttggccacgtaactaacttgtggaagtataggatgagagaacatgaagcctggcaggaaacagcacctgggaaactctgagcaaaatagagattccagaggttgcacagtgctgggagatgcaggagttctgaccagccataagggaagtaacctcactgaatactctgagcatttacttaatatcctccacaagccatgccacagaagcagacctagttggtcctagacaaagtgttgctttagaatttttctccaaaaagcttaaaggtaagctttgaaaaactcgagctgattcactgggaaattaactgtctgtcagaaaataactctttaaaggaagaaaacaaaattcagacaagtgtatgtccaacatacaataaataaataaagtttatacgtattgatttatctatagatatatctagaagcaggaagacatgtcctataatcaggaaaaagcagaaccagacacagagaaaagaaaattacagaattagcaggcagggactttacaacagttattatgaaatgcttagagttttaaagaaaatggtgactgtaaggagtgataaacagaattaaactgaaatttgagaactgaaaaaaacataatatgcaaatgaaaaatttactaataggtcttagaagattggacattgccaatggaaagatcaatgaacatgaagacaggaagatggaaaatgatccaactggtgcacaaagagaaaaaagctgaaaagaaatgagcagggactcaaagaaaaaagactgaaaaaacataaatagaacctctggagcaatattaaatagtccatcataggtgtgtatttgaaatccaagaagaggctgggcataaccttccctattctgctagcttattccaattgttaagtatacaaattcaaattatttactcaggaagactggagttgatcactgggtgcttacatgaaccaaatatgctgtgagcagactttagccaggactgtacttattttctgttcccctgtagactcccattctaacagaggggtcatgattctgctttaggtttctgaatttgaatgaccacttcttaaaatatctttccccagtacatagtcactcaattaaatagccaggggtaatttgcagaaaaattgaggctatttataacagtatataattgctatggtgttacggagtgcttcctctactgtctgccagggtagctccagcatttccacttcacagcgttggctatctttttccaagttttgaaggaccaccctagaagtgaatcaaccttattcactggagtttttttcttttttttttgtattttaagttttagggtacatgtgcacagcgtgcaggtttgttacatatgtatacatgtgccatgttggtgtgctgcacccattaactcatcagttaacattaggtatatctcctaatgctatccctctccacttcccacaccccacaacaggccccggtatgtgatgttccccttcctgtgtccatgtgttctcattgttcagttcccacctatgagtgagaacatgcggtgtttggttttttgtccttgcaatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccgcaataaacataacgtgtgcatgtgtatttatagcagcatgatttataatcctttgggtatatacccagtaatgggatcgctgggtcaaatggtatttctagttcaagatccctgaggaatcaccacactgacttccacaatggttgaactagtttacagtcccatcaacagtgtaaaagtgttcctatttctccacatcctctccagcacctgttgtttcctgactttttaatgattgccattctaactggtgtgagatggtatctcattgtggttttgatttgcatttctctgatggccagtgtgatgagcattttttcatgtgtctgttggctgcataaatgtcttcttttgagaagtgtctgttcatatccttcgcccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccgtgctgttttggttactgtagccttgtagtgtagtttgaagtcaggtagcgtgatgcttccagctttgttctttttgcttaggattgacttagcaatgcaggctcttttttggatccatatgaactttaaagtagttttttccagttctgtgaagaaagtcatgggtagcctgatagggatggcattgaatctataaattaccttgggcagtatggccattttcacgatattgattcttcctacccatgagcatggaatgttcttccatttgtttgtatcctcttttatttccttgagcagtggtttttagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagaccttgctgaagttgcctatcagcttaaggagattttgggctgagacagtggggttttctagatatacaatcatgtcatctgcaagcagggacaatttgacttcctcttttcctaattgaatacgctttatttccttctcctgcctgattgccctggccagaacttccaacaccgtgctgaataggagtgatgaggcaggacatccctgtcttgtgccagttttcaaagggaatgcttccagtttttgcccattcagtatgatattggctgtgggtttgtcatagatagctcttattattttgagatacgtcccatcaatacctcatttattgagagtttttagcatgaaggttgttcaattttgtcaaaggccttttctgctctaatgagataatcctatgttttttgtcattggctctgtttatatgctggattatgtttattgatttgcatatgttgaaccagccttgcatcccagggatgaagcccacttgatcatgatggataagctttttgatgtgctgctggattcggtttgccagtattttattgaggatttttgcatcgatgttcatcagggatattggtctaaaattctctttttttttttgttgtgtctctgccaggctttggtatcaggatgatgctggcctcataaaatgagttaggaaggtattccttctttttctattgattggaatagttttagaaggaatggtaccagctcctccttgtacctctggtagaattcggctgtgaatccttctggtcctggactttttttggttggtaagctattaattattgcctcaatttcagagcctgcaattggtctattcagagattcaacttcttcctggtttagtcttgggagggtgtatatgtcgaggaatttatccatttcttctagattttctagtttatttgcatagaggtgtttatagtattctctgatggtagtttgtatttctgtgggatcggtggtgatatcccctttatcattttttattgtgtctatttgattcttctctcttttcttctttattagtcttgctagtggtctctcaattttgttgatcttttcaaaaaatcagctcctggattcattgatattttgaagggttttttgtgtctctatttccttcagttctgctctgatcttagttatttcttgccttctgccagcttttgaatgtgtttgctcttgcttctcttgttcttttaattgtgatgttagggtgtcaattttagatctttcctgctttctcttgtgggcatttagtgctataaattttcctctacacactgctttaaatgtgtcccagagattctggtatgttgtatctttgttctcattggtttcaaagaacatctttatttctgccttcatttcgttatgtacccagtagtcattcaggagcaggttgttcagtttccatgtagttgagcggttttcagtgagtttcttaatcctgagttctagtttgactgcactgtggtctgagagatagtttgttataatttctgttcttttacatttgatgaggagtgctttacttccaactgtgtggtcagttttggaataagtacggtgtggtgctgaaaagattgtatattctgttgatttggggtggagagttctgtagatgtctattaggtctgcttggtgtggagctgagttcaattcctggatatccttgttaactttctgtctcgttgatctgtctaatgttgacagtggggtgttaaaatctcccattatgattgtgtgggagtctaagtctttttgtaggtctctaaggacttgctttaagaatctgggtgctcctgtattaggtgcacatatatttaggatagttagctcttgtcaaattgatccctttaccattatgtaatggccttctttgtctcttctgatctttgttggtttaaagtctgttttatcagagactaggattgcaacccctgcttttttttgttttgcttggtagatcttcctccatcccttgattttgagcctatgtgtgtctctgcatgtgagatgggtttcctgaatgcaacacaatgatgggtcttgactccttatccagtttgccagtctgtgtcttttaacgggagcatttagcccatttacatttaaggttaatattcttatgtgtgaatttgatcctgtcattgtgatgttagctggttattttgctcattagttgatgcagtttcttcctagcctcgatggtctttacaagttggcatgtttttgcagtggctgttaccggttgttcctttccatgtttagtgcttccttcaggagctcttttagggcaggcctggtggtgacaaaatctctcagcatttgcttgtctgtaaaggattttatttctccttcacttatgaaggttagtttggctggatatgaaattctgggttgaaaattcttttctttcagaatgttgaatattggcccccactctcttctggctggtagagtttctgccaggagatcagctgttagtctgatgggcttccctttgtgactaacccgacctttctctctggctgcccttaacattttttccttcatttcaactttggtgaatctgacaattatgtgtcctggagttgctcttcttgaggagtatctttgtggcattctctgtatttccttctactttgctctttccagtgcacatggaattgtcactaaaatagatcgtatactgagccataaaacaagtctctatacatttcaaaggatggatgtcatacatagaatattttctgaccacaaccaaattaaattagaaatcaatttttaaaaatctcaggggatttctcaaatatttggaaattaagtagtatactttaaataatccatgaggcaaagaagaaaattacagaatattttgcgctgaatgattaaaaatgcagcatattgaaatgcagccaatgcggcttaaattgaaattgatggctttaaatgcttattttagaaaataaagttttaaaaccaatgatgtcatcttagaagcttaaaaagagcaaattacaaccaagaaacatgaagaaatgaaaaataagagctgaaatcaataaaatagcaaatggacaaacaaaaaatcaacaaagtcagatgttggttaatggaaaatgtaataaaactgacaaatttgataataagatggataaactcttaatagactgatatcaccagaggctggcaataatgtagggtacccaggactgtcatatagggttgttggaagtataaattataacccagcaattaaactcctgggtgtttatctaaaataaatgaagatatatgaccaaaaatattacatgacttatataaaaatgtttaaagaggccttattcatgatagcccaaactaaaatccactcaagttttcatcagcaaaatattggataaccacattgtggaatatacatacatacaagggaatactactcacagtaaaaaggagtgaagtattgctatgtaaagtaatgtggaataatctaaagaaacattacactgagtgaaataaactagttaaaaaagagaacatgttatatgataccaaataaatgaagttctagaattttctggggtgttagacatgcttcatattttgataatgtatactacttgggtgtgcatttctcaaaactctgaactgtaacgcttaagagctgtatgttttatccatgtaaattacacttcaataaaaagattttgaggtcattttcaaataaaacagattttttaaaggtatattatatactaggctgaattattccttctgtttagatatcaaaatgtttttatacttaatttttaaaatacaagattagccaaacttgttttaaagactatcctttagtttattttgatgtgaatgacactccatgtttaatcatctattgtttgtggcccttgtctttctgatagttatttccaaattgacaaaaggaattgcattttaaaaaatttcatgggtagcagcaatcttctgagtacatacttggacacagcaaaaggtgctagtaggaaatagagaactagttaagacgtgatttgctccctcactgcaccctccaccctcaagttgcagtgaagttgtatgctttttgtgcttcttggctgtagtgtgttaacctttatatgattattcatttttatttcacagcaaaaaagaaaaagaaaaaaaggttttgatgttagatggaaattactgatttaactcaataaccccttaagatgctattgactttattttttataggttgaagttacattatgcatcttatgaaccgactataagggtgttacatgagaaacaccacactttactgaaggagaaaatgctgacctccttggaaagagacaaagtagttgggcaggtaaagatatagtcaaagctaacttaaaatgatcttttaatcatttttttaataatacaagtagaaatactgattttgtttctgagattaattttaaaacattttcaaccaactttcatgtaaaagagatccatttggaaacattcagaaaaagtatttctccatttaactacctataaagattattataaaattaggccaggggcagtggctcatgcctgtaatcccagcactttgggagaccaaggtaggtggatcatttgcggccaggagtttgagaccagcctggccaatatggtgaaaacctgtctctactaaaaatacaaaaaaaaaaaaacaaaaaacaaatagccgggtgtggtggcacaggcctgtaatccctgctacgtgggaggctgaggcatgagaatcatttgaacccgggagtggaggttgcagtgagccgagatggccccataccactgcactctagcctaggcaacagagtgagacagtgtctcaaaaaaattaaattaaatatcatttaattgagacataaatttatagcagattattaaattatagttagaagaaaaaacttagccattgtggtcaaacttgggtttaaatgccagctttgacagctataaacattaaccttaggagagtcatttaaacaaattggagctcagatttctcatatataaaatgtagctgcaaagaccaaagacataccatttaagattgctgtgaaacttatatgagatattttaataaataaaaactccctcataggtactgactcaagtttttggttatttttgctaatgcttgacatccttttagggtttttgtgtaggcttaggcctagggtagtgggtgagatacctttggcataaaaatttaagaaaaagaaacaaaatgtttatatgccactttaaaaccatttatcagtttttttagaatatataaaactgcaactatgcttaacattctattattgttttctggagattttcatttttggccaaactttgagaagctacaaaagcttacatgatgataatactcttttgaataattttatttgtcaagacatgctttaatcaagtttattttgtcttttgagtgaaattcttagcttcgaaaatgcaaaacatcattgtcttgatgccccttgtgcttgaatttaattttgtgttttgaatgtttgaattttaagtaatattggatacaatgataatatgatttggctgtgtccccatccaaatctcaccttgaattgtaatcatccccacgtgtcaagggcgggaccaggtggaggtaactgaatcatgggggtggtttctcccatgctattctcatgataattgagtgagtctcaagagatctggtggttgtataagcgtctggcatttcttttgcttgcactcactctctttcctgccaccctctgaagaggtttctaccatggttgtaaatttcatgaggactccccagccatgtggaacttgagccaattaaacctctagtctttttttttttttaatatatttttaccctaaaacctctattctttataaaatacccagtctcgggtatttcctcatagtggtgtgagaatgaactaatacaaatgagtttaacaataatttaaattttatggcattataatcaaaccttcagaatttcatacccttgcttcttttcatctaatctgtcttccccagtctcctaacaaaaggctttctttattctatatcctgaggtattaggagctagattcagatctcttcctatttcctattccagatgggccaagcttaagcttttgctacccatcttactctctttagtcctcctggtctcatgcttatctcccatataccatgtacaatatttgtgtttcaagttgctccttgatggtttagtggaaagagctaagaactgggaatggctggtatgaattccagttgtgttgtaaaacacccaagtgaggattcaggttatttaaatatttctttttactcacttattaaatagggataaattatttgccttatgattgatatgtgtacaagattaaaacatgtttaaaaagttaaaatcatttgatctatgagttagagttgaattttgcacactactgttcagatgtgcaaagaaatatatctttattatctgcaactggttttgtctttgaactcctactcctgctgaagacaaaagaaaagataacctgcatattaaagactatcccaatctttgtgagttaaaccagtctctttgggtttaacacagggtgtttgaatattatattaactgaatgtttagctaaaacatagttattagtgctcattttcttccttcaaatggcatgccctttttattcttccccagatggttcctagtaaaaaagttacttgtctatccgtatagcttaaagtctacaggctatattcactctccagtgtactgtgacttgtttgattaggttggtgtccaggtacatgaaacctggatagttctggatagctcctggatagttcctgggtagttcttttgtatgtgaacccaacacaccttgctaaatccatggcctctgccacaatatctgtgaactcctttatatctgtggcctcattatcctaaccctagctttttttctgctccagtacatcaaatattaacatttccatgtaccccactgaggtggttgaggcttctgatttctctatattggaaatacaagccatgagcaatttgaaaaccagttagggtccatctacacagatatacctttttcagtccattttcaacatgacctggagagtagtgtgtttttctagcacaatgtaaaatatgaaggactctttaaggggttgtcaattttcctaggctattgcctgaaaagctaacagcaagtatacttatattcctggagtatccctagagtatctggctttatttgcccttcatttccaactggccccacttgcatttttcacttggtagataaagtaggactcatgtctgacctgttgttacctcgtccctcaggcatctcgtccctcaggcacagaactcttttcacttctttgttctattggatggaatatcttcctatcttctttcatgttacaggatgctctatgtcctcatttgttacagcaatcctgatttacacctatttgcacaggggaatttttaataaattccactttcaccctaaaaatatcccaatttagaaaatctttattaatgggaaaattctatttttttatactttaagttctagggtacatgtgcacaacgtacaggtttgttacataggtttacaagtgccatgttggtttgctacacccatcgtcatttacattaggtatttctcttaatgctatccctgtcccagccccacaccccatgataggccctggtgtgtgacgctccctgccctgtgtccatgtgttctcattgttcgtttcccacctatgagtgagaacatgcggtgtttggttttctgtacctgtgatagtttgctgagaatgatggtttccagcttcatccatgttcatgtcaaaggacatgaactcatccttttttatggcagcatagtattccatgatgtatatgtgccacactttcttaatccagtctatcattgatggacatttgggttggttccaagtccttgctattgtgaacggtgccgcaataaacatacatgtgcatgtatctttatcgtagcatcatttataataatttgggtatataccccgtaatgggattgctgggtcaaatggtatttctggttctagatccttgaggaatcaccacactgtcttccacagtggttgaactaatttacactcccaccaacagtgtaaaatcattcctatttctccacatcctctccagcatctgttgtttcctgactttttaatgatcgccattgcaactggtatgagatggtatctcattgtggtttttatttgcatttctctgatgaccaatgatgatgagcattttttcacgtttctgttggctgcataaatgtcttcttttgagaagtatctgttcatatactttgtttttttcttgtaaatttgttgaagttatttgtagattctgaatattagctctttgtcagatgggtagatggcaaaaattttctcccattgtgtaggttacctgttcactctgatggtagtttcttttgctgtgcagaagctctttagtttagttagatcccatttgtcaatttttgcttttgttgccattgcttttggtgttttagtcacaaagtctttgcccatgcctatgtcctaaatggtattgcctaggttctgttctagggtttttatggttttaggccttacatttaagtatttaatccatcgtgaattaatttttgtataaggtgtaaagaagggatccagtttcagttttctgcatatggctagccagttttcccagcaccatttatcaaatagggaatcctttccccatttcttgtttttgtcaggtttgtcaaagatcagatggttgtagatgtgtggtgttatttctgaggcctctgttctgttccactggtctatatatctgttttggtactggtaccatgctattttggttattgtagccttgtagtatagtttgaagtcaggtagcctgatgcttccagctttgttctttttgcttaggattgtcttggctatgcaggctcttttttggttccatatgaactttaaagtagttttctctaactctgtgaagaaagtcattggtagcttgatggggaaggcattgaatctataaattaccttgggcagtatggccattttcaagatattgattgttcctatccgtgagcatggaatgttcttccatttgtttgtgtcctcttttatttcattgagcagtggtttttagttctccttgaagacgtcctttacatcccttgtaagttggattcctaggtattttattctctttgaagcaattgtgaatgggatttcactcatgatttggccctctgtttgtctgttattggtgtataggaatgcttgtgattgttgcacattgattttgtatcctgagattttgctgaagttgcttatcagcttaaggagattttgggctgagatgatggggttttctaaacatacaatcatgtcatctgcacgcagggacaatttgactccctctttttctaatcgaatcccctttatttctttctcttgcctgattgccctggccagaactgccaacttccaactatgttgaattggagtggtgagagagggcatcgttgtcttgtgccagttttcaaagggaatgcttccagtttttgcccattcagtatgatattggctgtgggtttgtcataaatagctcttattattttgaggtattttcgatcaatacctagtttattgagagattttagcatgaagtgatgttgaattttgtcaaaggccttttctggtggataagctttttgatgtgctgctggattcggtttgccagtattttaatgaggattttcatcgatgttcatcagggatattggtctaaaattctctttttttgttgtgtctctgccaggctttggtatcaggatgatgctggcctcataaaatgagttagggaggattccctctttctctattgattggaatagtttcagaaggaatggtaccagctcctctttgtacctctggcagaatttggctgtgaatctgtctgatcttggactttatttggttggtaggttattaattattgccgcaatttcagagcctgtgattggtcaattcagagattcaacttcttcctagtttattcttgtgagagagtgtgtgtccaggaatttatccatttattctaaattttctagtttatttgcatagaggtgtttatagtattctctgatggtagtttgtatttctatgggatcggtggggatatcccctttatcatttttttattgcatctatttgattcttctctcctttcttctttattagtcttgttagtggtctgtcaatattgttgatctttcaaaaagccagctcctggctactttgattttttgaagggtgtttttgtgtccctgtctccttcagttctgttctgatcttagttatttcttgccttctgctagcttttgaatgtgtttgttcttgcttctctagttctttttattgtgatgttagggtgttgattttagatctttcctgctttctcttgcgggtatttagtgctctaaattttcctctacacactgctttaaatgtgtcccagagattctggtatgttgtgtctttgttctcattgatttcaaagaacgtctttatttctgccttaatttcgttatgtacccagtagtcattcaggagcaggttcttcagtttccatgtagttgtgtggttttgagtgagtttcttaatcctgagttccaatttgattgcactgtggtctgtggtctgagagacagtttgttgtgatttgtattcttttacatttgctgaggagtgctttacttccaattatatggtcaattttagaataagcgcgatatggtgccaagcagaatgtatattcttttgatttggggtagagagttctgtagatgtctgttaggtctgcttggtgaagagctgagttgaagtcctggatatccttgttaaccttctgtctcgttgatctgtctaatattgacagtagggtgttaaagtctcccattattattgtgtgggagtctaagtctctttataggtctctaaggacttcctttatgaatatgggttctcttgctttgggtgcatatatatttaggatagttggctcttcttgttgaattgatccctttaccattatgtaatggccttctttgtctcttttgatatttgttggttttaaagtcgttttatcagagactaggattgcaacccctgcttttttttgctttccatttgcttggtagctcttccttcatccctttattttgagcctatgtgtgtctctgcacatgagatgggtctcctgaatacagcacactgatgggtcttgactgttaatccagtttgccagtctgtgtcttttaattggggcatttagcccatttacatttaaggttaatattgttatgtgtgaattcaatcctgtcattatgatgttcgctggttattttgcccattaattgatgcagtttcttcatagcattgatggtctttacaatttggcatgtttttgcagtggctggtactggttgttcctttccatgtttagtgcttccttcaggagctcttgtaaggcaggcctggtagtaacaaaaccccttagcatttgcttgtctgtgaaggattttatttctccttcacttatgaaacttagtttggctagatatgaaattctgggttgaaaattctttcctttaagagtgtcgaatattggcccccactctcttctggcttgtagggtttctgccgagagatctgctgttagtctgatgagcttccccttttatgtaacctgccctctctctctggcggcccttaacattttttccttcatttcaaccttggtgaatctgacgattatgtgtcttagggttactcttcttggggagtacctttatggtgttctctgtatttcctgaatttgaatgttggcctgccttgctaggttggggaagttctcctggataatatcctgaagagtgttttctaacttggttccattctccccatcactttcaggtacaccaatcaaatgtagatttggtcttttcacatagtgccatatttcttggaggctttgttcatttctttttactctttttctctaatcttgtcttctcactttatttcattaagtcgatcttcaatcactgatatcctttcttccacttgattgaattggttactgaagcttgtgcatgcatcacaacgttttcgtgctgtggttttcagctccatcaggtcatttaaggtcttctctgtactgtttattatagttagccattcatctaaccttttttcaaggtttttagcttccttgcgatgggttagaccacgctcctttagcttggagaagtttgttattaccgaccttctgaagcctacttttgtcaactcatcaaagtcattctccatccagttttgttccattgctggtgaggagttgtgatcctttggaggagaagaggcactctggtttttagaattttccacttttctgctcttgtttctctccatctttgtggttttatctacctttggtgtttgatgttagtgaccttcagatggggttttgatgtgggtgtcctttttttgaagtttatgctatttctgtttgttagttttccttctaacagtcaggccccttagctgcaggtctgttggggtttgctggaggtccactccagaccctgtttgcctcgctatcaccagcagaggctgtagaacagcaaatattgcagagcagcaaatattgctgcctgatccttcttctagaagctttgtcccagaggggcacctgcctatatgaggtatcagtcggcccctactgggaggtgtctcccagtcaggctgcatggggatcagggacccacttgaggaggcagtccatccattctcagagctcgaatgccatgctgggagaaccactgctttcttcagagctgtcagacatggggtttaagtctgcagaagtttctgctgccttttgttcagctatgccctgcccacagagatggagtctatagaggcagtaggccttgctgagctgcggtgggctcctccagtttgagcttcccagctgctttgtttacctactgaagcctcagcaatggcagacgcccctcctcccaccaggctgcagcctcgcaggtcaatctcagactacagtgctagcagtgagcaaggctctgtgggcgtcggacctgctgagccaggcacgggagaaaatctcctggtctgccagttgctaagaccatgggaaaagtgcagtatttggacagaagtgcctcgtttttccaggtacagtctgttatggcttcccttggctaggaaaggcaaatcccccaaccccttgcactcctgggtgaggcaacgccctgccctgcttcagcttgccctccgtgggctgcacccactgtccaaccactcccaatgggatgaaccagcacctcagttggaaatgcagaaatctgtcttctgtgttgatcacactgggagctgcagacgggagctgttcctattcagccatcttggaaacgaccttaatttgaaaattctaaagagctaatttcttgatatctaatatggaacagttagtcccactcttaagataacattgaaaaaaataaataaaatggagaagttaggatttataaatagcttttctctctcaaccaaatctgctgttgaaggtggtagattcactacaatttgagaaagtcaaatttaaataggaggtgctattgctgccactgagctgtcaccacaggttttaccatggacaatgctaatactgaatacttgatactctttcagaattttgttatacttgtcaatggaaactggatgtggcagccaccattctcaggataaattccaaattctacattgttccttatatcactaaattttgttcagaatccaaaatgggtacacaggattgatggagccaatgcaagtcctagttataggacaagctgtgtaaatatctgatatctattgcaaaaggtggaagacacatgattctctaaacccaaactgctaagtggccaaagcgactgtcaaatatccattatacaagtctaaaccaaggctcaattaacctactctccaaattagggcacagaatatagtcctagtcctgtcagctctccaggtgtgtccttgtggaacaagtcaaggttaccacttaaagaatggaaactgtttgtgtacccttcttacaaagaatgatttattgccaaccaatcctttctttctgttgtagcatactaatcaggtatatcctgggtgtacaggcatagattagcctttgaaattgaacatattagtagtgtgtcatggagctatagaatgaatttattcaaagtatgtgtacagagaaaatatcttaaaatatgtgaaatgtttctctataatgtaaaatagaagataggttacttttgtgcttatattttgaatatttctttatttcaacgtttgatgcagttacgctttgagaattcatttccaaccaaactttaggatgtgagttaagagcagtaagacatcttatgttttctagctggattcctgattgttacttccttaaaaactttatcttaatgagcatttagcttactgtgtttctccttaaacctataccttgcataaagaaggattgtataataatttaaaatttttgattattatctagtttgcatatgaaagagtgaaaacacactgtgggatgacaaaaatccgataggaaatacatgttttcaaatttctttagtagatactagacagtgaatcaacatttatttaaaatgtaatgaaaaacctataactttgtttttggttttaagaaattattgaaaatagtgttcagaattttgaattagagctccatgacccaagaaaaggtgaaatagaattgatttgtaggtatctatgtatactaaattatattttatcttttttagatcatgggattctaactcagaatatgtatgtatgtgtgtgtgtgtgtatatatatatatatgtatactaaaaactaaatctaaatatatatatatattttaggtctgtctgcttggagagtctagaagtagtgacactccaccagtaatgaacatatccagtgttaggatcttgatttctaatatcactctgtaataaaaggaaaggaaacagggttctttggagaagtgtctgattctagagctgggcagataaaatactagataggcctggagcacttgggacattttcttgtgctagaaaggaaggaaatgctcaaaaagtagaacagaaaagaaaaaaaaactcaacataataatgggatatgtcaagttatgacaaaggaactgtagtgggcacctgcagaggttggtggatccccaactaaatttgatttggatattcagactgataatgccacacacacacacacacacacacacacacacacacacacagaggctgtgaataaattcactacttgtggaactgaatttgctgaggagagctgcacattacctcccaagcatttctgaaatggcttgagagagcaagtaagggagactggcttggggtttttattgcggttgggggttagggccagggtgagaattctcatatgtgaggtgaggcttgagtcatttgaatctcccatcagtaccagacaagggagtacccaggcattcttgtccagttgcccagatgttgggcacaagggaagaaggaggaggtaaaacttaaaggctgttgacactcaaacatcaaacaataaagtcaggttcctcattataggaatccaacctgaaagagcttccagtgatcaaaccttctgaaacaatttgagcaacaaaataatgtagtgtttgattataacccaaaatataaaataaatatctttgattccttaatggtataaatataaatgattagtaaggacatgtgagagagtagacaaatctcccatacagaagaatctcgagtaatatatgttgataatccttccctcaagtaggtggagcttaacaactcagctgttgagtgttggctgcactttgtaaataatgacttgcatccagaaatgcaagggaaatagggaagaaagtaactttacagtggggaaacctgtcaaccttctcatcatgtaaccaaaggatcaaggtgaacatcatcagttttaagtactgttggtagcatgaacctatgatgtaatatgctaataatggcactcccctgtgatcttcttgcaaatccataactttagtctaaccatggggaaaatatcagacaacctcaaatctagggctattctgtaaaatactgtcagactaatgctccccaaaattgtcaaggacattaaaatcagggaaaatctgtgtattagtccatcttgtgttgctataaaggaatacccgagactgggtaatttataaggaaaagaggtttatttggcgcatggttctgcaggctgtagaagaagtatagcaccagcatctgcagagagatctgcctccatgacccaaacacttccccctaggccccacctccaacactggggatcacttttcaacaagagatttggagaggacaaatatccaaactatatcagtctgagaaactgtctcagtccagaggaggcttaggagacctaaaaactagttgtaaggtgatattctggatgcgattttgaaacataaaaaggatattatggaaaaattaataaaactaaaaatatggcctgtagttcataataatatatcaatattggttcattatttgtgaaaaatgtatcattacaatgtatgatgttaatgggggaaaaagggtatgggataaaacaggaattctcagtactacattagcaactctcctgttaatcttatgctattctaaataaaaagtttatttttgaaatttataattcttttggcttctaggaatagatagtaatcttttacttttttttaacctaggcatttcatgagcactcatctataggttataattaataaattatgttattttctattaataaagaaatattactattcagtgatagtagaaaaaagtgtgtatctgtatgtaattgaacagatggtattttgtgttggtataatcatatacaatgcaagatgaaatagcttttcaaggtcaaattttaaattaagtatttttcaggaatacaggtaaatcatgacaccaaagctaacaaaagttcttagttataagacatgtttaataaaatagagaatatatgtgggtggaaaatgagctaagagttgggggaataaaaacaacctcttcatattttacattccaagtgataattaccttgtattttataaatataaagatgatagttattgtgaaacaatttgaacagaggaaaaacctctctcaaaatagagaattgaataattattaaagtgtacaatgagtattcttaattcaggaaactatgccgtgaaataaatgtttcagatgcttacctaaaataagtaattaataattagctggtggaattatattttaacttaaaattctgtttttcttttgttaaaatttatgttttattaaaaaaggtataaatttaaaagagattaatattttttatattttacaatggatatttaaatattgtgttttatgtaacctttttaaaagtcatttagtgtataatttcatttctttgaattttactttttagatttctggacttcaagaaacattgaagaaactgcaaagaggacatagttaccatggtcctcaaattaaaggtaaatgtaaaatgtgatgaagctctcatttaatatagtttggtgatttctcaaccttatcagtgattaatattctagagatatttaaaggtgagtaagtggtggctatttcacaaattaaaattttaataaaaagattaagaagaaatatagatatcatactgtatggattaattatagagaaaaacaagtcaactataatggaaggacttctgcttctggtcattatacctggtaccagactagccttctctgtgtaaataactctaaagctaagctgtaagatcagacaactacttttaggcagtagaaaacagacagctcaagtaacagaaggcaattgacagaaggaaaatttataaggtgagctctgccatcaccatggctttgggtctgtggaaagttccaaactgagctttgtggagatggaagccaataagagcatgacaatcctgataattggaaatgtcagagaccctagttcacagcttttgaagccactggaatctgtagggaaagacaccagagaagagagctgcaatgaggagtggctcagtttgtgagggagtttactatgagtccttagctgaggctgcaatactatacataacaacactacctgacacttacaagagagatacaattatataggatcaagaggaggccagagattgtagaagttaagtagtgatgcgaaacattgcaaatctggccatgcctgggtggaaagacctctttcacaccttgttaacaacacagtaacattcagcatcccatatccgccttataaaaccaggaacaaagcttacacagcattcttagagaggacacagaatttggagtttgagtcttgccaagttatagggccttgagaaacatttagggctttccatggatccaccctaacgaagcataaaattaagcctaggattttagggtcatcagccaaaaatggaactgccttctagaacaaaaaatgacatccttttgaggaagacagtcatccagagtctttacaatcttttacccacattgcctagtacataattaaacatttctagatatgaataggaacaggaaaatgtgacccataatcaagacaacaagcaataaatggaaacctacccttaagtagctaaactgttgcatttagcagatagaaagtgctaaagtagatactttgattatgttcaaggacttaatggaaaatactaataagtgaacagatggggaatttaagcaaagaaatgagaacaagcatacattccaaagcaaattgaagttctacagctgaaaagtagaataactaaaatgaattttttttttttttgagacagagtcttgctgtgtcacccaggctggagtgcagtggcatgatctcagctcactgcagcctccacctcccaggttcaagtgattctggtgcctcagcctctccagtagctgggactacaggcatgtgccaccatgactggctaatttttgtatttttagtagagctggggcttcaccatgttggccaggctggtcttgaactcctgtcttgaagtgatccgcctgcctcagcctcccaacatgctgggattacaggcatgagccactgcgcccaatcaaaaattttatttaatgtacttcataacaaattagagatgacagaagtgtcagtaaatttcaagagagatccataaaggcatctagtctaaagaagaaagataggccgggcacggtggctcacgcctgtaatcccagcactttgggaggctgaggcgggcggatcacgaggtcaggagatcgagaccatcccggctaaaacggtgaaaccccgtctctactaaaaatacaaaaaattagctgggcgtagtggcgggcgcctgtagtcccagctacttgggaggctgaggcaggagaatggtgtgaacccgggaggcggagcttgcagtgagccgagatcccgccactgcactccagcctgggcgacagagcgagactccgtctcaaaaaaaaaaaaaaaaaagaagaaagataaaagattaaaggaaaacttgcctatttaacatatataaaattaaagtcccaaagaagagaatgaaaatggagcataaaaatacttaaacaaatgatggccccaaatttccccaaattcatgtaaagtataaacttaaacacctaagaaaagaactaatcatacacataaagagaaccactcctgaacacaatgtgttgaaattgttgaaaattgaagtgagaaaatcttttttttttaatttataaagaaaaagaaaaagaggtataatggactcacagttccacatagctggggaggcctcacaataatggtggaaggcaaaggaggagcaaaggcacctcttagatggcagcaggcaagagagagtttgcagaggaactgccctttataaaaccatcagatcttgtgagatttattcactatcatgagaacagcatgggaaaacccgcctccatgattcaaatacctcccacctggtccctcccttgacacatggggattatgggagctacaattcaagatgagatttgggtggggacacagcccaaaccatatcaccaagtgtccattgatagatgaatggataagcaaaatgtggtttttacatgcaatagaatcttttttttttaattatactttaagttctaggatacaggtgcacaacatacaggtttgttacatacgtatacatgtgccatattggtgtgctgcacccattaactcatcatttacattagatatatctcctaatggtatccctccccattccccctaccccatgacaggccccggtgtgtgatgttccccttcctgtgtccaagtgttctcattgttcaattcccacctgtgagtgagaacatgcagtgtttggttgtctgtccttgagatagttggctgagaacgatggtttccagtttcatccatgtccctacaaaggacatgaactcatccttttttatggttgcatagtattccatggtgtatatgtcccacattttcttaatccagtctatcattgatggacatttgggttggttccaagtctttgctattgtgaatagtgccgcaataaacataatgtgtgcatgtgtctttacagcagcatgatttataatcctttgggtatatacccagtaatgggatcgctgggtcaaatggtatttctagttcaagatctttgaggaattgccacactgtctttcataatggctgaactagtttacagtcccaccagcagtgtaaaagtgttcctatttctccacatcctctccagcacctgttgtttcctgactttttaatgatcgccattctaactggtgtgagatggtatctcattgtggtttgatttgcatttctctgatggccagtgtgatgagcattttttcatgtgtctgttggctgcataaatgtcttcttttgagaagtgtctgttcatatccttcacccacttgttgatggggttgtttgtttttttcttgtaaattggtttgagttctttgtagattctggatattagccctttgtcagatgagtagattgcaaaaattttctcccattctgtaggttgcctgttcactctgacggtagtttcttttgctgtgcagaagctcttcagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtgaggaagggatccagtttcagctttctacatatggctagccagttttcccagcaccacttattaaatagggaatcctttccccattgcttgtttttgtcaggtttgtcaaagatcagatagttgtagatgtgtggcattatttctgagggctctgttctgttccattggtctatatctctgttttggtaccagtaccatgctgttttggttactgtagccttgtagtatagtttgaagtcaggtagtgtgatgcctccagctttgttctttttgcttaggattgtcttggctatgtaggctcttttttggatccatatgaactttaaagtagttttttccagttctgtgaagaatgtcattggtagcttgatggcgatggcattgaatctatacacttcatgctaaaaactctcaaaaattcgttattgatgggacttatctcaaaataataagagctatttatgacaaacccacagccaatatcatactgaatgggcaaaaactggaagcattccctttgaaaactggcacaagacagggatgccctctctcaccactcctattcaacatagtgttggaagttctggccagggcaattagtcaggaaaaagaaataaagggtattcagttaggaaaagaagaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacaagtattcttatacaccaataacacaaacagagagccaaatcatgagtcaaatcccattcacagttgcttcaaagagaataaaatacctaagaatccaacttacaaaggatgtgaaggacgtcttcaaggagaactacaaaccactgctcaatgaagtaaaagaggacacaaacaaatggaagaacattccatgctcatggataggaagaatcaatatcatgataatggccatactgcgcgagaaaatcttgaaagcaataatacaaatacaggctgatttctcataggaaatactggaggctagaaacaataaaatggtatttttaaagtgtggaaacaattttaattcagaattgtgtatccaataaaaatatcctttaaaatttagataaaatgtagacattttaagatgcaggcaagctcggagattttttgcaagcctatctgtacagcaggaaatactaaagaagtttctttggtcaaaaaagtatatttgccagaaggaaattaatatctaccacaattgaatacagagaattaaaaatgttaaattctggttaaaatgagaaatatgttttccttttctaatttcctcagaagaaaagtgactgattaaaataaaattatggtgtcataaggtaatgtttataaggtatgtaaaataaaggaaaataaattgaggtgtggtggaaatgttttatatcttaattttggtggtagttacatgcctgtttatatttgtcaaaacacacctatctgtacaattacagtgcataatttacctacaataaaatgcataaatttaagtatacctgtgtttacttttaggcaaagaggatttttttttttggctcagatagctagaaggcacagacagtattctcagacatgactagatccagaaggatgatgtccttaggacctggtcactgcctctgtcttgtgagctgaattcattttttaaaaaggataaactttattttttagagcagttttaggtttatagcaaaattgagtggaaggtacagtgattttccatataccacctgcccccacccatataccacctgcccccagacatagcttcccctattatcagcatcccctaccagattgatacagttgtaaaaactgatgagtgtccatgacattaatatcaccgaagtccatagtttacattagggttcacttttgatgttgtacgttctgtggaattcaacacatttatgacgtgtatccaacattatagtgtcatacagagtagtatcactgccctaaaaaccttttgtgctttgcgtattcatcccttcctccttcctacttttctaatattttatgttaaagtagtatcagttatgcacagtgattcctaagggactatgcacaaggatgtttattgcagtcataaaagtaacacaacaatacaagcaatctcactttttaaccaccagtgaatgtttatagtggatcctacaataataaaaagtctaaaactcatgcataagaaatacttatgttttaatgttaagaagtaaaaacatttatatggtacaaatgtatgcctgttgaatatatgcaaagaaaaaatatcagaaggtgtataccaggattttaacataattttctctgtgttatgtgactacttcctacccttttctttattgcatattttacaaagagtgtacatttctgtcaacttcaaaaattgttttcatattaagataagaagaatgtaatcagatataaatattaaatgatggtttgaaattatcataatttcatgaactgtaactccaaaaatgactaaatagtctgaaaaagaatatatgtaagaaagcttaaaggttgagggactttgtgaattgggttgatgtttgcaccaattaatctctaacgattcattctactctaatggtttaaattttatatatttatccttgacatatcaattaaaataaactgatgcctgacagataactcccttatgaaattatctcctggtgtttagtctaattcatacaagaacatattgcatgtttttcttgagtgatgtttacaatgtactttggagattaaacttgtatttgatctgtgatattttgaaatggcttttagtcaaaagaaattctgacccaacatggggaaatagtttcttttagttatgtatcccaactatctaatcaaaagtagttatttaaatcctgtactgaataattttatgctctttgtaaacatacactctagttttagatacagaacttgaagcacttttccctaagcttctgatctcagcatttgtctgtggtcccttagactctgtcacgtctccagttgctaaaacttggtatcctacttagggactgtaatttgaaaagaggctgtgcgtggtggctcacgcctgtaatcccggctctttgggaagccgacgcaggcggatcacgaggtcaggaaatcaagaccatcctggccaacatggtaaaaccccgtctactaaaaatacaaaaattagctaggcatgatggtgcgtgcctgtaatcccagctacttgggaggctgagacaagagaatcacttgaaccaggaggttgcagtgagccgagatcgcaccactgcattccagcctggcaacacagcaagaccgtgtctcaaaaaaaaaaaaaaaaaaaaaagaaaagaaaagacgatttattggttaagtggttgttcttcataattcctgtcattcttcatattttcatgttacttcctcccgctttacttgctcatttaagtttagttttaaaaatacttccctctctctctcatttacccattcatccacccatccatctatccatttattttcggcagaagttggcatgtcaatagagattcttcaaattaaacattatttactttgaagttagaaaacaacaaattgattgtcatttactctaaactttgggaagaagacacattaattgttatttaatctaaatttagggaataagatgcaaattggaatgatttggagcaaagttagcaaagtattttaaacatacttttttgactaccaaagtgacgtttattatagaaaattcagacaatgataaaatatattttaaagaatcaccccgtaattgctgccatacaaagataatattaatgctttattacctaatctgatctgaaaagagttttcaattttacatttattctttatggtaggtcaaaagtagaaaaatttctgggagaaactatgaaataattattattgagtagatatttaaactgaaaattacagattatgtttttatttttatcaagggtcatatgtatcgaatatttacatgacactatacagaaagcactttttagtattacatattatgagataaatttttttttcaaattaatttcaaaaagcttatgaaatctactggttttgattgtcatccttttattagttgtttttgtttgctaaggttgcaatttcagtgcagtaatgcctatttttaaaccagatcataatgatacatataattgcattttagtatatcttataatgtataggaaattattaattccggatgaccttctagaaattgtaaatgcttggtgaagtgaaaaattgtgaaagctgacttcagagctttaaagaggaaataaatgtcatatatagtaaagcaaagtagctcttaagttagtacttcaaaattaatagtagagcaagtactcattatttcttatagtttaattaattgctgctttttaagttcgtgttttgttgctgctcagaattgcattatgagatgccaaattcatgtaattattagactatatggtctaattaatacttttttcaaatataacatcttcttatttaactctatttctttttctgaattctaattacatagatctaaccaatctcctcattttagtttacatgtgtcctaatctcttagacattttctgtttctctagggtaaattatagacaatttcttcaaaacctttttcagttaaaaaattctcttttcagttttgtttggtctataaggaagttagggagtggcatgaagttagggagtggcacaaagtaagtgctcaataaatatttgttaaattatggtatttatgtctttctgatatttatccaagagcctgaacatgttaacattgattaaatgtgtacacacatgaaggaacaattgagtgggtaaaatttagcactggaaggtacaataaatagaatttctataaatgaaagtgtgtttgtttatttgctgtttgttttatctcaagaaagtatgcatgccttaaaatgttgactttacctaagtaaaatttggaaaactgcacagtacctgttggtaccatagcctttgtcattaataagcattagatgacagccatgagaagctatgatagagacaaagactttgctgggatattactcaacattgagaagtgctatatggaatctgagaattacatgcatttaacactgaatgtgatacagactttattgtctgtgcctttcatttgttctgtaaatttttgtgtaagtaaaagtgatgcttatttgctggagagtggaaatcatatttattctcgctacattgagaaatacttgaaaaacatttttttttctgccagtaccctgtacattctgcaatgtttattcctaagttttggttttaaatgttgaatactgtcctaaaattttattaaagtgtgtattttccattttgtttgtagagcaacaatgtatacacataaaccatgcccttttggattttccacttttgtaattactaccatatttgtttgtttacttgctttttaattttatttctttgatgaagtggcctttagcaatgtcttgcatgctacatgagatctgcttatattcctggaattatctgttggattcttgagtttctctccctactgatttctcttttctttcctctgatattactatatgcattccccttctcatatacaatgggaacaaaaggtagtgtgaccttcacaagattatttacataattgcataaaattgtacctatgagttgtttagaatagtggacattataatagtaaaagatcaatgaggcatgaatgttagttattgtttttaattattatcaggttgacacccctggaatttgaaggggaaaatataataaaagagaagcagaagtaaatattttcccttaatctcaacaagctgtaattgttgcctttcctctagacttcagtatcctagatgctgtgggactctagcttagcaccttcggggaggacaggcagtttggacacccaggtctctcaagtactttcatgtaacgtggggttatggaacattttttaacgttattgtgggagttattttgaggattttctcctttgtctagaactggtatcgaatagaaaaaattagtcagaaaataaaataaaataaatgccagccattttcttccctgcctttataatctcaggatttcttaagagagccttgtcattgaaatcatccagacatttctttgttcatcatcttttctctattataaatctggtgttataatttgtaacgtttagttgtttatttgtgttagtgattataaccttagttttttgcaatcaacttactgtttagaaatacaagtggaaatatgtgtacttatatatgtgtatgtattatatgtagaaaaatgtgagagactttttctgtcaattccccactctcaaatgattccattaagactgctcattatgtccatgagaagtaggagaccaatgttacaactattttgaatattaccctgtgtttttcctttttgtccttaacatagtgaagcatagacaataatattttattaatacaatattctttttataataaaaatatttattatctagtttcatgtgggaagttttgtcatttcttgtcattctctcctccaccatctttaactctgtttataaacacacaaagccttgtgataacaggaatttggatatgtcataactgtgctctgtaactggctcaccatgtatttaattaaccttgtagtaatgcatctctgcatttttgggaactgaattttgagaccacacataaagcatttggtatggtttgggtatcaataatttaatgaattttttaaaaatacatgcatcattgaggttttggttttcatatttttggttgcaatcattttataccgataaacagtgcaaatattaagaataaattatattatcttgtagttgatcatagtcgtgaaaaagaaaatgcaccagaaggtcctactcagaaaggtcttcgtgaagccagggaacaaaacaaatgtaaaacaaagatgaaaggcaatacaaaggtatgatatttgtttttgtttgcattaagtcatacttaactctcagatctttagatccattcactcatatggtatcattattttaccggaaaaggaatttagaggttatatattccgggctgcttggtttatacatggacagtggaggtatccaaatgttactagtaagtagttaattcagggacacaggcttattagtagcagagacagctcagtggatcactctgccacctatcccaacataatcatgatcatgtctgctcacctgctaacttttctgcttgaaactacctctgtctaaaagaaatcactcccaggtcatatcttgttatatcttttctcaaaatgtaacgtcagactttacttagtctctttaaaggtagaatgaaatagcattatgctccgtttaacaatctctttatatcttgagtaccttcactttgtaatcagactggtagtttaaatctttgccagtgattaaagaaaatggtattaaaaatggttggtcaaagagatcaaaaatgaagaaaattacataaaacctgtgaagagtttagtttattgttttgaaaattacataaaagtctagctcaggtaatggattttcttgtaaggcagttgttaccttagagttctaaaatatctggcacttattttaaaataaaaatatttacaattataatagcttcttagtaattctagaagaagaatagatttgtatgaattcaaataatagcatttacttaggtaatgccaataattttttttctctctaaaacatgcattggattctggtattgtataaaatatttatacaatgaatttttataaatttgtataaatataaaatataaaatttataaatttgtataaatataaaatatttatacaataccagaatccaatgtataaaatatttatacaataaaataaaaactaatcacttttttgttataataagctttttattataatcttgtgctttttcagattagtgttttgttgtttttctatcataattatagattatcgtatgtgaggtagactcacatcagatttaaggatttttggaatgatggaggtgattgtcatcagaaacattttcatcttctaacggtataagtattgtctttcaggtagtaagtcatacttagaagtgatttgttgattcattcactcagtgcttactgcttataagagtttagattaataatgcaaggttgactttttatgggacaaaaagatactaaaatataggaaaagtacattgcatatttatgcatagtatattattttatggtgttgcattctgatatttaacgtaatacctacagcatggtagaaaacataggtcatattaaagggctaaagtgtaaaataaggtgaatccttctcaccttcactgagtaatcatttttactagtatttctcttaattttcttgttgttattattataacaaatgactgagttctgtttctatttttttaataattcacttcacatgatatctattgactccgccgtaacaaagaggcatttagagcactttactgacttgatttgaattatattattatgtatgttgtcataattgataacatttacatttgttctatagtcttaattctattttctatgctatgtctgtaaattaatactaacatttaatcccataaacagcctttaaatggattatgtttaagtaaatgtaatttattgcagacattgcaaatttaactagaactgtagaggaggaaggagaatacctgaagtgcataggactgtatttaaagatttctcttttataaacagtcgctctcttctacttcattggcttacactcagctgcccctgttatgtattctcatattttccttcatagattgctttttctgttttcctagattatctccttgagtaattttcaaaaagggccaatggagataaatgatctaagttcatacatctgaaatattcttgttctaccttacactgagttgatattttgctggaattagagttctagttttaaattaatttttcaccagaattttacaggcattgttttaatgtcttagaggatagcaataattgctgttggtctgattcttgttattttgttgggaagtaaaaaataccatatacaatacaatgtaccagtaaactagtattttgaacaactagaacagtgaggtgtaatcataataacaactttatttatgtgacctactgactcttaaagctgctcagtggaggtaattcaacccttaccctagggtgataattcattcaggcttcatgaaattattagtcaagtgtgtgtttactctggttgcaaaacacaatctcaaatcagtaattaaatatgtccagctttatgtaacacaaatgctccacatttaacatgaagttaaattttcacctaaccctcagctgaggacttctttgggctagacatttgcagtgtggaaggggttgtaatggtggtggtgtgtggccgttcgtaaatcttttcctcttactttttccctcttactttttcctcttactttttcccttactttttccctagtttgctaactggcaaggttgaaggtgcaaggagggagaaattaaagacgaatggaagagttgttactggacttgagataccttatgatagcttagagttctttgaacttggcaaaatcagaaagcttttatcctgatgagcactgtattagtcagagctctccagagggatagaactaataggatgtgtatatatatatatatatatatatttttttttttttttctttagaaggatagaactaataagatatatatggggagtttattaagtattaactcacacgatcacaaggtcccacaataggctgtctgcaaactaaggagcacggagagccagtccgagtcccaaaactgaagaacttggagtctgatgttagagggcaggaagcatccagcatggagaaagatgtaggctgggaggctaggccagtctggtcttttcacatttttctgcctgctttatatcctagctacactaggagctgattagatgttgcccacccagattaagggtgggtctgtctttcccagcccactgactcaaatgttaatctcctttggcaacaccttcacagacacacccaggatcaatactttgcatccttcaattcagtcaagttgacagtattaaccatcacaagtccccgccttgtcaacttgaacccatacatatctgctgagatcatacataatcttcaaataaagacaataataaggtcataattatgcctaacataaaacaactatccttcgtacaaccagaaatgcatcagtccccaactcaaatactattacataaagttaacaatacttaaatgttgatgtgaagtcagtaaatccttatatcacatgataagggaaaaaggaaataaaacgaaggtatattcttagtacagtgtatacatgtacaaccatggttttaacaaaagaaggagggaatacccatgacaattacagtcctcgtttctgcagctggtcatgtggttgtagctggtattgattactaccttgttctatctattctgtagtccctttgccttcagcaagtacctcagcaggttgtggattttttcctggtggagtgacccaaaccttcattcctgaagggtctgggccatatgcagtcctgcccagactgtgatgttgtaatttcccaatgaccttaatcacagggcatggcaatactaagagacatcctagtggatctcctgtagtcatgcatactctttgctacctccattgtggagtagtagactgatttcatcttgatagtctgggccaatcaccccagccaagactgtaactcccttcttagcctgttgacttaaaggtaggaggagcccaaagtgtccaagtggcaatcttaactttcagtttaatggaatcattgttgtgtctcttgatggcagcgttcctccctctggaactaagacctctaggccagcaggatcaatgttgtgggaacaggaagcaagaattttgctggtggatcactaggggtgatggtgagtggtgccacttccacttccaccccttggttcctggaaccatgaatcctggctatgggagaaacagtaccatatattgaatgctgattcagagcatacacaccttctggagaactttgcctcagcctagtaaagtattgtcacctagttcgtgttgtaattgtgacttcaaaaggcaattctacggttttatcaatccagctgcttcaggatgatggggaaacatggtaagaccagtagattccaggagcatgagccccatgctgcacttctttagccataaagtgagtgctttggtcagaggcaatgctgtgtggaacaacatgatggtggataaggcattccgtgagtccacagatgatgtcttggcagaagcattgcttttaggataggcaaacccatatccagagtaagtgtctattccagtaaggacaaacctctgccctttccatgatggaagaggtccagtataatcaatctgccatcaggtagctggctgatcaccccaaggaatggtgccatattgagggctcagtgttggtctctgctgctggcaaattgggcactcagcagtagccataaccaggtcagccatggtcagtggaagtccatgttcctgggcccatgcgtaacctccatccctgccaccatggccactttattcatgggcccattggtgatgacaggggtggctggggaaagaggctgagtggtgtccacagaacggggcatcctttccacttgattattaaaatcctcctcagctgaggtcatcagttggtgagcactcacacggaatacaaatgtcttcacagtttttgaccactcagaggtgtccatccacgtacctctttcctgaatttccttgtcaccaattttccaatcgtgcttcttttaagtccctgaccatccagccaaaccattggctgcagccgtaagtcagcatataatcacacatctgaccatttctccttccatgcaaagtgcacaaccagttgcactgctctaagttctgcccactgggaagatttcccttcatcactgtctttcagggatgtcctagaaaggggctgtggtgctgtagctgtcaactttcggatggtgcctgcatattgtgcagatccatctatgaatcaggccctagtcttctcttcctctgtcacctgatcataggtaactccccatgatgccatcagtgcaagctgggagacagaaggcagggtgacaggaatggagaccatggacatttgagccacttcctcatgtaacttacttgtgccttcgggacctgcttgagcccgatcacacatacaccactttcatatgatgaaggactgctgctatgcatgacccagtttatggctagatgtgtcagaaagcatccagttcacgacaggcagttcaggttgcatggtgacttgatgacccatagtcaaacattcagtttccacgaagcccagtaacaggccaagagctgtctctcaaaaggagagtagttatctgcagaagatggcagggccttgctccataatccaagaggcctccgctgtgattcacctatggaggcagcattggatctgctgggttatatggccccagtggtagagcagcttgcacagcagcctggacctgtttcagagcgttctcctgttctggacctcactcaaaactggcagcccttcgggtcactcgataaatgggccagagttacctaccccaatgaagaatgtggttgcctgcaaaatcaaaataggcccactaggcattgtgcctctttcctggttgtaagattttactaattgactaatatatctatttcaagaatacaatcagaagccagggaaacaatgaaggaatgggtccataaatccactgggcttaccgtaaaatagacttataccacaacactgttgatcagaaggctatgataagcccctaatttagctgttagatggtgttttggggtctctaggaaagggcatttattcagagccaatttctaattatatctgaaaggtatgaagcaaaagagtactccatgtaaatgactgctgttcctttagggaaggcttggaggaagacttacaatcagatttctgtagtgaacccaacatgatacaatgaacacatattttgtccagtgaaaataaaaaaacactgacccttctaaaatggtccaacataataagtatgccagtaggtggctggcaggtttttcatggtacggtgccataacaacggttccatgttggtttgtgctgttggtaagctggacattcagcactggatggtagctgaataaactttgcttaggagaagcctttgttaatgattccatacgtagtcttcatctttaacacaaggctacatgatcctattgagcatacagagggagagccaaggaaaatagccagtattcacaagataaggcatgtgatccacccgattattgaaaacctgttttgcagtggattttttaaaataagtatacccatgggacaccaatatttccacacttttgcctattgtgagagatgtagccactaaccatttccttagatcttatctcagaatttccaaccttattcttttataaacccctaaccagtcagccagactgatagccactgccaataaataggtatagatgtatccgctgtaccatttatgtttttaggcaacataggtgatcagatatactgccaagatttctgttcacctgaaggcttttcattcatcactgtctttcagcgctcccattggaagacttgtaatccagtgactgtccacttatagctgaatttgggtggcacattgtacaaacctgtatggaaatcaggctagttttttttttttaatccattctctgatagctggtcatggtgagtatctcacaaagccgtaggtatagttgagggacatgtgacattgaaacaagagtggaagtttggaagtttacctgctcatgcaacttacttgtgcttttctgatgttctctagcacaatttaaattataattcttccttttttaagatgaattgcttttacatgtccagactcatgtctttgaggacctcctggtttatgatgagcaattcagtttacttagttgcttggtgttataagtcctcagtatctgtcagagctcatgaacatagtaggagctaacccttaatagagaatatgtaaaagtagttatcaacaaggtgaacatgccttttctccagaagtctggaggtcagtactgtggccctctgttggggcttgttataggcttcctatagtatcttcattttctacagatagtttgagcaccattgggtctgctgggccataaggcccaaggagaattgtcttatatcctggacatgttgtaaactttttggggtccaaacatcatttatactatgttctttattcagcatggaggacaaaagatacagtaactttgccttttatttagaagcattatcttaccatgttccaggcttcagaatttctttggtgtttgtttcttctctggcacaagcatattgctaagacatctagggtacttgccacttcctgctcatcagatccatttagggggattttagcaatatagtggaatataaagatggtcaaggttactttagtttgacagagaataggggagtttatatggccccgaggcaaaggagtagaaagttttctgctgcctttgtcatgtaaaggcaatttggattaactaccatcacagatgggaggagagaataaaacattcaccaaatcagtagcctcataacaagtagtagagggtatttttatctgcttcagtaaagataacacatatggcacagcccatatgttccagatctttacatgattctctcaatcttgtaccccattattttctgattgaattcttgagcaatgtttggacagtaagattctactcctgtctctcttttgttggatctggcaacctccttttataaaagtaagtgacatattggataatatatgtataaacactttatacattataaaagcattatgtaaatacaaagatattattgttgctgatattattcctattattatagaaatatatcccccaacatgatgctaagattgcagagtatttagtatcttgctgacccctcttgacttatcttctagctctacttgttcctgttcttctcataatgaagtgcaaaaataagctaaggttcttatgggttgtcttggatgtctaaataagttgttcatttgttttgaatgttctaggtcttaatcagtgtatattaagattatatgaatcctcttgaatgatgatatacactccaatagagtgtgtgccacttgagtgtataccatatggtggatacactcagaggcagcagtgggttcctattacaagtttgtaggaccttattctcctggcattccaaactgtgtcttctcttgagtacatctgtagatagtcaaaacatataagacatgaactactgtcctgtttgcaccaactagctccttttgcctataatcataacacacaaagcttattattagtaaacatcatgtttatccattctgattaacataatacaataaatagtgatgttctataatatttctagagagtacagttcccttcagactattttatgactagagtggaatgttaaccttggcaagaacataaacatgtactgttgtctgcccaactgaatgcacattgcttctaatctcactttatgagaagacacatttgccggatcaatgactacacacgatgtgcctgagtacatgttaatctgctgttgcaaagataccatatcaggtagaacagttgcaatttaggctgttacttggttgagtttgcagtagtctcctgtcatcctccaggatctttgtttattatagaaactagactagggaattatatggaaatatgatgagaacatccacatctacatcctttgtttaaatctgtgccattttccaccaccctccccaatatgcagtattattttttatgaacttgacagggaaaggagcagttttcaagtctcctacttggcatttcccaccatagtatcatatatcccacaggtcaagaattaatgtggaagttctgcaaaataccaagtatgttctttcaacttgtttggaatctgttaaatgaccatcagatgggttcatggattccatcttactgtgagccagacctgggcaagctatatttattacttagtccctatatgcctcagcctcaaatctaagatggtggagggtgagagttataaaactatgagtccctgagtatcaacgccatgctagaccctgtgtcaacagtttcacaatgtctgggtctttctttttctgtagtgtattgttacctaagcctctggggaaggaatggaggaatcattgtatgtacttgctatggtgtaggaggatcctttttcatagggactgaacttctttcgtcaggaagttctgtgtgtgaaaactggctaagatctggaaaccaggcaagagatagtgactttttacaaggttgctgctctcagtatcctgatcatccatcctgtttcttctggtcgtacagattgaacattaccactgttggcttcccatctttcagccctttaaagattctatgttctattgactatcttcctagcgttctatggttcaggatatcctgatagcccttaccaccttgctgttcttttccataattgtgcccatcttgcttttgacatttacgtgcttctggctggcctctgctttctcaggagtctataatctaaattgctttcagggagtgtagttctctaataacatactctctactatcatcttagagaaccacaactgagcttctcaatgatgttgctgctcctctcaccttactgctttcctagtggacgtattctctggtcatccggtggacatggttatctcatgggatttttggccttttatggtgtatccactctcacaggctcacttctctgagtatttagatcctcctttgttgtggaatgtagcattggcttttctagttcacttagtttggtaatcactttttcccctaagcttcaaagagccatcctagcttcacataaataccagtttcctttctagggtgttaagttctgtgttatagaagagtactctcatattgataaactctgccttgtccaactttatattctacctctcttacctcaatgacctcaggacccaattcttcatgtactgtcgtggaacccataggtacatgttggctagttcctgcagttccttggaagtagttcttttcatctttataacagagtcattacttacctgaataggttttatttttatttaaatgaattttggtctgttggccagtaaggagggtggggaatatattgtaagaatggcatgtattgtctcataagacagaagactctgaattgcccttggtgaagagaggtgtgctcgtctctaaaagggagaagcaggccatttttgcagggccagagagttcagggaaatatgaagatttaagatttttaagtacgttgtctcagatttcttcatctctgtccacacacacacacacacacacacacgtatgacttcttgtaactcagaataaatttatttttccataaaattcatgtactaaaatactgttggttttcctaaaatgactttcctataatatgttttcaaatttcacttctttgctgatatctttaaatttttatattattatactataactttataacaatatttggagtcatctacagcaatttatgttttgagataaaaataacatgacaattcacaaataactatcatatttcacaaacattaatttcttcatctttgaaatgtcttctaatagtatctacattttactagtttattcagttcagaattgtggccttgtcttaaatcgtattcttcccaatgtcttccaaactcccattgatgccttttttccatattatttaataagttgtgaatttctcctaggagtggggcatgggttcagatcctactggaaagggcctaagagtcttgtcttgaaatttcatttgcaaaacaaacttagattaaatatatatatattttggttggatttaggagggcatctagcagagattttgagaggtctcctgaaactatccctaacctcctattgcagtttccccattttcctttaattctcactcccatccttctaaatctggtctccatgggctacattcacaaccttgcaggctgtctttcaatagttcattctatgtttcatggattgataactttccctaaaacatgcctctataagctcgtctaatcttccttagacaattgtatatctttacttctcaagccagttgggtatctagcttgttgatattccatgataattcttatatatcttttataacattataaatcacattttacttatatattttacaaagttggttacattttaaagtcaattcttatggtttaaactattttctcttgaattaggggaacaatttttgtgaacattagggaagccattttcttctgaaagttttttagccaatcagtggattactaaaatagtcagtggattagtctttgtaaagataactaaatattacaacataatttcattttacctgtggaatatattttatcctaaaggaaataagagccattatgcaattaattggatggtttttgcaatctcataagtcaaaattaagagaaaaaagttactgctttattgagactaagaatgatgattatacatgtgaaactttcagtgtgtcaacatattattttaaggaacagcagaatggaagagtgccatacagatttgaatagttttaaaaggtaatatttatacatagaatttccttttttgttgtagaagggaaaaaaaggatcaaatggtatccactgtagtccaaattcattactttaatgactccttgtagagttaaattggagctagattataatatttgtaatatattaaaaatctacctttcaccttgtattttgacctatatattcaatgacagtgcaggaaaggtgaaaaagcactattattaaaagtattttaagaaaatagaaaggaaattagaaaagataaggggctgctaacttgtttcttccatcctttttttgcccaaattcttagtcttttttgggttggaatgaaatgcatgctctttttttttttttttttttttttttttttgagacagagtctcgctctgtcgcccaggctggagtgcagtgtggagtgcagtggcgggatctcggctcactgcaagctccgcctcccgggttcacgccattctcctgcctcagcctcccaagtagctgggactacaggcgcccgccaccacgcccggctaattttttgtatttttagtagagacggggtttcaccattttggccgggatggtctcgatctcctgacctcgtgatccgcccgcctcggcctcccaaagtgctgggattacaggcgtgagccaccgcgcccggccatgcatgctcttttaaaagaaaattcttccctagtgaaaaaatatttagattgttttgtttctatctgtaaacatatttatatccctaataccccttctgggtttctgctggaaatggtgttttaaaatattataaagatctagtaagaaaacatagaagggaggattatgggaaggtggcagagtgggaagcaccagggatgcctcctcatctagataacaatggcactagcaaaatctgtctgatataatgatttggaaagtctagagtctgttgaagtctttcaatgtccacaggaaggattggacagtaaattatagttaagttgggtcaatttcaactcttagtatatcagcacctaccttcagccaccctagctctgtggcaggcagctgcacacaaattccaggagtaccttgcaggagcctgggtgggcaaaaagcatcctgtcctgcaaatatcagggatctgtgctcttatctctaactactgctttttatcatagaggtgcagacaaagagggttatagcaattgttgttttatcttactccattattcacccttgtctccctctctagctgaagtgatttccagggacttaaagggccaagtctccttttcccaccttcgtttttctcattccccactttggggagccaaacattaaagtctatgacattcagaagcaactgcatatatggggaaaattagaaagtgaccacacaagcctggggataggtggaggctcagaaaagtcctgagaaaacagtaaggttactgatccttgaccagagacagtccataacaataaatttttttaaaaaataaataaacacaaacaatagtaaaaaacccagcaaaccctggggaaggaggagaatctgatttccagactccaaattacaacacaaaatcatttgtatttctatacactaacaataaacaatcagaacaggaaattatcaaagcatttttatttaaagtagtgtcaaaagaataaagtacttaggaatttgtcaaagagatgaaagacttgtacaatgaaagctaaaaaacattgctgagggaaattaaagaagacataaataaatgtaaacatatcctatgttcacaatttctatcaaaatcccaaagaccttttttttgcaaaaacataaaaacccatcctaagtttcgtatagtctcaagggacactgattagcccaaacaatcttgcaaaagaagaacaaacttggaagactcatactttcttatttctaaactactgcaaagctacagtaatcaaaacagtatggtactggcataaagacagacatatagaccaatggaatagactaaacagcccagaaataaaccctcacatatatgatcaaatgattttgacaatagtaccaagaccaatcaatggggaaagacagtctttttaccaaattgtgctgggaatactgggtatctacatgcaaaataataaagttggacccttactaataccatatacaaaaattaactcaaaataatcaaagacctaaatataagacacaaaactataaaactctcagaagaaaatataggacaaaagtatcatggcattgattttaacaatgatttcttagatatgacacaaaaggcacaggcaacaatagaaaaactggactttataaacattttaaaatttggggcatcgaaagactgtcatcagagtaaaaaggcaaccaatagaatgggagaaaatatctgtaatcatatatctggcaaggaattaatatacagaatatatagagaattcctaaaactcaacaacaacaaaaagtccaatccaaaaaaggactttaataacacatttctagattgaagatatataaatggtaaagtacatgaaaagatgcttaacatcattaatcattaaggaaatacaaatcaaaactgcagtagggtatcacttcagactaataagggtggtttccattaaaaacaaaaagaaagctggtgaggacataagttaattggaaccattgttcactattggcagaatgtaaagtggtatagtcactatgggaaaacagtatgacagttcctcaaaaaataaaaaatagaattaccatatgatctcacagtttgcacttctgcctatatacacaaaagaattgaaagcagcatgttaaaaagatattttacacccatgttcatagcagtgttactcacagtagctgaaacatggagacaattcagtgttcattggcagctgaaggaataagcaaaatgtggtatatacatacaatggaatattattcagccttaaaaaggaaggaatttctagcaaattccacaacattgatgaagcttgaggacattatgctaagtgaaataaaccaataacagaaagacaaatactatatgattccgtgtatatgaggtactttgagtggtgaaaattataaatacagaagtagaatgatgtttgttagggctgggggagagggaatgaggagttactgtttaatgagtatagagtttcagttttacaatgaaaagaattctaggagatgggtgaggataattgttgcagaaagttatataaatgcatttaagaccattgaactgtatcctaaaattggttttatgttatgccattaataacttatgatgcatttttattacaataaaaacattattaaagaaagatcatttccatatggctaggaacagaaggcatgttaggaaggatacataaacattgcagtatgtacaacaaatatgttaaaacattttatatcttaattcaaatgtcaaaggttaaaagaaaaaataacttatgttttgggaaatattcacatcaacttcatatttaaagaagattttaaaaacgtttaaagcagcaatttaaaagcctacagtaaaattattagattatttgctcaggcagcagctggtttagcaacatttattcagagcttattataagaaaaatatcttttgctgaagtttttaaaaaatagcttctaattgccattaataacttatgatgcattattttttaatcatttaattttatgtttattaatcaataatacatgttatatacaaatggcttttcaaagcttggtttatactaccaatatagctattaaaataacagctttctcataaggtatgaatgagttttcaaaagctatagctgagttttcatttttgcccatttattttaattccttttgatctttagaaattatatggccaggcgcggtgactcatgcctgtaatcccagcactttgggaggccaaggtgggtggatcacgaaatcaggagttcaagaccagcctgaccaatatggtgaaaccccgtctctactaaaaatacaaaaattagctgggcatggtggcacgtgcctgtaattccagctacttgggaggctgaggcaggagaataacttgaacccaggaggtggaggttgcagtgagctgagatggcgccactgcactccaacctgggcgatggagcgagactccgtttcaaaaaaataaataaataaatgatacataatattttgttaagggaaaaaaatattttagcttataacttatccttgtgtaaattaactatcataatcaattttttgtttaccttagcatctgttagcaaattgtattatgtactttggcaaatattcttttagagtatgaattagtttgaagcctaatatgtattttagatccaggtctaccacttattacctgtacaaacatgggcacattacctaatttctatgtttccatctctataaactgggaagaataccatgtttatcaaagggttttttgttagtattcaatgaaataatatatgtaagatatctaacactgtgcttataacaggatttagactcaagtaattttgtttcgatagaaaaggttatttactaagggaagataaaagatctctaatttttaatactatttttctcttttaagtgtgacataagttacactgaatatgtctgctaaagacttccagattcattactttttaactactttagccattttattatgcaatggcatgaacaatttaccagtagttttccctgattgtgagtatagtttccctgtttcagattatatacaaatagaaacatggagattagagaattacggtggctaattctgatgttccaatgtttgcatgtcccctgttacatatttaaaagtgcttctgtgctcataaaacctgtacacaactctcagtttctttagggctattctatattttgatttctttaatgaaaaaatggaatgttatttaatatctttatcataacacctgccagttattatataaaataggtggtaatttaaacgtaaccatatgcaaatgtgaaaaggagagaaaggtttcctctactctgatacaatggtatatgccattgtgttgtgttatgtcaccctggcatgataatggcacacttcaactaatccacttaagtgctgatactttgcatttattgtagagtttagttgcatttagtacagtattcttgaatgtttctttgcagctattattattactttttgcctaaagtgtcattgcataatgcagagtgactctggcatcaaccaaggatctgggtgctattttgcaggatttgtaaatattacaccaaaatgttaaataattttatttatcacacatggagtttctaaaaaagaatttagttttacattttttcagtttgaaaatatggaagttggtaagaaatctataaccatatgcaaatgggaattttaatactaataatatgaaaatagtgttgaggctgggcacggtggctcacacctgtaatcccagcactttgggaggccgaggtgggtggatcacaaggtcaggagttcaagaatagcctggccaacatgatgaaaccctgtctctactaaaaatacaaaaacattagccaggcgtggtggcgggtgcctgtaatctcagctactcgggaggctgaagcagagaattgcttgaacccgggaggcagaggctgcagtgagccgagattgcactactgcactccatcctgggtgatggagcgagactctgtctcttaaaaaaaaaaaaacagtgttgaatatcttcagcagttgaaataattcatttaaacatctctgaggaaatatatttaccaaaatatttatttataatatcatgccatgttaaatagataagaattaagccaacatatttataattctgtgctaagtagaaaatcaaataaacagaaatacttacattattacactaaatatattctgcttacataaagagaagcaaatgtgaatcagaataaaagtaattaagagatactaattattcttaggttttaaactctgctccctatttttggattatgcatgtatagccctggatcatttgaaaatgcataactgagactgcagtaaaaaaaaaatgctgaggatttacaacattttgaaaactttggtcattataaatacttacattagctatatttcaactgttgatttatgaaaaataagaatttgtagattaaatatagcataatgaaaaaataatattcaattaatgttttagttaaaatatatcacatatatttgaatataatatataaattaaaatatatttttaaaatgaaaattacaaaatacatatgtagtcttcaacttgcttttttgattcgatttttgtttctaagagtctttagtgttgctgtaggtggctctaggtcatttcacaatatttacttttttgtattattgttacaatgttcagttggtttccaatgtcttggaaataaacagtgctgccaagaatattcttgtatgtctccaagtgcattagtggaagattttctgtaggacacaaacctaggggtggaattggggatgagggttttatgaaatagtgtcatttttttttcaaaccagttgaatatatttataaacccacacagagagctcctactactctatatctttctctgtattcattattgccagggttttttatttttcccaagcaaatgaaatatgtcgcctcactaggtcttaatttctatttttctgattactaattaaattgaacgtgttctttttcatatgttagcttctgtgaaataacagttcatatcttttgcaatttttttccattagattgttggcccttgaagtatacttgaaatgtataattgacattaattttgtgatcaattctattaatgcggatatcttgctccacatggtgacttatattttctgtttctttattattttttcagtgaatataagttcttcattataatgtagtaaaactaatcagtactttcttttatgatagcacttactgtcatttgattaagaaacccttttttatctcaagatcagagtactatgttcatatcttttttagcatttttcttgtttattttttcctttaccaaccaattcagacataaaaacagatattatctttcataaacccaatataattatctaaatcaagaaattaacattgataaaatacttttattttaatctatagaaattatttaaattttactgtgttgtactgtctctgtaatttcttaaaactaatatttttactttgagatagctttagattcacatacatatgtaagatataaatcagagagatcccatacagtctttacccagtttcccctaacggttacatcttggaaaactataatatagtatcaagattaggatgttgacattgatataatcaaggtatggaatagttctgcctgccagaggatccctggtgttgcccttttatagccacactgatttccctttagctctgtccatgcctaaccccaggaaaccactaatcttttcttcatttctgtaatttttttaattttaagattgttatttaaatggaattatataatatttaacttttgggggttgactgttacacttggcataattccactgagtcatccaagatgttgtgtggatcagtagctgatcatgttattaaattgctgagtagttgttgattctctttaaaatatttgggagaattcaccagtgaaaccatatggacttgggattttttggatgggagctttttaattattaatacaaatttaatttctttaatgcctatatgactattcagattatctcactttacttgagttttggtagtctgtggttttttaggaattgttccatttcatccaagttgttaaatttatgggcataaagttgtttatagtgttctcttattattcttttaataactgcaagatctatagtgataccactgttttattcttgatatttgtgatttgtttcttctcccatttatttttgtcagtcttgctatatagcaatttatcagttttatggactttttttcaaacaaccagcttttttgtaaacttttgtattaatttcctattttcaatttcattgatttttgcttttatctttatttcctgtcttcttctagctttgggtttattatgttcttccttttagacttttttgaggtaacaacttaaattattgatttgactttttaatcttgtaatgtaagaatatagtgctataaattttcctctcagcattgtttttgctgaatcccacatattttgttatattgtatttttgtttttattcagttttgaatatactttacttccatcaagtcttcctctttgacgtatagattatttagaagtgtgctgtttaatttccaggtgtttagagattttccggtttgatttctagtttgattccattatggttagagatcacattgccttttgttgctagattgggagtcagggctggctcaccttcttctgttgggtggtgaatgataaaatgccctatcattatgctcttcctccagtcctggaatctctgatcattttacctccctgtttccacctttcagagttccccttagattgtctcttgcatcatttccagggtttatagtttagttaccagggaagaatgggggacagttgagtctacaccactttggctggatagaacatcacttcaattttgctttacaattttaaatatttaatttccttgaaattgatttttcatgtagagtatagtaggaatccagtttcactttgttttattcagataattgctgtttcaacacaattatatggttcttcagtggtctgaagtatcagctctaactgttatttaactagtttccatgcatacatgagtttgcttctggactttcttttatgtttcactggtgagtttgtttattcctgtggcagtagcatacctctagattattttagtttttaacatatttggatatatcctaaggtaattatcttcaccttactattattcttcttcagaagtgttttagctagtcttatacctttatttatccctataaatttaatagtaggcttgctaaattcctaaaaaaattctcataacatttattgaaatattttatatttttatacattaatatggagattctagcatcttttcgatattgaatctttcaatgcgtgaatgaacatagtttatctccccacatatttggacattctttaacatctttcaataacaattttataattttccccatgcagatcttgtacatgtttttgttaaatataattctaagtaccttatagttttgctcttgtatatgatatctttttaaataaataagcttgttcctttgttggctttgaggcctccttcaacagaaatcaagagaaagcttatgagctcagtgcgagaacagccctctgtctaactccatgcctccatcagcagcagtggacagggaactctcaaacttggaataagaccgtacctctgcaggacactattggcaggagacaagagaacaacagtgcacaccagcacatcgactaagactgcccatcttcaggacatttgtcagcaggagccaaatgggaaattctgagcaacaggtgttcctggcttgttctcctccaatcctccctttcgtcaacacccataccctttatctgtgttctttacagtcttcataaaaggagtccaggacttccagttaatcatttatcccagaactctaatcctccgtaaggatcctttttttttgacccaatatttccctcttctgactccccaaaccctttctttgtactctattgaattcaaggtcagtcaacaaaaaagtcctttatattttaatattttactatgagtgttcccttcaccttctgtgctaatgaaaatctagattttccttcatgatagtttcccctgcatccattgaggttctggtaaatgttttaacaatcaactctttggaagaagaaaacaaaagccttgatttgtatagtgttttccagtttctgtgctgttaaacactcacaccatagccatttaagctatcttctcacttcactgaataaggagcctgggacttgatgtccacactcagctctcctaagccagtatgagagagcaacaacacatcacatcttacagtacctttaagggtaactgttctctctactccactcaaatgtagcataggtcctgaaagtcagataagtgtcccctttgcttctcattgctgctttcagtttgttctccctccttcatgaacatacccttccgtgaatctcatgtcatcagatttgcccactcattgtacctttttgttatgggcacctcttctcacctcatctttttgtcaattaaaaaaattaatccccgtgatattgtcactttcttaaaagtgattcctccataatgcttcatgattgaaatgttgatatggatgatccttctaactctctgaagtttcagttccttgacagcctctcctccagtgatccacttaactcactttcatagtcatttcctaggccttgttattgcaagtaactgctataatttttcattgcctctattgtttgctccctaccccccgaatctctgcatactgaggtgtttcaaggctcagttcttgaccctctgttggttgtcttcactccctaggtgatctcatccagtcttatggctttaaattctgcctatatattaattatcccttaatttacatcttcaactgagatctcttctctgaactctagtttcatatatccaactgcttactgaacacctccagttaaatgtcatttcttcatttcaattatctccccttccatgttctccttcttaattaatggaaactccacactttagttacttagccaaaaaactctagagtcatccctgagacgtctctctctctcacatctcacatctgataagaaaaagaaattattttggctctatctttgaaaaaatatctacattttcattttttcttaccactagcacttttgctctctgtttttttttttttgccaccgtctgtagtttgtattattgcaaaagcctcctaactgatctctgcttttgtctttacttttcttcagtctcttttgaacacagcagccacagtcatcttcttaaaacataagtctgtccatgacatttctctgctgaaaattttccagtaacctcccatcttactgagttacaggtaaggtcattataacctctgaggccctacattacctagatcccttttacctctctgacattatctcctgctaccctcccatcttttgctcaattgcaggcacactagcctcctacaaattctacttatttatagaacactgtaggtatgccccaccttgaggctcttgcacttgagtttttatcttctgtctgtgttattttccttcagataattcagatggctcatctctcactttatttaaagctttactcaaatgttcccttttcagagagacttttcatagccatccaatctaaattttaatgctgcctctaattcactggcacttctttggcctctatcctactttaatttttctttttgcctatcttacatatctctcatatgctatgttgtacttattaactcattgtatcacttcccactagaatgtaagtcccatgaaagcaggaatatttattaattgtattcactgctatattctcagtgccagaaaaatgcctggcaaatagtaattatcccataaatatgtaaatttgaaggaatgcataaattaaaaaatgtgttttgttagttgctattgtatagatatgcattgattactacaagttgatcagaaatagagtgtttctgctaaaccccctgtttctataatttgtctataggctttttgggaattttctttgtaagtagtatcatctgtgaaaaataatagttgtgactttcatttttcaattctaaaaatttttatttgtatttcttatatttgtgctttgtctaggtcctccagaaagttaaatagaagtggttaaatagtggtggttatactatttgtgattttaaaggtgatgcatctgatgtttcaacacaaggaatgatatttattgtctttggtggttattctttatcaagttgaaaaaatttgttttcctttgatatttaaagtttgtgttttaccatgagtatattaatttttttgaccataagtgattggtaattttatcatgtttaagttttaagattttattttatcatgaataagtattgtattttctgcttctgagactgttttctccattaatattttaatgtggtaaatgttgccatggattttaaaatgtaaacattctctttcattcctggaataaaactaatgtattcatcatgtgttatttgagttacataacactggacctagttaatcattttttcataggatgcttacttctagtttatgaataaaattgatctttaattttcctgttcagtcactgtctttttataattttagtatcattgaataagttgtggaatagttcctttcttctattctttgaaagatttttataccctggaagacctattccttaaatgtatggtagaagtcttctgtaaaactaattggaactgttatatatttataggaagattttatactgtggattcagatttctttgtaatgtaatagaagttatttcttccttaatcaatttttataaattctgaagtaatatgcttacatgaatatgaccatttcatctgagttttaaatttactggcttaaaatatttatcatattttttattatcttttaaatctcaaatggatccataattatattctctttaatttgtgaattctatttcttgccctcccttccaacagttttcccctcccttcccatctcacatcattcttcctgtaaatatataaattttgttggtacttttaaagatccaagctttggattttataatcattatgtttagcttttttcttgtataactttgtagtttcattgttatgatcttcttctgcctatagtctttgagtttatgctttgtttctttttccagcttcttaagttgatacataactcattaatggttggcttttctactattttaagtacttaatactattaattttccccaaatactgtttcaactgcatcccacagatgtttatatgtagcattttaatttttgtttagttttaagtattttaaggtttccattatggtttgttctttgtcctgtggcttatgtagaggacattttcaaatttacatatgcatgggttttgggttatttttttatttgggttattatgtatttgtagttgaaataaatcatggtcagaatgcatggtttgtatgaaaccaattcttgaaatttcttgggagttgctatggcagagatttctagttttctaccaaaaaatgttttctttattcctgtagttttcatgatatagctgggcatatagttaggtacctgtatttttcagtatcctgtacacctagatgttaccatgaaactaaatgttgccagtggaatttgcacttaatagttgtgtgtttgtggaattacctttcagaaatatttactccctcccatcattttaaagaaaggattctacttccctgatttttttagtctttgtttttttcttttttttgagacagggtgtcactctgtcacccaggctagagctcagtggcatgatcgcggctcacagtagcctcgacctcccagggctcagctgatcctcccacctcagccttccaagtagctgggactacaggcctgcaccaccacacctggctaatttttatatttttttgtcaagatagagttttgtcatgttgctcaggctggtcacaaactcctggactcaagagatctgtctgtcttggcctcccaaagtgctgagattacaggtgtgagccactgcacccagctgtttcctgattattgatgtagagcttggccttggccatgtaacttattttggtcaatgataatttgagaaacctgactctacagaagcttgatatatgcttgcacatttaggtttgctctgtctgccatgggcatgaaaagaatgcggccatttcccttgataatatatgttcttcagaaacattagataatgtcataatgcattattacttggatatttcacaatgtattttatgttcccatgtctactcattttgtttatttccgttgttttgctgtttcaaataattctatgaggcaattcttatacattaaattctgttcatatcttattgtttctttggtataaaactcaagaactggtgatcttggattaaaggatataaacaagtgtttgttctattcttcatttttacagtgaaatacaaaaaatctcctttaaaaagctactccttgcatttcatgttagtatttgcctggtacatcttttttcatccctttattttcaacatttctgtaatatgtttagttgatgtttctaggaattagtatatagtgggcagtctctttcatttatctggtgattttgtccacttatatttatttaagtgttttccacttattttgattattcatgtttttggacgtgtttctaccatcttattttttgctttatgttaatttatctttttatgcttgcatttatctttccttgctttataatacattgatttgttttcactatgtatttttctctttcagtgtttgctctgaaaaaatttagcatgcacatgtaatacaatctaaaattaattacttggataatagaaaaacttcaaacgttttaaataagatcaaaacacttcctatttacatatatttttgtctggtcatatattttttaatataatgaaacattattatttaagaaaggtaatttataaagacaatgcttatttcaatttatctacaaatttactaattttatttttctaactggttttaggatctcatattatctttttttgcccaagtttcgtcataataggtataattttttaaaaatttatttcatggactgtattatgtttcctgtatttaggtggcatgtcttttatcatttctcagaattcacactcatgattgcagtaaatatttcctttcctccattaataaaaattcattcctttcagagatgcaattagatatgttatactatctaattctatctgccatattatttaaactctcttttacattgtttatattcttatctccttatgctcaattcccaaaaatttatttatagttttttttaaattttattattattatactttaagttttagggtacatgtgcacaacgtgcaggtttgttacatatgtatacatgtgccatgttggtgtgctgcacccattaacttgtcatttagcattaggtatatctcctaatgctatccctcccccctccccacaccccacaacagtccctggagtgtgatgttctccttcctgtgtccatgtgttctcattgttcaattcccacttatgagtgagaacatgcggtgtttggttttctgtccttgcgatagtttacagagaatgatggtttccagtttcatccatgtccctacagaggacatgaactcatcattttttatggctgcatagtattccatggtgtatatgtcccacattttcttaatccagtctatcgttgttggacatttaggttggttccaagtctttgctattgtgaatagtgccgcaataaacataatgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtcaaagtgttcctatttctccacatcctctccagcacctgttgtttcctgactttttaatgatcgccattctaactggtgtgagatggtatctcattgtggttttgatttgcatttctctgatggccagtgatgatgagcatttttcatgtgttttttggctgcataaatgtcttcttttgagaagtgtctgttcatatccttcgcccactttttgatggggttgtttgtttttttcttgtaaatttgtttgagttcattgtagattctggatactagccctttgtcagatgagtaggttgcaaaaattttctcccattctgtcggttgcctgttcactctgatggtagtttcttttgttgtgcagaaaatgttatccagcatataaacagaaccaaagacaaaaaccacctgattatctcaatagatgcagaaaaggcctttgacaaaattcagcaaccttcatgctaaaaactctcaataaattaggtattgatgggtcgtatctcaaaataataagagctatctatgacaaacccacagccaatatcatactgaatgggcaaaaactggaagcattccctttgaaaatgggcacaagacagggatgccccctctcatcattcctattcaacatagtgttggaagttctggccagggcaatcaggcaggagaaggaaataaagcgtattcaattaggaaaagaggaagtcaaattgtccctgtttgcagatgacatgattgtatatctagaaaacctcgtcgtctcagcccaaaatctcctcaagctgataagcaacttcagcaaagtctcaggatacaaaatcaatgtacaaaaatcacaagcattcttatacaccaataagagacaaacagagagccaaatcatgagtgaactcccattcacagttgcttcaaagagaataaaatacctaggaatccaacttacaagggatgtgaaggacctcttcaaggagaactaaaaaccactgctcaaggaaataaaagaggatacaaacaaatggaagaacattccatgctcatgggtaggaagaatcaatatcatgaaaatggccatactgcccaaggtaatttatagattcaatgccatccccatcaagctaccaatgactttcttcacagaattggaaaaaactactttaaagtacacatggaaccaaacaagagcccgcattgccaagtcaatcctaagccaaaagaacaaagctggaggcatcactctacctgacttcaaactatactacaagcctacagtaaccaaaacagcatggtactggtaccaaaacagagatatagaccaatggaacagaacagagccctcagaaataatgctgcatatctacaactatctgatctttgacaaacctgacaaaaacaagcaatggggaaaggattccctatttaataaatggtgctgggaaaactggctagccatatgtagaaagctgaaactggatcccttcctcacaccttataaaaaaattaattcaagatggattaaagacttaaatgttagacctaaaaccataaaaaccctagaagaaaacctaggcaataccattcaggacataggcatgggcaaagacttcatgtctaaaacaccaaaagcaatggcaacaaaagccaaaattgacaagtgggatctaattaaatttatttattcttaattgtccagttctctttctatatgttaaatctttttacaaatgctttgtatttttctaatgagtaattgtatgttttacttctaaaggtcatatttgattctttaaaatttttttttaattattggtagctcctttttacttgaacttatttgtgtgtatactttttgtttaaccatttctaggattatgcttccaaagcttatggctgacctaaagcttactctccaaattgcagttctggttttggcatttggcaacataccccaacagtaagcatgtgcttatggttgctagctcctatacagttattttactttattttgtccataagctagtaatcgtaaacacatgctttactttttcactactgtcgagtgtaacaatgcaacaagatgaacctaaggtttacttaagtgccagttgtttttgtagtgggagaatccttcaaagtatgtagtcttacatattgctggaattaaacatcctacagttaattttagctattaagatttccattttttatgttttttggaagaatataagtaaatgattgtcctaatttaatccatggaggaaaattataacaatttttaaaattttatactatcatggatacataatagttacacatatatatggggtacatgtgatattttgatataaacatacaatgtgtaatgatcaaatctgggtaaatgacatatccatcacctcaaacatttatcattcctttctgttgggaacattccaaatattcttttctggttattttgaaatatacaataaattatcacaaactatagttgccctatggtgctctcaaacactagaacttattccttctatataactgtatttttgtacacattaaccaacctctctgccttttctctcccaccttcttttcccagtctctggtaaccaccattctattcattacctccatgaggccaacttttttagctctaatatatgagtgagaataagcgatatttgtccttttgtgcctggtttgtttcacttaatgtaatgtcctccaattccatccctgttgctgctaataacaggatttcattcttatttaagttctttattcagaattaaagtattttatagtcaatggataaatccaactcttgattagtttatatgttctagggaggataagagaaagcaaaataagggttttcaaagttctttaatctggttagcacaaaggctacaggagttgaagtatgccaaaaaagaggtttacatttggataataagaagaggcataaagtaaaataaaattatagtcaaaagtgaggttgccttaggttcagcatctttaagctgatagtggcaaaggcaatggtcaattactgtaaatgtcattttctcacccttttcaatagtttcctgttttccagaattttgtttttttgatgtatcatgaattggatagtggagctttgtagtagaagaaatggcttattaactatgtgcagttactttattcattcatttctttactcatcagaaatttgcatacagtttgggaggcagtgggtaggaatgggagataccaaggaagatggaaaagccctgcttttcaggatttcacacgccagatcaaatggatttcataatcaaaacaaaaattatttcacttgattctaaattgctaactttggaatagttgtgtatatatactaattgagagccaaggtgatgtcattattttatttaaccatacattaagttgtaatttttatttatgtgatttatgaaataatgttatgaaccaaaataagtcaaagcattgtattttaattaatcaaatattaacaattttaattccctctattaggataaaggatgttaccatattatacagaaaaaagttcagtttagaaataagacctaagcggtgtgctcaccattgttccatctgtatgggcgcacccttctatgtagaagtaacttgccttgctgagaattaaaaagaaaattttatatgcgagtgcaatttcttttgtggcaccaaaactttatatataacaatttggggtctctcccgggattacattctcctccaggacggtctctcctctctcgtgaggaggcgcacccagccctagtgtggtggcctcaggggtgagaaatcaagacccaccccagtgcaaggaataacccgagctctcagcgacgcggatttaaaaaaaaaaaaaaaaaaaaagggaaaagaaactggccagcaacctagcttaaaggactctcacatactgcggcgaccactctgtgcacagaccaaggaaggagaagccgcgggagcgggtagagtaccttggtggtcaaattctggagggctaaatgtgtgtgtgcgtgaatgatcacaaacaaccctgcttgcagtgttgttcgtgtggatggtgacaagtcctactgctggacagtgtgagtgggtcctctttgcagttctaccttggcggagcggccagagaggacagcacaagtgggaagtgtgcaaaggaccttcagagggggaaagggagaaataggtcaatcttccaggacaggcaagacaccccctggtttgaggggttgagccttccagggcaagcaaggcaagacgccccctggtttgagggcttgagccttccaggacaggcaaggtgagacaccccctggtttacggggttgagccttccgggacaggcaaggtgagacatccctagtgttgaggggttgagccttccgctaatttcaagggttgaacttgacacaacccccccgttcaacccctttcctttcttctcgggagaagaaagagtagttgcactcccgcaggtccctaccctaggagagagagagacaggagagagagagagagagagagagagagagagagagagagagagacagacagacaggagagagagagggggagagagacagagaggagagagacagaagagagagagagagacagaggaaagagagacaggagagagagagacaggagagaggcagagagagacaggagagaggcagagagagacagagaggaagagagacaggagaggcagagagagagagaggagagaggcagagagagagagacaggagagaggcagagagagagacaggagagaggagagaggcagagagagagagacaggagagaggcagagagagagacaggagagagaggagagaggcagagagagacaggagagaggcagagagagagacaggagagagagaggagagaggcagagagagacaggagagaggcagagagagacaggagagaggcagagagagacaggcagagagagggagaggcaggagagagagaaagagaaaaatagaagtagtaaaaaaacaaaaacaaagaaaaaaaaacaaaaaaaccagtgtaccctattcctttaaaagctagggtaaatttaaaacctataattgataattgaaggtcttctccgtgaccctgcaacactccaataccaccttgttgtaagtgtaaacaagggcatagccagaaagcactgaggccactgacaacctgtagccttcctataaaaaatccttaacctagtaatctgcggatggccaaatgcattcaatctgtagcagcaactgctttgctaacagaagaaagtagaaaaataacttttagaggaaacctcattctgagcacaactcaccagtttagttcaggactatcctaagtcaaaaaaagcaaaaaggtagcttactaactcaaaaatcttaaagtatggggctattctgttagaaaaagatgatttaacattaaccactgaaaatccccctaacccagcaggtttcctaacaggggatttaaatcttaattaccgtacaaaggtccgaccagacccaggaggaattcccttcaggacaggaccatagatgtttcttcccgggtgaatgagggaaaaagacacaatggttattcagtaattgatagggaaactcttgtagaagcagagttaggaaaattgcctaataattggtctgctcaaacatgcaagctgtttgcactcagccaagccttaaacagaaccaggaaggaaccatctataccaattctaagttaatttggactaaacaaggtcttattaatagtaaagaataattaaaatcccaaacttagaaggttttcaagaaacgtagcttgctaaaagttagcagtgtaacacgtattatcctaacttttaatcttgtggccttagacagtctagtccacagacatgaaggaagttcgctttgaaaaagaatggttatcttcaagagggaaaaaaaaaagtggggtgggagaatttacataaaaaggaatgttccatggtaaattattgtcctgaaataaattaactgttttttttttttaaaggggatgtttgtgacaagtcagaaagttgaggcatgtcgaaaaaatatctctgaaagttgtgggaaaaaaaggttataaaagggaatttatgcaagaaatgttgtataatttaaaagtaactaggcctcctgaatgtaaaactatttattctataaacagtttatgtgcaaggtgtgtaagaaaagtaaaatatacttttggtaaaaagattgtagggaggcataagaatgtggatttttacctacattaacaggttaaaaaatatatattttgttttaaaggtttaagcaagttgtaaaacgttaattgtaaagaaaattgtgtgtgtaaacatactcgctaaagttaaagaggtatcatccagtttttctgtgaactggacagtaaaagcataacaggtttttcttaacgcactaacctgctctttaacaaaaattataaaaggttaaaaagagtctataaaatcttaccttagggccagacattaaaaattgaataaatatatctacaaagttttattaaaactaagtttaacattaataacacactaatataaaggtgaaatttagctcatcgggtataaaaatcatacaagaagcattatcaaatataaaatggtatttggctttctttggtctaaaaactaataaaaataggtgctaaaggaaatttctcagtaagaaggcaccaaggactataaagtcctctgcagatgtccccacacttaaaaggtcaatttcttagaaattatatacttggtttatcttccactttccttttcctcaaaactaaaagtcttttagcacaggtaccatccctagaatttccggtaaacgggaaccagcctgaagatcacgttcttatctagggtggaaagaaagaaaactttagcgatcctgggaaggaccctaccttgtgctgctaaccaccgagactgctgttcgtacagcaaaaaggggatggaatcatcacacccgagtcaagaatgtgccaccccctccagagtcgtgggccatagtcccaggggaaaaccctaccgaactaaagctaagaaaaatttaactctctttcatctattctattactctttattctttcctctatctgttgctgaccatctagttattaacataagcaagtcaattttgcctcaaactactgcatttaatgcttgcgttgttataccctgaaggaacttaccaggtcaaagacagttttctatttcagaaaaggaaaagtacctgtgtccctcctgactcttctcagactgggcattagtaaattgggaccatttaatccaaggagatttcgataaagacctaaatgtcaaccaggagtcttgcccccgatgtagagcttttatgctgtagttggtccaacgttctgtggcccactgaagagcaaagatggactgcaaagatggactacaaaaaccaactggtttttgtaatttcctaaaaccctacattcattttactagagaatcatagaagttaaagacttaaactttggcaattaagacaggataccaagatgcaaatgcctagttggaatggatcaaatattccgtccacacattaaacaaaagcaattgttacacttgtgcgcacggcaagccagaggcccagattgtcccctttccactaaggtggtcctccagtcgaccaggcatgggctgcatggtagctcttttccaggattctacaccctggagtaataagtcgtaccaagctctctctctctgctatatcctgaagtccggcaccctgcgggtcagcccccgagggccatccagcttccgtctcccaacagtaagttaactttgtgtctctcatgacagggaggaaacctagtgttccttagagacctgaagggatgcagtgagcttaaaaattttcaagagcttatcaatcagttagcccttgttcatccccaagcagatgtgtggtggtattgtggtggacctttactggacactctgccaaataactggagtggcacttgcgctttagtccaattggctatccctttcaccctggcatttcaacaaccagaggaaggaaaaataagacattgtaaagcaagagaagccccttataggtctttcgactctcaagtctatttaaacgcaactggagtcccacagggaatatcagatcagtttaaagcctaaaatcaaatagctgcagaatttgagtcaatattttggtgggcgaccattaataaaaatgtagattggataaactatatctactacaaccaacagcgatttattaactacactaaagatgctgttaaaggaatagctgagcaattagggccactagccagatggcttaggaaaatagaatagccttagacatgatattagcagaaagaggagtttgcgtcatgattaaaactcaatgttgtatcttcatcccaaacaacactgcccccaatagaagtataacaaaggcattgcaaggtctgactgctctatcaaatgagttagccggtaactcaggggtaaatgacccctttacaagatggctaaaacagtagttcagtaaatggaaaggaataatagcctcgattcttatttccctcgcagccgtaataggtgtacttattcttgtcaagtgctgtgtcataccatacatccgtaagtagatgcagaggctcataaaaacggcacttactaaaacctcccttaactatcctccaccttatccagagaaacttcttttgaaaaatcaagcaaaacagctaagccatgttaaaaaaaaaagaaaaaaaggtttgaaaagaaaactataaagaatacaaggggaaggattgttagatatgggttctaaatttcttttcaaagaattaatatgtcagtatgttcaattctttgccttttacttgtaaacttcctcgtgaagcaacctttttcgtttccctgactcatctgattacctactccaccctgactcattctgatcacctactccaccctaactcattccgatcacctgctccaccctaacacattctgatcacctgctccaccctaactcattccaattacctgctatctgctctgccctgactcccaacaaagcactcaccctgtcattctctttaaattagccaatcggaattagtttaacctgtgtggtctaaccctagccaataggggaacaacacagcagcaggggccacatgtgtcagggataagaaccccttcccctcccttgtccaagtgtgtgctcaccattgttccatctgtaagtgcgcacctttctatatagaagtaacttgccttgctgagaattgaaaagaaaattaaaaaaaataataattagacatgggcattgttactctaaagagcacctcgtttaacttttatgaatcaaagttttatcctatgttggtcctcaataaatcctatcatacttcccatattaatttctgtaagttaattagagtgacatcttgtgccactctcagtgttttgtttgtttatttttttttgtttgtttggcttttcacttctcactagtttcctaccctccagaatttcccatttttggagaagcgctaaaggcttagttctaggactgattctatgtcacaggggcaatgaagaaaataaatgaaaccagcatggcataaaatatagaagagtaagaggagaatataatgataagagatagatcctaggagtagaggcaaataatagtgtcataaaggaaagatttaaaaaatgaaaattaaaaatatgaattgtctcatccaaaatgggttagaaaattaatttaaaacattattattaaattgataattttaaaatctgcaatgttagatttatagcactggatctacatactatgtataatgtgaggatctttataatatcaggtagtcttgagttatattgggtaatgctgttaattagtatgttgatactataaatggtgttttatagttggtactataaatgatactataaatgagactataaatggttttactgaagcataaatgaataggataattgcattaccattcttgttgcattttctgaatgtatgttttctagagaaaatgctatgctatttcatagaagttcatgtgtgtcataaaaactaatcctaagtgttcattcatttctaatagtatccataagattaagtattatttaaatttttttgaagtatcaggttgctgaaatattagtctgaggataacaaaatccagtaatagtttttcttcctacaaaggtcatagttttatatgtgtgcatatgtgtctatgtgtgtgtatatctacaaattaattaaaattgttgagcatctcatcatgtgctagacattgtataggttatactttacatatgtttccaatttaaaactgtcatatgaaatttaagaactttcttataactattgagaggactacatatattattcaaatattatttatattttaaatatgtttttaaaagatattacgagccaagcacttgtagcacagactagtgcataattaaggtttctgatagatttggtgaattaacaaaaaattgttaagttggtagtgagctaaaaagatggcagggtaaattaacaaaaatggaaatacgtgatactccatatctcatcccttggaattatggatctgactacatcatcattatgtctggccatgacagcacaaaccaacaatttaacttcttttcgatctaatagtgtttggtacatgccataatcatattgttagttttttgggatatttcacagtgcaaacaaagttatgacagattgatcagaagccctgggtctggtaaaatagaatagccctggtctgtttttatccaggtgtcactaatcttcatgtttaactttgtacctgaaaatataaaataatagctaattgtgctttcccatttcatttatgtttcttcaaagaaccacaggatttttatgtttaataattcattttaaccactcttttccaatgtagacagtaggaaacactaaatgcaaaaatatgtgcagtaggtagtctccaaacatagacccctcaattaactacacctcctgctattcagttcctagtgtagttcctgctacagtgggtctgagctaatggatctatgagctttcttttagcattaattacttggaaacaattttcagtttcttaaaaattcagtttatttaagcatgttaatctgaaaatttctttattattttaagattagttccttaattaattagacattttttactgtagaatatttataaatctctgttctttattaaaaaacctgaaaattttaaattttagtttaatttatagcttgaatctagatttcaatttgtttattcttattttagattatgacttttgagttttcaaattctcattttcaaacaggaaaatgaatataaaaatgtagtgttgagggactgtttttccctctaagtctggactgtcacatgattaatgtaacataaaagtgattttatatcacaaaagtgataaattcccattcttgtgacatactgctaatgcaaaactttaatcactgtgccttcaataggaagccaaaatagtctgacttaaatttaatgtaaaataagtaataaccgctgataaactatttgacctagagtcttataaatgataaatgaggacttaaagctctaatttgtcccttcttaatggactatatatgtatataagtaactgatgtcattgcttcattcttggtagaatgtgctgtctgttctttgtgacatagtcacatggatggcagcaggcaaagagagaatgaggaagatgccaaaatggaaacccatgataaaaccatcccatgtcatgagacttattcactaccagaagaacaatatgggaaaaccgcccccatgattcaattatctcccaccaggtccctcccacaacacgtgggaattacgggagtacaattcaagatgagatttgactgggaacacagagccaaaccatatcaggcagccaagctaaagcttgatgggtaggcaggaggaagctaggtaagagaacaaggagaggctgtgccagcacatgcaaagatctagaggtcagccccaagcttttcagaggggccagggaagcatgcaaggagcatgcagtgttgacagctgacctgggccaggccatggagttcctttgaagccatgcttaggaatttaggtcattatctgaaggtacttcctcaaattccaactctctgaagcggcttagaaactttgtgcctggaaatatcattttttcagcacatgaaaaaacaattgaagtggaacaaaactggactcaatgatgccaagttgggaataaatgcagcaatctatctgggtgagagatgggcacaggttggctaagaaagtagcagtgtaggtattgggaagaatagacagatttggtacttatggggcaaatcttcatggttgattacgtttgtagtgtgtgtatgagaaacaggaatcttcagatgtttttggctgggttgacagtgttatcattcattggaattgaagaaaagatgaggggaaggttttggaggagaggatattattaattggtttatgacgtgagggaatttggatgtctttgggacatctgagtaaagctgcttggttaactgtcgtacacagaacactggagtttaggagaaacttgggaaaatgaaaagccccaggttgctgcaagggaatagggtctaaggggagggaacttggttgcaattaaggcaggaagctgcagttagttctttgtgaagatgttgaggatgtagaggagttggttaatcataaaataaggataatataaacatgtaatgagaaagattgaacacaaacatggaagattgtgaagatgagatgatgggaatcagtagaaggccagaagggacacacattgtgagtgataacctgatgagcaggatgtcacatacagtgagtttgctggcccatggctgtaagaaggaatcaatgccagaagctcttggctgaatgggggctgggaaagacttgacattctctcaggagtctgaatagatcatacttccaaagtcctagcctgtggtacatgcagaggctttaaatgcaaccaactctgccacacacatatgcattgtctgtgagctacaggctgctgtttacacaggcactcagaatgtatcagggaccagatctttgtatgatgagactcggggtagggtcccagcagtcataaacctacttttaggagccaaaactaggtcatagcctatattggttactggaaaattagatcagcttcgtgtgtaaacactatttcagggaatgtggtcctactcttggtggtgtgaatacagcatgctatataacacttgatgttttaggcagcattacttgacttgttttttctttttttgttacaccacagcacttgggtaaaatatttatatgattcactgagataaatgaacaaggcatttcattgaggagaccagccattgggctctggcagtcgtaggtctttcctggctatcccggggtgggggctaaagaggagcgttttgtattcttatatgagatggtcagttggatccagccacaagaggagacagaagagaggatcaggaaaacaaagttcattatactcatgatcttaaagacagggggcacagtaaaccatgctaactgggaaaaacaccaatgtggtcaggaggcaaaacataggagcaagggaaaaggattaggccagagcctttactgaggtttccacaggaagggcaaggcaggacagacttaacagtttagaattggctagtttgaataatttcagcaggctctaagctgtaagtgtggctgctggttgcctggtacctaactctgggatgattaaagcagaggcacattgactcgtggggtgtatgggcctgttaaaggaggtaaagctctggattggttagtttgcttatcaaaggcatgatcttggctagactttcctgtctttaagaattggctagcctcaggaggtcagaggtcaagcatcatactatatagaaaagtacagacacacacacacacacaatacaaggaacaatattttgggtatagccataacctatttgaggcaaataaactggaaaactttgctttagggggatacatgaatgttatcagggcttttgcaaatgccaggacttctgacaactgtttagtgtttttgctttcacagcttcacaatatcttatatagagaaaatggtgtcatacttctaagaaattacttttgtacaacatgcagggaactagacctgtttttctcctttttcactatagagtactcagtggcacatggatttatgtaaatattaaatggctataacttgctttgttaaaaactgttatagaactattcctgctgatttcagtgtaaattaattttggtaaaccttaacagtttctctttgtaacttaaattttttaaatagaaaatactatattcacatggcaaaacattcagaaagtatattaaggcataacgaagaaactaaaaatctataatcctacattctgaaatggtaattatgcataatttagaaacttacctttttacttatctataaaaatatatttttatatgagtaaatgtatatgtaatcatgtcaatcaaaaatattttcctcctatttttcctccttttataaacaaagatcaaatttagaaatttattgtgtttcaattttttttttttttgagacagttttgctcttgttgcccaggttggagtgtgcagtggcacgatctcggctcgctgcaacatctgcttcccaggttcaagcaattctcctgcctcagccttccaagtagtggaaattacaggcatgctccatcacacccagctaattttgtatttttagtagacacgatgtttcaccatattggtcaggctggtcttgaactcctgaccttaggtgatccacctgcctcagcctcccaaagtgctgggattacaggcatgagccatgtgcccggcctacagcatatatactattaaacatgtatacacatatatgcatacatggtatttatagatatacatggatatttatatccatctacacacacacacatatatatatatgcacacatgtacacttctacccacaaacatacacacattactataacaagagcatccttctctgttaccaggatctggagctcctaaaggatgttcccaggtcattctaggagatttccagggcatggtctggaggatttccaggaagaggtttcacttataccttctatcatattttacattctcatttatactaaaaattttggtttgataatatgtttgattcaaagagctgtttgttattctctaattttttcatgacttcctatttttctctactggatcttgatgaatgcagtatattcttcaagggtaataattagatttattttgtatggtcttttgatcctggcactactcttttatgtggaatcttgcttttgttttttaaaatgtgttttattgtctcctgtaatgcttcaggattactgtaaaaggcttctggttattgattttatgtttacttttatgaatggctcaatgtaaaatctgagttgaatccctacatagattacatggatatgtcctctggaaagctttgtatagatgagtggataggcagctgatcattgctctgggtcttttaaaagccagaattctgggagcattgcttaggggcaccatcaactatacaaattactgattgatttatttcttactcttacccagtatttgatcaatttctttagaaaggaaccattttctcccaaggtctaaaagcctgtttcctaatgctgctatgctacaggagtagtatggtaggaatagagagagtgatgaggactgggaataaaaggggtaaactgtcctgtgtagatcaatgaatcctctactcttagctcctcttctcactgctgtgagaagcttacctgtttttttcctagtgctattttctgtgtggatatgcagatcaagtgagttgtctctgaacaataactccttcctgaaaattctagtctatggttcccccttgtattctcagtcaatatttttcaataactttcatttctcaggaccttatgttgttttctttgtatttgtacacattttaatttttctttacattaaatattttagccgttgccctttccacgctcctcattatgctgccttttttactccctaatatgctcatacagaaggtcatcttagtagcactaactgtggtcaaatgaataagggatgaagaagaaattatttatagaaaaggatcacatgctgagatttgtagtactcgtgtagcacttaacaccaggcaatacatatatgacatgaatgtctggcaggcattcaagatataatgatgtccaataacattgaaaaagaacacctttttaaaaaattaagattgtttttctcttgaaaataattttgcattaaaagcatgtgctacttttttttctttgaaaagaattcacattacatgtgtgctacttattgatatatggactacattgtggtttgccatattagattataggttttgaaccaaaagtatgatttaaaaggacatgttaaaaataaataatgaagagagtttaataatgtaagagatccgtatgaacaagtagtgctaagtatgtatctcacttcagctcctgcagtgggactttcacatgcaaatagatgcattatgggtaccagttatatgtagttatctcccttttcctcaagtagatgaacgtatgacaggttgcatttacaataatccctatggataatatttttttctaagtatatacaagatatttttttatacctttattttatcaaacattaagcaataactaaagcaataaacattggtttacaattttcatttatactgtatctcagttgcaatgttgcctagcatgtgacatatcttccactgacatttgtaatgcatgtcaaaataaaaatgatgtttattgctttcttggaacttactcttcacggagaataaaccctggataaatgatgcatttgatctgatgatgaaatataagaacagtgatatgtattgtttggaataatccatcaaaagacactgtcagtgtatccctaaagagtgtgcttatactttatatgttgcatttttcttcagaaactgactgatagtacctgtttttgagatgacaaaaagagaacagaagaaaatgggttgctacatgaagcaaaagttagtgcattattactcacaagtagtgttattgtaaactggaaggcacatatacacactttcactctgaaagtcaaaggccaagaaaatattttagaatttgcacagcagtgaaggacgtgaatatgtatggaaacatgcaagttgccttaatactcttgaaggaattaaataattgtcttaaggccatatattgtttaaccatggtttattctgtgttatgtaaaattcttatagttcttttaataacctaataccactatggagtttctagaagcaatacatatttgctatagaatggcttatgggttagttttagtaactttttgttagttttttaaattctttttaaaaaattaatcactcttttgcattccaaaaaaagaaagcaatacccatcatgcatgttcacatatacacatacagaatcactagtctgcttgtttggtatgtggatgggaaaaacagaaattatactgatggcagcagtggcccatctggagtggctgctgtgaagacaatggctgcagcaggggaggtgtggccagggctgcaggagagtcacagctggggctgcatcctcccagagccagcaggcctgaaacaggcgggagccttgcctcctaccaagtggtggagcaggagccccatgctctgggcacagctgcagccacccagctgcagctctggacctgggcatccatatactctcggggtcccaggaagccaccctgcccccacaggcttggaagtgcctgttcccactgtctggcctttccctgctcctggcacccactttggggcagagcaaagttgtggctgagcccaggtgctgttgcaacccagccaggtgtgcgtgtgcttggggtggtgccgactcaccagtcccccgccatttggccccctccagacattgggcaccaacaaacacaagagagaggccaaaggggtactgagggtggctcagctcaggtctgcaggtgccccttggcatgaacagcctgggtgctgtggatgacatgtagatggtggcaggaggcagacaggctcctgggcagaaaaatgtgggtccctggtgaagccccaccttcaagccaggcatggcctaaagcctgggggccaggctcccaattcccagtggagtccacaactgggagtgaggacttgtggtgatttttctgggcccacctatggccacccaaggaccaatcagcacgtatttcccctcttctgagcccataaaagccccagatggacccagccagactcacacagacattaaaactaccagctgtgggaaggagctacccaatttgggtctcctcaactcattcagacaacctgcctgcagataggagctacccactccagatctctgctgagagctggacactcatcaggacgacctgcccgcagaaaggagctacccactctgggtctcctctctgtggagggctggaaacgcattgggctgacgtgcctgcagaaatgagctacccactttgggtctcctgagagctgttctctgttctgtcacccagtaaagttcctctctgccttgcccatccacctaccagtttttcatgtacctcattcttcctggatgtggaatgaactcgggacccactaactggtaggggactaaaagagctgtaacccaaacagggctgaaatgaccccctgcttgccactttgcaggtgatgagaaggagagaagagctgtggcccttcagggagcccagacctagaagctccacgagccagtgctgtgacaccctctttggggctgtgcagtttcagatgtttccaagcatccagacgccactgaattctcatccagatttgggtgcccacagcagaagttgcttggagtgcatctgatccagctccaggcttacacagatccagtgcctgtgccagtgcctggagctgcctgccccactgcagcagctggcatgcctggctgtgcacagtggctggacctggttctcacttgctcacacacccctcacctctctgctcctggcttgcctttggctggtgtggaatctgggctgtagcaagagctgagcacagcctaccaggccgagtgggcagaatgagcccagcaggcccaagcaaaacttgggcaaaggtaccaccagccacagaggtttctggctggaaaagtgacaccctagggatcctgtgacagtatcagagttccttccccttactctccttccctcccaccctctgtacacacaagaatgcaattctctaatttctgacccaagatggatgattcttgtaggctgtgtaatttactcctttgctgacatggaattaatggttcctctagatgaaggattagccctgttgctaccatttttcccatctttgtgtaacctgagaactagcatttgacatccaagccttagcctcaagatacagatataactcaactaacagcatccttagtctatgatgacagcttagacttctaagtacttttctcttccctgccctagcagggatttccatgacagcaaggctgtcttctctagtcttcctttccttaggctgttacttcaaacactagaagcttgtcttttattgacttattttctcacaagtcagacagaagtgtaagggtttggctactgttgatataaacttttatctcatttagggagatgaatcattcttctctctggattgtgttaaccaggaccaaatgatctcttattttatgatagattttgatccagtacattcttgctatctaaaacctgaatgttcatctacccttaacttctattttttcatcaagggtagaatataatatgaagaaggaaattcctattcctagactgaaacttgcttcactttctttgtgtgtagctcctaacattagatataaacaaatatgtaattaagaaatatttttaaatagggttaggttaccttaaaattaatgatacaggatagcagtgtgttgaaaattagaccctggagagagggatggtgcctgtactcagatgctaggttggtcacatactagctgtgtggccttattcagttacatagattctctgtgccttagtgtcttcatttgtaaaagggggataaaaattaaatctgctgcctttggttgttgtgaatcttactgtttcagacaattctgtttcaactattagctgttattaatcatgatgacaatactaacactattaacgaaagacagtttgtatatgtcatttcattttggttctttcaacaatgctgaaataagatatgttattctcattttttaggtaaaaatactaaagcccaggaagttttattaatttttgccaggtcattcagtccgtctgtgtctaaactaagctcaaatttaagattctccctcaaaagccttttttctcgtctgcaatagatagtctccctttatttactgacttttgttataatgaggatcctgggtgaaaactagtattatcagagatatcttatttttacagagcatttcagcagagtacatttcctacattcatagttggctgtacaggttattgaactttatgatatgatgcaggaactcaaagagcactttccatgacaaacttaatttcctcatatacttattctagtgatacagagagaaaggaagatgaaggaagggattctttcagggggaaataagtgtagtcaggatgttatagtgaacactttgatcctcaaagggtcagcatgagaaagaaagttgtgagaaggaatcaaatgttaggcagatatatgaggagggaaattttcaaagacactcagttccttcataaagtagtttagtcaaaataattgttattagaaggattagaagattaaatgactttaaaaaatgagttaatttatgtgcaagaatatgtctttttaccattatagagatttgaatatatatttaatcacatttattttttaaacccgactttatgaactaatatgaaaagatggacacattgttcttttcttagcagagtcatattaagatatattattaaaacactctcaattagtaaaaatgagatctttttatggctaatttactggagttatctttttcttagatatcagagcttattttaaagtgtacttcttaataatttaataacccatctttaactttgaacatgttaattttctgctaccttaatgactctaatggcataaaaaataaatagtacatttatgcaccattaagatctggctgttgttctgtttcatactgctgggaactcatgctagagatgctatagtccttacattttttaaagatacccttttacaatttgagctttgagaatccagaattttaggggtctttttcaggagtcttgttcttctcctaggctctgggcttaggaataaaacctctactgagctgggaacccagccactgagttatattcatttctttgccatggcctttggggagaccttatagtttggagagcctttgaaaagaagcaagatttgttgtattcactgtcaggagtgtgtctagtgtttttgtcaggaataagggatatactcaaagtaagagtatatatgaatgtgtggcaatatagccaggcacggtggctcatgcctgtaatcccagcactttaggaggctgaggtgggcggatcacgaggtcaggagattgagaccatcctggctaacatggtgaaacctcgtctctactaaaaatacaaaaaattagccaggcatggtggtgggcgcctgtagtcccagctactcgggaggctgaggcagaatggtgtgaacctgggaagcagagcttgcagtgagccaagatcacaccactgcactccaatctgggtgagagagtgagactccgtctccaaaaaaagaatgtgtggcaatactacattagtgcatataaatgtgtaggctgggtatggtggctcatgcctgtaatcccagcactttgggaggctgaggtgggtggattgcctgaggtcaggagtttgagatcagtatagccaacaaagtgaaaccccatctctactaaaaatacaaaaaaattaactgggtgtggtggcatgtgcctgtaatcccagctactcaagaggctgaggcaggggaattgcttgaaccaggaaggtagaggttgcagtgagccgagatggcgccactgcattccagcctgggtgacagagcaagactccatctcaaaaaaaaaaaaaaaaaaaggtgtgcaaattgttgcaggaaaagtcgtgtatttccatttctactatactatcagcattatatgaatattctattaacattttatgagatttctcagtatactaaatcatgccttttaacaattaaaaattttatttcacatgctgacatgacattttactgtgttaaaagtggtggcattcatgctccaataatagaaaacagggctccatggagtaatagctgatactaagcttgggccaggaaacatacaggttgagcctggagcatgttgtagtgccaggaagcattttctcattccatattcttaccaatatgtgttatcatatttgccaataggataggtgaaaaatatttgctattattattttaactagtatttcttcaattattaattaaacatttaaatatatttattggccactggcagttttcattttatgaaatgtctgcacaatattctgtacttattttcagcctatatgatttataaatgatctttattgaagaaggacactaattcttgtcttgtacattgcaaatatttttggcagttttctattattttaaatttgtttatgataatgttaaccatagaaactttttatttagccaaatttaccactcttcttactttttggatttttttgtatttttataagaaaacgattctcatttgagattattgaaatgagcacccaaattttcttctagtacttttatagttttatattttatatttatatctctaatttatctggaatttattattgcatatttggtgtgagcttgcaatctaatgattcttttttcctatggctaataaatggttcatttttcaacaatccaagtagattttagaaaatctacaacctacacagaccaaaaatattcttgatatttgtattatgtattatcactgctaactagtttttataatgatgatgttttaattcttatttttgcttctctggctagaaggtagatactataaccttctcttctcctatactaccatcatctctttaaaacctcattaactgttcttaaaagggtgaactgttctctaaaagcataaatctggtgtgtgtgtgtgtgtgtgtgtgtgtgtgtgtatgtttatatttaaaaggatgaactttttcaaaagattattctgatacatacacacacacacacacacacacacacacacacacacacacacacacagggctacactctataggatcctttatttgatattttgctccatgaataaataaccaaagtttttttcttatgtgaatggagttaactattaaatttcaaattatttttctttccttttaagattataggtttatttcgccttttgcctaaaaacaaaactagtgaaaattaaagtataaaaataaatacagtttacattaatggacattccattcaaagtaaaaataatgataataatacatcaaaagctcacagcattgtctggcacctgtatgagaaaaagttgtgaacataaaataatatgcaaaatacataggcttttacttttaaattatatcacactcaagttgctcatccttaatctaaagctaactttaactttctccaaaacatactatttgttttagataatttgcattagtatacccaaaacttttagcatctttcttactggacagacgcacagtgatatgagtaagctgaatccttagttttttgtttatcacatttagaagataatttcatatactttgcctgtaaatttaaaaattagtaactgggatttttttgactggcttctaatttgatacaccttgcctgtaaattttaaaatggtaacttggactgttttgactggcttctaattttctggttcactcattctatatgcaatacatctcaataagaaagtcgagtttacatgcagggtaaattatcattttctgtctataggtggatgtgaaagttaaattttaggtggaacagaaaaatcagagaaaatgatctttatctacatattctcatcctgaaagcaaagacagcaaggaccaagttgctattcttcagaaagagttgatatattaaattataaggatattttccatcatatctcaagtctggttgtcaaaactgagcatcttatctgctttataatgactttttaagaaagattgtttttctggaaagtggctatcagtaaaatattcagtgtagatttaattttctttgatggatatataattaatctaaaaattagtacattgtatttcctaattgtgatattgagggaaatagtactaaatagagaatctagccctggtctcttatgtagttaaacacatcatcaacagctaatatagaagatggcagagtagagggttttctagagtgcctcaccaactctgaagaagcaaaatagtgtgtagaattcacaatgtgaaactttatccaagaaggcacacaggaattcaacataaagtgaataagaactttagatattggggaagagaaggtaagtgggcagcctgtgtggtggtgtctgactgagagctgtgagtgaagtcccaatataggagagggagaaaaagtactcctctgcaatccacatttccactggggagccgtacaatccaggctgtgagagaataccttgcccttcccaagccctgaatctaaattggagagaggctaaaacactatgagaagggacatcactaggaagcaccccaagcattttccagtacttgggacctgatagaaaaatgtgattctcaatcctagctcatacaaagccaggtgggattctgtgatctagcagcagtggcagacttgggcattaaaggagcttggacaggggattgtaatgctgggtttggggcaacagaggggctcccacagccaaaactgagagatgagtgtggcatttgctccagctgtgggcattttaatagggctctctcccttcgtgggtggagcagaaggagatttgccagagaggcatggttttgtcccggtttcaagttatacagctcagtgtgactttgcagactaaaggtatactgcacatgactttactgagtgtctcaacttgctccctttattgggttggggagtgaaccctgccaggtctaaagaatgagaggagaaggctgggcatggtggctcatgcctgtaatcccagcactttgggaggctgaggtgggcaggtcacgaggtcagtagtttgagaccagcctggccaacatagtgaagccctgtctctactaaaaatacaaaaaaattagctgagcatggtggcaggctcctgtaatcccagctactcaggaggctaaggcaggagaattgcttgaacctgggaggcaggggttgcagtgagccaagatcacaacactgtatgccagcctgggtgacagtgtgagactccatctcaaaaaaaaaaaaaaagagtaaggagagaggtgggtcctatattcgtttgcctagattaaggactgggctgcctctgccttcctgtgccaacttgatacagcaataattgctctgtctcaggaataattgcttctccctcaggaatatctccaaggtgcctgcccgttgctcctgaattcccaccagagatggtgcttttacacaccattgcagggcctgagtgcagaatttccctgttgccctttccagttccacccaacttgacccccaccaccttcccacaatgctggaccacaggacccagatcattaagttgctccctggcctagctaattgcctgggacaatggattacttttctgattgaaaaagatcaagtataaaccctattgctatcaccacagagagatcttacctgcaagcaagaactattggcctgaagttcggcctacacaatccaatacaaaatttactggcagaagtgcatagcatttggaaacaagataagtttcacataacatttgctaccaccatcttccatgacacctcagcttctcaggaggacatgagtctgctcacccacctggtacaccactactacaaccaacatttgagaaagctaccaccctaaggctatttataaccaaggaaattccacagattctttgccgttgaacacacctagaagcaaagccaaatggctctactcagtatacatcatagacacattctcaagaaaaaaataaaagtcctgcccccaagaaaataaattcaaaaataagaagtgactgtttctccaaatgcaaataaattagtgtaataacataggaatatgaaaaagtaatgtgtaatgatacacataaagaaacacagtaattctctagcgacatgtcctaactaaaaagaaatactcaatattccagataaagagttcaaaatattgatttttaaagaagatcaatgagttgcaagagaaatctgaaaaccaatacaaagaaatcggagaatcaattcaggatataaatgagaaatttaccaaggagacagatatcttaaaaacaaacacacagaacttctggaaatgaaaagttcattgaaaggattacaaaatacaatggaaagtttcaacaatagatgagaccaaaaagaaaagagcattttggaacgtgaagacaggtcttttgaattaatcgagtcagacaaaagtgaaaaagaagaaaaagaaatgaagaaggcctttgagaagtacaggattacttctcaggttagcaagcttttctaacctgtggcccatgggctgcatgcggcccaggacagctttgaatgtggcccaacacaaattcgtaaactttctgaaaacattatgagattttttttcaattttttaaaactcatcagctattgttattgttaatgtattttatttatagctcctgacaattattcttcttccaatgtggcccagggaagccaaaagattggacacctctgacataaagtgactgaacttacatatcattggtattcacaagagagaagaaaaagcaaaaagtttagaaaacctatttaaggaagtaattgatgaaaacttcactaggctagcaatatatttagaaatctagatacaagaggaccaacaaacaccagaaaatatgcagcaagatggacttccaaactacatatactcattggaatgtctaaagtcaacacaaaggaaaaaaattctaaaatcagcaagagaaaagcatctagacacctataaaggaaactctatcagaccaagagcaactttccagcagaaaccttataaatcaaaaaagattggatcctattttcaaagtgcttaaagaaaaaactgccaaccccaaattttatatcttgccagaataagcttcataaatgaaaaagaaatagtttttctcagacaagcaaacactgaggaatttatcaccagctctactagaaatgctcaaatgagttctaaacatgggaaagaaaggttgatatttgccatcattaaaacacattaaaggataagattatcaggttttataacacaattacccaaaggaagaagagaaagaaatcaaatggtagcataacaggactccaccaaaccagaaagacaaacggaggggaaaaaaaagaatctacaaaacaactagataacaattaatattttgacagtcagaaaacctcacatacaaataataaccttgaatgtaaatggattaaattctccacttaaaagatatagattggcagaattgatattaataaaaccccaaaaccaactacatgctgcttactggtaaaaaaaaaagatattccatgcaaacagagagcagaggcaagcaggagtagctatacttatatcagataacacatacattaaatcagaaactgtaaaaaaaaagaaaaagtcattatataatgataaagggattaattcaataagagtatatatcagtcctaaatatatatgcaccaaacaccagaggacacagattcataaaacaaatattactagacctaaagaaagagatagcaacacaataagtgcaggatttcaacaccctacggacacactataaagattatagagacagaaaaacaacaaagaaacactggacttcaatgaaactttagaccaaatggacctaacatacatttatagaacattttactcaacaacctcaaaatatacatttttctcatcagcgcatgcagcattctccaagatagaccatatgttaggccacaaaacaagtctcaacaaattaaaaaaaatagtaactttatcaagtgtcttctctaactatagtaaaatgaaactagaagttaataccaagcagaactcttgaaactatagaaatacatagcaatttaaaaacatgctgctaaatgatctttgagtcaatgataaaattaaattaataatttttttgaaatgaaggaatatgaaaacacaacatatcaaaacctttgggatacagcaaaagcagtgctcagaggcaagttgatagggttaaatggctgcattaaaagaagaaagatcacaaaataacaacctcacatcacatttgaaggaactagaaaatcaagatcaaaccaaatccaaaggtggcagaagaaaggacaaagatcagatcagaaccaaatgcaattgagaccaagttaaaaaataacagaagatcaacaaaatggaaaatttgttttttgaaaagataaacaaaattgataaaccactagctagattaaccaagaaaagaagtgagaagatccaaataaatgtaatcagaaatgaaaacgaagacattacaactgttaccacagaaataaaaaagatcaccggagacaaccatgaacaaccacatgttcatgaattagaaaatctagagtaaatggctaaattcctgggaacatacaaatttccaagattgaactaggaataaataaaaatcctaaacagaccaataatgagtaatgagattgaatcagtaataaaaaataatctcccaacaaataaaagcccaggagaagatagtttgaaattctggttgctgaattttaccagttgtacaaagaaaaactgaaacccatcctccagaaactctttcaaaaaattgaggtggtgggaatctttcataattcattctattaggccagtatctccctgataccaaagaccagagaggacagcactaaaatagaaaagtatagacaaatatcccgagtgaacaaagatacaaaaatcctcaacaaaataatagctaatcatatccaagagcactccaaaaagataatacaccatgatcaagtggttcccccactgccagggataccaggattgttcagcatttgcaaatcaataaatatggttcatcacacaaacaaaattaaggacaaaaccatatgataatcttaataaatgcagaaagaagcatttgataatttccagcatcatttcgctataaacaccctcacaaactagtcatagaaggaacatatcttctataataataaagggcatatatgacaaatccatgaccaacatcgtactgatctgggaagagtttgaagcaatccctctaagaactagaacaagacaagaatgtgcactttggccaatcctattcaacttagaatggaagtcctagccagaacaatcagacgagaaagaattaaaaggcatccatgttggaaaaaaggaagtcaaattgtttctattcattgatgatcttatacttgattagaaaattctaaagattcctccaaaaactcttagaattgataaatgtatttagtaaagttttattatacaaaatcaatttacaaaaatctgtagcatttctctgcaccagtaatggttgagctaaaaatgaaatcaagaatgtaatctcatttacaatagctacagaagaaaaaatagttagtaatatatttaaccaaggagatgaaatatccctacaagggaaattacaaaatactgatgaaagaaattgtggatgacacaaacaaatggaaaaacatcccatgctcatggagtggaaaaattaatggtattaaaatgaccatatacccaaagcaatctacaggtttaatacaattcctatcaaaataccaatgtcattataaagaattataaagtataatcttaaaatttatatggaatcataaaagagcccaaatagctaaataaattctaagcaaaaagaataaaactggaggtactgcattacctaacctcacattttaccacaaggctatggcaacccaaacagcattgggaaaggacactcttcttttttcctttttctttgtcttttttttttttttttttttttgagacattgtctcgttcttgtcaccccggctagagtgcaatggccctattttggctcactgcaacctctgcttcccaggttcaagtgattctcctgccctagcctcctgagtagctgggattacaggcacccgccatgaccggttaatttttttgtatttttagtacagacaggatttcaccatgttggtcaggctggtctcgaactcctgacctcaggtgatccacctgcctcggcctcccaaagtgctgggattacagacatgagccacctcacccagccaggacactgttttcaataaatggtgctgggaaaattggatagccggatgcagaaggataaaactagactcctatctctcagcatatagaaaaatcaactcaagttggattaaagtcttaaatataagacctgatactattaaaatactagaaaaagacctaggaaaaatacttctggacattgatttacgcaaggaatttatgactaagacctcaatagcacaagtaataaaaacaaaaatagataagtgggacttaattaaactaaatagcttctgcccagcaaaggaaataattaacagagttaacagacaacttgcagaataggagaaagtatttgcaaactatgcatctgataggggactgatatccagaatttatagggaactcaaacaacaatcaaaagaaaaccattaaaaagtaggcaaataaatagatatttttcaaaagaagatatataaatggctaacaagcatagaaaagatgctcaacattactaatcatcagggaactgcaaattaaaaccacaatgatatgtcatctgacgtaagtcagaatatggccagttataaaatggaaaaaatataatagactttgtgaggatgcagagaatagtgaagaaacatttagacactgtttatgggaatgtaaattaatacaaccactatgaaaagctgtatggagacatctcaaagaactagaaatagaactaccattcaatccagcaatcccactactaggtatctacccaaaagaaaagaaattatcatataaaaaagacacctacacttgtatggttattgcagcactattcataataggacagatatgtaatcaacctaagtgtccatcagtgatgaataaataaagaaaataatgtacatattttctttatccaatggaatgctatggaatactattcagccataaagaatgaaattgtgtctcttgtagcaacatggatatgtaatactgtatacttatgataccatatcattaaaaggatatgatgtcattgtcttaagtgaattgcaggtcattatcttaggtgaaacaatgcagaaacagaaagtcaaatgctgtatggtctcacttataagtgagtgctaaaaaatgtatgcacacgtacatagtgtggaataatagacattggagcctgggaaaggtgggtgagtggaagcaggggtgagggacaagaaattacttaatgggtacaatgtacattattcaattactggttacgctgaaaggcccgacttcacctttacatgatatatccatgtaacaaaactgcacgtgtaactctttaatttatacaaataagaagagaaaatattgtaatcctgttagaaaaaaatgtaagaagttaatatttaaaaagcaaagggataaaagaatttaaagataccaattattctctttagttattgaacatttttcatccatatggagctcaatataatttagtttaatatttattaaatctaaaatgactgataaaagacacattgttcaggacagaaaacaatctgaactcactttactatagcaaattatcagttttaatgtgttccattaaataacgtagacataaaatatgtattaagggtcaacgttaatcatcttaatatatatgccaaggctgtctttataatcccggtactacttgctatctatataattttggacagttaacttaagcctggtctttggaactagttcatgtttcatttagttacaccatattccccagatattccttttattcttcatattacttagatgtcttttaattcctatatactcattaacttagatgactgagaactacactaagtaatgctcaaatttctagtcagatgtagccaaaagtacattgggcttgcagtcagaagccctgagtttcagtccaagctgttatttattaggtgtttaatgttaaatcatttaatcacatttttctacagcttcttcatccgtggtgtgtaggatgtaagtaggaataaattgggcaattaaaaacaatttctagcggttttcacatttaagagtgaggagaaatatgtgtggctaacggattgggtagagtgggatgatgcaaaagattagtcttgttttcctctgaaagcagttaaatttatttgttccccatatggcaagcaatggggatttgggggcagttagaaaaatgtgtaatactgtagacttatgatagcatgtcattatatctacacaattaacacaaataaaacttctgttaatataattgtatcattggattattttactcttatcattccattaaatttgtttcaatgtattgtccagtcaagtagctcatgagtttatttgagggttggaaatactgattttattgtattatattttatacttcatattacccacaccttataattgtatatatttaataaatcttgagaaattaaattatatgaattcactttctttaaaaatatgtagcttattaatagcaaatctttatcttaaataatgtttctttccaaataccatttaatttattttcaaataattctaaatttcttctcttttatgggaacatttgcattgggtgtcactagtggcactcctgtaataaatcttttagatatttttaatttccagtgttttaattctcagtatatgacatgtaatactacgcaaaaatgataaactcttttttttttttctttgagatggagtctcgctctgtcacccaggctggagtgcagtggcatgatctcggttcactgcaagctccgcctcctgggttcacgccattctcctgcctcagcctcccaagtagctgggattacaggcacccaccaccgcgcccggctaatgttttgtatttttagcagagacagggtttcaccgtggtctcgatttcctgacctcgtgatctgcccgtctcagccttccaaagtgctggcattacaggcatgagccactgtgcctggccaaaaatgagaaactcttagtctttaagcattgttatgaaaggtaagagatttagaatcacattgcccatgccttatctcttactaactttgggaccctgggaaaattaatttatctgaccttcaaggctcttatttataaaatcagcattataatatcccatttttgaaaataacttttaacgggttaaataatgaaacggcttcaaagcatttagtcaggtgcttagcacatggtaaacctttatgttgttactactaataaaatcctcctgcattttaaagtagtttcctaaaaaaatcttttgcctctaaattttgtaagctttttgttctcacttatttcaacacaaattcagccattataggggtgacttcaatgccctcacaaatgattcattaatacctcagtcttacagatgtttgacttattctgctacagtgacctttactttttaccccaatcccacaatcattcctcaatattatacttttttaaaaacatactcagagaaacatggatgtttgagctaaaaacaaaatgcaataaacttaatttactttggtatcaaagtgctctccctgcgtatttatattattcttcctgctctttctttcaatgagtaagcagaaagtataggtagttttcattagttaatacagtaaatagctctgtcgctcttaaactaggttcttttggttgcaagtggcagaaacccatctcaaaccaagtcaaaactcatttcagagtagcttagttttagctaaaagatggaaaattattgattaatgttacagagaggcccagtgctggttttggatttagggatggttgcatctgagaggttcaggcagtgttgcttactttgtctctctttagctctttatgtctccttttctgtctttgcctttcaatctaccttaacgttttggcttttttgcctgttatcttttatttttagacaagtactagaaggaagactcctggctatcttagccctatatttatagataccagaaaaagtggtaacctattattaatagctctgccaaatagtctagtaaaaactttgattggctctgcttaggtcatgtgccaatttttgaaatagacaacaatggccaggagtggggagtattctgataggccatgcctggttcatgtgttcaattcaaggcgtgaggatgtgagatttatttaaacctgtgatggcaagctagggcccactgcttatttttatataacaagttttatttgaacatagatatagccatttatttacatattgcctatggctgctttcacactaaaatggttacagtactgacaatgttacccacaaagcttaaaatatttgctgtctggttctttacagaagatgtttactactgttctaggtagagttcaaagatgatccccaataactcacgtccttatactgtgagcaaaaccttccccttgattgtgggcaaaacctgtaagtatgacgagatggtactcctgggattatgttactttatatgtaaaaggggatttttacagatgtaattagtacccccaatcaactgagttaatgaaaagaggctatcttgcataggtctaacctaatcagatgcatttttaaaaagagagtgtagaaattagaaatggaggcagtcagagagactgtctcctaatggcctgtaagaaggtaaacatttatattgttaactttctgtggcgccatgtgacaagggactgtgggtaactacagggagctgattgttccctggatgatagctggcaagaaaactggaacctcagtcatcacagctgcaagaaaattaatttggctaaccttggatgaagactcggagactcagatgagaattgcaacctggttaacaccttgatttcagcctggggagatcatgaatagagaatccagtcaattcctactcacactcctgacccatggtaactgtgagatgataaatttgtgttattttaaaccaataattttgtgataatttgttactcagtaacataaaattgacatagactgttgtacctgaagttggaatgcttctgtaaatatcttaaaaaggggagcggctttggaaccaggcagtctgtggaggctttggatttttaagaagtatgataaagaatatctaaattgccttaaacagaccattagtagagataaggatgttgagaatactcatggtcaggacttagaaagaagtaaggaaattgttatttaaaactggaagaaggggaactatcattatgttgtggcagaaagcttaatggaattatgtcctgcagttaagtggaaagcagaacttgtaaatgatgaacctggatgaaaggaaatttctaagtatactgttcaaggtgtggtctgttttcttcttcctgcttatggtaaaaatgaaagaggagtaagataattaagggaagaactgttcaacaaaaaggaatgaagtctgcatggttttgaaaatcctaagcctctccagatgatgaaagatgctaaaagttagaaatggctatgaaaattatgacattggttaaagaaattgtagataaactcagaattaataagtgaatttagcaaagttactggatactaaataaataaacaaaatccaattatacacttagatttatgccacagaaattaggaaacttgaaaaacaaaatgccatttacaattacaaaaaactctatgataatttatctaataaaaagtatacaatacctctttagaaaagtgtatacatttttgtttagaggacataaaattttataaataaatggagaaatccaccataatcaggagttggaaactctgatactgcgtagctgtcaattttgctaggctaatccatatatctatataatctgaactgaaattcctgcagttttgtgtgtgtgtgtgttgttagcaagcttgccctacaatttaattccatgggccatgaataagcaatatcaactcaaagaagcacaagttgggaggcattttctctatccgatatcacttattttaagaccagaataatacaggaaaatagacaatgtaggctgggtgcagtggctcatgcctgtaatcccagcactttgggaggctgaggcaggcagatcacgaggtcaggagattgagaccatcctggctaacacagtgaaacctagtctctactaaaaaaaaaatacaaaaaatttagctgggcgtggcggcgggcgcctgtagtcccagctactctggaggctgaggcaggagaatggtgtgaacccaggaggctgaacttgcagtgagccaagattgcgccactgtgctccagcttgggtgacagagcgagactccatctcaaaacaacaacaacaacaacaacaacaacaaatagtcaatgtaacagaataagaagatgagaaagagatccatgcatacatggtttattcatgagaagtgtggtactactgagtagtgataaaataacagtacttttaataaatgatttaaataaatatgcaatcatttggttatatgtaaaaaatgaaactttatccttaccttacaccatatacaaagaataattacaggtttattgcatatctaaacatgaaaggtatattaatatattcttgaataagaaaggatttcctaagcagataatcaaaagcattaaccaaagagcaaaggtaaatgaattaggttgcattataacttagaaattaattccatcaaatgacacaactaagagaaggaaaagttaagccccagcataggagaagctatttgcaacacatctaactggagctaaatttttatagaattttcatgtattataggtggatgaataaattggcataattagtttggaaaactgccttacctactaaatttggaaatatgcatacattataatacagcaattccacttctggatacctgcatacaagaaatatgggcccatgagtagcaaaaataaaacaaaactaagccatacatataagcacattcaacataagcaactttatttgaaatagatacacattggtaacaccccagatgtcctatcagtggtagaataatctattaatttacaatgatatgttatccatctatgaaaatgtagaaagcactgtaatatggagcaaaatgaatgtcttctatacgcatagtatggaatgaaggcagctagaaacaacatatctacatatgcagatctatatatttcaaaaatggaaaacaaaatctatggtttcgtatttaggattcccaaagacaagaggtaaaggggtagtgacaaaatggaatcaggagttggacttacaaagtatcagtaatgttctattttttgacctgggtggtaattaaacagatgtatttatttttgtaaaaatgaattgagctgcacacatagatttgtgcacttttttctgtttgttagaattcaataaaatgttgaatttacaaagcaaaagacattgggaagaaataaaattacttttgtttgaagacgacatgattacttatgtagaagatccaaaataatttgccaaaaacctcctggaattagtaagccattatagcaagttacagtacaaagttaatatacaaaagtcaaccactttcctatattccagcagtgaacaagtggaatttgaaattaaaaacacggccggggtggtggctctcatctgtaatcccagcactttgggaggctgagacaggtggatcacttcaagtcaagagctcaagaccagcctggccaacatggcaaaaccccatctctactaaaaatatttttaaaaagttagccgtagtggcacatgcctataatcccagctactcgggaggttgaggcaggagaatctcttgaacctgggaggcggatgttgcagtgagccgagatcgccccactgcactccagcttgggcgacaaagtgagactccgtctcaaaaaacaaacaaaccgaaaccactatatcatttagattggcacccccaaacatgaaatacttaggtctaaatctaataaaatatgcaccagatctgtatgagaaactctgatgaaagaaatcaaagaactaaataaatggagatttatttcgtgttcataattagcaagactcaatattgtcaagatgttagttctttccaacttgaccagtagattgattgcattgccaatcaaaatcccagcaagttattttgtggatatcaacaaactgattataaagtttatatgggtattcaaaagacagaacagccaacacagtatgaaggagaacaaagttgcaagactgtgacactacctgacttcaagacttactataaaattacagtaattaagacagtgtggtactggcaaaagaatagacaaatagatcactggaacagaatagagtggccaacaaatacagccacacaaatatagtcaattgatatttgacaaaggagaaaaagcaatagaaagtagaaaagatagtattttcaagaaaggctgctggaacaattggacactcgtaaaaaaataaatctagacacaaggcttatatctttataaaaatgagctcaaaatggatcacagacttaaatgaaattactaaactatgaaactcctagaatataacagaaaatctagattaccttggatttggtggatatagcaccaaagacaggatccatgaacgaaagaatcgataattaattttaattgattaaaattaaaatattcttctctgccaaagacattgtcaaaagaatgaaaagataagccaaagactgagataaaacatttgcaggagacatatctgataaaggaccattatacaaaaatatacaaatgacttcagaagttgtatatatttaaggtgtaaaacatactgttttgatatatattatgcatagtaaaatgattactacagtaaagaattttaatctgtccagcaccttccatagttacctttatattttgtggtgagagtacctaatatctactttcttagcaaatttttagtatgcaatattattgattatagtccttatgatttacattagatctgtagattaattcatcctatatgtttgagccctttgacctacttctgtccattttctttccctccttgtcactagtaaccaccattgtattctctgtttctgttttcaacttttctttagattctacatataagtgatatcatacttatgtatgatgttgtaattctgtgtctggcttatttcagttagtgtagtgtccttcaaattcatccatgttgtcataaatgactgatctttttttagggctgaataatattccattgtatatgtattccacaatttctttattcattaatctgtcagtagacacctatgttgtttccatatctttgttattgtgaataatgctgaaatgaatatgggagcacagatatctttatgaggtgctgatttcattacctttgggcatatacccagcagaaggattgctgggtcatatggtttgttctacttcacttgttttagtttatttatttttagataatagctatcatgagaagtgtgaagcaatgtctcagtgctttaggtgggagcatgaaagttgtggtgcttgatgcatgcacaagtgtttccagggagattttgcagacctggatttaccactggagcaagctggaggagaggtgtgggaagtactctcactccaattcaggctcctgtaggtcgattgtttatctgcctttttctattaggctatttaaaagcctaatagaaaaagtgtgcagatttccaaggagaaactgggaactggacacttcagcctattctctgcactgattgttggaggaggagtgtgaatagatccccctggaagtacacgtgcatccatttaaaatcacctctttgttctgtagcctagggagacacaaacgctgaatcattttctgttttcagagtcaggtgaattaagggctcaactctgtgggaggaactgtaaaccttggggctctgtaagtgtatttcacaaccttttcttgtcaaagagaagttgagagttagaggttctctcctgattataaaaaactggtcctggggtggagtttgtggcatatgtgtgtctcagcttttccttccttttttgatgcagatattttatcagtttcccagtttttaggggtttatcaactagttttgagatttgtcctagagggaattgacctataaataactgtttacttagtacatccataagaggagggaaagtcaagaatttcctattctgccatcttgctgatatttcaagaacatctttctgaagttcttaaaatacaacaataagaaaacaaacttttatattttgatagggattgcattaaattttgggtagtatgggcattttaacaatgttgattcatctaatccatggacatgagatatctttccattttttgttccctcttttatttctttcatcaatatgttagagtttttattgtagcaattttttaaaaaatagagaatatttttcataggaaaagaaaaaaaattctaaaatttatatgaaaccacaaaatacccagaatagacagaataatgctgatcaaaaagaacaaagctgtagtcatcatactacctggcttcaaaatatactacaacactatagtaacccaaacagtatggtactggcataaaaatagacatatagactaatattagaaacaaaagacaaaattcagaaataaatccactcatttacagtcaactcctttttgataaaggcaccaagaacatatattggagaagggaaatccttgtcaataaatgatgctgggaaaactgaatatccatatgcagaagaatgaaaccggacccctgtctctcaccatatataaaaatcaaattaaggacaggcacagtaatatcactaaaacacaggtgaccaaagcaaaaatggacaaatggaatcacaccaaactaaaaatcttctgcgcaacaatgagaacaaccaaacaaaatgaagagacaacctacagaacggaagaaaatacttgcaaacgattcaactgacaagagattaataaccagagtatataaggaattcaaaaagttcaatagaaaaaacctcaagtaatctgattagaaaatggacaaagatcaaaagaagacatatcaatgaccaacagatatagctgggcgtggcggctcatgcctgtgatcccagcactttgggatgctgaggcaagtggatcacctgaggtcaggagatcgagaccagcctggccaacatggtgaaactctctctactaaaaatacaaaaaaattagctgggcgtagtggtgggctcctgtaatcccagctactttggaggctgaggcaggagggagaatagcttgaacccgagaggtggaggttgcggtgagccaaaaacatgccattgcactccagcctgggcgacaagagtgaaactccgtctcaaaaaaaatgaccaacagatatgtgaaaaaatgctcaacatcactaatcatcagatgaatgcaaatctaaactacaataagataccatctcacctcagctaaaatggcttttatattatcaaaaagacaaaaataagtgctggcaaggaggcagagaaactggaatgcttgtacactgttggtggaatgtaaattaacacagctactatgtgaaacagtatagaggttcctcaaaaaaccctgagggaccagagaaccaagctgcagacctggttccagccccttagggttagaacacacagcccaggagtgctcagctgaggcttggaccgctgaaaccatccagaaatgaagccaatcaactaaatccaacttacaacatagtcaaaccctaaagagcatcaaagaatataaaagcagaaaggccgattccaaagacagagactccaaaggttaaaggaacatcagcccacacagatacataagaaacagtgcaagaactctggcaactcttaaagccagagtatattcttaccttgaaataactgcactagctcctcagcgatggttcataaccagactgaaatggctgaaatgacagacattggttcagaatctggttggcaaggaagctcatcaagataaagaagaaggttgaaacccaatccaagcaaaatagtaaaatgattgaagagtttaaagatggcatagccattttaagaaagagccaaactgaacttcaggaaatgaaaaagtcactacaggaattttggaatgcagttcaagcattaataacagaatagacaaagctgagaaagaatctcagagctctaatacggctcctttgaataaacataggcagacaaaataaagtaaaaagaattttaaaaatgaacaataggttttatttaataattctcctccttatactttctgtctcaccagtttcccctcaaactgatttacctactacacaaaattattcttatcgggcttatgtgccttttcctccacttatttgacctctcacctggatggatgctcctgcggaaatctatactaacgatagtgtgtggatgcctggagctacagatgactgttgccccgctcaaccaggagaggaaggcactgcatttaatgttactatgggttataaataccctctgtgcctcagacatgcacctggttgtatccatctagaaactcaagtctgggctgcttgccttccagagagatcagccacaggggaatggggacatttggtctccggcctctccctttctcctttaagacaaatgaaagggggagtaatgagagataccccatactttcaatataaacctgtaggaaaatcatgtcctaaaaattttgagggcccatctaaaactttaatttgggaagattgtgttaactcacatgtagtagtattaaaaaatgcctcatatggtttagtaatagactgggcaccaaagggctattttaaaaaacaattgctcctctggtggaagggaatgcctggaggctacttattttatttctcattgggaggacaaggatcatcatcctactttgcataggaggttcagctcattttttcccttaaaatgggaagataagggcattacccccacaaggcctcatatgatattccccattctgagcccagaacacccagaacttcggaaactggctatcgccatgtccagactgcaagtatgggaaggggaaacttttctgtctgttatccccagtactgcccctcacatccatgattctgaaccccatgataaatcccctttgagcccttttcctctttttgatgcctatcctcctttatgggactccaattggcattatgataattcttctcaatccaggtatgccccctacctcttcagcatccctaggcccctcggattgcttctttatggtggagaacatcgggcgttcccaccgccactcctctccctcagtatcaatgtagattcaaacattctgctttgtttacctccagcctgactattcctatacagagttgtgttaagcctcctttgtgctgttagtaggaaatagcaaactttggacgaataatcaaactgtccaatgcattaattgccatttatacacttgtgttaactcctgttttgcttcaggaaaagtataatgttggttcgagctcaagaaggaatctggataccagtaactttacccagaccttgggaatcttccccctcagtacatttaattaatgaagtgttaaaacaaattctcaaaagatctaagagatttgttgttactttaattgctgtgatcatgggcctaattacagtcacggcactggccaccactgccggagtggcattacaccaatctgttcaaatggcttattttgttaatgattgccaggccaattccacccaaatgtggaattctcaacagggaatttatcaaaaattagctaatcaaattaatgatttaagacagtctgttatttggcttggagatcggctaatgagtctcgaacatcgcatgcaaatgcagtgcaattggaatacttctgatttctctatcacaccatattcctacaacgagactaatcattcatgagaaatggtcaaaggacacttgctgggaagggaagataatttatccttggagataactaaattaaagaaacaaatttttgaagcctctcaagctcatttatccattgtgcctggagctgatgcattagatcaggtggaagaaagtctttctggactaaaccccacgatttggattaagtctattgggggccccactgtagtaaattttggaatcatgtttctctgtttaatcagcttgtttttagtgtgccgtaccagttaaagaatcctgcatcaaaactgagagaatgaacaagccttcatccccatggcatatttatataaaaagaaagggagaaatgttgcaggaagtcagggacccaaatggagggacgggctggagccatggcagaggaacataaattgtgaagatttcattttaatatggacatttatcagttcccaaataatacctttataatttcttatgcatgcctttaatttttaatcatgttatcttcataagctgaggatgtacatcacctcaggaccactgtaataattatgttaactgtacaaattgattgtaaaacatgtgagtttgaacaatatgaaatcagtgcaccttgaaaaagaacagaataacagagatttttatggaacaagggaagacaaccataaggtctgactgccagtggggtcgggcaaaaagggccatatttttcttcttgcagagagcctataaacagttgtgcaagtaggagagatatcatcaaattcttttcctagcaaggaataataatattaataccctgggaaacgaatgtgttcctggggggaggtctataaatggccgctctgggaatgtgtgtcttgtgcagttgagataaggactgaaatactccctggtctcctgcagaaccctcaggcttactagggtggggaaaaactctgccctggtaaatttgtggtcagaccggttctctgctcttgaaccctgttttctgttgtttaagatgtttatcaagacaatacatgcaccactgaatatagacccttatcaatggctctgctttttccctttgtcctgttccctcagaagcatgtgatctttgttagacccttattggtagttctgctttttgctctttgaagcatgtgatctttgtacctaccctctgttcttacaccccctccccttttgaaacccttaataaaaacttgctggtctgagactcaggcaggcatcatggtcctaccgatatgtgatgtcacccctcgcggcccagatgtaaaattcctctctttatactgtctctctttatttctcagctggctgacacttatggaaaatagaaagaacctaccttgaaatatcaggggtgagttcccccaatagataggagggtgaagattgaaaaactacctattaggtactaggtgcaatatctaggtaatgacatcatttgtacaccaaaccttagcaatgcacagtttactcatgggagatacctgcacatacaccctgtgaacctaaaataaggttgaaaaataaaaataaaatagataaaataaaatgtaaattaaaataaaatttgaatacagttttatttttagtagaatttctacatgtagtttccagagttaataatttataatgaatgtctacccatgtgattattttattttccaccaacatatatttttaaatatattctcttttatagccctttccatacttagtctttttatgattaaaaagaaactgtcaggccagacatggtggctcacacctgtaatcccagcactttggtaggccaaggcaggtggatcaccaggggtcaggagtttgagaccagcctgggcaacatggtgaaacactgtctgtactaaaaatacaaaattaggcaggcatggtggtgcatgcctgtaatcccagctacttggaaggctgaggcaggagaattgcttgaagctgggaggcagaggttgcagtgagccaagattgtgccactgcactccagcctgggcgacagagccagactctgtctcaaaacaacaaaaacgaaaaaaagaacaagaaaagaaactgtttattgacatttgcttctgttactcaattctagttgtaatcaatgcctaagctttgattatatcttcgtttaacttggctatattgcgtatcatttattttgggagacagtagcctcctatcttagctctttaggtgtgcacatattcatctttacatataaagggatttgagatatttctgtgatttcataaagtttttatgaagttatcttctttaaatttacttttactttacactaattgaatgtgcattattttggctgatctattttttggaagtataataaattgctttatgtatacttcagtggctttagattttttatttatgatttttagcattatgtgtttgccttagagtttatgtgcacaaaactattatatatttgttcacattaaatacaatttatgtatgttttaatcaatattcacctgcatgtagcttgctctgaaagaactagaatgctttcattttccatacatataatttttttctatatctctggagaataatgttctgcatatttttgaaatatataggtaggactatgctttgtgaaagagtctattaaagtttaccacatttgatgagttttgttttggaattaattaaaacctgaagcaaaattgatctgacatataattatgtgtataattattatggttactgtgtcatatagtaattaggcataatatgaattttatttggttttactgcttttatgtaacatatccatcattgttttagtcagctgggaaagaactataggtaaacaattatccacattgtgaagcactttcatgagtattatctcattatgtatataaataggttatgatatttatttcatttcaggatagtaaaggggcatttcaaaaacaaaaaacaacatttttttaaatgagaaaaagatcctttaattccaatagggttagaaacaagtacgttatcctcttttcctaggtaatttatcccatgcccacaggttcagttaccatctctatattaattctcaaatattcagaacagatctttcttttgaaatccaggtatgttcagccaacttcttaattgaacctccaccttggatgtctcaaaggcatctcagattcaacatattcatacatgaactcatagtatctcccatctctactaaaaggcctcattgcctggggtaaatgcccaggttttggtctcatggccaaggaaatcaaagactcagacgcacacacgcatagtgaaattggagcaaaagtttaataggcaaaagaaaagaacagctctctgtcacagagaggggtcccaaatgggttgctgagtggtagtaaaaatgtcagggtttatataaatgggctagtgaggagggtgtgtcttatctccgtggggcctgaagaactggttaggaccgggtgtgccgtatgttgagggcagagcctctagtagtccccaccccttgtgcaggccgactcttagtttgtgctgctctgcgctgcttatctgagcatgctaaaagggagggagagtttctgtgcctgttccaggcactttcttgcagctgcaggtgtccctgactcgccccataccccgacccccaccccatctcaccccactccctccctccactcccgcgcttccagctcagcttccctatctttgtgtgcttaaagaaagggagatgaatgtgcttattatggcacactgtttttactggggcctattgtttgtatgtgaagtttggtgattacccaggacacttccagctctgtgcccaagttgcttgtctgtgtttttcagcctgatcttccaggctgctctttgttagaagagaggtgatttctttgaactgcgtgaggttagaatgggagcaatttctgagctgctttttgttagaaagaaagttttctgccagggactctctttaccctaactacctaaatgatttctttctatctcctgtaacactaccttggtacgtatttcagtgattgtcatcatcacccatcctgttaggcaaaccagaaaactcaaagccatccttgttgctcctctacatccctcactctatatccaatttatcatcagattctttatttttcttttctcaactctctaatatattatatccatgctttgccatttctactgctggaactaaccctagtcaaatcacattcctcctttgttgggagtattacaataatattctctacaaggtatacccactcaggaaacagagtgatctaattaaaatataactatttttatgtcagatcttttagtgacttcccattgttgttgagatgaggacaataattattaacaaggtgaacagggactgggatgttctggcccctgccattgcttactgaatcttgcaacaaacccccttgtctctttttttcaggtgctgaaatgcatcatggcctctcctgaggctgggcctttgcatatgccctaacacaacttaaaatcacctgtctttgaaagatgggctattgtatcagctagactaataaaaattattctccacataatcatgtttcttattattaattaacaaacatgaaaaagataccatgtaaaatattagaattcagttttcttttgaagagatctttttgaattaacagcttttaaggctattagttcctatgcattcttcagatatcagttcaagcctcattttcttagggaagtttttcctctgttcactctaggccaggttatgttttattccctatctcatagaacctagactcttgtttccttttttcttagaacattgcctcagtttatggttcttgtattgtaataatacacttatcaatatcattcttgatcaatatttatttcttccatttcaagctctgagaggtctgatactctgtctctttttgtccattgttttttctctaacctctcatagtgtctggttcataatgataaataattttcaagtcaatgaatataaagtggtagtaagtgagagagctgggatttgaaatcagagctgactctaaaactactattctgcagtgacagtatatttttaacatgtgcattataacaataaattacactggatgttcagcacttgtcttggatatattcaaaagcaaaacatgagtcttagcttttccagtttaagcagtttaattatattttcataatttataacattaataaaatggggaattgtggtaaaagagattctgaggtgcatataaaaatgtttgcaggatgaaccacttaagtaagggagacccagtggacatctgccagtgggagctggctgtgaaaggcaacaaggtagaatgaagcccagtttctgtacttgagggacccaggcaccaggcagtgagtgtggcactgatggcccaccttggtctctcctggcccagcctcaaaatagagtagaaaaagggagtcgatgacaatgaattggttctatggaagaagacagcatatgaagggaaacttcattggaatcacataggtagatttttttatgttgttggctgttgtgtccaaaaacattgcagaggaaagattcaatattaaaaagcaaattggttcattgctgagagaatgtaaaatttattctcattctctttccatctattcctcttttcttcccttcctttatctattactctctttcttcctccccttctccatgactcgctataacctctgattcttcagtatgaaagtagtgtacatggacagaaatccctaatatacttgtttttaatagcaaacggggaacatgtaaccacaactctccagcgaaattgagatcatggccacataatctacagctttttctctcttctctatgtagattataatagttttatttaatagaaaacaaaaaaattatgtattaatttcaatttaaaaattttcttgatgttagcaaactatggatcatatcttaagaaagcagtgtatatttcttacccaaattctaacactaaaatattttaaaatattatttatttcctttggtttttaatccatatatttgtgtgttagtctataggataataacaagattatattttctctatatctctcttgccatttgtaactttgtgatttttacatatttaaaagacagttaataggattgaagttgaaactgtatttctattccagatgttgatgtcttcagaattgctttggaaattgtcagatttccaaattaatatcatagattgacttcttcatctctattcttaatcaaaattttccaagaagtaaagatatttggtcaccgggaagaaaattataatgcttagcagtgactttctaagcagcctgaggtgtcttattaaccagagtctgctcaggcctcaagatctgttgctgcccacatgtagggcagtttttctcataagcctaactaagggctgagctcttcttttacagtcattctataatgcacacccaaagctaaaaaaggagtggtcagtttacgttattgtcttattagaatgcatgaaattttgtaatacaagcacaaatgtatgtattctttccatctgttagacacacaccccttttagagttttaaactgtatctttttatattctatatcctatagttttgtttgattctgtgttataaacttccagagtcattctaaagatcttgaaataatctagagttcattctaatatagtggaaaaattattttaatgtcttatcttttgaaatacagatttcaaaactacctagttagcaaatgctggataatgaaatttgttcagagtttgactttttattcattttcttatcccactaacaagagcaccttgaagttctctcatcattaatgagatttcttaaaatatgtgattctgaagttttacctgaggaaaaagaaaaattcacatgtacttttgtgatggagtagcttaacttcaaaattcattttgaaacaatttttcctttcttggttttagccttgaaacatactttacaactctgtttacctccctccccaccaaacatccccttgtactggtagcttatctagttatatccttacttagaagttccaggggctaatcttgaaacaagccaggcatggacacccgaaattccagagattacctcaaggcggtttgtcaacaatctggctattgttgagatgatgtcagcctatgctccaggtcagcagtccccagacttttcggcaccagggactggtttcatggaagacaattttttcatggatgagggcaggggtttagtttggggccaaaactgttccacctcagatcatcaggcattagaatcttataaggagcttgcaacctagatccctcacatgcacagttcacaatagggtttgcgctcctgtgataatataatgcccctgctaatttgacaggagtcaaagctcaagtggtaatgctcccctgcccatggctcacctcctgttgtgtggcctggttccagtctgccactggagggttggcgacccctgctccaggtggaccatgactcaagatagtcaccagaacaggacacacagaccttgtatccagcaccactcctgcatgccttccattccaggttgcccttttaaaacccttctccccagtctaaagttttgaatggttttttaagggaataagcttgtccattccccaactgctagaatttgagtgaagttgcctgcctttcgccacaccttgcctctcatgttttctggctctcagcagtgagcagccagacttggcgtgtggttacacttttgtgcgtaaggtattttaaaatgttctatattatgttattatttatcatattgttattaagttttttcatgtctcccattgctagctgtgcttttagaagaatttgtatgctgtaattacatactttcttaattatgcttttcttgcatattcaaatgctcccaaaagtctttatctttcacttcatttttgatttacaaactgaggaatgcaaatacttccttgtatgtactttaatcccaaactctattaagaaaggcttattcagtgtgtgtggctagggaaacagtttcaatggctaacaagtgaatatagcagaaggaagaagcatatgtatgtctgacataattttttgatgttttgaaaagttatcattcccttggttgtttccccaccattcttcaatgttccttaatagattttcatttgagtttattttctcttaggtattttgtaatttattttttatttcttaaataattttgtcttttgctttcattttttttcctgagttgtcggctctttttatttcttttctctttcctcctcttctgcctttaatgttcaatttatcagtcaaggatctgtttctccaaattcttctttgagtgtatgtaactcagttttgaattgtgacttacagttttcttctgcttcatgaatattttgtgagggaatttttgtcagttcagatgtaattaattgttttattttaatttttggaacaactctctatggattaatattttttcttctgcttattttggttgatttggtattgtttctaacattcctaattaattaatgccttcttgtatcttataacaaagctggtttttttagtggatttttttgagttatgtgtccttcatttttttttttaaatgttgtgtaggatcctaaatgttcgcattgcattttttccctttcattattcatctgccaaagagcatagctacttttcttttggccttttctcccagaaatcatgccttatgaagtcctccacttaacgttgcatgtttttctaatttccttccctgcaatcctgtctaccaggaaattgtttccctatttgactatttaggatggacttactctttctgttgatggttatgctttgctagcattcctcttttccaagcatttttttctcaggttgctcttcctctatgaaggtttagagtagggtggagacatgagagattgtttactggaatttggcaatttctgtctatgtacttcagttacttgtaaatttgagcagactgttctgaagttctaattttcgtggtttcttgtacttcacactttgttcggtattatttttaaaggacatatattgagatgccattataggcatacttgttcttttaaacgtttgaggtttatagtttgaggcaacatgcaaaaacttttgaattgttatatctaccctgtggcttttaacatcatgggtgtcccttttcttttttttaaaacccttgtattaaaatctttgtgtattattcaagccagaccagatttatttttggtgtctgcatggcatatacttttcttcactttgctttcactatttttaatctacatattttacttttgtattttgaacacagcatatgcttaaattttacttttaatttctgtctgacagcatacttattttgattagaacatttagtatacttacattcaatgtaattagatgacatattgggataaattttactacatactttctttttattattccctcttcttttattttttttttccttccttggcctttttgactaatttattactttcttattctatttttcctctagttttaataataacttgttaatatttagtggacatattacagatgactgcttgagttttttactcatcacattctaatataaactagtacttttacttcttcccaggatctttgaactttatttattccctttccttttttgctattctactattgccacattttcatttgtatagattttttattctgtaagactccattattattgttaacacaattaattttcttttagatatactcacatatttacctatgccatttatcatcattacttcatatatccctgagcttgcatctgagatcatttgccttctaaatgatgaagattaaaaaaaaatccttggctgggtgcagtggctcatgcctgtagtcacaggactttggtaggtcgaggcaggcagatcaagaggtcaggagtttgagaccagcctggccaacatagtgaaaccccatctctactaaaaattaaaaaaaaaaaagtagctgggcgtggtggtgactgcctataatcccagctactagggaggctgaggcaggagaatcgcttgaatccaggaggcggacgtggcagtgagctgagatcgcgccgctgcactccagcgtgggcaacagagtaagactcagtctaaaaaaataaataaataaaaattcctaaatgtaagcctattcacaacacattatttcattttgtttaaaaatgcccttatcttcatttttgaaatatattttcactgtgtacacagttgtatattggtaaatattttctttcagcactttgaagatactgttccatcatcttctggctctccttattctattgagaagttgtctgtcatttttactgttctccctttgaatacaatatatctatatttccctctggctacatttaaaatttcccctttatctgtaataatcagtaattacgttttaatatacataaatatgtttttctttttatttatattacatgtagtttaccatgttttttgaatttatgtgttgatgtcatttatcagttgggaaaattctcagccattatctcctaaaatattgcttgcttcttcgtcattttctctcttttccaacctgggagtccaatttacatttttgaagaatttctcccctttttttactttgtaccttatattcttttctatatcttttagcttcttcctatgccagccagttgctttctttggattagtcttccagttcacaaattaaaggttgtgactgagttcttcattttctgcattcttgttggtgagtttctaatgtccatcatttctcctgggtttggtcatacagtcttacgtttcatatgcctattgttgttgttgttgtttggttttatttttttctttttgggtgcaagacattattttcctaagaaatagagggctaacttaaggctcaagagtgattttatcttcttccaaagaaatcttttactgacatcttgcaggcaactgtgctagaagcactattaattccatgtcaccttaatccaatgggtgattgagatgattcaaagtttcactttagtacctgtaggtcaagtctatttctaggaatgaggatcattcttattccttgtatgtagccctcagagtctcaatccaaaccatggggtgatcactggaacccatttcttggaaggtcttcagcttcagttgtagtccttgtttcaatttctttgctttctccatcagaattgtctggcagcagccaaagattcagaagaaaatgaactctaagtgcaaggctcatctgcatgcatgtcgctattctcttggattgtgaatctattattcttcattacattgttacattatccaatgctttcaaacacatttatttttgttcatattttgaccatatttgctacttgcttttaaatggagtgttattccacataaccttgttcatcattactgaaaatctccacagctttaaggaaaaatatttataagtttacatttctgtaattgtgtgtagattttacccccactgaataatttcaaacagtatattattgttgaaaaatcgaatatatgttctagaatcatattcttggccagagatttcagtccctccactgtatgtgaaagtcaagttgttttatctggtcttcctgtttcttcatggtcttctgccactcacctttgcagactttccattcctgtctacatctactatctgtttatttattttcacttgcatttacattttttttcttccatactctgtctgtaaagatacctgcagtaccaggatttgattttccccgagtccaaattattttttagattattgcatgttgtttgttaccatcttctccaaatataataccattctctgtgtgcaacactgtgaaccccttgagcttgtaattagttgatctatatccatagaacaagtgtaatgccactgtatcaagatatatccataccagggcctctacccctttctagttgtttccctctgctgaaaattacatggctgtaaataaatgtgctttacttcttttcatgtgcttgctaatgttgcagggaacctcaatcaggaataaaacagaatcacgtggcaaagagattaagctaattttgaccataagaaaaatgtttgcaataatttaaacaaggttatcttgaattgtcactctttaatctttgattttgttatgaatgcatagtaaatttgatatacatgtgcatggctagaagtcaaaagatagaacttaaatcagactctttgaaaggtattactaaaatataaatgtgttatggcttaaagtcatagttacataatgctacggttggtcatagtaaatcagtaaatgtattttttagagccactaaatctttcacactcattatcattctatagtgcaaaaatgaataatgttttcagcaagtctcttatagtacataccacctagtgactgaattagggaaataacattcctaagtaagttcctgtataaacatgaatatacatatttatacatgaatataaaaaatataaattataattttactttcatgccatttctacctcagaagaataggttgaatctgttccacgaatgaaacataaacaggacattcacttgtggtagagccatttgttcactaaatacacatttatacagtgactattatggataaggtattatgctagagagagaaaaatgaataatatgccatccttgtttgctagtagctcataggtgaatggaaggactatgcaatgacacaattgcaatgttctgtaataaatgcagttctacattattaacagaggcaacaaaaaggaagaggtaatatggcatggcttagtatagggtgttatatttattggagcagtataagataatgttagagagataggcttgagttatccctatggatgatcttatagagtaatcttaggaatttaaactttatccagtggatagcggagtgccattcgatggtaatacatagatgaatgatgtgcaagtatgtatgtcttttagtaatgttattttgtctgagaaatttgttaagcagggagacatattagaggctgcagcaacatcttgtgaaaacaatgaaacttataataagaaagaagtaagtgaatagagaatgagcaatggatttttaatatgtgatttgagaaagcttaaaataattagaataatggcacatttcaggttggcaagtgccattaatcaaaatcatgaaagcaagaagaggaactgacttaagtgaaagttaaaaaaaatgtttagtgttaggcagtggaacatccaggtagaattagatgaagccagcaaagatataataggataagccctaggcatggacaaaaatgctataggaatagatgaggaatgagaaaagatacagatggttatggactcaggagaagctcaatgtttcagggacatggatgtatgtgtatgtgtatgtgtgtgtgtatgtgtatgtgtatgtatgtgtagtattctgcttactaaactaaatacagtgacaatgcctggacaggccagggaaattgttggttaacattagattatcagtcataaatgagatgttgaaaaaaatgttaaaaacattgtattctgattatgacttaaagtgttgatggtgacacattaacagcaaataaataagaggcaaggcattgtgtagtacaatttttaagagattgacttgttatcttaccccatgctgtcaaagaccacttctacagaattgcttgacttttggagtgaaaatagggaattcctacagtcaaaggcaatattttacattaaacagagcccacataactatgcagacagtatatggagttaatttcagctggacactattatattcagtctttacaaattgatgcctcagccataaaagcacctcagtgcaatctctagaaattggatggcttcccattgtaagcctttttgaggtgttggacacaaaataagtttttgattgtatttggaggagatcacatgttagttgggggtttgatatgactagactgtgtccctacccaaatctcatcccgaattataaaccccataatccccacattttgagggtggatcaggtggagataattgaatagtgggggtggttttccccatgctgttctcttaatagtgagtctcacgagatctgatggtttaataagcatctgacatttcccctgcatgcattcagtgtgtcctgctgccctgtgaagaaggtgcctgtttctcctttgccttctgccatgattgtaagtttcctgaggcctgcctagtgatgtgaaactgtgagtcaattaaacctctttcctttataaataacccagtctcgggtatttcttcatagcaatgtgagaatggactaatggactaatacagtaaatcggtaccacagagagtgggtgctgctatcaagataccccaaaatgtggaagctactttggaactgggtaataggcaaaggttgaaacagtttggagggctcagaagaagacacaaagatttgggaaagtttggaacttgctagagatttattgaatggctttgaccaaaatgctgatagtaatgaagtccaggctgaggttgtctgagatggaaatgaggaacttgttgggaactggagtgaaggtcactcttgctatgctttagcaaagagactggcagtgttttgctcctgccctagagatctgtggaactttgaacttgagagagatgatttaggacatctggtggaagaagtttgtaagcatcgaagcattaaagaggaagtagaacacaaaagtttggaaagtttgcagcctggcagtgtgatagaaaagaaaaacctattttctggggagaaattcaagccagctgcagaaatttgcttaagtaacaaggagctgaatgttaatcaccaagacaatggagaaaacatcctcagggcatgtcagagacagtcttggcagcccctcccattacaggccaggagctctagaaggaaacatggtttcattgaccgggcccagggccccttgctgtgtgcagcctaggtcttggtgccctgcatccaagctactccagctgtggctaaaaggggcctaggtacagctcaggctgtggcctcagacagtgcaagccccaagccttggcagctttcacatggtgtggagcctgcaggtgaacagaagtcaagaattgtagtttgtgaacctctgcctagatttcagaggatgtatggaaatgcctggatgtccaggcagaagtttgctgcaggggcggagccctcatggagaaactctgctaggggagtgcagaagggaaatgtggggttggagcccccatacagaggccccactggtgttgcagtttttttgcttctgtagttcagcaagtgcgagggagtggctcccagcagcttcttcactcccatagctcagtgaccatctgttccacagtggaatctatttcagtgaccttcactgccaaaggagtaaaaagaagtacagcgtatgatccctcccaatctgggcctagagagggagaaagaaaaggaagagtccttactagtactaagtcccctggttgaataaaggtggccttggttcatgggtttgggcctttgacatttgtttccgttcctgcaggaaatgggccaaagaacttacatggttaatcaaatcaaaggttacatggttaatcaaatcagaggtttcttggtctagaaggaaatcattggtgagaaaaggctgtccttacgtcatttcaaagggaattaaactcagcttcaaaggggtgtttctaaaacagtagtgccatgggcatgagagtaatccaggggagatgagtctcttaagaaagttttctgaagtgccttttgataatatcatgtttcttttctgcctttcccaaggaatgtggtctccaagcaccatgaagatggtactgtatacctagtgcctttgagtccccctgggtgacagcaaccttgaatgagaggctgttattgcctgaaggtacttagggagcccaaagtgaggaattatctaattaattagtacttctatcacctcagagactttctctgtcagacatgaaaatgcttctatccagttaatgaaggtatatacccataccaggaggtactggatgccccttatctttggaatatggatgaaatccatttgccagtcttctcccaggtagcctcccattctttgggctccagcggggagacaccattgactggggggattatttttaaggcaagcctcacaagcattaatgacctgtttgaccatttttacctgacaacaacctttgagccagttggtaggttttatcctttcctacgtggaaggcttggtgaaagattttaagaactttccattggctggaatttggtagatgaagtttgccatcctccagttgtagctgaaaggtatatccttgagaggaggcccattctatttctgcaggagagtactgagtttttgtttcttttatggagccctcccagattagaggggcctcaagtggatcagaaatctggggtactctaactgccaatttagctgcttgatctaccagtttatttccctcagcaatttcatctatctccttttggtggcctttacaatgtattatgccacttcccgtggaaggaaaaccaaggataatagtctgttaatttcccgatggtacttaatgagagacctattagctgtgaggaagtctgtctcttccagatcatggcatgggcatcgaggattgcaaaagcatacttagaatcagtataaatgttaactgctttccctttgcttaaatgcccccatgagggcatttaactcagctagttgagcacttgcacccgagaaaacaggtgcactcacaatagtgtcattcaggatgactactgtgtattctcctttatcccttgttctacaaaagaaattctgtctgtaaagagagtccattctgcatcctctaaggggtttttttgaggtcctctctggctgcataggtttgcactactatctgttcacagtcatgttcaggcttcccaagtttctctgggagggaggtggctgggtttaggagagccagattcttaactgaactgtagattcctccaatagcagagcttgatatttgaggaggcaattgtttgttagccagagactccccttagaagacagcagtcctgccaggttttgtggggtataaatggctaagttcttccccatgattaacttagtagcctctggcaccagctaagctaccgctgcaactgcccagaggcaggccagtcatcctttagccactaaatcaagttccttgctcaagtagcccatgggctgttggggtgggcctcagactgaggatagaactctgtgatgattaatattgagtgtcaacttgattgggttgaagtatgcaaagtattgttcctgggtgtgtgtttgatggtgttgctaaaggatattaacatttgagtcaatggactgggaaaggcagacccaccctcaatctgggtgggcacaatctaataagctgccagcatggctagaataaaagcagacagaagaatggaaaagactgactggcttagtctcacagcctaaatctttctcctgtgctggatgcttcctacccttgaacattggactccaagttcttcaactctgggactcagggactcagactggcttcctttcttctcagcttgcagacagcctactgtgggacctcactttgtgattgtgtgagccaatactccttaataaagtcccctttatatatacatctatcctattagttctgtccctctagagaaccctgactaatacaccttcctcactgatacataaagatttaacatcttccctatgggaagactaagggcttgtgcctcaagcaaggcttgtttcaattggtgaaaggcccttttaatatttggttccccaattatggagtgagtcttagctgcctgagtttctttcattaggtgatataagggatgagctatctcactgtgcccaggtgtccataatctgcagaatcatgtaatgcccaagaaccccctcagttgtttgagggtttgaggaggggaaagtaggagatgggcttaatcctttattcacctgttgccctggtctcctctgacaagagtagacctagatacttcactgaagtctgacagagctgagtcttagattttgagatcttatgtcctctgttaccctgaaagttaagaagaggcttactgccttcctgagtgatttcctcagttagggcacaacagataatgtcatctacatattgtaaaattttaacctgaggataaaggaactcagagagaccccttgacaacactttaccaaacaggtgggggctgtctcagaatccctgaagtacaccatccaggttagctgggtggtctggttggagggatcctcaaatgcaaacaaatattgagaggcagggtatagtggtatgtagaaaaaggcattctttagttccaggactgtgagccctttagttccctcaggtatttgagttagcaaagtatagggattgagaaccaccagatatatcggaaccacagcctcatttatgaggtggaggtcctggagcagtctgcattcccatttggatttctgtgctcccaatattggggtattacaagggctgttgcagggtttgaggaggcctgcctcttcaagttatcaatgatggcttctagccctttcctagcttctggttttagggctcactaaactagcttctggttagtgaagcaggtgggatcctaaaggtggagttggaccagtatggtggttgtggcttgatcaattttcccttgagctgccaaaacttctggattagtattagtctgcaccagtgggagacaaagagcctgccttggagccataaggatggtagttcccttatgaggtaaaatatccctatgtagcagaggagttggcctcctggcatgatttaaaaggcacgagtaagcaagaggtttccccaactgcaagtgagtggttgggaaaaatatcaggttaaagtttttcttgagatgcccctcataggcatgctaagggaggaggggaggcctggactggagaggagaacagaaatggctgtgctggtatccaagaggaggttcactttcctctcttcaactttcagagtcacttggggctcctgaatggcaatgacattttgagttattggagccagggagagaagcccaaggactcctcagtcctgctggaccatttgtgagtctggctctggactcagtgacctgcatctctggggacagtccaccctccaatggttccctccagagattggacagggtcaaggtggcttcctcatgctgcctgggcagttgttaaggtgccctggcttgccacatttgtaggagttatcaggtgcatctcagggattctgggtttttaagcctgcaaggcagctattagagactgtaccttttttcttgtgtctcctctctctctcttcagtctcctcctgatccctgttgtaaaagaccaaagtagccactttcaggaggttctctaaagtgctatcttgtcccatggcctgcttctgcagcttcctcctgataccaggggctgcctcctaaacttactctttaggattagttgtccctcaaatgaattaggggatagagaggtgtaccaaggcttctcttagcctctccagaaaggaaatgggtcatctgatccctggtctatcatggatagtttggagtaattgagaggcttagttttagtccttcataagcaaccaatatgcacatctgaaagtgtttcctcctctattctcccatgttgtattagtcagggctctctagagggacagaactaataggagatatatatatatatctctctctatatatatagatatatatatatatatctatgtatttatgtacagatatatatatatctatgtatttatatatagatatatatatctctatgtatttatatatagatatatatatgtatttatatatagatatatatatatctatgtatttatatatagatatatatatatgtatttatatatagagatatatatatctatgtatttatatatagagatatatatatctatgtatttatatatagagatatatataaaataatatctcctatatctcctattgtgtgtgtgtgtgtatatatatgtgtgtgtatatgtgtgtatatatatatctgtgtatatatatgtgtatatatatatctcctacatatatatcatatatatatatgggaatttattaagtattaacttacaaaatcacaaggtctcacaacaggccatctgcaagctgtggagcaaggagagccagttcaagtcccaaaactgaaaaatttggagtctgatgttccagagcaggaagcattcagcataggagaaagatgtaggctgggaggctaggccatctggtcttttcacaattttctgtctgctttatattatagccacactggcagctgattagattgtgcccacccagatcaagggtggatctgtcttttccagcccactgattcaaatgttaatgttctttggcaacaccctcacagacacacccaggatcaatactttgcatccctcaatccaatcaagttgacagtcattattaaccatcacaagtcaaccccttgtcaacttgaacccatacacatgtcctgagattatacataatcaaataaagacaacaataaggtaataattacacctaacataataaaactatcctttgtacatcaggaaacgcaccaatccccaacccaaatactattacataaagttaataatacttaaatgctgaggtgaagtcaataaatcttatgtcacatgatagaggggaaaggaaataaaatgaagatgttttcttagtacaggtgtatacatgcacaaacatgtttttaatgaaagaaggaggaaatacttatgacaattacagtcctcatttctgcagctggtcatgtggtcatagctggtattgatgactaccttcttcaactacccattctgtattccctttgccttcagcaagcacctcagcaggttttttttttttttttttttttttttcctggtggaatgacccaagccttcattcctgaagggtctgggtcatttgtagtcccacctgggttggggtgttgcagtttcccattgacattaatcacagggcatggtaatactgtgagatgccctaatggatctcctatattccacgtatactgttccttacctttgttgtggagtagtagactgatttcatcttgatagtccaggtcaatcacatcagccaacgctgtaactcccttcttaacctgttgtcttaaaggtaggaggagcccaaagtgtccaggtggcaatcttaacatccagtttaatgaatcattgttgtgtctcctggtggaagcattcccctctctagaactaagacttctagactagtagaatgtaatgccatgggaacaggaagcaagaattttgctagtgtatcactagaagtgatggtgagtggtgccacttccacttccaccccttgattcctggacctgtgaatcctgtctatgggagaaacagtaccatatattggatgctgattcagaacatgcatggccttctggagaactttgcctcatccaagcgaagtattatcacctagttggcattgtaattgtgacttcaaaaggccattgcacagtttttatcagtccagctgcttcaggatgatggggaacatgataagaccagtgaattccataagcatgatcccactgccccacttttttagctgtaaagtgagtgccttggtcagaggcaatgctgtgtggaataacatgatgatggataaggcattctgtgagtccatggatggtagtcttggcaggagcattgtgggcaggatacacaaacccatatccggagtaagtgtgtattccactgggcacaaatctctgccccttccttgatggaagaggttcagtataatcaacctgctaccaggtagctggttgatcaccctgaggaatggtgccatattgtgggctcagtgttggtctctgctgctggcaaattgggcactcagcagtgcccatagccaggtcagccttggtgagtgaaaatccatgttgctgagcccatgcataacctccaatcctcccatcatggccacttttctcatgggcccattgggccatgacaggcttggctggggaaagaggctgagtggtgtccacagaacgggtcatcctatccacttgattattaaaatcctcctgtgctgaggttacccataggtgagcactcacatgggatacaaatatcttcacagttttgaccacttagagaggtccatccacatatctctgccccaaatttctttgtcaccaattttccaatcatgctgcttccacatccctgatcatcaagccaaaccattggctacagttcacgaatcagcatataatcacacatctggccatttctctatccatgcaaagtgcacaaccaggtgcactgctcaaagttctgcctactgggaagaattccctttaccactgtccttcagggatgtcctaaaaaggggctgtactgctgcagctgtctacttttgggtggtacctgtatattgtgcagaaccatctgtgaaccaggacttaatcttctcttcctctttcaactgatcataggtaactccccatgaagccatcagtgcaggctggggaagagaaggtacggaggcaggaggggagcatttgagccacttcctcaagtaacttacttttgccttcagaacctgcttgagcccaatcacgtatataccacttccatttgatgatggaatgctgctgtgcgtgccccactttatgactagatgggtcagaaagcacccagttcatgataggcagttcaggtcacatggtgacttgatgacccatagtcaaacgttcagtttccaccaaagcccagtaacagaccaacatctgtctctcaaaaggagagtagttatctgcagaagatggcagggcctgctccaaaattttagaggcctctgctgtgattcacctatgggggcctgccagaggctctgatcagcatccctatctgccgctgtcacctcaagcactattgaatttgctgggtcatatggcccaagtggcagagcagcttgcacagcatccttgatctgttgcagagccttctcctgttctggagcccactcaaaactggcagccttttgggtaactcgatgaataggccacagtaacacacccatatgaggaatgtcttgcctgcaaaatccaaataggcccactaggcattgtgcctctttcttggttgtaggtggggtcaaattcagcaacttatccttcaccttagaaggaatgtcttgaaagatcccacacaactggacccctagaaagtttactgaggcagaagttccctaaattttagtcagatttattttccatcttctggcatgcaaatatatcaccaataagccctgtgtgtttgctacttcttgctcactggatttcatcagtataagacatgaatgtaatgaacgagtgtgacatcttgtagaagtaaaaagcgatcaaggtgtctccgaaaaagattatgacacaaagctggagagttgatatacccctgaggtaggacagtaaaggtatattgctggccttgccagttgaaagcaaattgcttctagtgggccttatggacaggaatggagaaaaaggcatttgccaactcaatggctgcataccagataccaggagatgtgttaattttctcaagcaataaaaccacatgtggtacagcagctgcaaatggagtcaccacttggttaagcttttgataatcgacgatcattctccaagatctatctgtcttctgcataggccttatgggagagttgaacaggaatgtggtgggaatcaccacccctgtgtcttttgagtccttgatggtggcactaatctccgcagtccctccagggatatggtattgttttcaatttactatttttctaggtagaggcagctctaatgacttccatttggcctttcccaccataatagccctcaccttacctgtcagagagccaatgtgagagttctgccagcctgctaagtatgtctatgccaattatgtgttctagcactggaggaataatcacaggatgcaccacaattcagacctgagctaaaactccattagttacctgacctccataaccccctactttaactggaggaccacagtgacattttgggtccctaagaatcaatgtcagctcagaggcagtgaccattagtccccgaattatctgatcttttcccttcctccaatgcacagttaccctagtaaaatgctggaggtttccttggggaagaatgggagaaagattaacagcataaattgtcagtagtgtagtggtgtccttcctcaagaggtcttggctcccccttcattcaaagggttctgtgtctgtaaactggctcaagtctggaatttcactgaggggccatgattctctgtttttataattcaaattcatcttttgtcccttctacgtagaagttttctgcttatataaattaagtagaaatacagtaggcttcctatcaatttcacttccaggaactccgtgattaattagccaatgctagagctctacttgagtcagactattctgattgcttctttgtctctgctatccattacggtacctatgctcaccttgcttttgatggttgagtgtcgccacttggtccctgccatctcaggatccaattattccaattgtgtttaaattttgtagatgagaactgcggttcctactattagatctgacatacagagaagagcaattacagggctcttcaaagatgcgggtgctatcctcacaaatctattttgcaaggcattggtcaagttatatcttctggaccctctcagctaggatgattaggtctgaagtgactaatccactccagcatcccaatctccctaagcctttggatcctttcctctatattaaaccaagggagatcaggcacagtaggccatcttttaatccatatttcagctaaccaagcaaataaactactagaaccttttttactccccaagctgcaatattaaattcagagtccctacttagtgggcccaaatcaataaatttagcctgatccaactctatgtttcttccactattatcccacacccttaatatccattcccatgcctgttctccagatttctgtttatataaattagaaaactcaagcagttattttcgagtgtagtacacctcctcgtggtcacactctcaacctcatctctaggggcctgccgggactttagtctagttatagatctagaagcaaacaggtgttgggtgtggctcctgagaagaatcaacattatctttcctggcaactgcctcaggggaagtcatcactgttgcttcaggcagcacagggtttatctcctcagacaaaggtggaaaggctgatggcagcatgggttggggaggggctgttgccactactgggcatggggatgcttttccttctggcaaaaaagtttcatcagagtttacaaactcagtgtccccatcttcatcagcatccttccacatgttcccattccaagttgcagggtcccattcttttccaatcaatgccctcactttaatggtagacacctggaaaggctgcacatgcactttttgttgtaggttagccactcacatgataagagcttctgtctttttttccacaatttcagctcgttctctacaggagataggtctctcagggaaaccttggcagatttgaggctcagtatctgcttctgaagttgggagatagaatccctgggttcctcattttctttcatcactttgtctactgaacttaggagcaaccaaccagctttattacattccccacatatggtcaaaggtattatatatatagtcacttaactccttgcctctcatgtttggtgactcaggagtgtcaaatgcatttattttgtgtatctctataagcagttcacaccaaggactgtcagtgttctccatactattagaagtagagtccttagcatttttgagtctaatcatattaagcagccaactccagaaaccctaaaaccaatgaaagaactctatccttaatattctgttcctctagaaccactcctggtaccaaaatctgtattagccagggttctctagagggacagaactaataggagatatactggcagctgattagttggtgcccacccagattaagagttggtctgattttcccagcccactgactcaaatgttaatctcctttggcaataccctcacagacacaccccagattaatactttgcctccttcaattcactgaagttgacactcagtattaaccatcacacatgtcatcattggggtcccatttagggtcctccaatggtactgctgtttttccaattgtataaagctcttccccttgcttggcactatatgaggtacaaagctcatccccaaatttctctgccacttgcagggctgtctgcttctcagcggtagtcaggattcgattccaaagtaacattacatccttccaggagagttcaaatacttgggttaaattctggaaagcctctatataactgtccgggtcatctgaaaacctgccaagatccccctaaatttgtcttaagtcctgtagagttcaggagacctgtatcttaatgggttatattcacaaggcattttctataggggcatgagcaaggcttggacctgcctaaaatgatttttaggatgggggcaaaataatataagaagttttttcttcaaagtctgaggggtcacaggagtcccagtgattcaggatacacttgaggggagtgcaggctgcaggtggtttgttacccacctgaaaagagagaggggagaaaaggcatgccttagtctctcccttgctaatcttgaatttgaagcatccctcaaatctcagtaactggtactggcaccatggatgggctcttgctgcttatgccatggttgtgagtatgaccttcccccatgaagcagaaaggactagttggcagggatagtcatgcttacctgcactctgtcctagccttctgttgttgacttcctctggttcctcagatctagttttctttttagggctccaaactgaagcatgaaaaatacactggagtaatggtaaggtgaagctatggaaatagatccttctcaaacaaaggaaagaaaaggaaccctgagaactggggacctggcctaataagatgtcttccaaaaggaaaaaatcagtccttcacatagaaaagctccttgtattttcaggattatgttgattcctgacatggtgggaaaagaaacaacttaaatgcagaggagggaaggtccctgggggaagtggtctcttgcactatgctaatgggtttcttcaacaggggaaagaaaactctcttaatttttacatccccctgtttctaagaatagacagaaacaacatggttcaggtttacactcccgataactaagccaagtattcattctacccactaatattatctttttggcttgcaaaaacacttgtaacattgtatataaagaagggatagaagccacaagagtcttgaaagaaagaaaatgtgataggaaagactggaagttttggtgcaacacctgaacaggctgtcgggaattggagccaatccaggagtcttccagtaatgtcgaggcatggccttggccagataccttcaattgccccaggaccttattctgatcccacatgacagctagaattctggaagagaagctggattggaataaagtgaacatttccaacacccgagggtgaagggggattgacaaaatcctcccctgcaagcctgttctctgaatcttatagaccagcagctgcactatccactcttaactggctgacaaaggcccagtgttctatctgtttttgtaaaaaatctgaggacaagaagcctcggaatgaaagtaaagagtcataggtccactcttactcaaactttaattgatcctggatgaacccccagaaatgttgtggcatttttgctcgcatagtttggtgagtgggaaggagtggcacccagtggcttcttcactcccatagctcagtgagcaggagggagcggggcccagtggcattttctctctcttagctcaggtagtggaaggggatgttacagctcttttactctcgctgcccacagcttggtgagcaggagtgttacagctctttcattcaagcagttcagagatttctacattcttgtcctgtgaccaaaaggaataaggtatgtggacactggagagtgagtaaggcagagtagaattttattgagcaacagaaagaaagctctcagaagcaagaggggacccaaaagcttgttgccatctgtgaagctgagtcgggtttttatgggcttagaatgggggaatgaatgctgattggtccatgggtgggctcgaaaaaggcatcatttgatgggttaaaaggcatcattcagaagaaatcaactgagagagagtagataagatggggatggcagttttcactctggtcctagactctatctggaactggaagctcagttttcaggctttaggctatccttggcttgaaggtcaagtttcaccagggacccatccctgtccacctatgaatttgtctgtctcctgtatctatcaatggggcactgcctaataaagctgtgagaagagggccaccatcctccagacctcagaatggtagatccactgacagcttgcaccatgcacctgaaaaagccacagacacttaacaccaagctatggaagcagctgggaggggagttataccctgcaaagccagaggaatggagctgcccaaggccatgggagcccatctcatgcatcagcatgacctggatgtgagacatggagacaaaggagatgattttggaactttaaggtttaatgactgccctgttggagatcagacttgcatggggcctgtagcccctttgttttcacgatttctcccatttggaatgggagcatttattcaatgtctgtactcccattgtacctaggaaataactaacttgcttttgattttacaggatcataggtggaagggacttgccttgtctcagatgagactttggacttggactcttgagttaatgctgaaatgaattaagactttgggggactgtgggaaggtatcattggttttgaaatataagaacatgagatttgggaggggccaggggcagaatgatatggttagtttctgtggccccaccaaaatctcatcttgaattgtaatccccataattcccacattttgagggtaaaagaggtggagataattgactcataggagtggtttcccccatgctgtgcttgtgatagtgagtgggtctcacaagatctgatggttttagaagtgtctggcatttccccttcttgcactcactctgtcctgctgccctgtgaagaaggtgcctatttctccttttctgtctgccatgatagtaagttttctgaggtctccccagcgatctggagctgagtcaattaaagctcttttctttataaattgcccagtcttgggtatttcttcatagcagtgtgagaatggactaatacagggttgtatatcagaagtcatataaagatagaagaatattaaacaggtacatttaaattttgtcatgaggttatgacaagttactctgacttcactaagcaaaccacctgagctgtttagatatcttaagtctagctagcaaaataaaacactgtctatatcaatgtagcagtatatgtgaaagggatttgtaaattctgtaatgtcataaataggagtactatttttgtactaatagaaaatttttaagtgtggcttgttcttgtggcctgttaacatgaatgtgatggtagctactattacaaaattaccacctcttctctactctcgaggatggtgattcactagcaacagtttctctttaggaactttgatatcagggaatgcctttcatagttccgtatcccaggcatttagcctgctatttgcacattaatacattaatacattaattcatttttttgaatgaattaataaaaactatgtgactgttctggaagattctgccatattcctactctgtgagtggtgggagggggaagctaaaatcaaggaggcttcacttaattattcttatccattcatcttctgaatactcttaagaatcttcaatttaaccaatagtcttaaataatcttactaagggtttttaatacatttaatgagttataaatcaaggataaggatagaaaattggcagtccatagatgcattttgtttggtcctcccaatgttgacatttctcagggttaaataattataataaaaatttactgtcagcattaaaaatttattctagttcacctaaacatgtattcttttctctttttcttctccaggcacactggcttccttttttttttttttttttttttttgtaaaatgccacatttactcttaaattctggactttgaactggctttttcctatgccaggaatgttcttcttctaaatatcatcatggtcaactctatcactgtcttagtctttaatcgaatgtcaccttctccatgaggcctcgccagattgccgcatgtataatttcatacatcatgccccaaaaaattctccccatgtacttccagtctctcttacactgctttttctttctactgcatttttaatctaacattttatgtgatatacttgtatatgtttattatttattttctgtctcctcaatatattataagctacatgaggattgagatctttttgtttgtgtgtgtgtgtgtgtttactagtgtatttcaggcaattggaataatgcttgataaattaggactatcaataaatatttgttgaatgattcaacgaaaaccccaaatatatggctccttttgaaaaaaaagcactatctgttaacattgggcttacattcctacatcctccaccatttgttggaactgagaggcaacaggtgctttaggcaagacatgcatgcattcctcggtcctctacagccatcaccaccacacttgtcttcccagtgctgagccttatctgcattggcatttatcttcatatttattcttttttttacaataaagaggaaaactatgtctagtactcatatctatatcaaaagggggtaacatgggataaagaaagatcaagaaagttatatgtttattgaaacaagggggacagcatgtttccatgttgaggtgatctacgtgttaaacatgtagaatatatctcttcatatgtccacctagttcattcatttgaattatttttctgatgcctggcttttgaatttctgacctctgctctaaatagacataactgcaactttacttaaaattcaaagataagaagtatggaagcatgcattatcagaaagaagataaaattatggaagcttacaataagatcaagtatcttgagtagctaatagtagaagttagttattttactgtggaattttattacattttaagttgccaacccacacaaagataatccttgtggacatctatagagaattaaattttcagttagctaagatgctataactttgggcataaacttgcatttatagctgggcatgtaaagcaaacagatgccaattggttgggacagtactattaggcatatccccttagccaataatgcaaataagttagccttgctacagcaaagttttgccttgcctttgaggaatggaagcagattaaagcagggaagagatgtcaatatcatccatactttctatccacaaaactaatcagaaaatctttgacatttactcagagtaataccatacctgaaataggtgaatctatgaattcttaatttagtaaatctgttagaaacaggtcaccattttcaaaagctgttacattaattcactttggtgtaaagcattgtctagcactatttcagcacccagtattgacagaagtgatcacttgtgtcatcatatggcacacacttttccgaacctccatatgcttttggctacctgtctttctattttgtacactttccctttgaatatttttaggtttgcaacacttttatgtgattatcatagtgttaaacagaagttataatttactgtccaggattattttacatataacatgtaactgaccctttcagatgttttttattattacataacaagcttatcaaaaagaaaaattgaataacttagaaataatatttattaaattgtaattattaacctgttagcattaaagtcaggataagatagctgagctgtattgcaatttcaattacaaaaatgcgtgcttattcttcattttggaagcccgccaactaaagaatatattaggcagtgaacgcaacatgacaagccattcaattcagcaatttctagttggtcagatacatcttcaggcaaatttaacctttataaggcttattcttggtctctgttttgtagagattacagaattgtttattttaaataaaaattatgttgagagaggtataatctaaaagtcattgaaatttccacttctatcaattttaggttacatgctgctaggtaagaggaattaataaaagtttagaaagtcttcattcattttcaaagtaaactgctagtagagaaactgccttactttctaaaccttaatagaatacgtttttattgataaatgtccaattcattgacttttgtcatctttcaattaattgcttacattttttgtttttaataaggttttaaaagttgttataaccatttatcacaactgtgaactgacttgacttgaaaccattagcaaaataaacacctgtattttagtagctacccataagcaataactacatactatgtaagtgccccctgacctcctgaatcctgcttcaattttgtttagcctctgtttaagctcctggggattatgggggcaaccagtatggcttccaaagaaacagagggataagtaacccaggtgtgtcctctttgtgccagtagtaggaactatgccagctggctgccctctggcactgtgcatagtgaacagaatatttcttgcattccccaaagggaaattttagtaaaaggaacacaaatgaattggatcattattcccatttctcagaaaaggtctgtgcaagagaagggcacagacttcattctttgctttatgacacaagtttattaaggttgccattgcagtgatttttgtaaatgaaggaagcatcagaacatcactgaaatacatactataattgggaattacagacagtaataggatatcctgacttggtaatgagaagagaaaatgagacttccctaaactttttctcagtatgtatgatcttatctaaaacttgaaattttggtgtctgcacaaaaacccaactcaaatatctcagtggattaaaacagcaaaatatatctctcttgtactacattgtgcaagggagcttcgctcatcataatcactgaggaccacaggctggatgggagttcctgccccatactttcatattatcaaatgaagggcacaaaggggtggccaaacacatgctggcacttcaggcttgcccccatgttgcttttgctcacatttcattcatcaggtaaatcacatggccacacctaggtacaagagggcacagaactgacatttgtaaataactctaaaactactaaacatcccgatgctgaatttgtctcagtttaaggaaatgtcagcagcaaaaattagtgccatgtgctgggttttgacagtagtaagattataagcattttcttatttagtaggaaggaggaggtttataaaatcaaatggtataatgattcttctaattttttatttagaatttttattttatttatttatttaaaaatgttcatttttattaactaataaactgagatttaggtttaggtataattatgttcttcttaggtaattataaaccatcagtggaacatgcaatttgaaatatctgattactccctgacacagagtctggtaatagatgagaaaaaggctttgtgaatcacggttctgattagagtgtagaattatgtatctaggaaccagattgttaataaggtggcaaagcccatttatgctagaggaaaaagaatattaaatagataagccattaagttaatttgcttatattcttttaaatatggtatttatagattacatacatatttaattccatgattttctgtgttaaaagtaacattaattccttatagaaaaatttgaatatgcagaaatgaatgaatacaaaatattataaagtaaaaagcatatgaagttagttgctattaatatttggacacactttattttagttgcacacatatatgtgtaaatatacatatatcatttatattaagtggacactttcctatgtccgtattcttcatgaatattattattaataactaaataatgtttcatcatctggatgcatggcattctatggttcaatcaaattaaacaccctttatttgaaatttaggtgtttctagtccttcactataataaataacgatgcatagaaaactttatatgtagatcttagcaaattggtctgaatattttctcagagtacgtttttagaaatggacttaattatggaaggtgtttggtcattatttaacataattgatacatattgccaaatttctttctagaaagtttgcattattaccagcagtgtatgagagcacctgtacaaatttacatggtatatatattgaacctgttatattaatgcttacagataggctttataaatcttttaactgtttgctaaatttcgaaagatgggttgttgagcagatggattctcaaacttaagcaagcctcagaatcacctagaaagctcactgaaaacagattgttgggccccattcacagagactctgatttagtaagtttgggaaggggtttgagaatttgctttgcaagtaagtccccagataatgttgatgcccttgtcagaggcttgcttttgggagaactgttgaaattgactaacgggagtttgttttaaagtaatagtcattattcttcaacatagtaaaaataggcacttacttaactttagaagctaaatattttctaagcatatcaatttttgtgggttagcctttaattgtattctaaaagtgtttcttaaaataattccttctatgcaaaatactgtgcatactaagaaaacataaatctaaccatttcctatgtttttaaatcaagcagatcttttatctctgttcgttagtttatgacacaaataagaagtttagtcaagaaatataatgttaaaataatgatgctgtgaagtttctaagtgaatgtttatggttgtacatcttttttttcattttatggcttcagccttatcttatatgagtcaaagttaaaaaagtttcagggataaatttaaaatacaataaaactattttgttttatataaacatctagaatagaaactttaaagactaattagatacttgaggagtactaaattaaaaatatttaagtacatttgggaaacatcattttgcaaatatcatccttctccctacagtctaaagcccaagaaatgaagacaaacataaaggtcaagtaattgaatagatatatgagtaagaaagacttttcctgacccattcgtattttcatacttagattgtgaatgtcaattagctcaatcaagccttgctgataatgtcagctgtcagtcactcctaggtagtgatgtgtgaagtttgtcagcgggtaatgggccatttgagtgatgaatgaaataatgagggcacagaagcctaagcaaaacgtctccatttttggtaaattcctctccacatgggaaattaagacaaggaaagaaaagccatataaaatctcttttaatacggtgtttattttaaaaatatatatcttaaaatatcttttaactttttatttttaaaaattaatttaaatggtcagtgattaattatcatttcccaatagtattgatcagtgtaagcaacattaggtactgcaagagataagcttgctcccagattcacgttgatattttgacttgaattgaatatttaaatcgaacttcttcagaagtttatcagcagactttctgagtccatggactatctatactaataagaccttgctttatatctctgaataaagtgtagtttctttctttaggcttaacacatttcttgttagtgttctagtaggtatttttatctgattgctgttagagttagagttagtggaatatttttcttttcttttttttttttgagacagcgtctcattctgtccattcaggctggagtgcagtggcacaatcctggctcactgcaaccttcgcctcctgggctcaagcgatcctcctgcctcagccccccaagtagctgggagtacaggtgggagccaccatgcctggctaatttttgtattttttgtagagatgggtttcactacattgcccaggctggtctcgaactcctgagctcaagcgatccacctgctttggcctaccaaaatgttaggattacaggcataagccactgcacccagacaatatttttcttttatatcttctgttaattcattgcatactagcgaaacttactaattttataatttgtcagatgtaatcagccatcataatatggtccctttagtttctttttccttttggcttatctatctaaacatctatcagtgtaatcatatctgtaattaatgatcattttatctcctcttttccaatagttttattgcttctttatttgcttattatcttttgcatatttctactctagctttttccagtgatgcatttttttttttcatttatgctgtgtccttcacaggactgtgaatccttggagtggaagcaatgtattctacttatatttgtgacctagtaattaacatagtgcctgaaatagagtagatactcaaatgttgacagaatgcctgattgaataatttttcacttccacttaaaaattgtttggggcaattcctgtgaatgttagttcaatgaacagcaaataacaagatagggaagcagacctctgttgagtggcacagatctagggtctgggggaaacctgggtactcaagggactcatggggaaagaggcctaatagatagcttggcttcccgtgggatgcctaactgatgtattactcaagttaagaaagaggtacccattgggtctttgaaattgaaaatattttattatttttaattgttttcagggtacatgtgaaaactcatataatttgtaaagttcacatcagtataattgaggtacccatcaccttaaatgtttgtctttatgttataaatgtttgaattattctcttctagctattttgaaatgtacaatagattattgtaaactagagtcaccctactgatctacagaacactaggtcttatttcttctatgaaactatgtatttgtacccattattcaacctctccatccttccttctccactgatcttttcagccttcagtaaccaccaatcaattctctgtcttcttagatccacttttttagcttccacatatgagtgagaacatgcagtatttttatttctgtgcttggcgtatttcacttaatataatgaagagatggctgcattctcatgtttattgcagcactattcataatagctgaaatatggaatcaacctaagtgcccatgaaggggtgagtgaaaaaagaaaatgtggtatatatacaatggaatattattcggccataaaaaagaatgaaatcctgtcatttgcagcaacatggatggaactgaaagttattatgttaagtgaaacaggccaagcacaggttttccattttttaaaatgtaagactatatttaattccaactggcccataaagcaataacttcttttattattggtactgagacatatatagatagccagctattaactggttatgaaactgggattcagtaagattatgtcaaaatcaagtctgcttcaatcaatatcccaggagaatattaaacttataatttgattaatatagaattatttcataataaataagtggagtatgaaacaattcatgatgaatttgctatccagctgaaattaacatgccactagttgcagaaataataaaaatagcaatataaatagataatgtttattaagaatttaatgaacatgttaggtgactaacgtgatgaatgctttgcagagattatctcatcttcatgcagcgtttaagacaggtatgattggggttgcattttacagagagaaatatatatatatattttgaaagcttgttaaatagcttgcctaagttcacacttatatgtggtggagctgagttgctaaggaaagccattattttaaccctgacttttatttcacatagaaagctttaaaataaacatgagtgccagagccttactctcaaattattatttaatttatttggggtgtgactcagtgatactggtatttttttaaaaagctgcctagtgagttcaatgtgcactttgagttaagaccagtgaactattaaagcacactgctgagagcttagctttgccttccaattgtatcttgtcaatacaaaaaaaggttatgttttttttgcttggaagaataattttaagatttattttacctcttctatcctgcacacattgtccttatttatgtatctcacatttacctcactgatcctgcctacccatgtattggccattgtctcctgaaatatttcagcacataggctgggtgatataagaaatctaatgtttacctctgcaagtgaatctatgcttagattggattgtttttactagggttttgccgctctcgatgtaaatctttttttaaatagttgttcagttatcattatattttactattttattagctctactaagtaggcagcaggacctagttgattaggtcgtattaaatacctctttctatgattattggtttaacaatgcttataaaaattgctgtgtttatggtttcagatattttcatgaagttcaaacaactatataagactggatttggatccatcttgctatattttctaacatagtaatttacccttcccctatttccaacccaagcatcatcattaaaataaaataccagcaaaacaatagaaaaataggcaatcagcataaatatgcaattcagaaaaaatgaagtaaagcaaataaataacaaatataaaaatgtttaacttaattatatatgaattggcaataattttttccataggctttttattttacagatataaaatagtatatatgttcattatttatattgacctaggtgttacttcttttagaatgtaagctccataagggagagaattttgtctattttgtttagtgatatattaaaagaactgaaactggtgcctgtcataaaattgacactcaataataaatattattcaaaggaaataactattgaaagaatggatttttttaagtgcatgtgtgtatgcacgtgtgtgtatacgccattaacaaagatatggtaaattgcacacagtactacatgactggcagcagtataattggtacagcttttctaaaaagcagtctgtgaaaaggtatcatgtttttctcaaatatttattctatttgaattatttacacttctagtactatgctttaaggaaatacttagtgaagtgcagatttatagaccaaaaactctgttcataacattgataaccataagagagacaaaaatcactgaataagtaaaatgtggcattcatcattccttcaaaacagactaaatgatgtgaaaatgcagcaatgataaatgaaaaacgagagaagacaatagagcgtgcttccaattttgtaaaaattgagagagaaagatggaaaaaaattaagtaattaaaccacagtgttaatagtatttatatctgggtggtgagactaagcgagcttttaagtttttgcagaattatgaaatgcagaaaatttctatacgaatatgtactactttgttaattagaaatatattatttcacgccagaggcggtgctcacgtctgtaatcccaccactttgggaggccaaggcgggaggatcacctgaggtagggagtttgagaccagcctggccaatatggtgaaaaccgtctactaaaaatacaaaaaattacccgggcgtggtggcacgcgcctgtagtcccagctacgcaggaggctgaggcacgggaatcgcctgaatccggaaggcggaggttgcagtgagccaagatcccgccactgcaatccatcctgggcaacaaagcgagactccatctcaaaaacgaaaaaaaaaaaaaaaagatttttcatgcctaaaataatgtttgagataaataatttttgaataagtaaatgggtgcaaaaattcatgatatgagccttctctcagagcaattttaaagaattagctgtaaggggattcataacttctttttttgagtacagttaagcaattactctatccttcattatgtgttgagtgcttatttgtagcatgtcttttttccactgaggaaggactactttctcatggactgaaaatgctctttgatctgtagctatggtttgcttggtggagcgggcggtgaccaagaaatgacagatgtggattctaatatgtgtgatttgacaggattaatagaaatggtttactttcagtaagtgtttttaaattagtactgtgtccttagatttaaaaagaaaatcataatcaatcaattagcaaatgttaactttgttacccaatgaaagtgtttttagtcggccatttataggggacaaaaggggcataagaattgtagactttcgactgctgacactacggttgggcctggaaagcttatttaaaaaaagacaattaaccaataatatatgacaatgctatattgtgcttcattggaattcaaatagggagtattttcaagtaatttttaacatgtaacatgaggcttagaattgaaattggttatataaattgatatttgccttatttaaaattttatctttttaaatattttctcaaaactaaaattggaaatgaaggacttcatgtaaattctgggcaaatataatgtttatgttgtaatttaatattaaatcagagtatcaacctgtgcagtgattttgatatttaacacagagctcttgtttaatttttttctctaggattcagaatttcccatagatatgcaaccaaatccaaacctgaatgtttctaaagaaagtctttctccagcaaaatttgactacaagctgaaaaacatttttagactccatgaacttccagtgagctggtaggatttttgatgttttattaatacttttgagattttattttcatgtcaaaattttaatgctcttacagccattcatggttgaaatggtttgcttttagcctttcaaaattgctactcatagcatgaaagaatctgcttatagtagctgtaagaatcttaaaagtaattggtttaagcacttggtggcagtacagactaagtgcactattgtgtattttattgtagaggttggagtaaaaatgcacaaatcatttttagagaagtttctaggattactttaaagataggatctcagcaactatacatttcatttgtttattttactcaccaattttaccaatgtactttttccctgttaataagttctttttacttgtttgttatgaggactgtaattttgtgaactataattacataggtttaaagatgagacttagtattactcaacatttattgaaataaattgttttatgaatctgcgtatttatattcatacacatttattttaaatcttataaaatggagagtatttttattcaaaattcaaaaaatctgtagaaaatatgcatatataaaccttataattccatggtacatttacatttcattaagtggccagcttttgttgataatcatggatacatcattttaattatggtttagtttatataagtaacattattttcttgcatttggtcatagagtcccaaatttatgtaattgttcttcaagaaatctaagacttatacaaaaatatatggcatttgttttgtaattgctcctattatacttaaggaggactaatgactcagaagagacattaaccactctttaacacatatattttacctatagtgagtatttttttttcatttgcaaagcttcctctgctcttgatgaccatatggcatgtgcaatctacttcctaaaccccatttgtttgattatttcctcatagcaagaatattgtctatggtatatgtcgtgagaacatagcacatatgaatacttctgtcataaccaaaagcagtaggtgaatgaattgaaaaggtctgttagtaaagggaaccataaaaatgatacatttataccttagtgttctatttcaatgtaaaacaagtgcctgtacattcatatgctagtcttttgatgtaaggtcgtgactttttcttatatgtctatcgtttggaattctacacaatatttcttacctaagccatgccaataatgcatcttctacaatttcaatttgtcatttcttttatctaaaataagaacttcagacaacttcagatgatctccccacctttttgtaacattaattttcattgacagtaattctgtttatccttctcatatttcatcaccataactaatgtttatactacaataacaaacacaactggcttataaacaggtttaggaccaaactcttgggactctttacaatcatgaaccttggctgatgggagtggccaatgctggtctacttgtgtgattagagagctctgagcagttggggttcagtgagtgcagcttgtgtgttttgtggagataatggaacgtgttagtcaatacagcaattaagtggaggttaagggaaaagcttctattaaatgaaaatgtggagaagaaacagagggaaacatttagctctcagtcaaaggcaaaatatggatttcagcttaatttatttccagcctttggaaagacagctgtcctgattactactactgcaactcaaggaataatggttttgtaacaatcttcactagttagcctattaggagggaaggctgtcacattattagtttattagtagaaaaataaatcggtaaaggaaaaataatcactagtctcttagagtaacataccgcagtggaagattaagttgtgactttgggacaacttacttacatgggacactttttgcctgtctacttcatttccaattggtctcattttctgcttccttatactactatttctttttttgctgtgtgtgtttgtcagtctcccaaacacatggcaaaagtagtagtttattctgcgacttctttctctgtactctcattctatactaccagtccttaactagacataatataaaactcaatttaaaattgttagtgtttctcaaatagtttcataatctgtgttcttaattttaaaaccagtggccgggtgtggtggctcacgcctgtaatcccagcactttgggaggctgaggtgggcagatcactaggtcagattgagaccatcctggctaacacagtgaaaccctctctctactaaaaatacaaaaaattagctgggtgtggtggtgggcgcctgtagtcccagctactcgggaggctgaggcaggagaatggcatgaacccgggaggtggagcttgcagtgagccaagatcgtgccactgccctccagcctaggcgacagagcgagactctgtctcaaaaaacaaaaaaaaacaaccaaaagaaaacagataccaccccctctacagacatacacatacagaatcttagtaagtctacaatacagtgtttattgacccaattatatacttttttaaggaaaaaagaaagttgttttttttttttttgtgcttggggactatgtatttttaaaatttatttttgtttttcatttgccatcagtggaaggaaagttcttcagctatggtgtgtaggtttcttaacttcaaaaatatagcagtaaaagtaatgacaatgataatggaaataatatcaataacaatgctttgctaagcctctataagtgccaggattcagctgctgtatacacacactatgtctgacctttgtatttctataaggcagttattatttttctctctctctctcgtttctccttctctgtcacatacatatacgagactcagacaccttgcgaatcacaaagaaagaatttgtgtcagatctggttaacccaaaggcaaactacaaaatagtgaataagccatgcattattttaaataaacaaaatgaaaaaaatctctgcttttatagttgggcatacaattttgccagtaatacacaactatatgacctatgatttgggcaaaatgcatgacaagcacgacctaggataattgctataaacttaaatattaaaataagtagttagattgtgtttaagtgcagaataattatgtttttttcccctctggagaaacagatttatcaaaatgtgtttttataatgtttttctaacaaggtcataataaaataaatgcatattaaaatccaggtaatttaaaaatcattgatgtattactagtttgcattttcatagagtatggtttcataggccaaagaaccagacagattttaaattaaattagtttagagagtttttgagctctgatttaggtagatgtctttcttctactcttacacgatgcttcccatcagcctagaacatgtctttcagtgactgccactagttgtttgtttgtttgtttgttttgttttttgagatggagtctcgctctcttgcccagactggagcgcagtggtgtgatctcggctcactgcagactccgattcccaggttcaagggattctcctgcctcagcctcctgagtagctgggaccacaggtgcctgccaccacacttggctaatttttgtatttttagaagagacagggtttcaccattgtggccaagttgtttaaaaatttttttttcttatccggagaactccccatcaaacctatgctgtttcctcatatcctgctcattgtctctaaggaggctgacaaaagtgcggactgaattaatagcctccacttgtccttgccattctcctctgccatcgggttctcttcctttcctctcctgaaactgctcttgccggtcattagccactccccgtgtccaccaccagtcatcactcactcattctcattttcttcacctctgaccactcctgcttttcctctcctgactcctattatttgcatgattctagttttcctgctgactcccaggctcatatccttctcagcatcttcagtgagctgctcctctctggccagatttctggttgataggttggccctagactcaactttatagcttcatcttttcactctcatttgcaggtggcctcttccattctctggctttaaatactttccatatggtggtgtctccaccatgatgtctctcctgagcttgaatatctaataggtttctccaaattttcatctgtccaaaaaataactttggttttcccccaaaagacctaatcttctccttatctccctcatttttgcaaacgtaccaaatctgtgtgaacttactcaagctaaaagcctaggagtcattttaattcctcattccctcaccctgcaattcccaccattaaatctaccagaaagtctgataggtctttcctccagaatatattaattttttccccacttctttctacctgtattactgtggtcatttctcatactcttgcaaaagcctcctaatttaccctgtcttaccccacaataattcactggtgtcacaatagccaaacatattttgaaaatgtaaatcagatcatcagatttcctgctttaaatacaatgatgtcttccccttgttgaaaaaataaaacccaaacttactactgtgtggcctttgcaagatgagactcttgcctacctccttggctgcatgctctcccactctcccttgccctatctcctcaatgacaccagtcttctcactattctgcaaacatgccacacttattcctactccaaggtctttccactaccttctccacagactcccagtattacttctccagtttttacatgtctagctcattctaacctctcttagctcaaatgttacctcctcagagaggcagtgcctgaaaaatgtagctaatatttttattcctcactcccttagtcactttcagtcctttcattctactttatttcattcatggttctcagtaggcatgcagtgttttcctagtttatgtgtggcagagatgggtagatgctcaccaatccagtttcctcttctctgagcccattgggagattatatcttcagtttggaattgaacttgggaatttggccatgtgcctaaaaatgaccaaaggcagtgcatatcacttccagacctaacccctaagacttccagtgggattcactgttgactttgaaagttctaagccatgtgatagaagaagcacggttccctgaaacatttgttggttgtagagttctccaaactttatcaagctttaatcttccagactaatgagctatctctttgtgaaattagatgttaggccacatatgataaatgaattttaaaaataaaaatattgaagagattttcacattcactcattcacacaaaaaaatgttattgaacacgtgtcaggcactactctgggcagttaactaactagacagaaatctgttctgagggagattacattgattgaaggaagaggtaataagccaatagtgaacacatgctgtatttgatggccataaatgctgtagaaaaacataaagtgagacagagggaaactgagtgtaggatgaattcagttttaaagagagtgaccgggacttttcttgagaaagtgatatgtaagggaaacctgaagcaggtgatgaagtgagacatgtggagcactaggaagaaaattagagtcagagagaacagcaaatgcaaagcccttgaggtgggagcatatccaaaatattgtgggaacagcaaggggtccggcatggacagaataagtgaccctggagaataggagggggaatataaagttatgtacttggggatcaaagagcctgtgacttagggccttataaatcatggtaaagaggactttgaattttaatctgagaatgtcaggaaggtattagaggattttgaacagaagaattacacagttttacatacataaaaacaaggtgtctgtaactgctgtgaggaaattatactgttataggggtcaagaatagaagctggtagactagttagcaactatttcagtaatccaagaaaagtataaggtttcctggagtaagttgacagtgatatagaggctaatgaatagtcagattttcattatttttttgataggagagtcgacaggattttctgttgggctggttgtggagtgaaagaaagaatttaagaatgattccaaggtttttggcctgagaacaggaagaatagagtgaccattaatttatatggggaagactgagggaggaacaggtttgaacaggtttgacatgttaaatgattgatggtaattaaacttctaagtgaacttagatatacataggacaccttggactgtgctgtgaacaaagttcataactgtgtatgctgcctagcgaacaggttcatgtcagtactattccttgtattttaattgaaacagacaccagaaataaagttactaagtagcttttactgtgaaaatatgggcattatagaaatgtaacttttggaaaacatataatttaattattatatatggatatgtataatataagctttaagtataaagcttaagtacttaattatacatatccatatatacatatccatatatataatgcttaagtacttaattatatatatccatatataaactatattaattaaattatatgttttcaagagagtatgttatattttaaaatgtgagttttgaaattaaatattttgaaaataattatagatatgtatttttccaatggatatttagaataagcttaaattatgttgtaatttttatgtttacatcccatcaaaacaaacaaacaatatattagagccaagtctatatttaaattttgcatttctaagagaaagaacttatactccatttagcttcaagaaaattccccttaggaaggtgataattacatacaattgaaacacttgtgatcattacttataagtattttacagaataatttaaaatattttctataatataaagatacagtctgctagttttacagtttattatcaaagtactaaggtattcagctatcttctattaaataataatatttatgccattaaattttaagaagaaaggtgtacaatatgcagcaaatataaacattcattttaatgagctatttatctttttggggtgtgttctatgaataaatacattatctaattagtagattcaattttcgatttatttcagattgtctttagagccattgcatgtgtttgtcttcaactttaaagtaagtttgtttagacattgggttttaaaacctgagcaactatcatcttccagaaggtgttctaccttgtttttttttttttttatggtcaactcacagccaaaattatggaaaggctttatcgttggtcacagatgatgcacagagcattttcaattccagtgtttcatagactcggtgatagaccgacagttgccctcctgggactgtaaacatttttcattctcttttaattatctagatctatattaataaccacagtgacctataagaaggcattgttggccatactataattatatatagcaattatgtgtagtgccaacaatacataaaaatcccaccctttaactacggttggtaagaaatgaaactatgcttttctgccttaggatatagtttcagtttttgaaaaattaagacattccatttttacataaaactttttctggagtatattattatggtaaggcaggtctatttccatggactgacaatacattaagaatattccaataaatatagaaagcatctctcactccagcttcctccttagctacatactggtatttcctattacatactgtataacagaaagggaaatgcaagttcaaagcaaaggttaatctttgtaatgcagaatgtcagagaagatggtttagaacaagtaccaatatatctcttgttctctttgaaaatttatttagtatttcaaactatattatattcacacatgtattcattattctgtttaaataattaaaggtggcaagacatggtgaagtatgagcaatcagtagttttgatttaggtgaagcacccatcaagtaatggcagtagtaattgccatttgccaatgtcttggcaagttgaggtgaaaccaatgtctttagtccgtgttaaagtcaatgcatgtggaatggtatcccataattgacttacttattttttttatgatgaatgggttgtaaacatcagtgcctgtgtcatagatctaaatcttaaaccaattttggcaatttcttatagggccatgactagagaatgatattgtcatattggtttatatcattaaatttttcatattaaaagtgcttttatagtctaatagaaagtaataaaacttttattagatttatacaccaaacatataaaacaatattgatgctctgatttcaatttttaaactcctgacattatcccaagctgcaatgactgttaattcagagtacctcatgaaataggacatttcaacttgcatgtcttgtgagcacctcaaatttagcaggtctcaataccagctctcctttttcatcattttcctcatcttcatgctcaccaactttctcccattttatttaatgttattatcatccatatggtcatctaagatgacctgtgagtctttttaacatcctctttaccacttatttgtcacatgcaatccatcacttaagcctgtgtattttatgtccaaaatgagttgttcagtcattcacgtctgtcaaagaccatcatctgtcacttaggcttccccagcagtttcccatggtctgcctccagtcactcctccaacttgaatttatccttcctactgccatcatagtagtctttctaaaatagagatccaatatcttatttgtgctttaaaatctttatttttcaagcccttaagacacatttggctcttccctatgtagctctaaccaatttttttttctagttctattgtgtcctttgcttctgcaccccttatgctctatattcaatgaaatcccttcatgtgttcatgcattggctcatgttcctttgaccattatgtctgttacctcctttttccacttgcaaatattcaagcaacctaaagtatgtttctatactatactagagctcctttctgttctcttgatactaggtacataacatagaaaatgcataatacaggggtgcatagaacagatcctatggattctaatgatttatttttgtgtctgtgtctcccaacaccacagtaaggactcttgagagcacagatcatatcttgtcactatgaatagtccctgacagataggaagtgacttaatatgtgttgaaagaatgaatgcatgacttaagttattatgagtgcctatagttctatagccaggtttttcaacatactgtgtattatctacttataacctggctatcaccagctgtcaccctctcttttaaaatttatttagcttgaatgtcaagaaatttatatgaatgcctgtggtataattttcctactcattatcataaccataactggcattctctgtgcatatagggtagctataaacactactctcgtaataattagagttacttctgtcatatgctcatgaccaaattctcttgcccttttcagaaagcacaaaagaggatccctttttttcagcctgccttattctctcagaattctaggtttcttactcttgcttgtctgttttctcaacagtcatcccccaattctcatacggactttcttgtccctgtttccagacactggtttctttagtattcctaagactttcactggattcttgaatcttctgctttttcctcatctatttggccttctcgattctaaattttgacagccagttaacctttaaacttgagcttgctaaactgacacctgggttttcactccataatctcccagttctattctttaactgtccaatcagattcttttggcacctgtatttcatatcattctccatttggggaatgaggatacacctgacaaacccacagaatgctttcatggggaaactcagtaacaaatataaatttagagtatattgtgtattctggattgaatccatgggcttaggacttttcaattgatgaagagtatatgaaaggaaaactaggcatttcaggtacatttgatatatgaatgtcacagatatggagtaaaatgtagtcaaaatctcctccctttttcaataagaccaccaataggaggaagataattgatttggtcaaggccaagaatataattgggtcatatcgctaaaacttgcaactttatgtgagaggagaaaagtggtcttgaatcgagaaaaacccagttatttccccttggttttcttcacgcattcaatggttgtatactcaattcctaccttgtgttctaaacattaggaattaaatggtaagtgagagagagagacagagatttatttctgtgcttctttttatcattacactagtacaacctagagatccaattattgactatgggcctagaagaaaaggacagagaacgaccaatgttattttaggccttagagtggggtggtaggtaataggttgaaggagtccagctgtcatatttgagagcggagataaactagtttgcatttacccagagttctttttgcatattttcttcagaaggaattaaaaggtgcccgagcaaggacttgggcctcctagtgtccaaacagctctagcccctaatcacggcaaagcaatatcaggaaagggataagaaagttgaaactgtgtaggtcatgagtaatgagataatatgttttatggtatacaaacacatgggtaattcttggtgagggtagagaccgttcccagaggggaaaaagtacctgtatatttctaatctcctatccaagtactcaccaggtctaaccctggttagcttccaagttttgacaagttagggcatgttgagtgtggaatggccatggactgcacattcctgatctcaatagggaattctagactaaatcttttaaggtaacttgtttctgcaataattcttgcagatgccattgacaagttttataactttcattttgttatgttaaattgggctaataacaacttctcaagaagcctaacaaattgttgatattaggtatcattttccttgctttagtaataatattgaacatttattaagctgataatattaactgcctgagaaattgtgatctaggaatagaaagaatttacctgcatttgttttacatttatgcttaaggaaactgaaataacagcacttggtgaaaaaaatatacgtctatgtccaaattttctagcttttcttcctaatattttcttatgcaaaacactatcagggaactgacatgataatgccagaaattctcttcagaggaagctgaattagtatgtcttaagacctgctctgtgtatttaaacagaatgattgggaaataactaccgtaatttcttagtgataattttgagactttttctccttttgtgcaaaatgttgtagtacatttaagtctagttgtttattacatgacaatagagtatacttttcctttttgtgcttggcagagaatgtacatttatttgtgatgtttatgtagatattaaaaatagatattggacttactatatactaaagcttagttgttctagaaaagtaattttatcgattttaatctttactgctagtcatattgctatttacttatttttctttttaaaaaacaagccaacaaaaaattcctgaaaattgttaattaacagatttagatactgaattagcccaatcaaatgatgtcttaggctattaaccaaagtggtttaagaattacatacatttatttttatttagctatttccaaagtgattttttaatttaaatagtggcttttattctggaataggacatagtaagtaaaacctttaaaaaaaattcaaacgttgtatctttgttgttgttgctgttcttttttgagacagaatctcatcctgtcactcaggctggagagcagtggcatgaagagggctcagtgcagcctggacccccagggatcaagcagtcctcctgtctcagcctcccccgtagctgagaccactggcatgcaccagctatttaaaaaattttttttttctgtagagatggggtcttgccatgtttcccaggctgatcttaaattcctgggctcaagcgattcttctgcctcagcctcccaaattgctaggattacaggcatgagccactgcacctgtctcaaaatttcctttttatacaaggaaccacatttataaataaaaatattttattttttatttgttcaccctactataaagtcatttagatgaaagtagaaactttgaaataataggctaaataaaaatgtgatttatgaattagtttatgaatttctattaagagatcagcaaacagttatgcttaaatcttggatgatgttaccacaatgatgatcacaatgaacattttttgaaaagttgaaccaatcacgttaaaggcttttcacataatttctcatttaatcctatgaacagttctttaatatggtactattattcatccattttacagaggagtatatagcagttgcccactttcccatctgaatatctgaatctcctactggctatcaacttctttgggaaagaactggctcttctttacatattctagcatagtagagcttatgacaacatagttggcacttaaaacacagtgacttgatgaatgaatgagttcctagaaaacagtgagtctgaattttctagtcaagtcatatgtacaacagaagggtcaaatataggtgagttttaaagactcttcttaataagtatgagttagccagtttctcaaccttagacatttacccttgattcccatctatatatcatgaaaatttaatagtaccgattactatgtatctgtttatgtatcttggacttttggaagtccacaaaacattctaatatctaatattgtttcacctcccccatgaatcaattttttgcctctgttggggcagctttgctctgattgagaatatatgagttaagcaatgggtgaagacattgaaatgttgatttcctcagaaaggagggatgtagggttttgctctttgcctaccttctttatgtgcctcaccatcttgttttcacagtgcttccttttagatatctttatgacattgccataaaaggtcatgttggcatattaccttaaaatactgaaaaggtaccattttagaagaacatttgatgatgaagtgaagcaacagccccattgctcctcaccacccctcatgcccttcaggtctgatttaacctgtaatgtgacttcaatattttaaggtgagatcaaccttttctttttggagaggtattcataaaaaggctaatgacccacttgtgctcataaggaatgacacagggaaacctgggggacaaagctaccaacttttcttctttggaggaaattttcccttagcttagcactatccttaaaaataaatcattaaacaagaacaattttgtgacaaggaataaagggaaattggtaaatgaaagtgaaatggtaaaatacagaggtttaagagtttaaaattaaataaattaaaatgtggaaatgtaaccggacccaggttcagctcctcaccacttgaaagccaaacacagaaggtgagggttagtgggaggaaaagcaggttttaattggaaagccagcaaactgagaacatagtgaactagtactctaaaataccatcttaaattttacagtttaccataggattttttaaggggaactttgtatggcagacatgtgggagtggtgcagggtgcagggtctgcgtgtcttgttctcgtggctatcttgtgagttattgctggtctggaagtctgattggcattatcttcactctccccaatagtggtggaatgattgtttgtgactcttgctaagcggaaggactatgcaggggctccatgcctggtttgtagcaagattagattttggaatttcttaagcaagaacataattagattagcatgcattgccagagggcagtgtgtagagagggaaggaatgaagaagtgaaagtggagggaaggaagaaaaagaaagagggtgatatttaaaacctgggtccctggttatggtaataaaacaaaacatctttaaattttaatcagggacacactttaagaaataaagattaaaggtattaaaataaaagaaattgagaggttaaaaacctgaaagtagaaggcagcaaataaaaaagttgaacttgagggcaaaaaaattatttttagtttaaaaataaagacaactagggatttctttatatgcctagtaaacaaaaatatattagaagataaagaaggcttgttggaaatagggagactaaagataaaagaagtaaggatccacttgaagtttgaaaagggggcaatttaaaacaactagcaagaattaaagcaattggaaaccataaaataatggcaagctgctaggctataaaactgtatgttctatgaagatgtaagaaagaaaatatggtggaaaatggggaaaaaaggggaagtttataaaagctccaagctataatcaagtgaggttgaattctggctaaatgtccctgtggagatgtgcaaaatgcatacatttataggagcccatttactttcacctgatcttaggccctgcctgtcagtgtgccacagacttgcccagattggcaaaaaattcatgcccttcggaattttccaaggcaatgtgctctgtgtctcacagtctttccccctcagacttgctccacagcatagataaacacttattttggttcgaggaagagcatttaagtactggcattcattcaaaatatcatttgtatcagtgacattttggtatttattatcatttataacagcaactgttttgtataaatataagtagacctttctacttgacaactgtgacctttaatttcacctggactgcacatattatatataatggagatttaaagagtattatagaaatggatagggggtatcaatttcaaatgtacaatgtcaaaactactagctgcagttgaaatgaaatttatatgtggacacaatttttttttaccttttttggttttgtttttcttttttaaattatttggagataatgagtaaaattctactatattctggtagcatcactctgcaagatttactctaccatacaaatgtatgttttttggtattctattttgaaaggttgtgttgttataatattggtattgaaaatattgatgagttaatattttaaaacataagttagtatttatttggttaggatgaagcagttgatgataatgacaacttttaactgcaggtaaaattgctaaataatacataattacgtacaacttgtggcagctttgtatttagagataatgatgtttaattgggtgtttttcttttaaaatgaaaatgagtttattctttttttaatagagtaatgcatgctcccctttacttcacttttcaaataccaaaacagataaaccctattaacaatttggataaccattatccttttagaaatccctacaagccccatccctccacacccagtcaggatcatataaagactattctgaaacttgctttatgcagttaagaccttgtgactatccttctgtgttagccattccatccttgtttatatatctgattaatattaataaatcatatataataatatatcatcatttttataaataacagctctgattatattttaatatagctctttatgtacttgtctgcttcatttggatttctttgtaatttatgagatttttgtacttttcctatttgtattagatatttatggatacaatatatttctggggttaagttaccttctagaattaaactacgtctatctaagttaccttctagaattaaactaagtctattaaactaaatctatttaagtgcttaatttaaggaaataaggacaatagatgagaagatagttcttgatgcaataatatttttatttctatgtattatatagaaacatgttaattattttagctattgacttgtagtgaatttattttcttctactagagtatatgtgagggtaaacaggaatattccattaatcattgtaaaaatgtatatacattataaatttcataatgccaggatataatgtgataggtataaatgctttcacttaataaattttatcccaagtgtgtcaagttatattttttttacattaaagtaaaaagaatttctgtctgcctaatttccttctacacctttttcatttatggaccactttaactcatggtgattagaaatccttcctcatcttatctcgaaccctcatctcagctcctcgtggactgaggtttattaaatgatttcctgacggccattttgaagactatttatcacctgaaccatgctgccatcccatctgctaccaatataaattgggatgccttatgttgcgagtgactgaaaatgcaacaaaatttgatttaaagatgaaatgaaattattggattaattaattaaaaagatcagaagtaggaatagctgcaggttaagcttgatttgctgccttaaagatattaccaaatacctgatcttaactgttttctgtcttttgtatcagcattatcctcagttcttctttcatggtagcaaaatggctgaagcaattttagacatcatatgctttcacaatgctctctaggaaaagagactctctttccattatctttcaaagaaacaaaatgtaagttctctttcctgcaagcttaggcaaatgcctccctgtgttgcattgactaatcaaattaagtgctaccccagagttgaaaactgttaccagggagaatgaccactgtatcaagaaagctatcaaaacttaccctaaaggtggggataagtttgaactgataatgaaaggagagggttgggggaagattcctttaaaaaatgcctgggtattattaccagaaagaaagggaatgatgctaaataattatacattgtactgctcaagtttccatcactggtgtctctgagttttggcaccgttgttttaaagaccctgttcttgtactatttagtattgcatagtacaaataaaattaccactgatatcaggcattcagccttttatttggcaatattcatcaaatatactcagaacgttgttctatgtcctggacagaccaaacaaaagaaaacacatctcatgatagtttaagtattagattaaatgacctacataatagtaggtgatacgatttctggagcatggtatgtcctcagtagatgatagtctttcattttgcctatttagaataggcagccctccttttcagcaatgtagtgacctgagacagggccttatcaactatgaatatatctttaagacattctttacctactcacctggacctctaagtgttacttatacctattgaaactcacctttgatttctggtgctgtttgacttgagatggggctaatttgttgacaggatgattcgatctccccactgaatctctgctgccatctcttttctgtcttcttaggtgctcacctgtgtgattctagaaggcgggtctgcttcagctctgatcactctctattatcccttcattttcctctaagtaaacaatcattaatcaatagtgtatggtaagagacagcagttttatgtagagaagtagattactcatttgactggggcaagagcttcaggtaaaataaatgattgatactttaagctcactaaattgaaacaatagccatcacattgtatgctttgctgtggtgattcctcagggatctagaactagaaataccatttgacccagccatcccatcactgggtatatacccaaaggattataaatcatgctgctataaatacacatgcacacgtatgtttattgcagcactattcacaatagcaaagacttggatccaagccaaatgtccaacaatgatagactggattaagaaaatgtggcacatatacaccatggaataccatgcagccataaaaaatgatgagttcggctgggcgcggtggctcacgcctgtaatcccagcactttgggaggccgaggcgggtggatcatgaggtcaggagatcgagaccatcctgactaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtctgcagtccggcctgggcgacagagtgagactccgtctcaaaagaaaaaaaaaaatgatgagttcatgtcctttgtagggacatggatgaagctggaaaccatcattcacagcaaactgtcgcaaggacaaaaaaccgaacaccacgtgttctcactcataggtgggaattgaacaatgagaacacatggacacaggaaggggaacatcacataccggggcctgttgtggggttgggggagtggggagggatagcatttggagatatacctaatgttaaatgacgagttactgggtgcagcgcaccaacatggcacatgtatacatatgtaactaacctgcacattgtgcacatgtaccctaaaacttaaagtataattaaaaaaaaaaaagtcccacagcctttaactccttttactgactgtgttgttattttctatacaatattttcttttcttttcttttcttttttttttgagatggagtctcactctttcacccaggctggagtgcagtgatgcaatctcggctcactgcagtctccgccttccaagttcaagtgattcttctgcctcagcctcccgagtagctgggattaaaggcacctgccaccacacccagctaattttttatatttttagaagagacggggtttcaccatcttggtcaggctggtcttgaattcctgatctcgtgatccacccgcctcggcctccaaaagtgctgggatttctatacaatattttctatattttctatttccagatagagtagaccaaagtaattgatgacctcataagcatgtttcataaatgtctctgagagattcactatgtcttattaaacctttgcctgaaatcttcttgcattattagagagaattaaggtcaaaaacaaggaaggaaaagaaataagcagttttatttatctacccatccattcacccttctacactttcatccatctgtccatctaacctctatttactcatctattgatagactagaaagataaataccaaaatgtacgggatataatctcctggtatgccgttggaataaagatgttctttgaaaccaacgagaacaaagacacaacataccagaatctctgggacacattcaaagcagtgtgtagagggaaatttatagcactaaatgcccacaagagaaagcatgaaagatctaaaattgacaccctaacatcacaattaaaagaactagaaaagcaagagcgaacacattcaaaaactagcagaaggcaagaaataactaaaatcagagcagaactgaaggaaattgagacacaaaaaacccttcaaaaattaatgaatccagcagctggttttttgaaaggatcaacaaaattgatagactgctagcaagactaataaagaagaaaagagagaagaatcaaatagacgcaatacaaaatgataaaggggatatcaccaccgatcctacagaaatacaaactaccatcagagaataccataaacacctctacacaaataaactagaaaatctagaagaaatggataaattccttgagatttatcctggataaatgatttttactaggccctggaaaatttagacatccctcatatagcactttttgaaatctgaaatcctagttattttcatatcacttcaaacccttcctggagatattgggtccatccataataggacaaagtttctagtgtagtttatgggttttagtcctcaaccatagcaaaaggacatagctgcagtttggtatgattttaatataagtacttggatagattgggatacatttaataaatttagtgagataactaatcacattctttaactatttaacattttttttattattttatttttttacagatgatagtcatgtacattagtataacatgctgtcaccattggtgaggcattcaatgaactttcaattgtgaatctttaatgtccttgcaagatataaattcatattaaatttcaacgtaatatggaatatatttgactcggatatatgtaactggaaacaactttaacttggatatttgttaaagctcagggaccagcaatgtgggttttcgcgttacactgcctacactatcacttgttgactgtgcaacctttgtattgataactggacttagtacaggcataattttttaatctgacaagtgtacttgaccatgaaacatcaactttactgaactgtgagtggattaagtgagaaacatgtgtcatatagtaaatacttaatggaatatacctatgtttacctagttataattaatatgttacttgtatttctaaatatatttccaatcctggaaccaatttatagttcatcttattgaaaccaaagtttaaaacacttgctttttcattttgtgatgtttaaactgccatataagtaattctggtttataaaagcatctcagttatgataataatagcattttaattttgaaagccctttggaaaagttattttgaatattaaaatattaaaaatgctaaatggcatttgggtatatgaatatgtaagtaaaatattaatataaagttcttgacttatttttaataattatctctttcatacaacgctatcctgttggtattcagattttacacattgactgacattcagactgacttggcagaatatttttatatgacgttattagctttttatgacaactaagcaaagagagcaccagtaagtaactagattctttgagctaggatgattctcaaatcccatcacttttaaaatatcagtgaaaaaactaacatgatttgaaggctagtttaaaataaaataccatcgtttcgagatttggaaaaaatgtatagttaaataaatcacttagtgtcttcttgaactataattctgcatttttgttaggggtaattttaaataaattggttctaaaggcaaaattcaatttaagaaaataaatgttagatttttctatagcataattattatttcctttttttaaaaaaatcttatttcaccctcaagcacatcaaaaagaatagttgccacctagaaagggcctttgtgctttgtatgtgtatcatgctttgtttttctctggtatttcttatcttcatataacaatagcttttagcattgtattttaaattaaaaatgttctactatcaaacttattctagtgagatttcttgcctttcaaaattacagtattttatttcctttaagtgtctcatattcattctgttttcacccttgatagatgtaaagtcatattatagagctatataaaacagggtggccaatctactaaaaataaaatacaaaagcatattttttttcaaaatctcattttttagtaaaacatttgcactcacaatactttagttttgagctttgttttctttatgaagtccagaaaaacattatagatgtctaatttttctcctctggagaaaaataaaataaaatatattacaccccttttatagagaagcacagattatattttagcttaattagctaaaatcacaacagtcatggttatcaatgaataacagtcatacttacagtatgttattgcaatggtgaaacaaattttcagtggcactgaaaaggcaataagaggtagaattcagttaaaattcaatgatgagggaaagaagcatataaaggggaaagaagataaacaaactagacttttgaacaaggtggagtatacatttactgatttttctgtagtatgataaagttagagagacagacaaaatggacttgaaacaaggtatacatcagttgtcatatcgtattgcaagaaaaaattattttttgcactcaagctacagagccctaaacctatcaggccatgtaagggaagtgcttcctgtattaattactaaagaccatgtgagggaactgcttcctatataattactggaaaaaatgatgaaagattgagaactattgattcacatcacatagcataaactttgtgtgaactggcactttaatttatagccctaaaaattcggctaggagactggagctgtcactggacctttgtacaagagaagggtgtggctgctaaaccaagagattaagagcccagcactgtgcaggtcagattgactccatctggcccctagcagtttcaccaaacactgccaggattttccaaaataagtatcccccatcacatatcattactttctgctgaacagattataaagtactatctccaggcatttcctgcgtttattgggaactggaagttttgaatcctcattgacttgaaagagactgccaacaatcaaacctagtcattatggcactcccaccaagactggaaatagccccaaactgctgctggtaattcctgatatcctcagctttcttatcttccatacatattaattttgtcagcagggtagttctttagggccctcagagtgcttctggaacctgtggagattcattaatggagtctggttgtaatgcattcagctaactccttttaaagctatacctgatgtcatgctgtctgttctatgatcctcttttccactgtcacgtgtgtatgtatgttttgttttgtctgtttcttgttttatcacctaattgcttgtctttttatccttgacttgctgttttgtaaagaacttagcatttatatcttctatgcttctctatgccctatattttcaaaggctcattccaaacctaacgtggtcatacactgtggctgaaccatattctaccttcaatgaatgcaccactttgaggatggggacctacaatttttgaagtctcttctgtatctgtgcttccaatattccatttctatgcatgttctcaggcaatttggggttcacacagttataaaataagtttatttctcattcaaacctgggcaatggagatgttcctatttcgatagcttttctgagcatcttttttttttgcaagtggtgacccatggaatctcagggatttaggatctttctaattttgtaatactggtgtcttcgacacatgaccttcaagattttgagaagggtgaaaacagaatgggatgggagttttatggccagccctgggagtgttatacattttcagagctagatgcaaggaagactggacaatgtgtgctaaagttaaagcacatagcggaatctctgtcacatcgtctttctgctttatacttaagctggtccccttcatatttatgaggtggctgcttgctgtataattttatacttaagctggtccccttcatatttatgagttggctgcttcctgtgtaattactaacaggccatttgcagcagcaaatgttatatccagtgggagagaggaagaaaacttctctctcaatcatagattgcaaatcttttcttatagctttggtcagaaagtatggaggaggattgagcaaccagacaaaattaggattttgtaaggagaggaaggagcggtaaatagataccagacagttaatctatcgtgagtatgacaaagaatcaagacagaatggtatcacagaacaaagagagtagagagttttgaaaagatggagtgcccaaacaggattataatgatgctaattttagaaattagatggtccttggaagctccgtataaatagtcccaaagaagtcatgagattatttctcacattatggtttatggagaagtgcatgaaagctgaggaaatgggcccttggtatttattcataatgctgtgctccatgcagttgactttacttcctaaataaatgttgcattcttgatgaaagtttaggctaaatacagtgagccctcaactttgaagataatataagaatattatcataattagagtttacatcatttaaaaatataatttgcttcattaaaaattactattagaaatttataattttgtcggcatatttttttttattatactttaagttttagggtacatgtgcacattgtgcaggttagttacatatgtatacatgtgccatgctggtgcgctgcacccactaactcgtcatctagcattaggtatatctcccagtgctatccctcccccctccccccaccccaccacagtccccagagtgtgatattccccttcctgtgtccatgtgatctcattgttcaattcccacctatgagtatatttttaacttttaaaattctcagaaatctaaagtaaattataattttaacactgaaattatttgctagtgaagatacaaatctatgctaattgctctaataacctagataattaattattatgcattcctaaaatggaatcctattaagttattttactatgatggatgtaatcattttgataataagtaacctacacatttttctagattaatcacagatgctcttctaaagttgtcttaatgtgatgaattataattgttcacttataagcatcaagggtttttaaactctcttgataaccatattcaaattttatcacctagaggtagatttatatttttattcaaaataacatgtcaggtgttatgcgtcttattttctgcaaaatagctaacttgtatgtaattctgaaataaactaaataaatattcaaactattagataagtagtacgtatgtatatatatatataaacccattctatctgaatcaatttaaaggttacttaaattaggtctttcttggactcagtagcccctactgatatcttcaaactgcactttatcctccaaagtcactcaattctttcaaaacaagaaagcccattatttaacagcctcacattgttagatgcgaggaagtcacattgatgacttccttttacctaaggataaaaaccaaagtcctctatacttcatcctctacctccctagctagtctattgccctgttgctctcaactggagtatttcctaagccatatttgtacacctgctgtgtccctgatgcgagcataaagtatgtgagtaaaaaatgtttttgaaatattatctgctttttaaaatgatgtaattcctttttttccatttcctttatcccatttgaaacagtttggttctatacttatgcctgggggaaaaatatgacagaaaaaggagatgggggagtttaaaaatatctttcttaccttggcgctttaaagtgcttaggagcagaaaaggctcactgcatagctacagcacatcagaacaaatataatgagttaagactcatccaccccttttccctttaccttcagataattttatgggagccaggaatgcaagagatctgttcttcatttcctgacaagaccccagaaaagaaattgttgcattgtgtgtctagacagataccatcacagagtttcagccctccggtgtgaagtaggaattgctcaatgattcctgtactcccaagaatgaaaatgaagtggcagaaagagagctattgaaacaaaataggccatagggagaggagggaaccagaagtttccactgagacttgtgtgatatattgataaattatttaagtgatgcctataaagccggatgatatttaggcttttatggtgttacccccagtgttggcataaaatgggaaaccctaagaaattatgctcaaaggaaaaattcagctaatgcagagaaagattaagaacctacatttcttgcattcttgaaattacactctagaattcacatcagctgtggaaatttatacttacttctttgtgtgtatttaagtaatggcataataaaaataatcaattcaccactgaggtccaatcatttcttcccttcaataagtgcccatacgttactaacatctgataacaaaatgaagcccaagttcttttgtaacattttatctttttcttaaaaaaatgaacttatcttagtgcttctttatttttaaagagaataatctacatttcttacttcctctggaaggtctgactccagagaaaggttaaaggttgcgctatatacccctaagtcttttcttatttttattttctccttcattccagaatatctatttagctattgatatgtgccaggcactattttaggtggtagaattccagaagtaaagacagtctctgtcctcaaagaactcaaaatctaactgtatggcatacttagaaaaataatgcaataaccacataagggggcctcctaaagcaaactgtgatgtggaaatgaatgtcaaaaaatctccctatcataggtagcctttgagtatagcattgagaaatgtgtatatttgatgagaaatacttttttggaaaaataattatgttgtttttcattaaatggaaaaaatagaaaaaagtttcaagatgataattgattttcatattaatgaatttatttaattcactgtgatctaccatcaccgtttgcattaaaacatttctgaggaagtcctagccaatgcaatcaagtaagagaaaaaaaatgaaaggcattgaaataggaaaataagtcaaactgtctcttcactgatgatatgattctatatctagaaaattctagagtctcttctaaatggctgataaaactgataagtaattttaggaagatttcaggacccaaaatcatacaaaaattggtagtatttctatataccagtaatgcccacgctgagagtcaaatcaagagcatgataacatttacaacagcggcaaagaaaacaaaatacttaggaatacagctaaccaaagaggtgaaagatctctaccaggagaattgcaaaacactgctgaaataaattagagatgacacaaataaagagaaaatcattccatgttcatggcttggaagaatcagcattgttaaaatgaccatactgcccaaagcaatttacagattcagcactactcttatcaaactaccaatgtcatttttcacagaagtagaaaaagctatcctaaaattcatatggaaccaaagaagagcctgaatattcaaagcaatcctgagcaaaaggagcaaagctgaacacttcatactacccaatttcaaactatattataaggctacaggaaccaaaacatcattgcacttgtataaaaacagacacatagaccagtggaacagaatagaatagaaaactcagaaataaagccacacacatctgatctttggcaaggatgacaaaaacaaatggagaaagggctccctgttcaataaatagtgctgggacaatcggcccgttatatggagaataatgaaactggacccttaccttttaccatatacaaaaattaactcaagatggattaaagatttaaatgtaagacctaaaactatgaaaattctagaagaaaaccctaggaagttcccttcttgagatgggccttggcaaagatttttggactaaggcaccaaaaggaacttcaacaaaaacaaaaattgacaagtaggacctaattaaatagaagagtttctgtacaacaaaagaaattatcaataaactagatagacaccctacagaatgggagcaaatattcacaaactatgcatctggcaaaggcctagtatctagaatctgtaagaaacttaacaagcaaaaaacaaataaccccactgataaatgggcaaaggacctgaatagacacttttcaaaacaacacatacaagtggccaacagacatatgaaaacatgctcatcatctgccatcatcagagaattgcagatcaaaaccatgatgcaaaaccatcgtacaccaggcagaatggctattattatttgaggcatgttctcactctgttacccatgctggagtgcaggtagcatgatcatcgcttactgcaaccgcaaagtcctgggctcaagggatcctcttgcctcagcctcctacaggaagctgggactacatgctgaggcaggtttttttttcctgtagagacaaggttttgctttgttgcctaatctggccctgaacttctgggctaaagcattcctcccacctcaacctcctgaagtgctgggattacaggcatgagctaccatggctggcctgattggctattattaaaaagtcaaaaaacaacagatgctggtgaggctatggagaaaagggagcatgtacagtggtggtgggaatgtaaattagttcagccactgtggaaaacagtttggagatttctgaaagaacttaaaacgagctatcatttaacccaacaatcctgttactaggtatatactcaaaggaaaaccaaaaagacacatgcatttgcatgttaattgctgcactattcacaatagcaaagacatagaatagacataggtggctatccatggtggactggataaagcaaatattatacatatacactgtggaatactatgcagccataaaaagaacgaaatcatgtcctttgtggcaacatggttggagctggaggctataatcctaagcaaattaatgcaggaatttaaaagcaaatagcacatgttcttacttataaatgagaactaaacattgagcacacatagacgtaaacttgggaataacagacactgtggactaccggtggggggttaggtcaaaaaactgcctattgcatactatgctcactacccgagtgcaatatacccaagtaacaaacttgtacttgtgccctctgtatctaaaaaaaggtagctataaaaccaaaaaatcatttctgaaatgctgaatagaaaccttaaaattttctactgattcatacccttacttttaaaaaagttagctttaacattttatccttcacctgttgatatgatttggcttggtgtccccacccaaatctcatcttgaattgtactcccataattcctatgtgttgtgggagggatgcagtgggagataattgaatcatgggggcaggtctttcctttgctgttctcatgataatgaataagtctcatgagatctaatggttttataaggaggagttttcctgcaaaagctctttgcctgccgccatccacataagatgtgacttgcttcttcttgccttctgccatgattgtgagtcttccccagccatatggaactgtaagtcaaattaaagctctgtcttttgtaaattgccagtctcaggtatgtctttatcagtagcatgaaaatgaactaatatgcctttgattaaaattatgcctaagaatgttaacatttactcctagaaacaaactctcttcagcaatatatagtgcctttgtatgtaattcttctgtagcaatcatacaaaaaaaaaatgaaagcacacatgttttcatagtatactctttgttttgagttgaattgtgtctcccaaaacaatatgttgaagttctaatcccctgtacctgtgaatgtgattacatttggaaataacatttttgtaggtgtaaacaagttgaggacattttggattagcatgagccctaatgcagtatgactgatgtccttattagaaaagaagagacacaaacatacgcacaaacacatacacatatgcatgtgcgtgcacacacacacacacgagagagagagagaaatagagaggagagagagagagcaagagcaagagagagagagagagagagagaatgctaagtgatgacagaggcagagattggagttatgctaccacaagccaaggaatgaccaggactattggcaaccaccagaagttaggagaaagtcatgggatggtttctctttcacagcctccagaaggaatatgctgtgctcgtaccttgatttcagacttatggcctccagaactgtaaaagataaatcttggccaagcgtggtggctcacgcctgtaatcccagcactttgggaggctgaggcgggaagatcacgaggtcaggagattgagaccatcctggctaacacggtgaaaccccgtctctactaaaaatacaaaaaaaaaaaaaattcgctgggcgtggtggtgggcacctgtagtcccagctactctggaggctgaggcaggagaatggtgtgaacctgggaggcggagcttgcagtgagccgagatcacaccactgcactccagcctgagtgacagagcaagactccatctcaaaaaagacaagataaatctctggtgttttaatccatccaacttgtattactctgttacaacagccctaggagactactactgtgttctaattgctctgttcataaacttggaaacaaaatctttccaaaaaatacaaagcattccacaagttttgcttttattgttcacttaagtaacttgtaattatttcatgtaattacctaagtgaattattgtcacataattcttgggatcagtcactcagttggagattcaggtatatctattaaagatcaacagtcagtactgcccttagacttggacaaatcctgctcttgatcctcagaggtcctaccatttggagtgacttccttgacatttttgggtctttctttggtgccaggggatgtctggggctgggagtgccatctgccagatgctttgattggcaggttaccgtatctcaatttatcatttttggagtcctctctgatcctcttatgtgtgtgtggattcaacccaatgccctgtggagctcatgaacttgtgttgatggcatcttttcaggactttaatgtctgggttctggttccaggaaggtggcctggttggtggatgttttctgcttactggtatgataattcttttacacgatcatggaagattgagctactggaaccatgctgatttggggtgacttctcattcacattggacatatgacaattcaaagatccaggtgtgggctcttgccaatttttgcctaggttctcacctgttttcattctgacttgcagtgctgattctagtctgtagcacccaaggacaatcaccacaccttctcttcaggcttgtcagcatatttcaggaagacttccaggatgttagagcctatctcccctgagagcttttgctttttattctcttgctccacaatgccagtggaccctctggttcatgttttttcttgtgtccaatccatgtttgtatgtcgtgcacttctaggtcagtgttaagccatgcctgatgcaggacagatattcttgcatgaatggaactactgatgtgttcctaacctaatctccctgctggtgttggtctgcagaaggccaatgtcaatatcaaaaaaactcttattttagaaatgtactcattgtggtctgaagagttcacaatagtcatgtttggaaatgtgtcattttacatttatagtactcccatgctgtaatgtgttgtttaaaatttatgtgttaccattacaaatggtaaagttagcatgactacaaagtaaattattgtttatgcttttctgcgtgccctgggaagacttgcatttgtggtcaacatcaatgaagcatagcaatatcttttgggagtatcattggaaaccaatattcatgatggatgatgcagccttataagcaatagtgtgagcatcaaataaatggaattagggaactgcagagccaagaacatctatattgttcaatataaagaggttctaaagatctatagcattgctatctttttcctgtggctggctgtaagaaattagccaggaatggcatatttgacagaaaagaacaaagaaattgttccaggtcctgaataggaggagatgggggcctggccactataaggaatctttaagtttgttgattggataataaacacagatgtaaacacttttcactctccattattcgaaagctttattgacaaatcaaggtatttcacatgagacaatatattttaagtaaaattgttcatgtagacaggaacctaacaaaaaatatttgcttgggctacctaatttctagaggcaatcctgtcaacagctatttaaaaaggggggtgggaagagagaactgggcagagggaaaagtggacaaagcctcaggcaatccagtggggttatgccccacatctgactgaaatggtttggcctttacacccctgcctctctcagttactggtccctggaggaatatgaccttatacaagttggctctctgtggctgagacagagaaggtgaagaagctgacagctggagaccatctgctgtttgcacaccccaacactgggcagcaaatcctttcttgaaatgggggtctgggcagcacatctttgtgtctaccacaaatataatttcaggacttagtttgagagagatctgtaaatgaaatttaaatatattctaaaatgcccaaaacttacatgccaaatatatatatatatataacaaacttatatatatataacaaacatatatataaaaaaactaatatatatatgttttaggcattttagaatatatttaaattacatatataaatgtatgtatttatatttgttcaaaattatggagaggcagaggcaactaattattgttaatttaataactattaatagcccttgtcttattaaatttaaaacactttgtctaaaatacttgatttcccaattactaattgatatggtttggctgtgtcacctcccagatctcatcttgaattgtagttcccataatcctcacatgtcatgggagggacccagtgggaggtaattgaatcatggaggcagtaaccctgatgctgctgttctcgtgatagtgagggatttcttacaggatctgattgtttataaagggcttttcccccttttgcttggcaatcctcctttctgccgccatgtgaagaaggatgtgtttgcttccgcttccaccatgattgtaagtttcctgaggccttcccagcgatgtggaactgtgagttaatcaaacctcattcttttataaattacccggactcaggtatgtcttcattagaagcatgagaatagactaatacagtaaattggtaccagtagagtggggtactgctataaagatacccaaaaatgtggaagtgactctgaagctgggtaacaggcagaagttggaacagtttggagggctcagaagaagatagaaaaatgtaggaaagtttggaacttcttagagacttggagggcttagaaaactggaagatgtgggaaagtttggaacttcctagagacttgttgaatggctttgaccaaaatgctgatagtgatacaaacaatgaagtccaggctgaggtggtctcaggtagagataaggaacttgggaactgaagcaaaggtgattcttgttatgctttagcaaagagactggcagtatattgcccctgccctaaagatctgtggaactttgaacttgagatagatgacttacagtgtctagcagaagaaatttcaaagtggcaaagtgttcaaaggaagcagagcataaaaatttggaaaatttgcagcctgacaatgcaatagaaaagaaaaccccattttctggggagaaatttgcataagtagcaagagactgaatgttaatctccaagataatgggaatgtctccagggcatgtcagagactttcttagcagcccctctcatctcaggcccagagacttaggatgaaaaaattgttttgtgggctgggaccagggcccccttgctgtgtgcagcctagggacttggtgccttgtgtcccagctgctctagccatggctacaagaacccaaggtaaagctcaggctgtggcttcagaggattcaagcccaagccttggcagcttccatgtagtgttgagcctgcagatgtacagaagacaaaaattgaggtttggagacctctaactggatttcagagtatgtatggaaatgcctggatgtccaggcagaagtttgctgcaggggtggagccctcatgtagaacctctgccagagtagtgtggaagagaaatgtggggttggtgctgcctagtggagctgtgagaagagggccaccatcctctagactgcagaatggtaggtccactgacagttttccctgtgtgcctggaaaagccacagacaatgccagttgtgaaggcagctgggaaggaggttgtaccatgcaaagccacaggggtggagctgcccaaggccatgggagcccacctcctgcatcagtgtgacctggatgcgagacatggagtcaaaggagatcattttgaagctttaagatttgacttcctgactggatttcggacttgcatggggcatgtagccccttcattttggtcaatttctcccattttgaatgggtgtatttacctaatgcctgtactcccattgtatctaaaaagtaactatcttgctttcaattttacaggctcatggttggaagagacttgccttgtctaagaagagactttggacttggaattttgagttaatgttggaattagttaagacttttggggactgttggaggggcatgattgtgttttgaaatgtgggacctgtgatttgggaagggtcaggggcagaatgatatggtttggctgtttccccacccaaatctcatcttgaattgcagttcccataatccccacatttcttgggaggtagcttgtgggaggtaattgaatcatgagagcagctacctccatgctgctgttctcatgatagtgagtgtgttcttacaacatctgatgtttgtataaggggcttttcctccttttgcttggcacttctccttgctgttgccatgtgaaaaaggacatatttgctttccttttgaccaggtatgtaagtttcctgaggcctccccagccctgtggaactgtaaatcaattaaacctcttttccttttcttttttttttttttttttttttgagacagagtctcgcttgttcacccaggctggagtgcagtggcgcgatcttggctcactgcaacctctgcctcccaggttcaagctattcttctgcctcagcctcccaagtagctgggactacaggtgcccaccaccatgcccagctaatttttgtatttttagtagagatggggtttcaccatattagcaaggctggtctcaaactcctgaccttgtgatctacccgcctcggcctcccaaagtgctgggattacaggtgtgaaccactgcacctggccaattaaacctctttctttataaattacccagtctcaggcatgtatttattagcagtgtgagaatggactaatacactaataaatctgataatgttacaatttttaaataactaattttctacatcacttcttctccacacttgggttttaaagtgctttcttaaatatatccatgtctatgtatatctacatctgtatctacctaggtagagcaataatagatttataatagatctaccagggtagatacagatgtagatatacatatctatatattcttaagtttttatttgctacaaattttataattatctaggttgtacatgtgtttcataaaaaataatagtgtaattataaaattaataaaatagcattctgttcttatcctcatcaacttgcttctccagaattaaacacttttacctatttgtctgttacttatctccacatttctaaatagcctccttttaaaatggatttttctggtttaaagtttgtatctctatttcttaatatcggtatcttaacatagaaaacctatattgcttaaatcatcacacacttcttttctctttattcaccctcctatgcactttctttctctccagtctcccaatttgtaattatatcataatgtatcactaattcaatttttagtgttcatataatactcaatatttagtatttacacaatatgactatggaagtactattttcagttgaatcaagttatgataatattttatttttgtacaaccttttttcctggggttattttcattattttctcttgtttaattctatacacctactacgaattcatcctcaaactttttgaaagatgtgtaaaacttattttaatcaaattggtttcatcttctttcccccttggagatagagatctttccagcacccctttggctctgatctggaccacatgctgtctaggttggctgcacagatgtcaacttggagcctccttttggcagcaccttaagaaactttttggcatctctttgttgaatcccactttctggacaccatattttgttccctcttgaattatcttctcatattgatggagtgcattctccatcagctttaggagaaagaaggcaaagaacttgaacattttgagaacttctatttctgaaaatgtctttattattctgattcatacttggttgaacaaatttctaggttaattttttttccttcagaatgttgaagtattgctacaatgtcctaaacttgagaatgtgtgtggggttgtcaagaagacctcatcataagggtgaggaacagtatctatgtaaaggttagaatctacaggtgttctctctaggctggtttgtgttttccagagaagaaggatccagtgctctgctttggctgaaagagagaagatgactgtacagtctcactattcagaaatcaatttcagctaacctctgattctcacccttcctctcagctgtgcctggtatccttaaagctatctctgccatggatcaatgtctttagacagtgaatcttttgcctcctgccaaggaggatgtgtagtttagggaaggagattggagtctagatgctactgatgtaaagtttctaccagtctgcctgttttcagctttactcagtgcctcataatctcatatttttcagggttctgagagaaaaaactggtttgcttcttgtgagtgttacccctacaagctgcttggttttagctttctcaggacagctaaattggttaacattcatatgctttgcagcttctaaaatgttgttctctctctgcttctgttgctcttttatatttcctttaaccttgtgggatttttgtttattccttattgtcattttagctgagatttaaggagaggaatttagcatcttcatttaatgtattctttaaatcacaacttctgatcaataataatttctgcctttttgcctctccattataatgttcctctccctgaaatagtaaatgtcaggaatagcacaaaattctgatcaaatatggcagagtgaaggttttcattacattttctactccaaaagaaattgcgaaaaacaaaaattacactaaaaactcaacacacagaaaataagacaacaatttaagtgaaacggaatcagccacaactctgaaaagaatactttaaaaatagatcaggagatacatgaaatatacagaaaaacatgcaacaagctgtagaagaaagggtgccaagtgcacacccatctgtatatttcttgcagcacatagaagttttctaaaatacattcactatagaaataaaaattaaactagtagcagcaacatataagctctgctgaaaggtagttatagatatggatgagaggcttgaaaaaaatcaataaaaatataaaaacaaatgaagctgattagacaaggggaagaagaaatgaatcatgatgtaaatatcaaacaaggtggatattgatagaccatagactttgaaaatataacagaagagatgaagcttatatgggattttagttcaggacaaacctatgttttcaacgggcgcccatcagaacctcttccatggccaaagggtactaaatagagtcagtgggtaattttcaggataggtgaaactccaatattatgtttgcaatttagagaaaaataacatttattttctaagatactattataatacctagaaaaagtagtctttggcagggggtgggggtaagaattgagtaaagtttgatgttgtaaataaaactataaagtattttaaagtataatttaattttcagaatgggaaacctgttttggttttaccaaaatcgcatatattaacttttaaatttttatatatagtatgtaacagatgtgtgtgtgtgttctatctttcatacattctaatcttgaatgaatgatttattcatttaattgccttctcaatacagaataatttcaccaaaaattatacgtgtaaaaccagaagtgacttgttacttccctactgaagatattttaagtaaacttagcctcactcccctctttgacagcctgagcaagctggaaacctttcctgtaatcctttcttgtatctaaatcaggggtatccaatttttggcttccctgggccacactggaagaagaattgtcttgggctacagtaaaaaacactaactatagctgatcagacaaaaaaattgcaaaacaatttcataatgttttacaaaggtttacgaatttgtgttgagctgaattcaaagccatcctgggctgtatgttgcctgcaggccatgggttggacaagcttgatctaaatgaaagaagtattaactaatctgaaattatagattcttgaaaaatgtcctttctcagtagataagaattttatgtaacatgatacttggtattaaattctaatgagaataagttttacaacagatttaagttgagcttcagatactcaggctgataatatttctttgtaggatttaatttttattgacacattaatgaaactattctctactttagagcagtagggatgacataaatttcattattttaaggaataaattttattaaattttcattaagttactaaactgtaggatgtttaaaatgtttttaacatgatcaatgcagttaccatggatattgctctttattttaaaaccacctcagaataaattgtggtctgctggtcaaccaggcttcccttctactcctcaaaaaagccctgatttgtagaatttgctgatttctgtattaaaccctgcattatggctgattttgagctatcaatctgatgtcactgatggtgactttagggagaaaggtgaacaatgggctctccttggccatgtgagccagctctagcacactactgcattaacacacaggggtgcatcacttaacaagctgagtgtgttctgagaagtgtgtccttaggtgatttcttgtgtgaacatcatggagtgtacttacacaaacctagatgatgtagcctactatgcacctaagttatatagtataggctattgctcctaggctataatctgtacagtatgttactaaaataaatactctaggcaactgtaacacaatggtcagtatttgtataactaaacatagaaaatgtacattaaaaacatggtataaatgattttaaatggcgttacctgtgcagatcacttcccatgaatggagcatgcaaactggaagttgctcaaatattttctttctttatatccttattctttagacatttttttctatttttaaaatgctttataatttttagttttttgaaagtttttgttaaaaagtaagactcaaatacacacattagcaaaggcctactcagggtcaggatcatcagtcaatatcactttcttccacttccacattttgtcccactggacgatcttcagagattatcttcagagataataacaaggatggagctgtcatctcctgtgataataatgccatcttctagaatacctcctgaaggacctgccttaggctgttttagagttaactctggctttttaataagctagagtatactctaaaatgatagaaagtaaataataaatatataaaccagcaacagcattatcattaccgagtattatgttctgtacataatcatctatgttatacttttctgtgactggcagcacagtgggtttgtttacaccagcatcacaacaaacgtgagtattgcattgtgctgtgacattgtggtgtatgacatgactagggaataggattttttcagctcctttgtaatcttatgggaccaccatagtatatactgttcatcattgactgaaatgtcattatgtagcgcatgactgtaatcatctttgtaattttcttttttctcaaaatttatatacacctttaaaaagtcaagtaggaccagaagcatttataatgaaaaatgatccaaacctcattctaccaacatccttcccagacagaagttactctcttgaactgtttctgtttttagttctgccagttattatttcttcccaaatctaaataatttgctgtaaggctattttttgatttggcaataatatgaacacttccaagtctttcaattagaattattttctattatctagtaactttctcccctctattttctctgttctctacaattcctgttagttggatttaaggtcattataagtgatactcttgtcttttcttccatatattttattcatcttttctgctgtttcaacctttttttgattttatgtaccaatcatgtgtttgtatatttgtgctttttctcattttttcttagcattgtcttcttgcttaaataagaaaatattacttgaatttatgaatctaattaaagttatttataatcttttttaattcctgaaatatctgtttttcttttaagttccttttttcctcttgagctatatccttttattgctggttttcacatacttgttgaccttttgttgtctattcatatttagcaatgtgggatgagtatgatttgtctgctgaatgatttgagtgtcctctttacctatatatgaagttttcacactaggacattttaacaggtctttgagcacctttcatagatgtgcaatgtgctcaggcttcaatttgggatttttctggggaactcccaaatgccagaatggagaagccttaaaatctagtgcataacctatcagcctttgttttgctcatgcatttcttttctgtttattaaaaaagatgtgagtgtgtgtgtgtgtgtgtgtgtgtgtgtgtgtgtgtgtttatgattctctttggcagaatgtgttaggctgcctgcactcagcaatttagcaatagaggagagagaatggatggtgaagaggcacgtggggagtagctgcaagatgcagttgtttcatggacagaaactgcaccaatcctatcctcctgcccccatccccagttttccaggcttttgcacagtacctacggattccaagtccagcgcttctttagagttttgccaaagatatatggatctttttcttatgcagatcatttccatgcattctaagtgtagcttcatttttctgtttgatataatgaagacttcagtctgtcttcatttacccccaaatttttgaaatctctcattcatcaaaaaggtccttcttttttactaatttttctgtaattttattccatttttttcctacacaatcatatgaatatgaattggaagtcatgatctattgcacagtgaatccatttggaatcttacaatcagtgaaccatccctgtacctctttgggagctatgtacattgtatcttgtatatgtacagagttacgttttttagattttgatacaaacacccaaaaaaacactgagcaatcccattagggtttttgtttgcttttaaaaaatactggcatcaagaaattcttttattctaaaagtatacctatttgaaaaactcatatccaaaattctggtttgtaaaattatgagcattatatatgaagtttagaggacatttatggagattccttcatatagaacaaaacaaaatcttataaattattataatgtcatgttactggatatgatttcttttttaaaaaccacagtcaaaatataaatctgcattctttaatgcttcctttgacaaaacaatctttagaaaacatttattgtcacactactttggcctgaactatgaattctaatttaatttttatatactctgtgttaaaaataatttgatttggggagaaatttggaggcgcttcaaggcaattgacattatgaagacaaattctgtttatttcttgaaagtttctcttcatatgagtttaattgaatttttttttttttttttgagatggagtcttgctctgttgccaatgctagagttaagtgttgccatctcggctcaccacaacctccacctcccaggttcaagcgattctcctgcctcagcctcctgagtagctgggactacggctacacatcaccatgtccagctaattttttttatttttagtagagatgtggtttcactatgttgtccaggctgatctcgaactcctgacctcaggatccgcccgcctcggcctcccaaagtgctgggattacaggcatgagccatcgcactcagctgtgtttaactgaatttctaaaacttgaatatgattttataataagctataagtttattctctcagtatttcaaaccatataatacaattcttatgcttctatcttataaccatttaaagttatttagttggttagctatttaaaggttaatcctatgttttaacaatattaaatactttatataagaaatgtgttcatattttatagtaaattatcaaaggaatacagccattcaaaaaataaacattatttgccacatttatttctgtgtatactgctatgaatgcaactcattattcttagaatatagtttctctgtattgtagaatatatacttctatgtgtatatgtagcttttatgtatatatgtgatattaaatgaaaattagcacatatatgcatgaatggatgtcaaatgtcccctatttttcatatatacacaacactaattcatatatgtgtgtatgtgatatgcacatactatctttttttgtatatatgtatatatgctttcaaggccagattaagcagaaggatgctcaaatttctcctccctcctcctatgcctgattattctgcaccagaccttcacttttattgagtagctagggttgggctgacacttttcaggctgaaaggcagaaacatttatcttcactgacaaacaatttgtgaataccttccttgggttgtgagacacttgctctaacacaattctcatctgttttattatggagtccctgcaacatttgacatcctcttactgaatttgcgtgttgtgaaccgaatggtaccataggttgattgtaatatatttttttaaagttcatgccaatttttctgtctttgaaatttagaaattaatgtgggattatttcacctgtattttttaggaaggaactctattaatttttcctctgaatataaatgtaatctgtgtttctattagaaaactatgagaatatgagaaaataccaggaagaaataatatctatataatatctatgatcctactaatcaatgataattgctattagtattttatatatattctttaatcatgtatttatgcataaacatgcatgatattaacttaatgctagaatcatgcagtttatgtttgcagacttttgtttgcttaattttgaatgacattaaaggcttggtttttaattgatgcatgatatttcatcttatgtactttctgacatgtgatcacctcctattgttgcatatttacgttatttttatttttgatattctgacttaaaccatgataaaattcatatgtaagggtttatgcacatctacagtagtttttagccattttttaaggttttgtatgtaacctgatcattcctttagcacatttaaaaaataatatccatttgtgttttcttattgatttataagtcattttttctacaatggtgttaatctttgggctatcttatatgttgcaaatgatttctacttttttggttgttttacattatgtgtattttttatatatatactgtaatttaaaatgtccactttagtacagcctctatggaaaactggttggcaatttctcgaaaggttaaacacacatctactttattatctagcaactttatgcataagtatataccccaataattgaaaacatatgcccacaaaagacttatacaaaaatgttaattacgtctttcttcaaaataacaaactattggaaataatctaaatttacgtcaaaaagaatagtttaaaatttgtgatatatttataaaatggactacaactcaggattaaaaggaataaactatgaatttacacaaaaacacagacgaatcccaaaaacatactcattgaaagaagcaagacccaaaataatgtatattgtatgattctcttgctgtgaagttcaacaactggtgtaaatgatttatagtgtatggagtcaggagaatagttgcctccatgaaggggaaagggaatgaaaggaaagagacacatttatttgtcacaaatcaacaaacgctactattatggggctgaattttgttcccccaaaattcatatgttgacattctaacttcctgcacattagaatgtgaccgaatttggagacagagctttaagacataattaagagtaaattgagttcattttggttgccctaatccagtatgactggtgttcttaaaagaagagtagattaggacataaagacacacaaagcaggaccgtgtaaagacacagaaagaagacagctatctataaaccaaccctgctaacatttgatcttgaatttctactttccagattgtgagaaaataaatttatgttattttattacctggtctatggcaaaaatcaaaaatgtttataaaaatgtttaaatatccagaacccaacaatgtaaaatcataatgtttggcatccaaacaaaaattacctggcataccaagaagcagaaaaacatgactccaaatgagtacaaaaacatcaatcatctataaatgatctggaaataacaatgatgatagaattagcatacaagtatattaaaacatttaaataactacatatcatatgttcaagaacctaaaagaaagcttaagcaagtgtagtagacacaatgggaaatataaaaaagacacaaattcaacttctagagacggaaatcatgtctgagttgaataatgtcacttatgtctgttttcctttgcatttatgctaagtgcatacaccatcctgagataaaaatattaaaacaaacttttttgtaatttctttgcaattttcatttcttattgaaatcataccttaaatgtattttgtatataatctatttttctgtattattaaacaatattcagaactctaattgttttgttacccatcactttctcattgatttgaaatgccagtttttaacatttatgagtgcaggtatgtgtaaatgagtatacgaatttaaaagtctctatcataagaagaaatgttctttagcaattaagagtgcaggctaacaaatgactacattctaactgtaaccttgaccacattttttttcatgagtcttgacagtaatctacttgtatgtaataaatgtcatgtggatagttgaacatattttacagggttgctgtgagatttagtaaggtaatgcaagtacagtcttgccttgaattataatagggacattttaagaaattttaaaggaaatttacaattaaatgttaaaggaaatttaaagcatattttatctattctttcatccagaggtatgtgagtgtgtgtgcacgtttgtatgtttaaggtttgtgtattggattttattttaaatgtttctattttgcctcttaaattttgacttagtcttttgtatagttcacattctttcaagaggatgttgatttttttcttcttgtttttactcaaatttgaataaagaaattgctatttggatcaagcattaggttgaactatatgaaatttcgtttttactgtgtaaaaatcctatatagtgggatttcatatggatcaacttaaaattgcttaaaaatcactgagggtagatacataaagaatctccagtaatgcaatggctgggtcaaatggtatttctaattttagatccctgaggaatcgccacactgacttccacaagggttgaagtagtttactgtcccaccaacagtgtaaaagtgttcctatttctccacatcctctccagcacctgttgtttcctgactttttaatgattgccattctaactggtgtcagatggtatctcattgtggttttgatttgcatttctctgatggccagtgatggtgagcattttttcatgtgtcttttggctacataaatgtcttcttttgagaagtgtctgtttatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagacccattactgggtatatacccaaaggactataaatcatgctgctataaagacacatgcacacgtatgtttatcgcggcactattcacaatagcaaagacttggaaccaacccaaatgtccaacaatgatagactggattaagaaaatgtggcacatatacaccatggaatactatgcagccataaaaaagatgagttcatgtcctttgtaggtacatggatgaaattggaaatcatcattctcagtaaactatcgcaacaacaaaaaatcaaacaccacatattctcactcataggtgggaactgaacaatgagaacacatggacacaggaaggggaacatcacactctggggactgttgcggggtggggggaggggggagggatagctttaggagatatacctaatgctaaatgacaagttaatgggtgcagcacaccaacatggcacatgtatacatatgtaactaaccttcacattgtgcacatgtaccctaaaacttaaagtataataataataaaataaaacaaacaaacaaaaaaaagcaacctatcatacattaatgattgaactttaaatatagtaatatgtttttcaaggaaataattactagatggtatttaagacaattcatacattgttgtgttattttattaaaatgatcacatttttataatttaaaaaaaaaaagaatctccaagggctggtagtggaattctgctctatataagttcagtgatactgcacttggagagtaatagggagcagtgagtggaagcactgccaagcatatacatcttctttctccacagtcaggtgtttttggtttttgatgtctctatttttggcaaagccacctcttaacatttttttttctgtatcttgatttcagtttggtttagtttacaatctacatagtcattgtgcttgtgttttttctgcttcttggttttacagtctgttaaggaatagaacctattgatgtcacaatgtcagttacctacttctctgatgtttcggtcagttatgtttgcttgagtgtttcaggacacctgcttcctgatgttaacatacttggcagcagacctttctcaagcttactcttatttccaattattgcttcttaatacagaaagtatcagtggggtttattcactcactctttcattctttcaatcattcgtgtattagttcagtactgacagtatcaaaagaatgtttgctctacttttatgaggtttttgtctataagattaggtaacaattacaaaacaaatggaagcaatacataattccaagctatgatagtgaaaatgttctaacaaatttaaacccactttttcagagatcgatattgaaaatgactctgttttctttcaatatggtcccaacttctgtacatgtagcaaaaaatttgatgaaatgtttggatgatacatttttctaattaccagagtgattcagttttccctattttaaattcctttggtcatttcaatcaggattaggtaggatgtgatgttacagcctgtgtttaaattgacatcctatgtcaaatttattatatatgtccttaagaaattaggatttactttgattaaaatctttctgtgcctcaggaatgagtagtatattttatgattttctaaggataactttctctgtaatttaaaagaacaataaagtgtttatttccttttcttaaaaaaataaaattcactgattcagttaacctagagaaaacaaccattgtgcatagttactgagggagtatgttaataatcactttttaaaacaatgtggagaatgtctgcatcaaaggattctgccatcaccctaagtattttctccctatcttatctttttttctcctttgactaatagctttaacattgatttagttgaataaaacatttgacatttttaaggttcagtgcacaaaaaatactatttaccattcacagggttaggattattttgtattaaccaaaaaagtatgtatgtacatatgtacgtatctatttatctatttatctatctattatctatctatcatctatatatccacatacatacagacacacacataatcatcattgatatttaggatatttgtagttttctttgattagatatactctgtaaacactttgccagtagaaatgtactgtataatgtgacagtgatctataaaaatgcattttatttcattcaaacttaaaactatgcacataatctggttatcttctaaaacaggtgatatgcttctttagattaagatttgccttcttgtgctttcgggaagggtttgaacaatgagtgatatgtgattgaatttatggtgaagaggcagaaatgctcttaaatattataaattccgtagattcatagtacaacattctcttcagctgtgccaaaattatccctgtagaatgtttttatctagtaatagcagcgatgagtagttgatctcatggcaatgtgataccgcccctcatggacacctgctaaatcaccagtatctgttttatctgaagtcatagcttgtggtgacaatgtttaaatgctcattaagcacattaaacatagctaagttcaaagtgaaatttagctggccaaaaacttattactcgagtcttgtaatatgttttgtacaagtctttttcaacttgtacaactatcactgggtgtttatgaaaaagtccaaacaagttttcactatagaatgtttgtgtctttgtacccatcagacctatttggtgtttggcaaacaaagcaagcaatcatgatttttctgacttaaaaaaatgcatgattgagtgatttcttgctacaagaatttagtgcttcactgtgttacaaccgaacaaaaagtgaacactacagttgtccttgttaataaaccatactattaagcatattaatttttgctaaaagcgtggttaaacaaataataatacaagtacataattaatgaaaattattttcaggttgttactgatatttaaaaaataaaaacgttgtaattttaaacaacttaccaaaggacagaaatctaaatactaagtttggtataatgagtcttttaatttcatctttgtacaccactattttaatgtactgacatattttgtgtgttgtaatcgccttggtcagcacaatttttagataaaggaagtgaaataaatcgagtttcttattagcacaatgataccattatatttcttaatttttttttttttttttttttttgagacggagtctcgctctgtcacccaggctggagtgcagtggcccgatcttggctcactgcaagctctgcctcccgggttcacgccattctcctgcctcagcctcctgagtagctgggactacaggcgcctgccaccacgcccagctaatttttatttttttattttttttgtatttttagtagagacggggtttcactgtgttagccaggatggtctccatctcctgaccttgtgatccacacgccttggcctcccaaagtgctgggattacaggcatgagccaccatgcccggcccaaaaacaatcattgtatttctaactgaatctttatattacacaaagtctgaagttccctaaacttggaacttgggaatatcagtgtggatatacatttattacataattatcatttattttcataaatgtaaatacctttatataaatcaatgaaaatttaatattacatttcattttctgtcattatttcttttcatctttaattaacaaaagtttctcagcctttagttaattgctttgttaatgatttttcaaacagaattagaagactttaatatttaaaggaatatttccatattatgaaaaataatactttaaagaatgtttcatttgtagttcttcacaatttggagaagttggagaatgttcagtgaaatagcatataattatgcattttaattaaagtagccaatgctgtgacttaaaaaatggaatattatgcttcagactttacttttcaccgtaaataaaacaaccacagaaatgccagacagaacaggaacattatggtacctgcagtacactcgggttacatacacacaccaaaagagagaatgtgaaaatctagggagagggatggaagctatttgtgtgtgtatgtgcgcgtgcatgtgtgtgtgcgtgtgcacgcaggtgcactcgtagagttacaagtaaagactagaggggctttcctctgcatggttaatatttacatatgtgctaattctgccattgattaggtcagtactattgttaccatggtttttccttttttgacacttctgtcattgtttcatttacggtgaaaacgaaaggctgagaatgggggccatgaggaaacggaggtctgagtagtgagagcagtaggctgtttgaggatggatttggggagaaaacctgtagtctctagaggaaaatccctcaaaagccttaccattaggatgcagaaattaggacgcatagagtgaaaactgctgacagagtatgctcttgaaacatcttgggccatgcacggtggctcacacctgtaatcctagcactttgggaggctgaggcaagtggatcacctgaggtcaggagtttgagaccagcctggccaacatggtgaaatctcttctctactaaaaataacaaaaattagcctggcgtggtggcacacacctgtagtccaagctccttgggaggctgaggcaagaggatagctcgaacccaagaggtggaggttgcagtgagctgagaccatgccactgcactccagcctgggtgacacagacagactccatctcaaaaaagaaaaaaataatcttgaagattggaggaggttttggctagaatagaagagagaacccttccaagatgtataataaacataaagaacaagaatttcagacctctatcgacacacagctgaaaagaaagcaatagtggtttgtttctcttctgcaaaagcaggtggataattaacgtcttcccttgtctatagaaagaaatgtttttgacagttgagaaattgttttttccataatttaagtcctacccactgagttcttcctcactgggggttgacacgtagtaggcctggggagtggatggagataccaactttatggttaccatatgagtcccaggtgccatcgtctgtaagtaccacaaagtcagagttagtttaatccagcaaaaaaagtctattttcatagacaaattctcaatattaaacctgagctatacttgatgtattaaattagtttgatgagaatttttttctgtaattaaaaagaaacgtaacaagaacacagtttacatgggaaactgtctcatatataagtgaataagtaagaattgtaaaagtctttgctattatgtaatttaaattaagttagtgcatattaaattcttttgaagatggtacttgtggtcattcatccttttcatttttatttatttttacatgaaacctagctaatataattatttttacaaagctttactttcttcagtgttttcttattcattaagaagaaagcattatcttcacattacaatttatttttgggataaaaatttgtctagttcaagtttaaaataaagaaaaataagaaacaaaatattgttatgtattgctgctgtttttatttacttctttctttgtcagtaaaatcctcccagtaagccattgcattaccacaagtttttcaattacttaccctcactgatgtcactaattatgatgcattaaccatgagaatgttaatgcagaaaaataaaaacaacaaccagaaaaatcaaaacaacaaatactaagtataagaatattgcgaattaaaagatgcagaatatttccactgagattatgcaaatagaaagagaaaaaatgagttgatgcagctatgtatgtctctgatagttaatgttactgattatagttcttaaattgttgtttttttagtttgctcaatgctatatattttcttgttttacttgaattgtggaaacatttgtgtcacagaagaacaaattaatcccaatgtaagcagtagaaagtgaataataaaattaaaatgaatcaatggaataaaaaacagaaatgatagagacatcagtgaaatgaaaagctggttctttgagaagatttataaagttggtagatatccagccagactgatcagaaagaaagaagtttcaaattcaataacaaaaatgagtgatggttcattgctacaaattttccaaatgtttaaaagataatcagaaagtattaagaacaattttatggtcaataaacacactttgatgaaatgaacaaattccttgaaagacacaaactaccaaagcttactcaagaagaaatcgatgagctaaagagcccctaagaaattggttaggttgagcatctcattttatttcttttttatgaatggtcatttcatatcttttgcctatttctctattagactctcagtacttttttatttgttgggttttttaaattttatatattgatcccttgtcagttttagacgttgcaaggaacttctctattttttattggttaatttcaactatggtgtcctttattgaatggaaatgtttatttttaatgtacccaattttcctcttgtggattttaatttttgaattttattcagatctttccccattcctaggtaaagagatactctagtacatcgtaatttattttctttattgtttttctattcagatatacatatttaattcttctgcatcccaatttatttgagatttaatgtagcaatcctgttcatattggtaattttccgagatctctatcctgttccactggtcactttgttcttgaccaaacagctttattatggtagcttgtaagtatattttcatgttggtataatgagcctccccactttctttggtctttttaaaatcaaaattgacataaactcttcatgcacttttattctaccagatacaccttgattaatcatattgacttcctaaaaaacactgtatttggaattttcactggaattgtgttgaatttataagttaattttgggataattggaataattacattgctaaatggttttattgatgcatatggtaaaattttgttgatctctttcaagccttttaatagaagctttgcgtatttctcaatgaaagtcttgtgcatgctttgtttaatttctttgagtagcttcccatatttttcttgtcttctctttcaggaatgcatgctagtcaaatgttggacctattgtactggctttctgattttttttttatcactttctctcctagttagtccatccttttttcttctatatggtcccactctctgaataacttctttgactttatcttggaaatattaaattggcattttaattttaagtaacatatataattttcaaaaactgttattcctgcataatctttcttcataatattcctgcttatattctgtgagtacaataccttcttttatttgtaatagactattaatcatggaattttaaaaatatactttaattttaagagcagttttaggttcatggcaaaactgagcagaaggtacagagatttttcatatatcccatacccccacacgtacatagcctccttcttatcaacatcctcaaccagagaggtatattcgttttaatttataaacctacatgaatacatcattatcaccaaaagtcgtagtttacattagggttcattctcagtgtcatatattctatgggtttggacaaattcataatgacatgtatccaccattatagtatcaaacagggtactttcactgcattaaaattcttctgtgctctacctattcatatcgctcccccctcgtacccctggcaaacactgattttcttcactgtctccatacttttgttttttctaacatgtcatgtagctggaatcatatagtttgtagccttttcagactggcttatttcacttggtaaaatacattgaagttttctccgtttctttttgagacttgatagctcatttgtttttaatgttgaatgatattccattgtctagctgtaccacagttcattcattcacccactcaaggacagcttggttgcttccaagtgttgaaaattgtgaagaaagctgctataaacatccgtgtgcaggttttcagctcctttggataaatactaaggagagagattgctggattgtatggtaagaaattaccaaactgtcttccaaagtggctgtaccattttgcatctcaccagtaatgaagtagagtttctgttgatccacatccttaccagcattttgtggtttatggtcattctaacatgtgtttaatggtattcattgtggttttaatttgcatttttctgatgacatatgatgtagaacatcatttcatttgcttatttgccatttatatatctttggtgaatctgttaaggtctttggcccattttaaaatcaagttgtttattttcttattgttgagttgttgtaaatgccttttgtttattttagataatactcctttatcagttgtgtgttttgtaaatattttctcccagtctgtggcttctgtttttattctcttgacagtgtctttcatagagcagaaaatttaattttaaggaaatccagcttatcaatttattttgtgaactctgcctttggtattgtatcaaaatagtcatcaccaaaccctaggtcatctagattttctgttatgctatcttctaggagttttatagttttacttttacattgaaacgtgatcaattatggaatctttgcagttttttctgcttgtatcacttctgcttatcttgagttactttttatatgtttatctactttggttcctgtttttttatgtgggaggttttcctttattgtttggtgatcattgtctcaccattatgtctaagaatgaaacactttacgcttgggaggggtttgtgtgatgtgatggcccaaaacaaaccatcattttaactggagaatgccaaatgttgatgtccataggtcttttctctctgtagagaatcaccttccatatacgaacttccaggaatataagcctggtttctggtgacccaaagctgattagcagaggacttggggggaaggtcactactctttttttagaatgtcattttctctttttgtctttagttgggtgccttacctttgccttactttgaaatggggtccaagtgttgaatttttaaaaataatatatcttgcaatttttctatgaatgaggatgtgagaccaaggactctcaggcctaactgcttcttaaacagactagtcaatttctctacttttactttaatttacatgatttttttaaatcctcttttgtatccctctctgtaaacacttaggcttgctctcttctgttttgctaagtcattaccatttctccatctgtttcctgttcattatattgcagggtggaattacaggtgccccttttttttagcaagcatagcatgtgttattactctctttgttttttgttatatctttaccttgttgtgtttaaagcagaagttagatatgtattttttctacaatgcatttatttatagtgctcagattagtctctgaacacagaaagaatttcataatagtttcagattgaacattacaaacatgtaataatcacaatttaactcaacaaatattttactaaatctcggtaactgtgctaggcaatgggaactccattcttgtggataataaacaaataaaaactatatgagaattggagttagtggtaagtgctatgaagaaaaacataggagatatgacagagtggatgtatattttaaagagtttgttaaagcggcctcctccttgtttcttgatatttctttttaaaatattcttgtaacacaaggaccaaatgaatcactgaaaaattcactcagaaataagagtgagacttgtaacggttagtaggggttataatcaccgtacaagaagtatatctcttctcgttgctttgtctgcctttggcgaattggaaatataaacctgtttaatgaatgtgttcttaaaataccctttggaagtttaaattactattgaaaaagctgtataatgcagttatattcctttgtttatgtagctagaagagagaaggaaaagaacctgaggctaatagaaatagattacatttcactatggagcatagattaaaataatgtattttattgtggatctcccttcagaattcaaactaaatatcatttactttttctatttaagtaataacctcagggctctttaaaaaatcattatcagaagataacctaatatatcattgatatagtttcttcctatcattgacaaatatcatattagaaataccacctttttatagtcttgaaataatataatagaaaagggctccaaaaatgcaattgttccagtaaaaatagtcatggtgtattctttattttatcgaaagagaaataatattaaatccttcccttgcatttctttgaaagtgaatacttatttggtctactcgaattaataatttattttcttttgaatgttttgcagatgtttatatatcagtagtttcatttaaaagagctcttaaatgtcagtacttttctactaaaattagtaaacataaacatttaaagtattctaatatcattttaacctattttttaaagaacagtgtaattgatttttaaatcatgacattttaaatcatggtatacagaaagagtgtgattttagagtaaagagtatttttaatttgagaattaaatcaaatggctataaaattgtatctataaaactaggtacacagtgaaattcccattgtcagcatggtcctgtctccacccaggtaccatactccacctgcaagtaaccatttaatatattttttcgtatccttcggaggattcatttatatgcaaacaagcttgaacatacattcttatttgcccttatgtacctaaaatttagcttattttaaggttgctttgaacattgtttttatcacttacgtctaaagttctttctaaattggcatagaaagaacttcatatctacattgtagtattacgttgtataatataccaagattcatttaatctgtttccaattggtacatatcagccttttgtccaatattctgctactgcaatcaatgacctatatttaaattgttttggacataaaactttacagggaaaagccccagaagaggaattactgaatgcaagggtcaagttcttgtaattttggtgaatattaatattgccagatttccactattgtatcatttttacatttttaattattttatattacccccaccaaaaaattgatagtttatttccttacagctttttttttcggggacggagtttcgctctgtcgccaggttggagtgcagtggcgcgatcttggcgcactacaacctctgcctcccaggttcacgccgttctcctgcctcagcctcgcgggtagctgggactacaggcgcccaccaccatgcccggctaatttttgtatttttagtagagacggggtttcaccatgttggccaggatagtctcagtatcttgacctcgtgatctgcccgcctcggccttccaaagtgctgggattataggcgtaagccactgcgcccgacccttacagcattttttcaagattttcggtttctatctatatgataggtgcgtaatcaaatactcacgacagtttttagtttcagttatcttattataaatgagattgagaatgattttaaaagctactatttgtgctttctgttctgtagattttctgttcatatgttttctccatttttcttttgatgtggttatttcagtttctatgagcccttttttgtatgagataatttatttttgtatggtataaactttaaatattttcccatttgtcattatctttcgagtttgcttatagtctataattcttaagttttgaataaaaaattataaaaactgttttcatgcaaacttttgaagggctactcccgtgtttgatagttttatgattgtatattttatattttaatataaatgcatttgtcctggcttgtcatataaagcgtgaatgccactttattttttttccagatgacactgttttgttccaataaaacttttataattattcttttctcgttatatttaagatgtcaccttcatgatatgccatatacttgaatgctttttctttctacctgtggtctatggaactcaaaatggaactcaattttaatatgaccaattttgtttgtaatcctatttatttcttttctgttttaaaatgttattcttcaaaaagacctataatataacattcaaataggaatttttacattatagattttaaataattttcctatgatctatttaaaaattttctcttatattattttctctaaaatattaaattacagattttatttgatgcattattaataaaagttcaaatttatgagtttctaaaggtattttaatagttaattttgacagctatctcatcaacatgtctaaaattttattattttctcttactcctattcctttgtcaaggctcaaatcaggagtcacctctgtttcttacttctcactctgcagtcctattgattctgactactaaaaatatcttagtttcttcacttctctccaacagcaacttggttgtctctatcttagacaaaattgccatcaccactcatttgtgttagtccaacattctccatgtggaagctaaacagatctcctaaagaaatgaaagtaatcttgccccatcccttactaccaacttcaaaaacttgaaaggcttcttaccttgcagtagtagtgtttgaagtactcatatctcaatatctgctaatatgcattaaaaacaaaatagaacaaaacctcatcagttaaatattttaaaaaggcattttaattgtatgtatatgtctgtatttgtgttcattttatttatagtaaggttaaaaaatttgtgctttacttggatatttgttatttgagggaggtgacatatctcttcatataatttgttcatattattttgtcttattttttgtaataatttaattaaaaattttaaaccttattatgccacttagggtctgaatatttttatagttgtatttgacaaaaagatgcttttaagtttttacatttattcacatctatcaatacctttatgagtttgggtgtgtatgtgggtgtgttcactggcaaatatttacttattttattctaacaccatatttatgttacttccttacttttacaattttatctgtaatttgtttttatataatttgaattaggaatatcacagacttttttttttcagaattaatcagcatcatttattgaacaatgctacttttccaccaatttttaaattctatggttatttatattcaaagtcctagtcttctttctattatagtctgaccatctgacactattttaacactattcaaattatgcgcttttaatgtatatttaaatatttctccttatcttaggattttcatcttcaagaaaatctttagcaattcatttggttccttgggaaaacatgctgctggtacttttatttggagtgcattttatttacaatattcttttagagaatttatgtcttttcaatattgatcaatctcatggaagaatatgtcatggcattccacttactcaagtatacttttttatctctcaagaaattcttgccattttcatcatatcagatctacaaaattcctttaaacttatatgtagttattatgcattatattcactgttacaaatattatgttccaacttttatattccttatttcacttaactgtctaaatttattggctatggggaataaaaaatagtaaagctaaaaatgatcacctttatatcattgctgactttaatgggaatgtacctatagttaaaataataagtatgatattacctgtgaatttggaacagccatttttaatcatgattatgaattatacttttatgcatattttaaattttctttttaaatcaaagttttttttacttttagcattttaaatatatctaataaatactttttatgtattactataattgagagatagctcatgaaatcaagatattttagaaaaattcagaattttcctaaccgtaatagtcagagatttggaaagcccaactcttaattttatttttctttgcttattccttcttttcttctattgcagacagttttcttcatgttccaaaaattaagctactgaaagctttggtcgtttgagagactcctctgaagctccttctggctccaagtccagaaatcattcagaaggcttttctcccaacttttggaccaagtagtctggaccaagataaatgtgtttcattgcacaatatggcttatcttgtagtgatatgtgatttttcactggcattagggggcatttcccaagaaaagtactggcaggtggtcttcatttcaagaactctgcagtattttacttgttgagtgctatttgcatttatagtgtaaatgagattagtcaatgggatttttaaaatttactatcagtattatttttaggttttggtatcagagtatcagaaatgttctggcctgataaaatgaagttgggacacttctgtcatctcataattctgtcaaaatctgtgcaggtttctattcagatctttagatacttagaagtgggcaaagtttctatttcctatagtgttattctgttaagttgggtttcagatagccataggaatagagagagttccttagaaggcatctgagttgaagggacactcactttttgctgaccactttcttttctgtggttgtaaaagcagtctgaatttttcaacagtgacgtccccactccacttctatatttgacctgaataccattttgaagaactagctgaaataatgccagaaccttgcctatcatgtcaaatctgtcaggtaatagatgaagatgaatacagtttttagagtctcccttgactatgcccagtagcaattcccaagatctttataggcttgggaattctatgccatattttgcacttgtctaaatctgcctccattcatgctactccaagtttgggcatactcccttcacctttatttggtcttcatatcagttgtttgtaagaaataggaagtaggaaataaggaaggtgtgcagagatatttggtcctatcagaagcttatttttcctttgtctcctccttattttttgttttaggtcaaagctagtttagccattcttatctgcctttcttgaatttgctccctgctttagtatacagacactctgcgccccataaatcatggaaatgagcattaattttacattttgaattgtggactctgcaggtttctaaaattgcttgatttccctaccctccaccaaccaacaacaaatatctactttcttcccgagccctgcttcttcatgctatggacatttctgcagaaactgctagaattctatcactaaccttcctggtggggctctccttagcatatgctctggttttacatgattctttattttctcaactctagttttatatgattcttcattttctcaactcaactgtttctgtgttgaaatatttatatattgataagctgtgttttccagagctgatataatttattcatttcaaaaacatattctcaaacagtgatatcatcaagatagtggagtaggattgtgatgtttaatattgagtgtcaacttgattggaggatgcaaagtattattcctgggtgtgtctgtgagggtgttgtcaaagaagattaacatttgagtcagtggactaggagaggcagacccaccctcaatctgggtgggcaccatttaatcagctgctagcgtggctaggatgaaagcaggcagaggaacgtggaaggactagactggctaagtcttctggcctccatctttctcccatgctggatgcttcttgccctcaaatgtcaaacatcaaattctttggcttttggactcttggacctacaccagtggtttgccaggggctctcaggccttcagccacagactgaaggctgcactgtcagcttccctgcttttgaggttttgggacttggactggcttccttgctcctcagcttgaagacagcctattgtgggacttcaccttcaccttgtgatcgtgtgagtcaatacaccttaataaactccccttcatatatacatctatgctattagtcctgtccctccagagaaccttgactaatacaaggagacactagccttcatctgtccatacacaaaaaatatggacaactatttacaaaccaaaataccccagaagcagcccacagtcacattaaagaatctgcagcaacccagtggagcaaaaatatggagaatatccacatagaatcactggtaagaacagcatacccaagtacctgagatgccagaagaaagctaggagtaaagaagaatggtataggctatcagcatggttcattgacaggaaccgctgtggttaccagtatcctggtccacagagaacacaggcatctcttgccactgaggtaaccaatagcctcaaccactttaacaatcctctgttaaaagaggggctgcacgctcctccccttcaagaagtggccactgttgaaagtagaggtgctcctttctcaaaatgtatacccatctcttccaaccctgagtatatgcactgaccctggaactgtggctacttcacgagtgaccataccccagacctgggctctgtgactacaataggcgtgatcatgtttcatataccacagccattgccatagtgagctagattgtattgcaagacccagagccaagtcctctctgtggatgcccatcctctagacacaagctcagctactctataaagagctaggttctgctctaacctcagggccattttaactctgcatacacctgtgcactcctgcagactcctctgctgctttacaaacaccctttctttgaatactgttacagacttggcagtgggggagtcagtgccccaggtaccagttctattatcaccctgggttccagagccatagccccttcatgtttgcccatgcttcaggcctaacctcacctctctggcctctccatcagataccagtaccaccaccactacaaatgagtacacaagacagatacagttccaggacagattccccttagtaacaacttctctggtatgagaaaaggaggtcatgaggacattaaaaagtatcaccatcaaagactctaacaacacttgctgccactgtggacatatacagtgttggttgctgaggatcccctgaaatcttcatcaacactgacctcagttaccacagcagcacagagactacatttctggcattctcactggtaccagaaaagctgcactttatccagtaagttcccttgcaacaaccctagacaaaggtctttccacatggaaactaacttataaagtctgcaagaggtccaacaaatgtgcagacatcaatgtaaaagcaacaagaaacatagaaagccaataagatttagcattatgaaaagaacaccatgatcacccagtagctaatccctctaaaaatggagatacgagaacagcatgacaaagaattcaaaataattgttttatggaagttcggtgaacttcaataaaatacagataaataattcaattaaataagaaaaataataagcaacaaaaatgatagagaaatcaaaattataaaaaataacaaacaaaacttctagagctgaaaaaatacgatgcaatggaaagtgtcaaagcagaattagtcaagcagaaaaaaaaatctgtgaatttgaagacaggctattttaaaacacaaaggagaacaaagaaaaaaagaaaaaaaattaatgaagaaagcttatgggctttattggatagcatcaaatacaaatattcaagttataagagtttaagaaggtgaggaaagagaccagaggtagaaagctcatctaaagaaatgatagcacaaaactttccaaacccgagaaagataaaaattattcaggtacaagaaggtccaaaatctgtagtcagattaaatccaaaaaagactacaccaagacataatcaaattatcaaaaaacaaataaaaagaggggaccccaaaagcaccaagagaaaagaagcaaataaggtagttccaataagactagcagtgcacttctcagcagaaaccttatagtccatgactaaatggtatgatatattcaaaatgctgaagggaaaaacaacctgccaaccaaaaataagttttatccagtgatatggttgggctttgtgttcccactcaaatcttaaattgtaatccctataatcctcacacatcaagggcaggagtaggtggaggtaattggatcatgggggcagcttccgacacactgttctcatgatagtaagtgagtctcacaaggtgtcatggttgtataagtgtctggcatttcccctgcttgcactcagtccatcctgccaccctgtaaagaaggtgcctacttctcctttgccttccaccatgattgaaagtttcctgaaacttcctcagctatgaagaactgtgagtcaattaaacctcttccctttataaattacccagtctcaggtatttcttcatatcagtgtaagaacagacaaatacatccagcaaagctgtcttttacatatgagacaagatacatacattcccagatgaataaaacctgagggagttcatcatcaccagacttttccaagaaatgctaaagggagctgaaaggatactaatgagtcacacaaaaaccctgaaaatataaaacccactggtaaaagtaagtaaacaatcaaattcagaatactctaataatgtaataatactgtgtgaatcacttgtatctttagtataacggttgaaagacaaaactattaaaataataatagctaaaataatttttaaggggtaaaataaaaatatgtaaattgtgacatcaaaaacataaaatggggggtggaatgaaagcatagatttattttatgcaatcaaagtttttgtctgcttaaaatggcctgtaataactgtaaactgttttatgtaagaattttggtaagcaaaatgcaaaacctatagtagatactcaaaagattaaaagcaaggaaccaaaacatatcactggagaaaatcaccaaatcagtaaagaagacagctaaaaaatgaagaaaggaacaaaggacctaaaaaacaacagcaacaataacaaaatggcagtagtaagtccttacatattaataatgatcctcaatataaatgattacatcttccagtcaaaagatgtaagggggctgaatgggtcaaaaaaaaaaaaaccaaaaaaaaaaaaaaacaagatctaactatatgctgcctacaagagcctcactttacttctaaaaaccatgtataaaagtgaaaggttgggaaaacatattctatacaaacagaaaccaaaagatagcggggatagctaaacttatatcagatacagtagatcttaagtcaaaaactacaaaaagagaaaaagaatatcattatatgataaaggaataacttcattatgaagatacaaaaattataaatgtgcacctaacatcagaatacctaagcatataaaccaaatattaatagatctggagagaaagaggctgcaatacaataatggaaggggacttcaatatccaactttcaacaaagaatacatcatccagactagaaaaataataaggaaacactggacttgaactatactctttagaccaaatggacaaaacagacatatgcaaaccattccatccaacagcagaacaatacattttcttctcaagggaacatggaacattccccaggatagatcatatgctaggctacaaaataagtcttaacacatgtaagaagattaaaatgatcaagtatcttttttttgaagatgttctttcttcacttctctattcatgtatctgccagatttccaaaataatatcagtcatgatagttttatatcaaaagtcaagaaagtatttcactgacataaaatatttaagactaagcatcatgcttggaatatgctcaaattagtatagcataatataaaaattaagcatatgttatttgtgggtttttttctcagtaaataagttgtattttccagtcaggtgattgagtaatggaccatgtcagacaagcactgcctttagatctctgaaatctgccagctaatggctatctctataataatgagttacctatcacctttttaaatctcttaccagccctttccttgcttagtctttgttattgttttattgtaagcacatacacatgcacaacatatgctctgtttcctgcaattttatatacatgtaatattttgagacagctttgaaagttggaaaattgtaaacctttcaaatattttggcttattgactacattttcatgatggataattatatctaattataattatatgtgtatatataattatatgtataccattaagaatagagtattctgaaaacgttttaaattgctgagtctttccagggaatagtatatgaaaaaaattagaatgaaaagtaaaggcaagaaaagttataaatggtaaaataaaaagcagtagtttatactttttaaataagtttacattaaaaaaaattgagttgaagtctcactctgctgcctaggctggtctagaattcctgggctcaagcaatcctcccacctcatcttcctgagtagctgggattacaggcatgtgccatggtgcccagcttgagtttacattttgaaaatacttcttttttcagattcaacaaaatctgcctattgacttgtttaatcctatcaaattaattttcttctctatatttacatttaaaatgcattcttatgtgattatatatttgcagcataatcctattctttctaaagggattttttaaaaaacaaggaagtcatcagaactagagtaaaatgttcattataggcattttgtgagttttcatttctgaacgatatttattttttctacttggcatgtaagcaatttttttaaaaacagcatttcagaggaacagattagatagtgatccaatgaatgaatactttataaatcttgtttttgtacattttattagttccttataaacatattagtgcttgaatgaatgtaaacatattaggacctgataaagtaactatgtgaaaattagccccatagccacattcccctttcatcttccacagagcatcatactaacaggttctaaaaattttaaaaatgaaacagatgaactcattataatatatttaagcttaagatgtcttttgaaaatcactcaaaatttggtaagaaatcatatgtttctaagataaagagaacaagttggaagctttttattccataaatattattaaatgcttataataaaatatgaataaaatgttttaactacttctaattattgatttagccttatttattacatgagaattttttttttgtgttagtcatgtacagggactgtagagataaaatcaaagtaaaagataaagtctttatgtatctgctcaattttgttgtgaacctaaccacttaaaagataaagtatatttttaaaaaagaaactttatcctcaagaggtttataatctaattaagaatattcactatacaagatagttctgtcataaagatataaatcagatggtataatacttttggtcctaatttggctatttttggaaattcctttttagttaattttacctttttattatggaaaatttcaaacacccacaaaagtggaatggtacaatgagcctccatgtaccatactcagcttcaaaaatcattcgttttatattatttacttttttgctcttctctcctctctcatctttcctgagatgtttcaatgcatgtcgtgacatcatgtcatttcactcataattacttcaatatgtatctttaatagggaaaaactttataaagcacataatcataatggcataattacatgaaaaaatagatagtaatttcttgatattatctaatacctaggcctcattcaaattccttcagctgtatagaattcattttagccatacaagctctgaaggaaatatttaagatataaaattaattttattcttttgacgcaataagaagacaattatgagtgctagttttctatgcctgtctcttctaaagcaaaataacaactgtcatcctgaaccgtctctgaattatctacacattccaaacggagtggcagtgtttattctcattttaactgagagatgtcagcaggtgcatgagcttctaaccttgtgatggcaatgtgatgtcatgaagcttttcagcaaaagaatacaattattgtcacgagcatcaatgcactactggtaattgcaatcatttttaaggagaaacaagaggaaggagaaatcttaccgaatgaaaaaaattaacagctctagaccatttttacataaattgcataaaattatgcttgcttatctaacttacctacagatttaatcaaaccacaaattatgttttagactttgaatatttgttacattataaaacattttctcaatatacttgtaaaattatagtgcatatattttaattttagttactcttacaataagaaatgtataacatggctaaaaatgtacaaaaccttaagaaattttttactggctgtttttccctaaagatataatttcccagtggggtaatagtttaaggtttcatagagacaatcttattctagttaaaaatatataaatacatgttattatttcatagaacaaaaattgcctcattttcaacaaaggtacacttaataaattattctacattacttttaatgattgacaatcaatattttaaacacggcattctgataatatgcttttaatttatataggtattttcttgcatgtttatgctattaggccattaattttgcatacataaaaattttgagagattcaaagataaaaatgcaacctgttccctaccccacccagcctggatatggatacatatggctcatatattgtttatatattataaatattgaatgcattcactcaggaaatgcaaatgtttaaaactatatcaagtccattctgattatcctcttatttccaatttttcttttattaagaagcctccatagaagaaaaggaatgcttaataggtttgtggatctcagcaaaattctagggcataataaagtatttgggatatagaggattataaaaaatgtggaatatttcttatttgggaaaagataaagctagaaactatgtttagaaagtttgtaactccttgaactaacaaaagtcacaatgagtcatttttttccttcataggaaggaaatccacatgcatttcaagcaattctaacttgatgaagagaatccattcagatataaagtaatatcaatggaacaagttttagcaaacctccaaaatataattttataattttaatatagggacatggaaataaaagttcaaaatgcattgaagaagaaaaatgaataatgaaagattctctaaatttatattctcagatccctttcttacatatagctatttttgacaatctctgtttttagtttttctggtgatataagttgtatgttttcgtatttcttaatatgtcacctctaagaaaaatccattgtttctccacaatgtgagttaagaattacttttctttccttgttccacttcctactccttaagagtttattttctttttataaatttagttagtaaaagttcagctttatttcagtctccaactattttaaactactatctttcaactacacacaatgaatgacgaagttagcaaccattaactttttttgtgggggagatggagtcttgctctgtcgcctaggctggagtgcagtggcacgatctcggctcactgcaacctctgcattccaggttcaagagaatctcctgtctcagcctcccgagtaactgggattacaggcctctgcctctacatatagttaatttttgtatttttggtagagatgaggtttcaatatgttggcaaggctggtctcgaactcctgacctcaagtgatctgcctgccttggtctcccaaagtgttgggatcacaggcgtgagccactgtgccaggccagcaaccattagcttttgtccagtttcctccatcttcccaaattctatctgatatgctagtactttaataatttcagttattaaaatgtatattagttagaattacctttaattttttactatagattcattctgaaagttgatttcaatgaatagactttataatattatgattatttaactactattgactacatattctggttggatttgtgcataaaaatataatttcttacatttaaaataactaagagtatattggaatgtttacatcaccaagaaatagtaaatgcttgagtggatagatattctatttaccttgatataatcactcattgtatgcctgtaccaaaatatctcttgtaccccataaatgtatacacctactatgtacccacaaaagttaatatgcatataattctttacctctagcaaaattttgctccctgaagtggtatatgcacacatgaagagcaataggattctactcttaaatgtaatgtcttttttagaatcaagtcatatttttgtttgttttatttcaacaaagacttcttaatgttctatttttacaagaatttcaaactgcctttatttttattatttttatcaaaaaatgccttttgttgtataactaatgtactccagctctgttatcacattatgtcttgaatgttccggtatgtaatgatattgtgctaggtcccttggccacctattattctgaaatttctttttgttgtattcctatctgatgtgcaatgtttcttgaattgcagtttatgctcagccaattattctgtcttgaaactgtctttcattttgctctagcgaaagtgtcttccaatcatttaaaggaaaatgcatgaaggtacattttctgaattcttacatgtctgaagtgtctttattttgctttcatattagattggtaataccaatggccagacgattgaatattcagaatcattttctgcaaatagaagacattttaccattgtctttcagaattcatagttgctaatatgaacaaatgctgacattttgcaggtaggggagaagaaagttcatgtgtttctaggctcttcttttgatttttgttctgaaatttaaccaaaattatgtaaatacgtgaaattgcttttgccctttgtggtgtatttaattctgaagactctgatctttagtagccatagaacagttcatgttatctctttaattcttccctctcctctcttaactcctctttttctggaaaatacaaatatggatattgactcttaagtttgttcaggctgccataacatatcaaaatatcataaactgggtagcttataaacaactgaaacttttttttctcacagttctggagactggaaagtccaagattagggtgctggcagatttgatgcctggtgagggccaatgtcatatttatagatggtgctatcttctctctgacctcacgtggtggaagaggcagatctggtgcctgggaaagccaatgtcatatttatagatggtgctatcttttctctgtcctcacgtggtggaaggggcagatctgatgcctggtgaggccaatgtcatatttatagatggtgctattttctctctgtactcatgtggtggaagggacagatttgatgcctggtgagggccgatttcatatttatagatggtgctatcttttctctgtcctcacgtggtggaaggggctagctagctctctgaagtctcttataaggtcactaataccattcatgagggctctgccctcatctaaacaccgcctaaaggcctcacttcctaacaccatcacgctgggcgttaggatttcaacataggaatttggcatggcgggggaacacagacatttcaaccatagcagtgaccttctgtattcatcttctatgtctctattttgttttccttttgtgttttatttttttagtttttcatctgaattggggagatagcttcatttttttactttcaacacttaacattaattttggttttatattcataattatagttttactttctgtgaactcttaatatctgattgcttcttttaaatgacagatttttttttcacatatgccatatatcttctggaatctttctgagaaagccaattataatttgttcttgaacttttgagtttttgtttcctcccttatcagtatgtgtattagtcagcttgggctgtcataacaatatactatagactaggtggctttaataacagacattaattttctcatagttctggaggctgaaagtcctaaatcagagtcccagcatggctagcttctagtcagaactctctttctggcttgcagattactgccttctttctgggctctcacatggcagacagagagaaagaagtatttcttcctcttcttaaaaggccaccaatcctattggttcaggaccccatccttatgaactcatttaaccttaattacctcataaaagccctatctccagaaacagtcacattgtcaggtagagtttcaacatgtgaattttggaggaacacaattcagtccatagcagtatatggtctttgtttttctcgtttctcttgttattgttttgttcatcttcctcagtgcttattgtttgcacatatttattaacgaaggactaaacatattaatgtacatggcttcttttggttttctctgctatcacatttctacaccctgaatgagtgtgctgattgcaggtgccatatatgtggaaaaacatggagtatggaaaaccagcttcttcttctgctccccctacctgcccattggaaagggaaaggaggaaagggagctttgtgagtaaaaagaagataacatctacctacattaagcattctcttgtgtggatgtgatctatgacttcctcgggttaggttaatctatttttgccattttatcttccttcactgcatttctcttgatgtaggtcttttgctcttgctgatatttcaatgattgactgaggatagaagaaaggagccaaaggcagtatgtgtgcccactctattatgttgaactagtaatttaaaaaaaacgagtatgtctgggaggctaaggcaggtggatctcttgaggtcaggaatttgagaccagcctagccaacatggtgacaccccatctctgctaaaaatataaaaataagccaggtgtggtggcaggtgcctgtaatcccagctactcgagaggctgaggcaggagaatcacttgaacctgggaggcggaggttgcagtgagccaagattgcaccactgcactccagtctgggggacagagtgggactctgtcttaaaaaaaaaaaaaaaaaagagtatgtcattaactttttaagtcataaaaatctgtgaagaaacaatatatgggtgaaatattttaaatgaaattacttgtaaattactgtggtgacaacttgtagtacatgccttgtagcacataaacaattagtgaaatagttgttgatgtaaaaaccaccaccgcctcctaacatttattgaacatgtctcatgtgtcaagcactgttttgagtacttaacgttcattaactttgttaatatgcacaagaatcctgtgagttttataccactattaactctattgactacatgttgtagattaggaaactgaacgtaaaacaattaacagacttgcccaaggtgaaacagctactaaatgacaagagccaagattaaattctgtagtctggctcctgagcctgcacatttaattacatcacattgaaaatattataatcacaaaaatgaattttatctgtaaaaattgaaaaacttactggttgttttatagtcactattattaaaatatttattttaaacaaattcagtagtaattttcttgagaagagttactcaaataagatgtgtcagtgttactttctataataagaacattaggcctagctctacccccagcactaccgccaactagttctattaatttgtttaccttctcttctcttcagttttcttttctgttccatgttcatttcattccacaaggaatatatattgactactacattacaggctctattataagagcattggagacattaatgaacagaagaaagagatactttcttcagggttcttatattccagagggagacatagtccagaagtaaatacaagctcaatatagacttttgcttccagcaatgaaaacagcttatttctaagcaattcttccattgagaactggaaacctaagcaaaacataaaatatcatttgttataaagcatgcgagagctactcaagtgagatttacagacatcaaaatctggaaagaatggaaacacctaaatagatgatcttgccagctgaagctgcttttccccttagtgtttttaattccaaagcatctattgaaaggctgggtggctgagcaggaagtggaagctgagaggttgagaacacaccaggattgtcaggaagcgaaacttagaaataaggcctgccaagagacaaactccctggctttcagttgagatgctgaagggctaggagttaagaatcaactagtaatagcccaggcctcagaaggatggaagaccagttttgaataaggtaggccttttaaatactttgtcccatagcccagatgaatgccagaagcaaaagaggacatactgatgattcaaagcaatgataacgattgttgaagacattttggtagaatagaaggcaagggaggaaaataccagtcctgctaagggttgaatgattatgaggttcatactgggttggaaaaggagtaaaagcaggagaggattcattagcccaggagaatgggaatagcttttaaactagaggtcatggtgactggatacagaaagttgtgatcaaaaagctagtttttccagctgaacagttcaaaaattgataatgataaacttcagagtatggcaaagtcaatgggttgctggagtgaaggaggaggtaattaaacaagaagaaactaagaaattgtgtggttaggtcgttggaggaattatccaaattggatagtgaaattgcaaacgatgctagcaggagtaaaaattgagggaagtgcaaagcctcttagaatcagaagtatttaaaacgttatattattagtatttatttaaggagattttaacttcaggcaaaacattcagagggaaaaaataaaaaccatttatcccttgtctaagggtcaatttgtttctctcacccccttcaatttttttattctttaatccttcatttaagaaaaaaatacaatttgaggaaaaaggatcttttaattactttaaaaatccagccaagtattgagagtcgacaaccttaaatttcatagctattattttattataagtaaattgctatgcttcacagtaatttctgaccatggaataatgacctaagctcactgtgcaacatctggtataccctatgttgactaaaaatcaattagaatttttaattatttttgcaacatctgcataacaatctaattcaaagccaaattaaatggtccttctggtgatggtgtataatgacacattcataacttaagaaaactgccctttcccagagcataagacttgaaaatattcagctcgcctttcctgatttagttgccagattatattgatatagttaatggtacacactgttatattttaatagattgtgacaccaaatataagaatcactttttaaattttctgaacacatcttttgactctagcacttaattttcttatcaaactatttttcatagttagccaacagttttaaataatcctcatataattaactgctgataatataatgttcatccttctggcttatcttgagctgttgccagtgctgtttaaatcttctcatgaggagagtcagatgcaaacagaaatataatagagtgaccagaaactccagagacaaagttggatgctcatttctaatcaacacagattcttttttttttttttttttttgacttatccctgaaattttattattaaaattacttgtttgacattgtttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaacttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatcgttgaactagtttacagtcccaccaacagtgtaaaagtgttcctatttctccgcatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtctcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatgtgacttcctcttttcctaattgaataccctttatttccttctcctgcctgattgccctggccagaacttccaacactatgttgaataggagcggtgagagagggcatccctgtcttgtgccggttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggccttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttccgaaggaatggtaccagttcctccatgtacctctggtagaattcggctgtgaatccatctggtcctggactctttttggttggtaaactattgattattgtcacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttatcattttttattgtctctatttgattcttctctctttttttctttattagtcttgctagcggtctatcaattttgttgatcctttcaaaaaaccagctcctggattcattgattttttgaagggtttttttgtgtctctatttccttcagttctgctctgattttagttatttcttgccttctgctagcttttgaatgtgtttgctcttgcttttctagttcttttaattgtaatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaagtcactgaggacttgctttatgaatctgggtgctcctgtattgggtgcataaatatttaggatagttagctcctcttgttgaattgatccctttaccattatgtaatggccttctttgtctcttttgatctttgttggtttcaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcttttccatgtttagcgcttccttcaggagctcttttagggcaggcctggtggtgacaaaatctctcaacatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacatagatttggtcttttcacatagtcccatagttcttggaggctttgctcatttctttttattcttttttctctaaacttcccttctcgcttcatttcattcatttcatcttccattgctgataccctttcttccagttgatcacatcggctcctgaggcttctgcattcttcacgtagttctcgagccttggttttcagctccatcagctcctttaagcacttctctggattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggagtaccctgccgtgtgaggtgtcagtatgcccctgctggggggtgcctcccagttaggctgcttgggggtcaggagtcagggacccacttgaggaggcagtcggcgggttctcagatctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctctacccagttcgagcttcctggctgctttgtttacctaagcaagcctgggcaatggcgggcgcccctcccccagcctcgctgctgccttgcagtttgatctcagactgctgtgctagcaatcagtgagactccgtgggcgtaggaccctccgagccaggtgtgggatgtaatctcatggttcgccgctttttaagccggtctgaaaagcgcaatattcgggtgggagtgacccgattttccaggtgcgtccatcacccctttctttgactcggaaagggaactccctgacccctcgcgcttcccaggtgaggcaatgcctcgccctgctttggctcacgcacggtgcgcgcacccactggcctgcgcccactgtctggcactccctagtgagatgaacccggtacctcagatggaaatgcagaaatcaccgtcttctgcgtcggtcacgctgggagctgtagaccggagctgttcctattcggccatcttggctcctccccttctctaatcaacacagattctaatcacctcagatttcagtttttaatccttgattaattctaattacctagaacaatcatttttatttctctgtgataatttttgacatctctctgttcttcaacaggatgctgttatttaaaaagaaaacaaaaataaaactttcaccaaaattgcattaatctgtacatgatgggtacatgtgattgatctctgttgtttgcattctacatataattgcattttggtaaacagtagctacttttcaatgctaaaagctcagccattaattttctgcagtatagaattctcttgaaatatttcactgtttctcactgctctaattgctttaggaatttcctttaatacatattttgtatatatttttatacgtattttaagtttttctaggtaaatgtaagtccatgatttcttctactatttttggagtttggaattatcttaattttgtcataaatttctgtgaatatttgttttgctggtacaaacaaagatttgataattttctaagcactcccagaagctttgaataaataattttggtaaccacatgatgatatttatgaaatacataaagctcttaaagtttagggcaacctaaaccagtgtgaatcagactttaatgtgcatacttgtcccctggggatcttgtgaaaaaatcagattcagatttagtatgaaggaggtaaggtctgagattatattaatacatttctaataagttgtcaggtgatgcctaagctgctagtacccagactataatttgagaaaaaaagaaataaataactttatgttttgatatgtttatttttatccagtaaaactgtattttagcaagtttattaattttctctacttgtaggttatatgctatcactctgtcctttcaccatagtactttgtagaaaaactgtctaatcttgtttatccagtttttcatcagccctgctgggactatatacaatcaaatttttgccccattactttccatgactgttttcttgatgttctatgtgaacttattcatctccaaatcatggctatttatgctgactggttataggaaattaaggagtagaggacaaagccaaattttaaggagacaaggagcactctacatcagagtaattgtggtaagaaaatctgtggtactagagttgttgacatttaaggagctaaacatggtgttgggcagggaggaaaatcccatgtgccaagaaggatattgtgaaatgagcaccttctgttacacatgaacatgttctcatgctgctagataatgttaaaccatactaattgagttcatgttaatccctcacccttactcactgtagttgtaactccttacgatcaccagatatatatcatatatatgatatatgatatatatatgatatatgatatatatatgatatatgatatatgatatatatatatatgagctatacctggtcatggtcatctttatttttctcttagtcaattgtgaactaggggataaggtgcaatgtgcagcatgggacagtatctatttaacagctctttataaacacacatctgtgtgtgtgtataaattgtttatatattatacacacatacaaccataataatggtttacaccagtttctgcagtttgccttcccatttgatcaccgaggacaatgtatggtcaatttctatccataaccattatccgttattttccctttcgtctacttcttatttgtcctgaaatctttctgcattgcacctaactggtgaaaagctttttcttgcttctcccacagactaaaactctatgaaacattattcatcaacacaatgctactagtatctctaaagtctttagttatgaattcttatctgtaaagtgagtgaggagatgagactagctgaatatctgataagagtatttactcctcaggaaaccgagtattcatacttatattcagagttgaatgcattagtttaaataacaagatattacttgcgaattttcattttcttgaaacaacccacagcaatactttatccttttataggattttgttttgttttggcataattatgttgatactttgaaagtaaccttaaaagcaataataaaattaaagggtatttattgatttcatttacatttttcttgacttttttattcatttgagatctattgtcttatccccatattaattaatcaaatgttaagtcttatattgggaattattgattatagcttcaaaaggaggtttgtttataatgattttgtgtatcccttttccccagtgacttccactgtaagttcaggttgtttaataaagacattgaatattattgatctatgaaatgtcatgccaatttctaattgcttgatttcagtgtaattccatattatatttttattcattcaattgttcattgaattagttgttcagcaattcatatcaacattatgtattatttccactagtcaatacaatgcaatggatatagctcaattgtaggattattatcacagaaatgtatccattttaccaatctctgttattttgtgtctcacaaatcattcttgcattgtaaaatggaatttctgataataagtatatgccacaaatctgtaagattacttaattgattcctatgtttttcatactgcattttaagtttcttttgctttttgtttggaaatccatttgctcaaagttaaaaaaagcaacacaagattgtcctgaatggtattgcctaggttgtcttccaggtttttatagttttaggttttacagttaagtctttaatccatcatgagttaatttttgcatatgatataatgaaggggtcctgtttcagtcttctgcatatggctagccagatattccagcaccatttattgaatagcgagtccattccccattgcttgtttttgtcaggtttgtcaaaaatcagatagttgtaggtgtgtggtcttatttctgggttctctattctgttccatttgtctgtgtgcctgtttttgtaccagtaccatgctgttttggttactgtagccctgtagtgtagtttgaagtcaggtagcgtgatgcctccagctttgttctttttgctttggattcagccattgaggaagacagtgtggcaactccttaaagacctaaggacagaaataacatttgacccagcaatcccattactggatatatacccaaaggaatataaatcattctgttatgaagttgtatgcacgcatatgttcattgcagcactattcacaacagcaaagacatggaatcaacccaaatttccatcaatgatagactggataaagaaaatgtggtacatatacaccatgggatactatggagccataaaaaagaatgagatcatgtcctttgcaggaagatggatggagctggaggccattatccttagcaaactaacacatgaacagaaaaccaaatagtgcttgttctcacttaatgggagaactaaatgataagtgggaactaaatgataagaacacatagacacatagaggggaacaaaacacactggggccttttggagggtggagggtgggaggaaggagaggatcaggagaaataacaaatgggtatgaggcttaatacgtgggtggcaaaataatctgtacaacaatccccattacacaagtttacataggttacataggtaaacttgtgtactgagggtttgttgtacatatttctttgctacccatgtattaagtgtcatgattatttcaggacacttgtacccctgaccttaaaatataagttaaaaacaacccacaaaatttcatttttctctttctgtctcttgtataaatacataattagttcaattaataaagggtacattttaatagaggaatcaacattatatactctttatgaaagaaaaagggaattaaatttaaaaagaaaatattctgtggcaacataatcctagataaccagaagtacatccttggtctaaatagctctgcctgacttgaacattattatctacttcctgtatcatcttacccttgagttcaaattggaccttgtttggcagatgcttatttttctcacaccacaacttacattcccttttgggatctgtgcaatttgtacttgatagctgctcttgctcaggtaaggctttatgatatttttccagtcccgtttcctaatcctcttccctccgtttcctgataagcccatctcaactgtttatttctgctcaaatacattaactattccaaagtctgtactggggcttctaaaaaatagaggtagacttataggaggatccaatcctgacacttaagataattctggtagtgacaataattatgtttttgctcctttatgttactctgatattagtcattaaaatatttaccaagcatactttatctttattttattcaaggtaaggcaagaaacagtaactcattcaaagttgctcggttatttgagaatgcaacatgttgcagaaatgaagtccagctgggcattctggagacaaatgctgagacttctgagatattgaaaaccattagggaaagaaattatgactcttgtcctcttgctctgttcctggggtcaccatcgctctgcctcatactgccttttatgtttgctctatccagcctcctctcaggaggaacttcctctgcttgcattcgatttttgctctgcaataactaaaactcttaaggaacctgattatcataacataactctgtataatcaaatgtccacctctgttccaatacattgtagcagaaggaggaaatgtgtatgttttaaaacatcaaaaaaaaattagtgaaaaagaggctgattgcagacaagtacccgaaacatgaccactgtaatctgccattttaatctatgtcttaataataaagtgatacatcagtcatgttttctttattgacaagaacataggatctcaaagatcttgatataatttcaatattgatgatttaagttgtttcagacaggacagcaattgccagtgaaaagcaaacaacaataagttgtttaaagtgtgagaaaactactttgtaaattaatgtcaactgaaaaaagctaagatgctaaggtgtgtattctttgaaattatattggttgtacaaaaaataaactttgtattaaggctattttaatattttcttatattttccacattattgtaaaagttgaatattagagattattaaatgatgtaagcatctcgtgaacaatatttagtaaatccttattttatgaactacaaataaaatctaggacttaagacatgggttgtttaaattgaaaatgctacttgaatgaaatcagaatgactcaaggcatcgcttctacactttttggctaaaatcaagtgtaaaatgactcagggatagagtcaaggttgcaagagttttcctacattaatatggagacagatgaaaaagacaactattttttttctgcttatattgttgtaaagattttaagttttgaaaaaatattaaggtaacaaatatcagctttgttttttccttgtaaattttttttttacataggtgaccagagtttcatgccattccttttgtaagaactgttaatatagctaaggaaaaattataacagtttctcaagtaacttcttgtgtgttttatcataaaaacccatttaagtgtttctcagcataaggcaattttaagaacttgcattgttttaagataatacagtagccgaatcagtgttatattgtgtaaattttagagtatttttatcttcaagttatttttaatatatgtattgaattttaggtatttaacattgtactttcttctacaatatccctgtagatcattttcatttgagcacactttgagtttgtttattgtataaattcatctctttataacttttgtaatgtaataagggattctttggtattaagagaaactctggatctgagcagggctgatgtggaaaatggggcttgattccaaagggtgatggcagctatttcactgctctctctacagaagggcagttgcccagatagggtgtgtgtcttcaggtctcagcagcttggtagcaagaaactttctctcctgttttataacaatagttacttctaatatatactttgatattggtcttattaaaactcttttaaaaagaaatgtacctaataattgacaattctcattaattttcatttgatctaaaataagtgcactctccttgatattttatgctggcaaaacaaaataggttgtagataggatccattaaaaatgatctcttcatacatatatctaaataaagaaggagtaattctcatttgtgtttcatttatgatttatctttagtgttcttttttgtataatcaatttcgatgtccctttacattgatttgacttaaaagtctataattgtatgtgcaacttttcaataacatgtttattttgttagccaaagcaataaagattagagatgaggtaatccctcccaattctcccctggtattcctcaccaacaattttgtatcatgatctaatattaatcaagatgacattgtgatcaacaatcatatcaaaataaaaagcacagttgtgctgctgatagtgattatacataaataaatatcaggagattaacattgtttatctaaatactgatggggttcaaaacatactataccccaaatatggcaccttgccatttgagaaaacagtagaagtaggaaggtcactctcaccttccccccaacttcgttccccctgaagcaagctttaaaatctagctgacctttccctgaagtaggtcctaagacccttattccagaggtgcttaccctatacccagagaggaatatccttatccctgaaatgcaggagacaaagaagaatctacacaaacaggcctatggcattcccccattagtttattaccattagatcatgaccccttgtccatcatacttctccacaaatacccacttattcatcaaactaagaataatatacagattattttatatctttggatcttcatttctgaagccttctgtgtcatgtaaaacttaaatttgtatgcttttatcttgataatttgtcttttgttataggtgcctcaaccatgaatctacctatgagcaaataaaagataatactttttctcctcacaataccattaaatattgtattacataattctatgggaaagtatatctaagatttgtttgcagctggtgttggtagattatttcccaaaagattgtcatgattcacaaccccaacaacaatggatacagtgctatctttttaatccttgcctgagtgcatgttgtttttctttataacttttctctactcagaagaataaaaaagtcatctcattgttgtcttaacttgtctcttactaacagtgagatagattatctttagatgagtatatggatgatatataatttctgttctgtgaaaatcttattcatattccttacaattttttatttatcattttaatacaaatttataggtacttcttgtcagacatttatttacatgccagaagttttgcacatgtatctcccagcctatcattgttttgtgtgtgtgtgtgtttttttactatttagaaattagacttttgtaattaagtaagcctatattttgtttatggatttgttcctgttttgcttaataagatcccttctaattcaagtttacttttttgaagttttttacattgaaatgtaaaatagtacccagtcttacaagttaaaacccagagacacagagagtttaataatttgttgggtaactctatagctctttttagttactagtaactatgctataatgatcataactattaataatatctggcatctcttctgaacatctgctattaggtactggcaaccttttatactctatttcttttttgagacagagtcttgctctgttgcaccacctggagtacagtggtacaatcatggttcattgtagcctcaagctcctgggctcaagtgattctccaccttagcctcccaagtagctggaaccacagttatgtaccaccatagttagctaattttaaaattttttttgtagagacagggtcttgctatatttctcaggctggtcttgaactgggttcaaccagtcctcccatctcagcctcctaaaatgctaggattatatttatggccactgctcccagccctctatttaaaggccctaaatgttcttcagaaaaccacccttgatagccatgaattgttgctctcactctcaggtccaagctgattttgactggattaagctagtctccacatctcattcccagtacaattagagccagtggatctctagggaaattgagatgaaggtagctaaaaaggagcctttcactattcctcttgatttggtgatgttaagctgcaacacttagaatgtctgccactgtatgcctatgattatggaagccagctgaagatagctaatacccagaagaagcatggcccaaacagagatgctgtgatttataagatgtgaatcaagggtgctttgcttgatgccttgcttcaaaggcaacttgccctttcatttaaaagagccacaagatttccttttttgcagtaagccattttcagatggttcctctttccttctccctgtacatcatagagagtcatcagagacattggttaattatgaaatgcaaactatggaatggaggaagaatctcatccttaaatgtcctgatgcaatctcaagtcaacttaacctaaattatattattatatttaatttacaatataaacacttaccttttactcttggagagtaaaaggagagaataggtacaatgaagaatctacatgtggtaactttgatactatccaaaactttttctaagccttttaactttgtagtgtaagtaatatgacatttttttccctatactgtgtccttcctaagttattttgtaacatcatcatggatcttacttttatgcataaccttttagtttttaacagccaggtgtggtaaggaataaaagttatttttaacattgacctcaggttctttcttatacaaaagcattctgtaattggaaggtagctgagtagacagctttagccatgaaacatgaggccttgaggtcatgggctgaaagagatagttgaactctgtggcatcagaagttatagtgattagagattggggcaagaacgaagatagaaatagaaaatgagggactttaaaaagaggagtttttgatattcagtttaagttattttttgtgctagagaaatatttttagaaagggcactctgtgcgtaggatggcatgttgttcaatgtattgaagcaaatttagctgcagtaggtcacaggtgattcctgataatgcttgaaaattacttttttcagtggaagagaaggaacttaggttactgtctttggtccagtctgcttgcattttggtaggagagaatgctattctgcaataaatagaatgttcatttttatttggaagttatctttttaggcaccagtgactaattatataatcaacagaacctcattttctgaagcagtactgtgcatgttatttcactaaattttttaaaaggtgataatacaaccataacacaaatgtaaaaatgaaagaggcacattaaggtttattgaatgctatgtcattttttatttaaaggtaagttaacagctatattcattttagcaaattaggccattgtttcttttttctattttgcttcaggtatgactactgtatatgccacataaagtagagcatcttaaaagaaaaagtatatatagtatattgatgtataaattaaattgactgctctatttcagataatttttgccaataatgcattttccatggaaaaaacaggctcctttccaaatggaatgaaacacatatcaacttgccagtgcatgaacagtctgtacctagtttggaaaattataagtaacgctggatccaaaacaaaagtatatgatataatgtttaatattttctcaattttttgacattggttggcaattttcctttaaatagtcattgttactgttcttggagaaaacatcagttgtggtaaagcacttttccaaattttgttaactagcttgaccttctttagaaatgacagaaggtagaagatgatactgcatttttccactcacatgtgtgtataatgcttcatatactgctaaatctttatagaagactaaacataaagagattgtgttagaggcaaataacagagtagatattgacatttgggggggtggtaactgagttagaaaaacaccattttgtctgaggtttcagtaactaactgtttaaacatcttctcagctgccttttgtaaagaaaaaaagcaatagtttttcctatgattttttctcccatatttgatcttcattatgatatcttgactactttttaaaataatataattgacaatgaaagacaattttgttggaaaatctggatttctatgatttcttttaaaacaatttgagattgtagtacctgtgaagattgatgttaaaaataattttatgtttcaaaaggtagcaataaattacgaacaacgtgagtgcagtttctttcacctaccatttggctcattaaagaaaaaaagtacctgacattcagtcattttatgaaaaatcatggactaacctttgtagaaatgtaaactttaacaagattatagtatctttgaaactaggagttatgtgacaaccaagttctgatgtccttataagcactctactggatgaccccctaacatgtagtattggccaaatttgtttacaatgtgtttattttgcatttcttcattggatttttttttatactagtccaactagcatgcctggtggtgtgttggaggaagcatggctaaatgtactcttatcgtttttaaaatgtcttgaatgaggcccagcatttgaagccaacttttgggaaatgcagttgggttactgacattggagccttacaactgcagtggaaatatatgatgacttgaaaagaaaatgggaaaacaatggtgacatttagaagaaaattaagtttggggttcagtgttgcttaggaaagtattgttctaatatatagtaaaaatgggagagatcaaagaatctcagtgaaaaaaaatcatagaattttgtgctcactatttgattgaggtagtattttctattcaagaaaatgtgtcagaaactagatagggaaagaaaaagaaataaaggaaaggaaaaaggaaggaaagaaggaaggagggaaggaaggaaggaaggatgaacggacagacggacggatggacgggaggaagtgagggaaactagacagagttatagggcaggctctcgacttttggaaaagggaacttaaccatttctaaaactcattcatcaatattgttcactgatgtcttcactttaaaaatttattggtggctaggaaatatattgtaatagtagtgagtccaactagcatgcctggtggtgtgttggaggaagcatggctaaaatgtactcttatcgtttttaaaatgtcttgaatgaggcccagcaaggtggctcacgccagtaatcctagcactttgggagggtgaggtgggtagatcacctgaggttaggagttcaagatcagcctggccaacatggcgaaaccccatctctactaaaaatacaaaagttagccaggcatggtggcatacacctgtaatcccagctgctcaggaggctgaggaaggagaattgcttgaacctgggaggtagaggttgtagtgagctgagatcgtgccactgtactccagcctgcacaatgagagtgagactccatctcaaaaaaaaaaaaaaagtcttgaatatttaacaataccttttgaaggatccttaaaatagatttcctgacttttacatatgaatgatgaaagatttttttttttttgaaatggagtctcactctattgcccaggttggagtgcagtggtgcgatcttggctcactggaacctctgcctcctaggttcaagcaattcttgtgcctcagcctcctgagtatctgggactacaggtacgtgccaccatgcctggctaatttttatattcttagtagagatggggtttcaccatgttgaccaggctggtctcaagctcctgacctcaggtgatctgctcaccatggcctcccaaagttctgggattatgatgtaagtaaccagcctggcagaaagattttttagaagtataaaggctttgttttaagacaaccaaagatgatcatacgtctcttgctaaacatattaatttcatccatgcatctcatagcaagcattttttttgcatttaaattcactcactctaaaatatatcaaagttcttattcttggagaggtgaaatataagcactgtcaaatcaataaattaatttgtaaacacttatatttgcataagttaacctcaacaaatcatttttgaaagtgacagaattgtcagaattggtttgatttatgactcttgcccatgataaggaaatagtaccaaaaagattaaaagggactgcttttgaaacatttattaccctcctccttctttttttttccaaatgaaagcatttaatctaatcatctccataacatatgatgtatacagtggtgatgaatatactgacgtataccatgcattcagattcctatttttagagattacataagaaagaagtagtacattcaacttaaattcttcttagccataacaattattatttgaaatcttacccctagaatagttttcggtggaaaactggctatatgaaataaaacattaccttttcaatcatttctatgatgagccagtatcttagttcattcaggtggctataacagaataccataaactgggtagcttataagcaacagaaatttgtttctcacagttctaaaggattggaccatgagcaaggtgttgacacattccatgtctagtgaggcccacctgctttctgtttgatagatagtgccttttggcacggtagaagggaacaagacagctatctagcactaatcccattcatgacctaatgaccacccaaaggcaccacctcctaacactatcaccttaagagttaggatttcaaaatacagattttggggaggacccaagcattcagaccacagcgtttcaccccgacactctcaaattcatgttcttcttacatgcaaaatacatttgttctactccaacagccccaaaaatcttaactcatttcagaatctaccttaaagtccaagttcaatgtctcatctaaacatgatctaaatcagatatgggtgagactcaaggtacaattcattctgaggcaaatttctctccacctgtgaatctgtgaaatcagacctgttgtgtgtttacaaattacaatgatggggtagacacgtaacattagcattctagaagggagaaacattgaagaagaactggggcaataggatccaagtaagtccagaataataaagcttgagaataatctttgacttgaggatctgccctctgggccctctggggtcatagccctgcccacatggctttgggaagccccacccttgtagtgtcttcagtgtctctgtgcctgagcctccttgccatgctattgtgattgtctgtgatggcccccacctctgcagcagctctgtgcctgggtcttagcgctcatggcttttctgggcttgaatcttgcgctggtgatgatcagtagtctccgagcagccctgtccttatagttccatggagcatttccctagtggaatgtctctgtggagactctgacaatgaggcaattttctttctgggccctacatttctccagggagtccttctaaatctagatagaagcagccacattcccacaactttgctgggtacagtgcatgctgtacctgggtcagctggagccatcctaggtcagatgagctggtacttgggtcagctggagccatacctgggtcagccatacctgggtcagccccatacctgggtcaattgaggagtacagcaacagagtgcaggaagcagagcccatgatctgaggtggtgctgggcagccctggcccctcctttgaagttgttctgccctaagacccagtactctggccctgtgataggaggggcagctcctgatgatctttgaaatgccttaggggccattctttcattgtcctgatgaatagcacctgactattcataccaatttctttatcaaatagtcacttggccacaccttagtattctttccagaacacactttcttattccttttaatatggataggctgagaattttccaatttttaaagtgttgctttccttcagattaaaatattttaaattctctctttttactgtaagcaaaaataaatcatatttttttcaaatgtagttcactcacaagttctaccttccacaaaatactgggactcaaagacaattcggccaagttgtatgccactttataacacttttaggaggacacaaatattcgaattagcgtacccattatatgattaaaactaaaattctctttgggtcatatgccccttagaaatctttaaagaaatatatggatgaaaagtttagaatgattgatcaagaggaacctagattacaataagataaactcatactatttcactaattatactgtaacatgtatttttcataatggtttgttattcaatcacaaaataatctttttagtatggttcctatataaaatgaaatgtaacatttatcctgtgatatttaaaattgtcacctgagtagtatgtgaaagggatttttttctttaagcaatatattaagcatcaaagacacatgcataatttgaaatagtttcagttcatttcctcctttttatcttttctaacagagcatttatatgttgttcattactaatcattcaagaagaaaacattctcatattcttatattaacaggaaattgaatatggaccattacaatgagggtctatagtaatttaatatgacaaagaccgttagaaagcttcaaaattatttttaaggaaaacactaaccacctcatttatttgtgattttttttttttttgtaagggaatccaaaagtacaatatagtgatattgtgataagactccctatccatggccgggcgcggtggctcacgcctgtaatcccagcactttgggaggccgaggcgggtggatcacgaggtcaggagatcgagaccatcctggctaacaaggtgaaaccccgtctctactaaaaatacaaaaaatcagccgggcgcggtggcgggcgcctgtagtcccagctactcgggaggctgaggcaggagaatggcgtgaacccgggaagcagagcttgcagtgagccgagattgcgccactgcagtccgcagtccggcctgggcgacagagcgagactccgtctcaaaaaaaaaaaaaaaaaaaaaaaaaaaaaaaaaaagactccctatccattttgagaaactacaattgagtagcaaggtgtcagaaagtacaatcagttcttatatcaagattcttacatggtagaattgctggtttagaaaaatcagttcaaatttaaacgataatctgatcaactccttcttggaaaaataaaccttattattcataactttttaaaatttatattagtcaatcattatttattaggttttacaaaaaacataagcaaaaagtatagtaaactgttgattacattttacaatactctcttgtgaacaaagaagaaataataatatagaatgcttacatgcttatgttcatgtatgaagtttcctcagttgtgttgggctaatgtaaattgcccaaacttcttctaaatggcagaaaattagatcacaatgtggatgaacaaacagaaatatctctacatcattactttatataaccagaagtataagcatatattcccgtttgaagtattttgttaacaattaactttgctaaatatttgtaggtattttattgataaatggaaagtgctaatttttcaaatcaattagaatatttcaataaacaataaaagttgatttctaatttctcccaatattacacctggtaaattgctccagattttataatacaaattggagcagatgggactgtgagagtggctctgactgtggcaaatcaattttctttaaacatttcctgtgccagggtagggcccactcccatcatgtcttccctagagaacgccaccgcagcttcacccttccttaaaaataattttgggctgggcgtgatggctcacacctgtaatcccggcactttgggaggctgaagcaggtggatcacctgaggtcaggagttcaagaccaggctggacaacatggtgaaatcccgtctgtactaaaaatataaaaattagctgagcatagtggtgcacacctgtaatcccacctattcgggtggctgaggctggggaattgcttctacttgggtggcagaggtttcagtgagccgagatcgcgccattgcactccagcccgggcaacagaacgaaactccatctcaaaaaaaaaaaaaaaatcctttgaacactggggactctgtgtgcttttctgagtttacattttgtcatctaacctcaggaataataatattccctcccattcttcttcagtttgcataattatgactgtattaatgtttctatcctaattctcaaccaacttggcagtcaaaaaatatatattaaaaagctcagagcgtttgctatgaaaatcaggctagaaaatggccaaattcctataaaagctgtaacacctaaattctaactgtttttacacgtaattgcacttgtttaaaattttaggttcagtgggtacacatgtatgtttgttacatgggtatattgcataatgctgaggtttgggcttctaatgctctcattgcccaagtagtgaatatagtacatgatagatagtttttcaaccctttccctccattcaccctccccatttttggaatccccaatgtttgcatctgacaaaggactgatatccagagtctataaagaacttcaacaaaacaacaagaaaaaaaaaaaaacaaataaccccattaaaaagtgggcaaaggacataaacagacatttctcaaaagaagatgtataaccagccaaggaacttatgaaacactagcatcatcactagcatcatcagaaagatgctaatcagagtcacaatgagatgccatctcatacaagttaagatggctattattaaaaagtcagaaaataacagatgttgctaaggttgtggagaaaatggaacgcttatgtgctgttggtgggaatgcaaattagttcagcccctgtgaaagcagtttggagatttctcaaagtactaaaattagaattactgttcaacccagtaatcctattagtggatattcaactaaaggaaaataaatcattttaccaaaaagacacctacactcatatgtttatcacagcactattcacaatagcaaatacatggaatcaactcagctactcatcagtgatggattggttaaagaaaatatgttatctatacaccatagaatattacacagccataaaagagaacaaaacctttacagcaacatggatgcagctggaggccactatcctaagcaaattaacatagtaacagaaaaccaaataccacacattatcacttataagtggaaaccattgggtacacatgaacataattgtacatttttgtacatttttattctatattcttgccatctttatcttctaggttataggaagcattatgatctgtcacttaagctatattagattttggagtatgtgttttaaagtaattcaatttcctgtatatgtcaagggaagatcacctaattctgacccttaaaaagccctgttttgaaaaattttaatagtcattcacacttctagaaacacttcttcacaaactctagtttctttgttcttgctaacatcaattagtagtaagaattatataatattttatcaatgtattctaagagaagacaatgcctccaagatagtaaagacatgtggatcaaaattaggggtaaaattccaatatgtattataaattttaataactatttgaaatcattttatgtttatcatgtcatttaaaaatactaccagtgtttataaaattattcagtgatattaaagaatgataaggcaggcattaatcaggatcatcatgataggtatagaaaccactgcaatgaggttttgtggtggggagagagattgggctcgactccaaatataacaaggaaaaatgataatttatagccaaggaacagtgtgtgtggcaaggggtcagcggatggaaaattgctaagaagaaacatgaggagtaaggaggaattctggctaaactgacataaaaggattcttgctgaagacaggccaggagatcagacaacacctgtgggatggggtatggtggaggatgaggaacccgattagattttgagagtgaccagatactagcatgaagcagtattcttgctagaattaaacaatgcagaaataaacatggaagctcaaaagtcaaagcctggttgagcaaagagttcagaggaggctgagtaggttcagtcgggagagaatattgtcatcatgtttaaaattcattgctctgtatatctcaattatgtttgaaattttattcatatttttaaaagtaatgcaaagaaacagctttcaccattacaaaatttggctttcagcatataaaaaacaaaagaagacctctaataccagcagaactataacagaaaaacagctttactctgaatattaaagtgcaattataaaaatttaaaaacaatcacatgcacacacataatgataaagtagatctacctgctttactcgtgtaaaataaatatctttatgtctcagattgaatcgctctagtgtttattatatctgtcttgtattttagatttttattaggaaaaattaaataaagggtttgtaagtctacatactaatattctgaagtatttgcttaaaaaagaaatactttataaaagctttatagttagtaaatcaaactattggttgaaaagtgcaagtatttttaaaactaaatatatatgtttacaatcctgccctactgcctgatatttaatatctaaaaaacatcccgcaatcttaacaatctagtaatagactagatgactccttagtcccttttagcagttccttggggacctgtgggaagtctctcttcacaggaacatcttcatttgaagataagagctgttatccatgtgtgctctccatgaagggaggaggttcagagtttgaatggtgctaatgaagttccttgctgtgcaacacagagcacatgcaatttgacgttgatgcaaatgaccctaaatggtgtgatcacttcgtcagactgaatatactgttcctatagcaggtggctattctgcactggcagaaaccgttttaacactttcttcccatttgaacgcagctcttctaacagacaagtataacatattgtaatgtattttaatgatttaaaaacttatattaatctccactttagtaaataccacccccaccccaccaacaccaccatgttttcctgaaatttctatattcttgcttttatctgattagggaaaaactcaatccgtatgtatatatatatttttacttgtagagaaacacctaatatactgatttctcattcaaagattagccaatgtcttttcctggaagctgcctgagaagtaagaaaaaccgaggtgatacattggagttctatttcaatatgcttcttgatattttcctgtgtggcttctaatacccctgtcagattgaacagtgcatttttctgtaagtccatgctctttcctggaacctgactagatcctgcatgctaagattctgtatagaccttgatcaaattcatggacttatcatcacaattttgatttggaaaatgcttttatccttctctttttagtttccatcccatcatctatgtctcatttctgcttatgagctcttaatattacttgccttataagttaaaagtatacctttttaggtgctttcatttgcaaaattttagatatatttaattttgaaattcaaataatgtggtttgtattatttatatttgtatgtttcctgaagatttctgtcaatgttgtaagtcatctggtttgccagtttgattgctaatatttttctctgaaattcttgagaattattccttctcttttctaggtcatcatcctctttcctatttaataatggttaactggagaatcaaagtagatttctcataccccatcatccccaccacatcttttttttttttttttttttttttttttttttttttttttttttttgggacggagtctggctctgtcgcccaggctggagtgcagtgtagagatctcggctcactgcaagctccgcctccccggttcccgctattctcctgcctcagcctccagagtagctgggagtacaggcgcccaccaccacgcccggctaatttttttctatttttagtagaggcgggttttcaccacgttagccaggatggtctcgatatcctgacctcctgatcggcctgcctcggcctcccaaagtgctgggattacaggcgtgagccaccgcgcccggccatccctgccacatcttattaaacttcaactctttagctttgagtcacacatatttttcaatgcatcacattctttccatctctactggcactgatgtaggtcagaccctcatcatacctagcacagattttaggagtcttttatctccttgtcttcaactcttcgcttcctcttcaatctaacctttgttttccacccagtggtagctctttcaaagaaattttcttctaaataaaacctctcagagatacccatgacctacagatttagtttcaaatttttcagcatggtagataaggtcctctgtgacgttaagttgggctaacataatagctcctctttatactttaagtttcattgcaagcctcatgaagagtacttggagttcttccttatgactgttgtttcatgcatttgtgatttttgcggggagaatgggggtgtgctcactcttttttctctttctatacctggcaagcctctgttcatcttttaaatctcaaatatcattgccccctgaaaatttcccatttctctttgggtttcactaagtgattactcctgtgggttcccagtaaatgttatcgcaattcatcatttacgtttctggctgcctcagttcttgaagcagggacttggctgatgtataaccaggacgtgataagggatagacacacaggagacaattaacagatgtttgcgaactgacacaaactttttcattctttttaaatccttcgtcttgaacatatgttcttttaaaatgtattctccaatgtttcaaagtacatttttttgtgtgtctgaatagaattaggattataatgattttggaattaacttacttttgcattgtccatatccttatctgtctgtctgtctgcctgcctgtctatttatgtatctacattagctcaaggttttatatttattttagagggcttccttgaccttctgtaattaatgttttacacattatgaatgtaaccgtagcattcaataggtatactagataagctttctcaaggagaaaaaaataatattcaaattttaaatgataatttagaagcatgatataatttaacttttgaagtatgcaaatgataggctgctattccatcaaaataaaaataacacattcaaaagaattcacattctaacctatgaacttttccttttatttcaatgtaactctcatgcaattaattaaaactcagtggggtattgtggtgaaaattttaatatcatgcagttactttcattaataatatcatttctttggctaagtagaataacaattgagtttatccagctggaaaaagttagacaaagacacataggcaggtaactattgtctattaggtaagaagaaatgcagcttttcttttaacatatatcaaacgacatattctgcattttctaggattcctttaaactgttttatgtggtaactgtcagaagtttagataatttaggtagttatggagttaatagttttagaatatttctgttacaaaacataaatatctttgcgtaccacctataatgtcataaaaccctagactagaaatatctgtttggagacattaaataaattaaattgctaccttaagtaatatggtggattttaagttccaaacaagtcaacaaaaattagaattaaaacattctgaggttttttttactttatactttggaaatattaatcatgtagtctttgtatgtaaatgacagaaatcactatcatgaaaattagatagcagtttttttattaaaatagagtatttattctgcaagttattgcattcattatccaacagtatattaaaatgtactttgatcaccattgtatacttcatcaatgtgcttttgtgcttcattaattagtaactgactgaaagttaatgttcatcctgtgtcagtctgctctagatacatcattttgctattcaaggccaaatcacaaaatgattataaattaccagcagcatttatttgttttacttctcattatgacaaattcaaagatcaaactgatagcatatcacatacatagaataatacattttaatttaataagcaataggccaggcacatttctctatggggaataataaatgaattgattgaaagcagaaggaggttgtaagctttttgataatggtgcagagcttttacatgttgatttgaactttgaaaaaatatgtaatatccttgtctttctcatgaaatatgatgtattttagattttggtttcttgagggtactttaagggttatcttttcttgaaataacatttatttaggcctttagttacacagatttgcattgttggtagtcttcattcagatcacactaattttatttcaaaccatactcacttttgattatgaaacataaaggttgaaatccttcaaatctgaggcatctctctgacctaaatttcagatgacatttaagaatatgattaaacaaattttcaaataaaaacagctggagtgcaacagttttcgtacttttagatactttattttgccactggggaaattatagtaaattaagattaaggattctaagtgaaactctataatcctagtgggttgtttggtattggaaggtaaggaaaagattgttgaaagtcaaagacaaagattgagctctcagatcagtatacaccaattgtagagacaatgtagctggctatccaagttaatggcattagacctctgaaattaaacacgttgccttcagtatgaatctgtagtcaccaagcaaacttctgattatttgaccccctcctagtttttttttcttgcaaggagaaaatatagggtcagttatacaaacagctataattacttttctctttataaaaagggtggaggttacaaaagcattttgcggagacttatgaaataaaatggtgagaatgcaagtgaaaaagacattacaagacaccaaagactggctttttaaacaggcacaatctgaaataaaattgatatgagaatatgcctcagcagaagtgaccttgtcacaaagttttccaacagagctttgcaattcagtagaggtgactcactgaagaagatgcctaaatctaatttatttttaataaaatttattcattcattcacatgttgattggtaattcaacacatatttactacatttttattcaaagtattttgctggtcactggagctacagtattagccatacattccagaactttcttctcaagttgcttatagtcttcctacagcattgtagaatatagtcaatatatatttttatgacttctttccatccttaatttaccttaagtcctcgttcttgccaaccacagttctacaaacaacaacatttcaaaataatttatttaacagttatcataaatataatgaatcatatgtgcttaaataaaacacacatccagtaatttctaaattctagaaatttactgaaacaagattttaattcaaaacttcatcttgctatattataatttctttttttgctcaagttaatttacataagtgtcacttttggccaatgaaatatagtagctaaagtctatgcgccttgtttctccaaaatctttacaaatgccgctatttcatttaagaaaaaaaaattttgttacatattttgcaaaaagcttgaaggaaataaaaactttaaatcttttgcccccccaaaaacttctctgacatattttaagatggctattcagagggcctgcaaacagaagtatgcaaagctatattttatgggggagatttgcatctgtcgagaaaatctgccttgatgcagccaggctttctctgaggctctccctttttcaattttggaaagattaactgagaatctggcacatttaaaagtctgaaacatttaccatttattctctctgagggctgctatctttgaggtttcatctacataaaaagaccacctttgctagccaggcttcctctctcttcctcccataacctgtcttaccatcatcatctgtttttggccatgctctgagccccaattatttctgtaatctcaagatgttatataaacttctgtaccccattaagtggttggagtaattattctgtggttctcccctgtacacattaataaatttgtataccatttcttctattaatctgcctttgtcagtttacttttcagagaaccttcagagggtgaaggggaagttctcccttggcctctataggttccatcatagtttccaaataccaaaattaataatgatattttacctatacagtgagtagttttaagatgccttttgaggtatcaaattaatatttattattaatgtgtcaagcaatgtgttatttgtcacagaggcaagattgccagatgccagcttcattagagtgtaaaatttagggtactaaacattgatgatcactgggaagaattccagatgattgaagactgtgaagccaattgagttttgagcattaaatgaagtgttattaagaatgatctgacctcctctcatgaattgtttcttatgttttctctgttgtctctattgtaatttttgttcagtggaaattaaagtcactcaaggtctcaaattaaataataaaattgaaattgcacatattttctccttttgtggggaaagaggtactgagacaggaataatacatggtggttgcaggagaacagaaaattccaggcagcagtttcacatgacatattttggtaatgggtcctagagatgaaacataactaattttagtatgtttcatcatgttacataggcttcagtgggaaaacaaactctgtggacaacctagttacttattgcctttgaatatgaaatatttgactcagaaagttgacctttaaaaagtattagctttatatcatctaaattgagcaaatgtgtataggaaaggttatgtctcctcatggtcattctttatattattaaattttaatgatatgtttatttgttctcttaggagaaatagtcacaactaaaatattctttccagaatttaaagacttgaaaaacaaatatagttttaaaactcagtttacttgtaataatctaaaaacacaaatagcctaatgattacagagtgaagaagaaggacaattcttaaggcagtatttctggagggttatctgagaattatatgctgcttcttgcttgctttcttgatacgaactacaaattacttacaattccaaactattcccaagctcaactgacataaactacagttgtcccttgaaaaaacatggcattaaactgcgcaggtccacttatacttggaccttcttccacctctgccagccctgggacaacatggccagtatcctcctcttcctcggcctactcaacatggtgatgacaaggatgaagacctttatgataatccactgccacttaatggatagtaaatgtaatctctcttctgatttttagaataacattttcttttctatagagcttactttattgtaagaatacagtatataatacacgtaacatacaaaatatgtgttaaccgacttgttgatgttatcagtaaggcttcttgtccgcaagaaggctattagtagtttgttgttggttttttgttttgttttgttttgtttttgagatggagtcttgctctgtcacccatactagagtgcagtggcacaatatcggctcactgcaacttctgcctcctgggttcaagcaattctcctgcctcagcatcccgagtagctgggtttacaggtgcctgccaccatgaccggctaatttttgtatttttagtagagacggggtttcaccatcttggtcaggctgacctcccgatccacccgccttggcctctcacagtgctgggattacaggcatgagccgctgcgcctggcctattagtagttgtgttttatgagtcaaaggttgtatgcagattttctgctgtgtaggaattggcacttctaatccccatattgttccagggtcaactgtattggtttaaagttcatacttaaaatttttttctctttatattttttaatttaatttggctttatataaaatattgaaataactgaataattgttttagactcttagccaatcccctttctccaactctccatttcaagcatcctccaactctccatttcaagaaacctaacacatacgttatgcatctcagatttgcaacattatattctttcttcctgaggagaggatagaattttgaggattttccaagtcttcagccatggattctctgcatcatcttttatttattcccttttcctaagtggttcaaaatcatcaattttagaattaattttgcctcattgatatgaaggttttggattccatatatttgcttaacaaatgttcactgagctcttctatgttcctagtattgtggtaggtgctgaatctgcctcacctggctaaatgaaagtatagtatagataaggtgttcttccaaagctttatatctttcagttaccaactttctccatccaatttatgctgtaattgtttgtgacaatgtgggaaataggaatgatgatgtattagtttgtagaagtgtgaattgtctggagagaaatttggccgtacttagtgacattaagcatgcatattccttggactccaattattgaatttttacccgagagaaattttagcagaagtttaaagacactctctgtccttttccttttctcgctatgtgttgtagaggcaaaggaaaaaacttttaccttcactctctgaaggttcacttaaaagttaattgataaaaggcaaattagtatgagaaatgacatacaaatttattagcgtgcagggaggaaaaatcacagagccattactccaccacacaatgaggtacagatttttatatatcctttgtcttaggggaaagtgagatggggaagtgtggatgattttaagcaaggagagtaaatgattgtagggaaatgcaatgggcttggagaacataaaatggcctgggacaaagtctgttgggcctgcagaagaggcaatggttttgaaaaaagtttgtccaggtatgttgacagatttcagtctttcttcctgtcatatgagttcagttaatgaaaactcagggaagggaccagaggtaattgttttcttctttggtggatctgaactttaaccagaaaagggaatttcagagaccaacttcatccagtgttttggaagagatggaggggagagagaccttgaggcttctttttcagttcatcatgttaaaatgccatattttggagtatcagtttctgagccctaacattgtgtacatgcatgtatatgtgtgtttacgtgttcatcataaatttagaggctaaatacaactttaaggtgaaacgctagggtgtatgcctatgatgaattactatggagcaattagaaatagatatctacaaaccaacatgaatggttcccattaacacagttttaagtaaaaaagtatgatcaactcaccttaaatctgaaatgaataaagtcaggtgctgcataaaaatatttaggtcaacaatcagctgtacaaatgtatatgacagtggtcccataatattgcaacatcatattttactgtaccttttctatgtttaaatgtttagatacataaatacttaccattgtgttacaattgcctatagcattcagtacagtaacatgctatacaggtttgcagtctgggaacaataggctataccatataccatcagtcctcaacctttttggcactggggactagttttgtggaagacaatttttccatgaaccagggtcagggtgggggatggtttctggatgaaactgttctacctgaagtcatcaggcattggttagagtctcataagaggcacacaagctagattcctcgcatgtgcagttcacaaaaaggtttgcacacctgtgagaatctaatgccactactgatctgacaggaagcggagctcaggcagtaatgctcacccttgcctgccacttacctcagcccagtttctaacaggccacggaccagcaccggtctgtggactggggttgggacccctgccataggtgtgtaataggctgtatcatctggctttgtgtttggtacactctatgatgtctgcacaatgacaaaatcacctaataatacattttgtagaacaaatccccattaagtgacccagatctataatttaaaataacagtgggaaaccaaactagtataataaactcatttccaggccgggcacagtggggctctcgcctgtaatcccagcccgttgggaggctgaggcgggcagatcacgaggtcaagagatcaagaccatcctggccaacatggtggaaccccgtctctacaaaaactacaaaaaaattagccgggcgtggtggtgcacgcctgtaatcccagctactcgggaggctgagacaggagactctcttgaacctggaaggcagaggttgcagtgagccaagatcgtgccactgtgctccagcctggcaacagagcgagactccgtctcacaaaacaaaaaagcaacaacaacaacaaaaagaaacttgtttcccacccaaaagctggcagaaaataatttttaataatttcctgcatattatttatctgttttttgttttgaatgttgtatatttttctcaaatgattaccaatttcttagttttatatattgaactctttattgaataaaatctttgatctcattttatttatttttcccacttgggtaattgattaagaatgtattctctgctaggttacaataatattctcctgcacatccttttaactttatggctttatatattgcattcaggtgtttaattcacttacagtgcatatttgcaattggtgctagttggttcagcttttttcgcaataacaaataacttcaaaagctcatagacttaaaacagcaaaaatatatttctcattcatttgcgtgaaaagtgcaggtcaacactcatgggctctgccatcatgttttcatgttgtaactagactgaagaggcagaggcagcctctatcttagaaatataacagctgttttatcaaaatctgtccacctctagtctttaaacttcataaggtaagggacagagtctgtattttctactttctgtgaaacccttgtttatatctttcgctcatttttctatgtattgcttctgttttatcacaaatttgaaaggaaattttaaaaatgtttctatgccaatcttctgatgcttatacgcattttccgtatcttgccaactgtggctggttttctcactttgattatgccatgttttgatgaaaagttgtttatatttaaatggagttgagtttattaattattttcttcatagttataatttttgtctcactgagggaattcacgctattcaaaaataacaaaaattatctaatattcactaaaagagatttaaaactttgctttttacacttagatcttatatccacatagaaccatttattatttagctgttttaatttgttttgggaatatttgtgtggggaatgagatagaaatcgaataaactatttaaaagactaaatggatgagatctattcataaaatgattcagtgctatcttatgatgtatagaataaaatccaaactctttttctttcctacaagcgctgaatcctctggcctaccattcacactccagttcattccattaattcccttgcttattttgtcactatctgtggctttaattcagtttttcaagtattaaccactttcttttctctttccgtattatccatctcttacccaaagacttcctggttttttttttttttttgagatagagtctcactaagttggccaggctgaagagcaatggcacgatcttggctcactgtatcctctgcctcctgagtagctgggattacaggcatgcaccaccacacctggctaatttttgtatttttagtagagacagggtttcaccatgttggccaggctggtcttgaactcctgacctcaggtgatctgcccgcctcggcctcccaaagtgctgggattacaggcatgagccaccgtgccctgcctgacttcctgtttatttttgtgtgtcagtttaaatgctgtgtttttagggaggccttttctgcgccatctatttaaattgtcatttcccttcaatttctgaagctagttctgttttttacagaactcttatttttttcctttattttttgttcatttcattattactgatttctcttcattgtactcaagcttcatgaggcagaaaccatatacatgtatattttttacttttgctccttgaagcccatcaaattcctggcatttataggtgctgaacaaatgaacaattgaattatgtgtcctcatttccttcttactttcatctaattaatcatcatattgcctaggttcagtatcttccatattctcacattagtccatttttgttaaaaacttatgggcactgtcttattatataaatctatgctatttcttattgctactgccatattatagatctacattatttattaaattgtaagctgtttttttctcttttacctttcccttctacagttctatttctacacaatagatcttcctaattttctaactgcatggcttttctggttataattctttaactcttcttcatttgcttcaagaaaaaaacctaaatttgtaatatgtacacaatattctgttgattcaacattctattccagctaccttctcatttcttccactttttactgcataattttgtaaacgtttttgtaaatatttattttatttatattatatataaaatatttatattaaatacaaaactttatgttttgtataaataaacattgagttctattatctttttcgcatcaccaaatctcttttcctttctctctgtgtgtgcatatatgtgtatatatagtttttattgattgattgatttgtggaatatttcatgtatacatgaaaatgtaaagaataataagatgaacttcttgtacccatcaagaattagtgacttgtagccaatcacactttatatatgtccacccaactatctcaaaatactggataattttgaagcaaaatcagacactttatttcatctataaatactttggaatgcattttttttttttttttgagatggagtctcgcactgtcacccaggctggagtgcagtggtgcgatctcagctcactgcaggctctgccttctgggttcacaccattctctggcctcagcctgtctgtaatctcagcactttgggaggccaaagtggaaggatcccttgaggccaggagtttgacaccagtctgagcaatatagcaagaccccatctttacaaaaatatattttttttttgagacagagtttcactcttgttccctgggctagtgtgcaatggcccggtctcggctcactgcaacctccacctcctgggttcaagcgattctcctgcctcagcttgcagagtagctgggactacaggcgcctgccaccacacctggctaattttttatgtttttagcagagatggggtttcactgtgttagccaggatggtctgcatctcctgacttcgtgatcggcctgcctcggcctcccaaagtgctgggattacaggtgtgagccaccgcacccagcctggaatgcatttctgaaagagaacttttagggcataatttacatatacatagtaaagtacacaaatcttaagcagcttgatgcatttttacatatgtatacaattatataaacaacttacatcaggatatataatagaccatttacaccatactgcaatttttttcatggttctttccagatggcatcctctatgggtaaccactattctaacttcaatgaacattggttaattttgcctttattaagactttattaaccttagaggaatgtaatctaatggcatctctatggtgtctggtttcttccattaacataatattgctgagatgtatccaagtagtgggtgttagtgatttattcctttttggtgttgagtagcattccattatatacatatgccacaattatggtgaaaggcatttatattcttcctaatgtttgctttttatgaataaagctgatgtgcacattcgtgtatgagtcttttggtggatgtatgctcaacaaagtggggacatgttcaggcatattatatattacaaaaccattttccaaaatggttgaaaaattcacgctcccacaagcaatggatcaaagttctagctgattcacattttcgacaacattattagtcctctcaattatagctattttactgatttatattgatatctcattgtgttttgattgaaacttttctaataaattgtttgaccatgatacatatgcttctctgacattacttctggatttgtgctaattacaaataatgtggcatgcacattcttgtacatctttttacttggtgcagttaccaaatatccacctgatcctagtgattaatttgcagctatgcctactacagatcataatttctattcttatctttagcctggattttattatctacacttggccctaagactctctactttagcttgctgatttcagcagatttctgtgtctctcaatctgtatttagcaatgaacctttccctaattctagcatcatccataccttcggcaaaatgcaaagcttcatctgcactacagtcctaccatctcaccatcttggcatcagaaacaatggcgaataatctacagaatattatgagaatcattgggtaaaaataaaaggatggagaaggttttaatagagaaggcaaaatattatcatggaagaaaacagcagagacacgtaatagagtagaaatcagctggagaagtttatattgcatgtgttgagctcatcagaaagatgatatgtttggtagatgaaagaagagactagttggtaaaatgtcttgaaaattgatcagtttcgttttgatttaatagcaaatagtaatcagccatgaaagttctcaaattcagtttcttccatgaacatattttacatgatagtttttcttatttcacaaaagcataatcaattattaaaatttaaatgtaactatgaatacatactgtagtaaaatatttctttccttgtataaagcaaatcaataatttttagaattaaatattttctattgcacctttcttaaaaaaagaagtcttgatccatattttctcagtgcctaagtaatatattaggtgtgtgaattaactttctagattaatattggtagatgctctgtacctcctcctgtgaaatttatgaagattaagtccattcactcacagcacctgtgttagtaagaacattttaaaattttctcatgcactgtttaatttaatgatttactttttataaaggagagtgctagtaggtattattgtcattttatatctgatgaagaaattactgaaattaacttagccattgaggacaaggcttagatgcacaccggaatctactgattcaaaacccatacctctgtctaatgtgagttatctgccctcttcactgcatgatttccactcatgtgcattctaaaatacatctaagatacaattgggattctatctaggagggtttcattttatttttcctgcagattgcagggaatacttgttttcttctctggagaaagttgataatttgtcaggtgcaactgcctccgattttaggaagtcatttaagtaatttcccttccattaaggctaataagaaccttccctacttgtttaattttgtgctttctggacttcaatccatttacaatactttagaaagtactaaatttaactgtgatcctttatagtgtgaagtataattttttttataatgttatctattaagaattcttgagacaacaggttcaaatctatgcccatcaactctttctggttttgttttttctgagtgtgtgtgtgcgtgttaggaggggagcagggaggtggtgttcacaaccatgatagatattatactttccattttttattctattattattatactttaagttttagggtacatgtgcacaacgtgcaggtttgttacatatgtatacatgtgccatgttggtgtgctgcacccattaactcgtcatttagcattaggtatatctcctaatgctatcgctccctcctccccccaccccacaacagtccccggtgtgtgatgttcccttcctgtgtccatgtgttctcattgttcaattcccacctatgagtgagaacatgcggtgtttggttttttgtccttgtgatagttttctgagaatgatggtttccagcttcatccatgtccctacaaaggacatgaactcatcattttttatggctgcatagtattccatggtgtatatatgccacattttcttaatccagtctatcattgttggacatttgggttggttccaagtctttgctattgtgaatagtgccacaagaaacattcgtgtgtatgtgtctttatagcagcatgatttataatcctttgggtatatacccagtaatgggatgggaggtggagtctcgctctgtccccccaggctggagtgcagcagtcgggatctcggctcactgccaactccgcctcctgcgttcacgccattctcctgcctcagcctcccgagtagctggggactacaggctcccaccacacccagctaatttttttgcattttcagtagagacgggtttcaccgtgttagccgggatggtctcgatctcctgaccttgtgatctgcccgcctcggcctcccaaagtactgggattacaggcgtgagccatcgcacccagctgggtattgtactttcaaagagaaaagcaataaaaataaaagaaaaataaaagcagacgatcttttaaaagatctctataaaaattacataagtcattttgcagaaattattgtaaaactggttattcatctcagagacttgacttcaaaacaaaaatgaagagcctgaacattatccactgaatttttccattctgaaaattaaagccagaaaaatcccagatcactggaagcctttttgcagctatcagcttgattctatgttctaaattactggaacagtgatttatagtgactatttctaaccatttcacttacttttggctaaattgtctttgctttagagcaatggtaacctctttgactgtacatctaaaattctgttttaagtatatcccaattcttctgtgcctctgttgccatctcagttttccaagcttttgttttctctccctgttttcctcttcgtggtcttttaaatttattttgaatgctatatcttctggatgctaagttggttttcttacataccacagtgactagccagtcaccctcttgcactcatgaacagcaatctattgagttccatgtatcactaaacatctttcctagtgctgtttcaatcatattcatgttatattgctttctattatataggagctgtcccctctgggcattttctgcccatctcccccactatttccttttcactccaaactgccactttatatgtctctcatcattaaatgtgtagattgatcttactttctttcagaatttcttgactcagcaaattgagttttgatctttaattcagcttttaatgatggtagtgatggtggtgttctggtgatgtgtatgcaggtgtattttattcatagcttcttcaggttttaattctctaaacaaaatcccctctgcctattcataatccagccaatgtaatccccaggggcacagagaaagcagccttcaattagggattagtcaggccaggtcatggttggctaaggctcctggctgagcctcctactagatcccgctgtcactctcctactgttgtaattatggccacttttatttaaatacccctgccattttatttcaaagttattggctgattttttattttccctttcttccctatattaataatatttttaaatattttactgttaagtattgagggaaatcaaagtatttcactgcaaaatatacttctttgacaaattttgagaagtttgttaagaggacctgcaaacagaagtagccctgcaaagctgtccttttgcagggagatttgcatctgtagagaaaatctggcttgatgtagccaggttttctctaaggtcttcccttttcttaatgtaggaaagattgactgaaagtttaacacttttgaaaatctgaaagaaacacttaccatctattctctccgagggctgctttctgtgagatttcgtctacataaccagaccacttttgctggccagacctcctgttctccccatcccataacctttttatcaccataacctgttttgccatggtccaagcttttttctgtaaccttgctacaggaaaagggtcccaatccagaccccaaaagagagttcttggatcttgcgcaagaaagaattcagcgcaagtctgcagtgcaaagcaaaagcatgtttattaaaaaagtaaagtggtgaaagtacagattctccatagacaaagtaggacattcctgaaagtaagaggaagaacgcgtctaccctaggtacaatgcttgtatatatataggattaaaaaaaggtcatgaggagatgtgctctgttacaaggttttgtggtgaagaattagttttcttaattactatattttgcaagaatcaatattattatctttaaagtaaaattaggaatctctttgttctcaagatatcgggatatctggacactcccaagtctgggtctattcagtaaacattatcaatcggtttccttaaccataaacatctagaggccaggaacacctttcttccagggaatgcagcccagcaagtcccagcctcattgtcctagctcccactcaagatggagtcactctggttcgaacgtctctgacaacctcatgatgatagatacatttctgtaccccactaggggttgggggtagtcatgctgtggttctccctcatgtgttgtccctcccaccttaataaatttgtgtgccatttctcccattaatttccttttgtaacttgatttttcagtgacccttcagagggcaaaggggaagttttcccttggctcctatggcatgttttttgtttaaaataaaagtcaaaaacattgattaagttgacagtccattggtaagcatgtattaatagcatgtttttttctatgtgattttatatttaggaatctggatgaataccatactatttgaaaaaataaatttaatggttaccaaattgaagaataaagaaggttaaatcttggtaagctatattagatatactgtaggggatttcaatccatttttatgggtttgtttggtttaaatggagtgtttagttaataatactttgaatcgtgccttctattttatttactcacagatagctacaccattaaatgctctatttttaggagatttgctatttagactagtaataaaatgtccagggtaaatggagttttccactaggaaacatatttttatccacttatacatatcaagttattagctaataagctaataataggtgataacatattgaagaatgtaaatgagaaacactaggtttcattttggagaagtaaagacatctcttgtttcatattgttttacaattgaaaccacagatttatttacttaaaaaaaattaatagccattttccctatggcgcttcacagaaagttacccatttgtaacacttctttcagaatgttctccacaatcaatattttttatgggtggaactatgaaaaccaagaatcaatagttgattataataataatgacattagtaataaaagttgcaatgctttatgtaaatacagtgacttttttattgatctcaaaactgcttgtgtgtgtaattataatattggctgattcattcatattaaatacctatagcaaaaatagaatgagggcttgaagtcattggcgaatatttccatatgaaatgttatgtctcttatctttagtttagatatggatatttatgtttaattttttttgaattagcaaacatgtagtaaaactaacaggtgttcaaataacattcagaggggaaatgtcactattaatatgttttacacataaaatacaaatatctacatgtttaagtgccctaggataagttattataatttttcttttttctctctcagaattatatcttctttaaattattgatttccaaatatttctcttgagccaagacaccacgctgaattccacctgcctactttgtgtcatcacttagatatctaatagatattttaaacttaacatgtgcagatataaccttctgaacctgtttcttttttgcctcagtaaatgacaactccattttcccagttaacttggttcaaaaatcataaaatcaaccaccaattgatcacaacctgttacagatttctttgttccttcttcgcgctcactgctccacttgactagccttgaaaaataaaaattaaaataattttttttgagacgcagtttcgctcttgttgcccaggctggatggagtgccaaggccccgtttcagctcactgcaacctctgcctcccaggttcaagcgattctcctgccttagcctcccgagtagctgggattacaggtgcctgccaccacgcctggctaatttttgtatttttagtagagatgtgttggtcaggctggtctcgaactcctgacctccggcaatccgctcgccttgacctcccaaagtgctgggattacaggcgtgaaccaccgtgcccggcccgaataattttttaaaatgatggaatcattattggattttatttttctccaataccaaatattctaatatttagggaaacctattgggtttcttcagagtgtatgcagtatctgaccacttctcaccattttcatttttaaccacttatagtccaagctattattccatatcacctagattattacagtgatctccaaactggtttgcctgcttatccctgtgttccccttcacccccagccaaatctattctcaatacaaaagccagagtaattctattaaaatatatggagatcattgtactccttggctcacaaaactcattggctctttatttaacttaaaataaaagctgaagtccttctaattaccaacaagaccttacatgacttggagccctgttgctctctgaccttatctcctaatgctctgcctccttgctcactccaccccttactggtttccttgacttgattttaatagactaggtaattccattctcagggcctttgcacttgccattcctgccacctggaataatcttccctcaaatatctataggcattttttcctcacctgcttaagttcttgttcatatgttagtttcttagtgagctctttcctatctaaatattgtaaacatctctgacacctcctatctacattttgtgcttttttctccttagcacatattttttagttaggtttattgttctctgcctcttctctagaatgcatttttttctgtgaaggcagaacttttttctttttcttttcattactgtagctccagttcttgatgcataatagatgctaagcagtatcttgtgaatgcatggatggttcttcctattcctctccctataggaataaaaaatttggaagtaggcgagagaacactgcttagtgaatataaactaagaatggaagtacttatctcaaaggtttcaaatagaaactgatgttatgatgaatcattctttcaatctctttgtcacacagtgtggtcagggagcaagagctcctctaggtttgggaacaggatagcaatccactctaaaatcccatcctcctgttgtgttgggagaacattttgaattgagggtatggtaaaatactgtttcccaaacaacttactcattgaaacattgttggctggggtgtgtgtatgtaagggagagtagaacattctggaattatatgaaactaagtctgttttgctaaaacaaaatgaaagttctcagcattcactaggatttttaacgtcctgcaagtgattgattaagcttttccaacaactgatttttgtaacaaatttcatttaaagggatacaaatggcataataagatacatgatatatctttttattttcctgtattactttgtatctctcagtgctacccagaagacagtcactgatggtaatcaacaggcttctgtcactctgagagatagaaagagtggatgcaatttactttaaattctttttaaaccaacccttgatgcctggcttattgcagatacctggcccttttggctatcagtccttcagaggcatcagagaataaatacccatcacaacagctcctggtgttgtcctgggatagtggatgccgctttcttgaaaactgggtattccatctgttgataaggttgaccacaaatgttagcaatagtcccacataggtcattataatatttgtatcttaagtgtgattaatcttcttctttcagtttatctgtgaaactctcttatgcttttataagatattaatgggacattagtataatcttaaattaagattggttaatactgcactgttggtacataatttatgcttttagcaaagatggcttgtgatgtaaatattgcttaaaaacatcaatacaggacttcctggaagttccataacattttacccaatgatggggtagaggttaaaaggagtaatcaatgatttctttgatttttctcactgctgaggactatcctaagtgctttatatacatttacattaattcttaaaacaatctctcaagattggtattattagaaccactttattgataactaatctgagagtctcagagtggttaagttgatttacccaaggtcaagttgacagacggttaatctgcaaatacttactgaacatatactatgggtacagttattctactgagatgatacagacaacaaacagagttgcaatcctcatgtcttgccagatgataaaaacccacctacaggagtaccaaaattgttattatgaattaataatgtattcgtattcttgagattttgctcattgtagctgtcatttaaaacaaactttaggctgggtacggtggctcacgcctgtaatcccagcactgggaggctgaggcgggcagatcacctgaggccaggaattcgagaccagcctggccaagatggtgagaccctgtctctactaaaaatgcaaaaattacctgggtgggatggcatgcacctgaaatcccagctactcgggaggctgaggcaggaaaatcgcttgaacctgagaggcggaggttgcagcgagctgagatcatgccactgcactccagcataggcgacaaagcaagactatctaaaaaaatgaacaaacaaaaacaattaaaaaaaacccaaaaaactttattttgcaagtgtagacatgacaatgtattaacttaaattaacctgataactttagccaaatgtttattgtgttgtgttatttaacgttagataatattagtttgttttgtgtaaatagctgcaattacacattaaacaagaatgcaggaccagcctataactgtagctaatagcatatatatattatgttatagggtttacaaaatgattgttactttttgcagtatcacaataatcctatgaaattagtccattttgggggtgggggcaaggggagggatagcattaggacaaatacctaatgtatgcgaggcttaaaacatagatgatgggttgatgggtacagcaaaccaccatggcacatgtatacctacgtaacaaacctgcatgttctgcacatgtatcccagaacttaaagtatgataataataacaaaagaaattaatccattttaccgattaggaaactggagatcaacttggttaacaaatgctcaaagccatgtaccattaagtggaagagggggattcaaacccaagccctctgtgccatttttctagctcttttcaagataacaatggaagatgtgaactcactttctgatgttctatgattgaaaagaaacatgcttccacaaattgttctaattttactgcataattgagcagattatactataaattaatgtgttggcacagttaactatttcttgtttacttttctttccctaaggagtctgctactctgcaggaggccttttaaacagaaacatcccattaactttcttaacacagaggcgagaaaacaaacaacaacaagcatagctacaatcgctgttattaggcaccctgaaaagatgtaaccctgagcattggatagcagtaaatcatagaaggggggtgtcaggatggggaagccagaaagtctagcttactttttctcaaaatatgatctgctttagaatcctgagggagttgattaaacatgcagattcctgatctctggcccaaactactgaatctcagtctaacggcagagttcctaatgggcctgttttcataaagattcctggatgatggtttttgtttttcactcttgtacattaaatattaggactttgagaatctagttcattctgagtcatatgcttcagttaaggtactctgtctgcatagggtactctggctaatttaaacaaacaggaatttactaagagcacccaaaagttactgagacaagaagcagtattgggaataggaaggaatggagttaccttggggtctaggaagcaagaaccacaacatgaaaaatctgttcaggctattgtagctcagtctggatggatgctcgccgtttgtagtgtctttgtttgcatgcacaggtcatgtgttggtcccgtgtgtaatgggtaggtgggcccctgcagatgaaactggattgaatagggaaaagataagtccaaaaaggaaagggaaagaagggaaattaatactgagtagtccaaacatagcttttctacagtacaaaataatctagtttcactattgattgaagctaattgctattcctaagtaccctcctaataagacctagtctggaagggcccttcactcataaaaacaatgaggcatttaaatgctgatgatgggcctggcaccatagcttatgtctgtaatctcagcactttgggaggccgaagtggagaagtggaaggatcccttgaggccaggagtttgacacttgttccctaggctaatatgcaatggcctggtctcagctcactgcaacctctgcctcctgggttaaagcgatttttctgcctcagcctcccgactggctgggattacaggcgcccaccaccatgttcagctagtttttgtatttttagtagaggccaggtttcaccatgttggtcaggctggtgttgaactcctgacctcaggcaatctgcccaccttggcctacaaagtgctgagattacaggcgtgagccactatgcccggcccaaaataattttttttttaaaaatgagcaaggcatagtggcatgtgcctgtagtcctagctactggggaggctgagtcaggaggatcccatgggcctaggagtttgaggctgcagtgagccatgatcaggccactgcactccaggcaggatgacagtgcaagatactatctcaaaaaaataaaatgaataagtaaatgcctcttatgaaccctattgacatcaagtaggaatgagcactagagctttaagaggcctcagctcagcctatccagccctttggtggtgctgtgtgtctacaaaactttcctttgtacacagctactttttcccctacactcacctcaaaagggcttgtcaaggttgaggttgtagcccctagttattgaattgtttaattcaataacttgttttgtgaaaacgtagcagagataaataactttttctatgtaatagaacccacttaggatagttagctgattaaagtttatcatataactatagtgtccataccattaggtttccattgtctgcccttggccttaacatttcctcaacatagaacactcctccaaatcatatttctgactctttctcagcatttgtatttccgctcaaatggcattttctcaaagggaaatctttatgaacttcctcacaatgcccctgccttctactctatcctcactgcctgatcactccctagtctattatgatatttttccttcatagcagtcattatctgattaataagcatttttacttgtttaagattagtctctttatgctgcctcccaacatacaaacagtccccccaaactgtaaagtatctgctttcctcaacaggttatgaataagattgccatttatttaaagtaggacttgaatagatatttgttacttaaatccaaagctatcataatgccaatctctttaacaggggcacagaaggcccttcctttccattctatctttaaacacattatcatttatcctatgccttaaacagaatcgtgtttatagtttgctgaatatgctatatgctctttcatttttcatgaggatttctgttttttttttttctttgcatgcacagaatttaaaaaaaatttaaaaaaaggaaaagtcacaaggtggattaggttgctagaccttaaaacactccatgatttctttgtcttagtcatttcctttttttaattgctaaattttctttccagattccctgcttttcttttagtaagagtttaactgtaccttatacaaatcagtaattattctcttaataactagttatactacagggttagatagttggctcattcattaacaaagttaaacattttattttaaaacaagttttattttgtaaatataaccatttagcaataacttaaatttaagtttaagccataaatggaaaaattactacaacggtaaagcaacatgtaagtcagtctcaagagtgtttaaattttatgcaatgattaggaaggatgataggtatcagatctgaaactttataaactgtggacccttccctctcagcctatacaaaaatcaactcaaaatggattaaacacttaaatataggatctgaaactgtggaactactagaggaaagcataggggaaatggttcaggacagtcaacaaaaccaaaaatagacaatgaggttacataaaactgaaaagcttctgcacagcaaaggaaacaataagcaaggtgaatagacagcctgtagaataagagagaatatttgcaaattattcatctgaaaaggggctaatatccagactatataaggaattcaaacaagtcaacagcaaaacaacccccaaattattcaactaaaaaacgggcaaagcgtatgaatagacattcctcaaaagaagatattcagataaccaataatataaaatgatcaacatcactaatcatccagaaaatgcaaatcaaaaccacagtgagatatcatctcactccagttagaatagctaatataaaaaaagacaaaaaataataaatactagaaaagatgtggagaagaggcaactcttgtacaaggttgatgaaaatgtaaattagtgcagttattatggaagtcagtatggaacttcctcaaaaaactaacaataaaactcccatatgatccagcaatcctaccactggatatttatccaaaggaaaggaagtcggtatatttaacaggcatctgcacccccatgtttattgcagcactattcacagtagccaagatatggaatcaacctaaatgtccatcaacggatgaatggataaataaaatgtggtacatatacacaatggagtactatccagacataaaaaagaatggaattctgacatttaaggcaacaaggatgaaccggaagacattatgctaagtaaagtaaggcacagaaagataaaataccacatgttctcactcaggtgggagctaaaaaaaaagtgagctcttagaagaataaagtagaattatggttattagaggctgagaagtttagggaagagggaaagaaaaaaaggttggtccatgggtacaaaattatagcttgataggaggaataagttctagtgttcacagcattgcagagtaaatgtagttaacaataatttattgagtttttttttttttttttttttttttttttgagacggagtctcactctgtcacccaggctggagtgcagtggcacgatctccgctcactgcaagctctgcctcccaagttcacgccattctcctgcctcagactcctgagtagctgggactacaggcacccgccaccacgcccggctaattttttgtatttttagtagagatagggtttcaccgtgttagccaggatggtctcgatctcttgacctcgtgatccacctgtctcagcctcctaaagtgctgggattacaggcatgagccactgcgcctggctgtattgtgtattttcaaaaagctagaagagatgattttgaatgttcccaacataaaggtttgataaatgtttgaggttatggatatgctaattactctgatttgatcattacacattgtatatatatactgaaatatcactctgtaaccataaatacatacaatgattctatataaagataaaatgaaaagtaatgtttatgcttttattgtcaaatgtaattatatatatttaatttttgcttatgataagactattagagtctgcagataaatttaagtgcttaagaaattgaaacacatcagagttttacattgaaatgtgtggatctttcttcaagagtctcaagctcatgcttaactggacaattgaaaaatatcactctttactgatttatatcaagttttatttgtactaaaaactagttttagtacttacctttaattttctagtactaaaactaaaaactagttttagtacttacctttaattttctaaggaaagctagtaagatgctttggctaactttattgaagaataacttggtatgaaattatgatttgtgatagaaaaaagaacttagattttattatttattttcaaaaatcaaattaatgaaatatttagattgatcttttttgttagtcaataaattctgactgtggttgatcatggttttccagggcagacactatattaattttagtgtcatttgaaagaaaaatatgttacaactgagaatatactcatgaaaagataagtaacaatttaaacaatacacatcacaaataaagcagaacctattttttggaaagacttgctgtattattaaaagaggctactattggtttgattagtgtgacaaacttcatgatggagtgggaatttttaatggtcatggaaaattatttaatttcaggaggcgaaatattgatggatgagacattcaacaaagggttgatagagggagataggaaaggaaatagaaatgtacctggagacagatattgtcaatatgaccagggagaattaattgtgtatggaacagtgagatacatttgaaaatgtggtataggatagattatacagaattctgaggagtttaatactgcatttgtatccattagcaatggtgagctgtttaaaagaagtttttgaatctttagaatatttatttgaaaggtttgatatatttgttttccaagtgtgatctaaagatagatcacataataaaattgtctagagagttgctaaaaatgcatcaagctcccaaaccctaaccttctgatgtagtatgtttgggtgggaaccaggactacattttttagcaagatctcttattatttatcacttcacaataagtcttagaaccattggaggaggaactatagcctgtggagctcccttctctaaggttgctggagcccagtctctcatgcctctctcagcttattttcaaatataaaccatctcaaacattgtgactcaacaatacacctgaacaattaaagatgagtgcattttttttcctatgctaaacctcaaatgagtgaaatggaccacccaatagtcccatagctagctttttaaaatttttattttataaacatagaaattgactcttacggtcttaaagtttcaaagttatatttgttttatctgagttccttcctgaggaaaggaccttcaggcctctcaaaaaacgtgtcaaagaactgaaactcatcagatcaccatgtccagacaatgaaatactgaaccccctcattcatcatgattactttcttgccgctccctagttcctgttttcttacacattgtttcatttctttcctgctgtataaactcctagttttagtgtgtcaaggagatggatttgagaatgagctcccatggcctctgctgcagcacccaattaaaacctccttccttgacaatactcattgtcttagtggttggctttctgtgcggtgagcagcaggacctagaccaaacccttggtgtttcagtaacatgatcagaaattgtgatttgcttccaacctgtgttcaaagccaaggctctcagagaacatcattggtcacctttattagactgtcaccatattaagtaggactcttctgattgcatgatataaaatccagagactatgcaaacttagcaatatattttatagaagaataactttttggtagaaaaaattaggagtgccacttgggccttgttttgttttgtgtgtgtgtctgtgtatttttaaagtataagtctaaagtgacattcagaagagaaatgtaactctatacctttcattattgatgcatcgatttgaataatttgtgtaagttcttgggttaggcacacatggagtgtgtgtgaagagtaacgaagccttccatttgttcttcacaaatttttaaatgtgtctcctttattctttccattttgaaaaattaaatcattctcacgcctccatttgctaggtgtagatattcatatttggaaatctttgtatcctctgattgatgggtataagtctgtcatggaggttgccatgtaaagctaaatgcagaatttgttttctctatgaattgattgctcatgtaaaatcactttttactgctgctggtatttaacacataaatctatcatttactttttttttaagtgaaggagctactggtttatcatgtgtaggaaactttttttcactatgtcatcactaaatcgaaggtaaaattatgtttttttcctgaactatgaattctatgctttccttgaaatagataaaatagataaacaagtaaggtattagaggagtctggaaaatattcattagtatccacctttaggtttacctgaagtagtcaggattttctttttagtattccatttttatatgaagtaccattttatatcaacttcttttgttccattgtcagaatctaaagaaatattatctttctacctggcatttaaactggttctctatttttaatggatgatgtgcattgatttgaaataccttgataaataattatttaaatggatgaagagacaaattgttccagtaataaatatttaacctaggagtaggttaggcactttaaaaagctgtagtaatacatgcaaggcattttggttaatattcaaaaactgacctctgaaaataataaaaaatgtgttaattataatccaagacataccagagtaaacaccaatgaatcctcctttattttaccttgtctctcaatattctaattctgtaacaataaatatactcttaaaggtgaattttagacattatcaatttatctattagaaaattatatgatgctaattccatcatgatacatatttaacaatgtaataaattaattaagttaaacacaatttattagattaattacatggggcttaattagtaattaaataaactacactataacatatttacaccaatttatggaaaatgcttttctctttatctttattttttaattcctgacaacctggtagaagttaaactacagaaaaaacatctgcattctagattttgattattagtattctaaattacaaatgcttgtacttgaacaaattatattatggtaatttttttcctttaaagggagaatatcaatggttgaagatcaggctatttatcatcatctttgaaaaagcaaagtaacaatacagcccatttaggagacacattaatctcccatgtgactccagaagcaaacagaattttaaaaagcatcttcagaaattatttggaatatacttctgttctctaagaatatatctctaactttcttttaacaatttaagacataaaggcaacactagatactgatgcttcaggaagtgtcacagtagaaaagttttaacagagtttatagccctggggccttggaaggaaaagctaaaaactataagtagggtagtagtgaattacaatgataaaaactaaatgtcttccttttgcacattaagttatgttaaaacactgactggtaagttacagagctgcggtttgaacctacatttgtctgaaccaagtttccacacttttgaccacaataccttgatgcagtgattaagaaggtattttgttgaagcagataataggaattcatacacttcctctgtacttgctgaatgcatgatcttggacaagatacttaaggcctttgtctcaggtttttgttttttttgagatggagtcttgatctgttgcccaggctggagtgcaatggcgtgatctcagctcactgcaacctctgcctcccaagttcaagcgattctactgcctcagcctctcaagtagctgggattacaggcacctgccaccatgcccagctaatttttgtatttttagtagaggcggggtttcaccatgttggccagtctggtctcaaactcctgacccctcaggtcatctgcttacctcggcctcccaaagtgctggaatttcaggcttgagccaccacacccggcctcagttttttaattctaaatggagtgataatactataaaagtacttacttcatgtattagtccgttctcacaaagctataaagacatacctgagattgggtaattgacaaagaaaagatgtttaatcagctcacagttctgtgagctatacaggcttctgcttctgaagaggcctcaggaaacttacaatcatggcagaaggggaaggggaagtaagcacatcttcacatgagagcaaagtgggaggtgctacaatggataccccattctccatgatatgcttgtttcacattgcatgcctgtatcaaaacacctcgtgtaccccccgtaaatatatataccgactatgtacccacaacaatttaaaaaaataaaataaaatgacttctccccatctgtagattatctttaatttctttaaggtttattttacaggtcaaattccaacataaccatatttatcaatcttctattttatacttagtttttttatgtcttatttaagaaatcctacctttcccaagactttcacctttaatatttgactaaaagtctttttgttgttgttactgttcttttttttgtttgtttttgtttttgtttttgttttagacagagtcttgctctgttgcccaggctggagtgcagtggcacaatctgggctcactgcaacctccacctcctaggtgagttcgagtgattctcctgcctcagcctccggagtagctggaattacaggcgcccaccaccacacccagctaatttttttgtattttcaatagagacggggtttcatcaggtgagccaggctggtctcaaactcctgacctcaggttatccacccgcctcggtctcccaaagtgctgagattacaggcatgagccaccacacccggcctctactaaaaatcttaagttttgttattgacatttcattcctaggatcttctggagtttgtccttttatatggagtgagaagaggtcaaatttcatattttgttgttatcattgttcatatggaacattttgtgagtctctgtgaggcagaagttccatacaaaaaagtgtgtttggaagtaaaaagaaaaatcagaaaccagaagattctgaaaatgaaagattatcatgataaggaatcatattagcagtccagcatattaaatggaaggaatgtctgaaagcaccaagcaaagataacaagagatggacatcaaggaaaagatatgagttccaagagttaaaccatgaaaaacaaaactgtaaatacccggatttttaggggaaaaaaatagctgcagtaaaggcagtaatgaaacaataaagaaaatttcatttgcttaaaaaaatggagtctcaacactgaaagattcagcaatgaaagtataataatgaaaaatatatataacattagtttaacagttgaactcaacatctgtttacaaatttaaatttagacagtcttgctctagaatcactgctgtgtgaatctgtatgatttgacaattacaagtttgcatgacacactagatattattactatcgggctcaatttttttttttttttttttttttttgaagatggagtctctttgttgcccaggctggagtgcagtcatgtcatcttggctctgtgcaacctccgcctcctgagttcaagcaattctgctgcctcagcctcctgagtagctgtgactacaggtgcatgccaccacacctggctactttttgtaattttaatagagacggtgtttcaccatgttggccaggctggtctcgaactcctgacctcaggtgatcctcccaccttggcttcccaaagtgctggtattacaggcatgagacactgagcccaccctgaattttttctttttagaccaaagtactatagacaaaagcacacaaaagtcacactgatctctgtattccaactcctatctttggcatttcctatgaagttacagcgagactattttactcagcaaactatgtaccatgcaccatctgtggatggcagtggggaaaaagataacacaggaactcataatttaatacagtgtcagtacagtattatgagacaagataggatagaagcgggatcctcactattgaagagtctgcaagtgctataagatcctgcatggcagagagcgttcctcacgtggttagggagagaattacagtggagcaaaagaggcaataaattacaatcagcctatgtgactcagtgtcttcaaagttaataattgctaagaatctgaaatctaaaacaaatactgattattattaaactacagtgtaacacatactttcttcttggctatcaggtctttcttctttcaatacctggaggaaaaatactcaccatttaagccacttgcggaaagcccctttttgctttctaaaatttgcttcacaaaatgtatcattttctccttcctgtattcaaagcagttttagtcctattttagcaatttcaatgtgcattattttagttgtctgtctcctttaccacactatgaactcctgaagcatgatgtcaatatatttcttgtgtctaaaaagaaaaggaactcaacaattgactgttgaaagaatgagaatgaataaattgacaaataaatgaatgaactgaatgatcagcttgagaactcaaacatacaaaccaaaacagtatgccaatgggtattcatattttaaataacttaagcctcaaaaattgcatctcttgtgtttacattgaagtcaaggtctttggtccagctatcataccacaaaatagcgtgagtgcttcgcagcatcactgttactattctttcctccagttctccaatcccatcatccaaagtagtatttctctttctttcaatatagaaatgtcactattgaaaacctatcacatgttttattctattcaaagagaaagtaagacatgagccttagcattgcctcacccatattctcatgccctgcattgttaaagaagccactcagcagagctgtgctcttttaacactagcttgaaatttcatctctcagtgttgtcacagccaaatttttacaaatttgtgaatatccagttagagttcaattgtgagatcaacctttctcagcaactagatttccagccttttcttatgaggtcaggaaattcttgagtgttttccaagatgcacatgtttccagtttcacaaatagtaccaagacctaaatgaagctcctgattcctcccaggagtctagtaaagcacaaagcaaattctatccatttatggcccttctgtgcactaaaattacagctggtcctttgcaatttttatgtagagggaatttagtctctttattatctttgtacttgaaattatgaagagtcttattcaaagcaccgtacagtttcaaccaaagaacaggtatgtgccagatttaaaaatttggacaagaaattattaagtgactaatgtctgatcatagaacattgcacaatggacccgtttattttacatatcatcacaacttggattcgcacaacttgtgttttgcttgtaacttctatttcttgacttgattgctttgaaaagtttgcattctttaactagccttaattatttgtgtgtatgtgacatcacttttctctaaatggtcaaagttactttgaattttgttaatatccacttttaaatcaatgccaattgtcaaaatattaaatatataatttatctcaccaataaggaaactgaaattacctaaccaaggtactcattttatttaccattaattccctttattcagtcagtttgtgtctgttaagcgtgttgtttgtattaagcactatggtagatgctaaaaatgaagatatatatagcactgaacctaccctcaaaatacctaagaaaaagagcaaaagaaaaatcaaggtgaatggcctattacaatacagtgttttaagagctctgacagaggtaaggcaacaactttttcagaggaagaaactcataagcaaaggactggagaaaaagtagaaaggaattattaaaacatcaacgaagttaaaagactataggttttggagtcagaaacccagacttgtaacacaaacttacttagtatgtgactatttttgacttgtcccttcaacagcctcatcaataagagcaataaagtggtcagaatgacagccccaggaatcactgtagccatttcttcttagccattgcaaccaaggactacacgtgttaccaacccacagttctagctgaagcacctagccaactaactagcaacatttagggaattaaaatgtgaataatagtgaaattcaatatatattccgtcagtctcttgtgtatgatcccaaaagaaagacacaaaattgactttatgttcttcagaatccaacacaaggagagaatcctgattggtggcataatttagagcctgttacatataaacaaatcaattgctgcgaagagtcaaatctatttcccatcctgaggaatgagtacaatttgcactcatgcttcctcatggaatgatgtggcagtcctgggtcagcttgccttcagatctattcctcatgcctcttttgctctgctcaatgcttcagggtgctgatatgaaagctacttttttccagggttccctaatagttgacttctggctgggtataggcaatgggaagtgctgattgaattattggaagggagtagccaggctatttctccttcagcctcgctgtctaatgtaaagtctctagaagctgctgtgtctccttcctgggtctggctctcactctcagtgcacaggcacagcctcctttttccagggacctctgaccctctggcttcagaaactccatcttcttatattttccctccagcctaggcgtgttaactagtctgtcactattttctcatttgcttcattgtctcatttgacttctcaatgttcccatcatccatataaccattgccctgcattaaattccctctattttggcaacttaaagatgtttctggctgggcacagtggctcacacctgtaatcccagcactttgggaggctgaggtgggtggatcacatcaggtcaggagttggagaccagcctagcgaacatggtgaaacctcacctctactaaaagcacaaaaattagctgggcatggtggcagatgcctgcaatccgagctactcgggaggctgaggcaggagaatcgcttgaacctgggaggcagaggttgcagtgagccgagattgcaccactgcactccggcctgggtgacagagcaagactccatctcaaaaaaaaaaaaaaagatgtttctgtcttcacagatgaactgatattgagggcataagtttcatcatcaattatatcatgtctataataaaaatggtaagtttgtaagttatatttcttctaacatttatcagtgtgggctgggatataatgtaaaaacacagttcaaaaaaagtaattctacaattttaagagtagcaaaatgatgaatgcaaaatacccagctcattgatggctgattaatgaatgagaataaaactgagaatatatagaaacatagatagaagtaaaagtgatttagagacctccaaaacatatttttccccaactatcaagttttatataagtagtaaggtagtaagggcagagagtacttgtttctgactagtacctggaagaacaattaagagcactaccatactcctcaaaattcagctgagttggagataagataggcaacggtctacctgggacataaataaacaaatgttaatatagtttaggaataaatgatatcagaggaaaataatacataacaacatggtagtgacttgagatggggttgttgtggtggtggcacaatataaacactgaataatcagggaaggttactcttaggaggtgccctggaggaaagacctaaacgatctgatggtgccgaccttaatgaaaatccagggaaaacactaccggcaaaactacagcaaatgacaaggcccaaagtagaacaaatttggcatgacttgtttctgaatcagaaacttatacttgctagtttctcaggtgtcaaaaagtacaaaaaagagaagtacccccccaaaaaaagaccaatttgaaaatgtttttaagtggcaataaattcatttcaaaacaaacaaacaaacaaaccatggactatgtagttgtgaacagtgtaaactcccagaaaacactcggtggtaaacatatgttagtctaacttgctaaattagttgagcatgtattatgttccattgaccattctgagtactttaaatgtattaattcgtttaattcttatcacattatgaagtgatatggtttggctctgtgtccccacccaaatatcatgttgaattgtaattcccaatgttggaggtagagtctcgtgggaagtgattgaatcatgggggtgaaattcccccttgctgttctcatgatggagttctcatgagatctagttttttgaaagtttgtaggacttccataacttgaggtcttagatttaagtatttaatccattttgatttgatttttgtatatggtgaaagataggggactagtttgattcttctgcttacggatatctggttttcccagcaccatttattgaggagactttcttttccccagggtatgttcttggcacctttgtcaaaatcgacttcactataggtgtgtagatttgtttctaggttttctattttgttctatgggcctatgtgtgtggttttatgccagtatcatgctgtttggttacagtagctctgtagtatcatttgatgacaggtaatgtgattcctccagttttgttctttttgtttggaatagctttggctattctgagtcttttatggtgccatataaatattaggattttttttctatttctgtgaagaatgtaattggtattttcgtagggattgcattgaatctgtagattgttttactagaattgacattttaaaaatactgattcttctaatctatcaacatggaatatttttctattttttgttgtccttttcaatttgtttcatcagttttttacagttttcattatagggatcttttacttctttggttatcctaggtatttaattttatgtgtggctacagtgaatgggattcctttttaaattttttttcacattcttcactgttggcatataaaaatgctattgatatttgtctgttgattttgtatcctgtaactttactgaatttatcagttctaatagttttcttgtggaatctttaggtttttccaaacatcagatcatatcatctgaaaacaaggataatttgacttcttcctttccaacttggatgacctttatatctttcttttgtctgattgctctagctaggacttccactatcatgttgaataacaaggatgacagtgggcatacttgttgtgctctagatcttagaggaaaagctttcagttttctcctattcagtatgatactggctgtaagactgtcatatatggcttttattatgttgaggtatattccttctatctccagtttttttagtgtttttattatgaaggaatgttgaattttatcaaatacttttacagcatcaattgaaatgatcatatggtttttatccttcattcttttgatatgatgtattacattgattgattggcgtaagttaaaccatccttgcattctagggataaatcccacttggtcatgatgaataatcttcttaatgtattgttgaattcagtttgctattactttgttcaggctgtttgcatcaatattcatcagagatattcacctgtagttttcttctatttgttgtatctttgtctggttttggcatcaggctaatactggccttgtagaaggagtttggaagtactcccacctttgttttttagaatattttgagtaggattggtattagttcttctttgaatgtttggtagaattcagcagtgaagccatcaggtcctggacttttcttcactgagagactttttattatggcttcaatcttgttacttgttattggtcagttcaggttttggatttcttcctggttcattcctggtaggttgtacgtatttaggaatttgaccatttcttccagattttccaatatgttggcatatagttgctcacacgagccactaatgatcttttgaatttctgcagtatcagttgtaatgtttcctttttcatttctctttcaaaaatttctctttttaatttctagtttcataccattgtggtcagagaagatgcttgatattatttcaattttttgaacgttttaagacttgttttatgctctaatatatagtctatcattgagaatgatccatttgctgagtaaaataatatgtattctgtagctcttagatgaaatgttttgtaaatatctatgagatccatttggtctatagtgctgattaagtctgatgtttctttattgatatagtgccagtaagatctgtccaatgctgaaagtggggtgttgatatctccagctattattgtattgggactatctctctctttagctctaataatagttcctttatatatttgggtgctccactgttgggtgcatatatatttaacattgttatattatcttgctgaattaacccctttataattatatgatgactttatttgtctcttcttatagtttttgtcttgaaatctattttgtctgatagaagtatcacagctgctgctcttttttggcttccatcagcatggaatatctttttttatccctttattttcagtttatgtgtgtctttgtaggttaagtgtgtttcttaggaatagatccattaagattttgttttgtcatccattcagccagtctatgtcttttcattggtgagtttagtgcatttacattcaatgttattattgataagtaaggaattacttctgccattttgttatttgtttttgggttgttttgtggtcttctcttctttctttctttcctgtcttcttatagtgaaggtgattttccctggagatatgattattttcttgctttatattttttgtgtgtccattgtatattttttggttaccctgaggcttgcaaatactatcttataacccattattttaacctgataaaatcactgtttgcataaacaaacaaacaaaatgaacactaataaaaactatatgcattaactttgtctccctcactttttaactttttattgtttctatttatatcttattgtactgattatgtcttgacaagttgtggtagttactattttttattggttcattgtttaatctttctacttaggattaaagaagttcacatgccacagttacagtgttataatactgtgtgttttcctgtgtacttactattaccagtgagtttcatacattcatgtgattatttattgcttgttggtgtccctttcttactgcttgaagcactccctttagcattactttttatttatttgtttattatttcgatagttttaggggaacaggtattatttggttacatggataagttctttagtggtgatttttgaaattttggtgcacctataacccgagcagtgtacactgtacccaagatgtagacttttatctgtcatccctctcccaaccttcctcccgaaccctcaaagtccactatatcattcttatgcctttacatcttcataccttacctcccacttataagtgagaatgtaagaggcttggttttccgctcctgagtaacttcacttggaataatggtctccaactccatccaaattgctgtgaatgccattatttcactcatatatatatatattccatggtacatatatatatactccacattttctttatcctcttgttgatttatgtgcattgggctggtttcatatttctttttctttctttttttttttttgagacagagtctcgctttgttgcccaggctggggtgcagtgatgggatctcgactcactgcaagctccacctcccagttcatgccattctcctgcctcagcctcctgagtagctgggaatacaggtgcccgccaccatgcctggctaatttttttgtatttgtaatagagatggggtttcaccatgctagccaggatggtctcgatctcctgaccttgtgatctgcctgccttaggctcccaaagtgctcggattacaggcgtgagccaccatgcccagccctggtttcatatttttgcaatcgtgaattgtgctgctgtaagcatgtgcaagtgtctttttcatttaatgacttcttttcctctaggtagatactcagtagtgggattgctggatcaaattatagatttacttttagttttttcaggaatctccatactgttttccatactggttgtactggttcacattcccaccagcagtgtaaaagtgttcacttttcacaacacccatgccaacatctattatattttgttttttaataatggccattctttcagcagtagggtggtattgcattgcggttttgatttgcattttcctgatgattagtgatgttaagaatttttttataattgtgattatgaaaaaaattagtgactgaagcactcccttgtttcttgaccatttgtatatcttcttttgagaattttatattcatgtcctttccctactttttgatgggattagtttttcatgctgatttgtttgagttccttgtagattctgaatattattcctttgtcagatgtatagtttgcaaaaattttcttccactctgtgggttgtctgctggctctgctgattatttcttgctgtgcagaagcattttagtttaattaagtaccgtctatttgtctttccttttgttgcatttgcttttgggtacttggtcatgaactcttagcctaagccaatgtctaaaagagtttttccaatgttgtcttctgaaatttttatggtttctggtcttatatttaagtctttgattcatcttgagttgattttttgtataaggtgagagatgaggatctagttttattcttctacatgtggcttgccaattttcccagtaccatttgttgaatagggtgtattttccccgctttatatttttgtttgctttgtcaaagatcagttggctgtaagtatttgggtttatttgggggttctttattctgttccattggtctgtgtgcctatttttatgccagtaccttgctgttttcatgactatagccttgtagtatagtttgaagttgggtaatattatgcccccagatttgtgctttttgattagtcttgttttgatcatgtgtgtgcactcatttttggttccatgtgaattttaggattattttttctagttctgtaaagaatgatgttggtattttgatgggaattgcattgaatttgtagattgcttttggcagtatggtcatatttacaatattgattctacctgtccatgagcatgggatgtgtatccatttgtttgtttcatctatgatttctttcagcagtgttttgtagttctccttgtacagatctttcacctccttggttaggtggattcctaagctttttgtttgttttgcagctattgtaaaaggggttcagttcttgatttgattctcagcttggtcactgttcgtgtataacaatgctactgatttgtgtacattgattttatatcttaaaactttacagaattcatttatcatatcttggagctttttggatgagtgtttaggggtttctaggtgtatgaacctaaattggcaaaaagtgacaatttgacttcctttttatcaatttggttgccctttatttctttcttctgtctcattgctctagccaggacttccagtactatgttgaatagagatggtgaaagtgggcatccttgtcatgttccagttctcagggggaatgctttcaacatttccttgttcaatataatgttggctgtgggtttgtcatagatgacttttattaccttaagttatgtcccttctatgctgattttgctgagggtttaaatcataaaggcatgctggattttgtcgaatgctttttctgtatctattgagataatcatgtgatttttgttttaaattctgtttatatgacatgtcacatttattgacttgcatattttgaaccattcctgcatccctgtaagaaacccacttgatctttttgatatgctgttagattcagctagttagtattttgtcgaggatttttgcatctatgtttatcaggcatattggtctgtagttttctttctttgttatgtccttttcttgttttggtgttagggtgatactggcttcatagaatgatttagggaggattttctctttctgtatcttttggagtagcttcagtaggattggtaccaattcttctttgaatgtcggatagaattcagttgtgcattcatctggtcctggacttttgttgttgttggcaattttttaattatcatttcaatctgctgcttgttattggtctgttgagagtttccttttttttcctagtttaatctaggagggttgtatttttccaggaattatccatcttctctgggttttctagtttgtgcatttaaatgtattcatagtagccttgaatgaccttttgtatttctgtttttgagatgaagtctcactctgttgcccaggctggagtgtagtggctaatctcggctcacggcaagctctgactcccgggttcatgccattctcctggctcagcctcctgagtagctgggactacaggcacctgccaccacgcccagctaattttttgtattttttagtagagacggggtttcactgtgttagccaggatggtctcgatttcctgacctcgtgatccgcccgtcttggcctcccagagtgctgggattacaggcgtgagccatcgtgcccggctgatcttttgtatttctattgtattggttatagtatctcccatttcatttctgattgagcttctttggatcgtctatcttcctttctttattaatctcactaatagtctatcaattgtgtttatcttttcaataaactagctttttgtttcatttatcttttgcattttgtttgtttcaatttcttttagttctgctctgatctcgcttatgtcttttcttctgctgggtttgggtttggtttgttcttgtttctctaattctttgaggtgtaaccttagattatctattcatgctctttcaaactttttgatgtaggcatttaatgctactaactattttcttagcagggattttgctgtttcccagaggttgtgtcatgtttgataggttgtatcattcagttcaaatcaatttttaatttccatcttgatttcattgttgacccaaagaccattcaggagcagattatttaatttttatgtattttcatgattttgagggttccttttggagttgatttccaattttgtcccattgtggtctgagagagtacttgatataattttattttcttaaatttattgagacttgttttgtggcctatgatatgtcctatcttggagaatgttccttgtgcttatgaatagaatgtatattctacagttgctaggtagaatgttctgtaggtatttgttaagcccatttgttctagggtatagtttaagtctgttgtttatttgttaactttctgtcttgatgacctgtctagcgctgtctgtggaatattgaagttcctcaatattattgtgttatctatctcatttcttaggtctagtagtaactattttataaatttgggagctccaatgttaggtgcatatatatttaggattgtgatattttcctgttgcatttatctctttatcatttttatataatgttcctctttgtcttttttaactgctgtcactttaaagtctgttttgtctaagaatagttgactccttcttgcttttggtgtccattgcatacaatatctttcttccatcttttcaccttaagtttatatgagtccttatgtgttagatgagtcttttgaagacagaggatacttgattggtgaattctgtccattctgccattctgtagcttttaagtggagcatttagaccatttacattcaaagttagtattgagatatgaggtactattctattcaccatgccatttgttgcctgaataccttgggatttttgtattgtgttgttgttttataggtcctatgagatttatgctttaaagagattctattttggtatattttgaggatttgtttcaagatttagagctccttttagcagttcttgtagtgctggcttcgtagtgctgaattctctcagcatttgtttgtgtgaaaaagactttatctccccttcgtttatgaaacttagttttgctggcaaaaaaatcttagctgataattgtttttttaaggaggctaaagataggatcccatccctgctagcttacagggtttctgctgagaaatctgctgtaaatctgatacattttcctttgtagattatttgatgattttacctcatagctctttagattctttcctttgtcttgactttaagtaacctgataagtatgtgcctaagctataatctttttgcaatgaatttcctgggtgttctttgagcttcttgtacttggatgtctatatttctagctaggccagggatgttttccttgattattccctcaaataagttttccaaacttttagatttctcttcttcctcaggaacatcaattattcttaagtttgttcaataatcccaaacttcttggagaatttgttcattttcttaaattctttttttctttatctgtgttggattgggttaatttgaaagccttgtctttgagctctgaaggtcttccttttactttttctagtttattgttgaaattttccagggtattttgtatttatctaagtgtgtctttcatttccagaagttgtgattcttttttatttatgatgtctattctctggagatttttttcatccatattctgtttttaagttttggttgttttaatttaagtttgttttctcctttctttggtgcctccttgagtagcttaataattgaccttctgaattctttttctgacaattcagatatttcttcttggtttggatccattgctagtgaactagtgtgatcttctggaggtgttatagaaccttgttttttaatattaccagaattgtttttctggttccttctcatttgggtagactatgtcagtggaaagatctggagcacaggagctgctgttcagattatttttttctcattgggtgctcccttgatgtggtgttctcccccttttcctagggatgcagcttcctgagagctggactgccgtgattgttatttgtcttctgggtctagccacccagtggggctacagggctctggtctgatactggggagtgtctgctaagagttctgtgatgtgatctgtcttcagatctcccagctgtaagtaccagaacctgctctcatggaggtagcaggagagcgaatttgaggctgtgagagtccttggttgtagttgtttagtccactgtcttttttgaatgctgggtatgctagcagtaaagttgtcatatggacagactcaggacttctggttagcaagggtgttaaagttagtagaattagctgttattttctccttccttggagcagggttgttctgttatgacttgctgtaatggcttgagttggttggccttcatccatgaggtaatgctttcaagagatcaccagctgcagtagtatagaggggatacaccttgccctgaggccaccaggataagtatttgggtttctctggtaatggatagggctatagagcttccaagagtttgtgtcttttgtgttcagctaccagggtttgtagagacaaaccatcaggtcggggcagggttaagtgggtctgacctcagactctccttgggtggggcttgctgcaaccactgtggggaatgtgggggttgttctcaagccaatggagttacgttctgaagggaattaaggctgcctctgatgtgtcatacaggttgtcagggaagtggaggaaagctggcagtgacaggcctcacccagctcccaggaagccagcaaggccagtctcacttctgctgtgctctgtcaacaacaaacagtgccaagtttatatccaggcctccggcacacagggctacaagactccctgctgagaaagaaagcagggcttttaggctttgcccttccctgtctgccacagcttctgtgcttatgtctgcactttgcatttgctccccagactctgcccaggaaaattcactctctcttgaatttactacaaagtttagtggaagccttcttctccctgtggcccttccctgattccactggctgcgttccccaaaggcccctgtgaaattaaagtcagaaatggcttccttggggttccctgaagattgggcatgcctacaaggctcttcccattgctcattctacttttgtattttacttggctctctaattttgtttcagctcttggtaagggtaaattattctcttgtgatccttattttcattttcctgagtgtattagtccattgtcacactgctataaagatactacctgagactgggtaatttataaacaaagaaggtttaattgcctcacagttccacatggctggggaggcctcaggaaatttacaatcatggtggaaagggaagcaagaactttcctcacaaggcagcaggagatagtgtgaacatgtgaaggaggaattgtcacatacttgcaaaaccatcagatgtcatgataagtcactcactatcatgagaacagcatggggaaaccatccacttgatccaatcacctccttcttttgacacatggggattacaggtccctccttgaggattacaattcaagatgagatttgggtggggacacagagccaaaccatattactcagtgaggatgtgtgtttgggggcagactttccacctctcgcactttgggaacgcacaatgtttcagctgtttcatggaggttgcagcagcaagccacttcttccaaagggtttgtgaattattttggttttcctgttgtgttccctgcagtggttcttggagcaaaagttcacaatgtgaatctccacatgctagttctgtccatctgagtgggagctacaagttagtcttgtctcctatcggcaagttttttcatcaccaacttcctttagtatttcttataggacaggtgtgatggttaatactgagtgtcagcttgattgcattgaaggatacaaaatattgatcctgggtgtgtctgtgagggtgttaccaaaggagataaacatttgagtcagtgggttgggaaaggcagacccactcttaatctgagtgggcaccatctaatcagctgccagcatggctagaatataagcaggcagaaaaatgtgaaaagagagactggtctaccccggctaaaatggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactctgtctcaaaaaaaaaaaaaaaaaaaaaaaaaaaaagagagactggtctaacctcccagcctacatctcttttccatgctggatgctttctgccctcaaacatcgaactccacgttcttcagttttggaactcagactggctttccttgctcctcagcctgcagatggcttattgtgggaccttgtgatcatgtgagttaatacttaataaactcccctttatatgtatgtgtgtgtgtatgtgtgtgtgtgtatatatatatatatatccattagttttgtcccgctagagaactctggctaatacaacaggtctgatattgatgaaatgcctcagctttttgtctggggaagtctttatttctctatgtttaaagagtattttcactggatatgctattctagggtaaaacttgtttttgtttgtttgtttgtttgtttttattcagcactctaaatatgtcatggcactccctcctggcctataaaggtttccactgaaaagtttgctgccagatgtattggatcttaattttatatatatatatatatatatatatatatatatatatatatatatatatatatatatatatattttatctcttgctgctgttatgatcctttctttatctttcatctttgggagtttgattattaaatgacttgaggtattctttgtattaaatctgcttggtgttctacaaccttcttgtacttggatatcggtatttttctctatgtatagaaagttctccgttattatcccattgaataaactttctacccctatctctttttctacttcctctttatggccaataactcttagatttgccctttggaggctattttctagatcctgtaggcgcccttcattattttttattcttttatcttttgtgtcttacgattgtgtgttttcaaatagcctgtcttcaagctcactacttctttttttttttttttttttttttttttttgagacgcagtttcagtctttgttgtcaaggctggagtgcagtggtgcaatcttggctcactgcaacctccacctccccagttcaagcaattctccagtctcagcctcctgagaagctgggattacaggcgcacaccaccatgcctggctaatttttgtatttttagtagagatggagtttcaccatgttggccaggctggtcttgaactcctaacctcaggtgatccaccctcctcagcctcccaaaatgctgggattacaggcatgagacaccacgcccggcccaagctcacgaattctttcttctgcttgataaattctgttatgaaagggctctgatgcacccttcagtatgctaattgcatttttcagctatagaatttgtgctcaattctttttaattatttcaatctctttgttaaatttatctgacagaattctgaattccttctctgtgttgtcttgaatttctttgtgtttcttcagcacagctattttgaattctctgtctgaaatgtcacatttctctgtttttccaggattggttcctggtgacttatttagtttatttggtgaggtcatgttttcctggatagtgttgatgctagtagacattcttcagtgtctgggcattaaagatttaggtatttattttagtcctcactgtctgggcttagttgtagacatccttcttgggaaagctttccagatacttggaaggattgggtattgtgatctaagctgtatctactttagggggctccccaaacccagtaatgctgtgtttcttacagacttgcagaggcacctccttcacagtcttggacaaggtccaggagaatcctctggattcccagggagacactcttgttctcttcccttcctttctctcagtcagtctctttctctctttctctctctctctgttctgaaccacctaaatctgtagttggagtaacataagcaccactgtggctgccaccactatgatggtactgggtcagacctaaagacagcacagtgctgcatctcacccaaggcctgctgtaactacttcctggccactgcttatgttcactcaaggccttgtggctctacactcagcagggggcaaaaccagccaggcctgtgtccttttcttcagggtggcgatgtccctcaggccctgggtggttccaaaggcactgtccaggagtctgggactagagtcaaaaaccttagacgtctgcctggtattgtattcggctgagctagctctcaaatcacttgatgcagttcttcccacttttctcttccctttccaaaggcagaggagcctcactcctgcagccacaaccaccgcaggccatgaggagtactgccagactacaagccaatgtttccttaaggcccaagggctcttaaggcagctgtggtgaatgaggaactggactggaactcagcttttagggcagtgggctcccttctggcccagggcaggtccagaaacatcatccaagagtcaggtcctggaattagggaccccaagagtctgcttggtgctctgccttcctgtggctgtgctggtacctgaggccagcaagtctcagtgtctcacccaaagcccttgatgcagtacctgggtatcgctgctggttattcagggactaaggaatcttagttagcaggtgatgaatgctgtcaggactgagtcccttccttcaaggcagtgggttcttttctggcccagggtgtttgtctaaaaatgtcatttgatagctagggcctgtaacagggacctcaggactctgttgccctatcctattgtgtctgacctggtatccaagaggcaaggcaaagtcctctcccttcttctctctcctcttctcaagcaaaatggaggggtctcttggagctggaagctctgcaacttggggattaggggaggggtgatgccagctctcccttggctgtcccagctggtgtctcagtagtcacgtggcccccccagtcaactgtctgtgagcctagttcagcattaagtgtcacctaagatttgtagtccttatgacccagactgcctttcaaatttacctggagacaagagcgctgtagccatctgtgctgaggtttgaaggcactcaagttctgatggctgtgatccaggattctcctcaggctggggctggtttaaaggttccctcagtgggccagtgtcagttgagtttggttcagttttcttttctgttctaacaggacaccactgagtttagtgcctcacaattgctgtgctctccccactactctgcctagagatgctctgggcacccctccaaacctgccccaggtcagggaggggtggcatcatgattcaaaactgtttttcctatcccttcagtgcctctttcgacgatacaaagttacaaccaggtactatgagtgctcacctgatttctggttcttgtgaaggtgtttcttcagtgtagatagctgttaacttggtgtccttatgggggcggggttgggggatgatggagtcttctattccaccattttgctctgcctcttctctagaaggcatttttattatatacaatgaagaaagtattatcaacaatatataaataaatgctaagtcaattaaaaagcaccagcaatttcatagataaatggccacaaatcatgattagcactttacagaacaggaattatatattgctagtaaacatatatgaagacatattttggacttaatagtgattagagaattacatatcataccatggtgagttctcttttaaattcatttgattggaaaaataaaataaaaaggtcattatatcaagtgattaaaaagacgtgagtcctctgagtcttttatatatcatttctttaaacataagttgataccaatgctttggaaagcagttagatattattgtgtataattttgtatactgtgtgatgaagtaattttggctgtagatccaggggataatctctcctgtgtactctggaaacagcaggttcacagcagctctcttcacaatagcacatctgtagaatcaaatcaaatgcttccacattagtcaagtggctgaatatcatgtaatatgctgttataaatccacaaaatgaatataccacaatgacacacaacagcatgcatgaatcttagcaatataaacataaatacttagcaatttaaacataaaacaattaaaatgaaattaaaaattttggaaagaaacatagatgagtaaaaagaatatgaaaagaaaagaaatggaatagcaaacaggcttcagaagggttgttctcttgggagagggaacagaggaaatgaggtgaaggaagagaaaataaatacatattaatgattggtgagattctactctttgtattgtgtggtgggccctcagttgcttattacactactcaagagggatgactgcataaataaaaacagacagccatgcatgaatcagttatgacagtatcatgcatatacgtacagttgagcaattctatacaccagggttggaaccaaaaattgccatctacctacttcacaacagtaatctactgccattattccagagccagttctgagtcttctgcttctttcacctttcttttgagcttcattaggagcatgctattattttattttgctcattctttaagactcaggtcccgctgctggcatacagtgattcacagagtaggggatggtgtgtttcctctgctccattcggtctttgttttcacaacaggcagattagaagtttcttattgaagccccagaaggaaaccatctctgctcgcccatctttttgtagtctcccagcctcagtcatgcagagaaacttgaagcttctcttcaagctctgaaggtcagccagaccagaaactaatgtgacatagagtctcttttccaatctctgtaggtcaggctcttgccaggatctgtctcagcctaatctaaaccatggaccctatatcaccaggccccaggcactgtcttctctgaagggtgcaagacatacctcaaatattttttattcttcaggactaaacgagacttgaaggctcagttgcctccttcaattcattggctcccttacgtccacagcagcttcttggctcataggaggtagatgtgttaggtttgatagcaaagtgtagccaggatgtttaaaatttgctattttcccagaaatgtctactctcttaaatattcttttaattttaataaagttttcatttttataggattatccgctcaaaattataagaactttgtatttatctattcattaaccccctttataatcatttcttttccttcatttgcaagacgtaaccattttttatattttactttgcaaagtaaaggaaagatgaaactctaggaatagcaagcaaagttttaacatttacagatggcagagcaggtttgagaataatctaactttgggaatgactacaaagggtgttaattaagtagcaggtgttttatcacctatgtctattcaaaaaaaaatgtagcacagatgtagaaagcttaagtacatctatagtttgtataacaaaactctatattcattgggttccatctgccacactaacctcaaaccacacttagtgccaaccaattaacaccttgattaagctatagaccacctgcagcttcagcaatgtaatgaattcactgacttttatacaaattcattgtaaaacctagactgaaactgcatagcaaaaagagaaaaaatgataaatgattcatgcatcagccttggtgtaggcacacacagacacacacacacacacacacacacatttactaaggcatgcacatcaattgtctcatctctgctgctctcttcattttttaaattttctttaacaaaggagacttggctaaaggcatttcaggcttataaacccacaaactataagcagaaaagaatatcatatcctcctccatcaactcaaattttaaaaattccaggaaagtactccaatttgcttaactcaggtcacatgctagttctgaataggattgggcattctggttgacacagtttaaattggttgcctaatcctgtggccacaatgaaaggatatggctgacagaccctaccataaccatgcggcaaaagcaggtgaccaaaatatatttagtctgaaaaaaaataatctaaatgaataatgtaagataattgatacatgtatgtgttgttagaagtatattaaattctctgtcttcactttttttggtgaaatcttcattgctcacttatgaattatggaacagcttttctttccatactgagaaaaaaatagttacttcctatcagagaaaactaagagataagttaaaataatttaaagaagaaaagagacattttgaataatgaattttgtgacacctgacctactaacagttggcaggattgattagagaggagagagctggaaaaaatagtagacttttatgatcatctttatgtaatgttgtaaatggaggaaagttaaactggaaagataggtctgtgtttctggagaaaggttatacaatgaggaggtagctgggtgatgactgttctactcacgctgtcgcaatgtttgcagtagttatgaattatttttttctcaacttatcatggcagaatgccacttataatttaaaaaaataacccagaatccaggaaagatgaaaaacagcaacaacagtataaactagggtaaaaatatattttatttagcacagctcattttgttttactttattttgtttatttatttattttgagacaggatctcactgtcatccaggcggtagtgcagtggcctgatcactgctcactgcagcctcaaccttctgagctcaattgatactcctacctcagcctcctgagtagctgggaccacaggtacacaccaccatggtgggctaatttaaaataaaatattttttgtaaagaaaggttcttgtttggttgcccaggctggtcacgaactcctgcctcagcctctgaaacatgagccactgtgtccggagcacagctcattttattaagaagctcattgcagagctagttatccaaaactatgagaagagattcatccagttattcaggatttagcatcagggtgtattctaaataaaggggctcagaggctgtcatgactttaagtgtcatcattccataccaatcctttttatgaaaaggaagaaaaagaagttctcgaattttatttgttctcaaggagaactctcaaggagaagaatggcagtttttagtttacattattatattcatatggctgatgttttacttctgccctcaaaatcctctctgaaaaaatatcttttgtagcctaccctaattggaaatatacagagaaggaaattctgggaatcacagttcaatctgatccagtggacacattatagtcactacagttcatgcattttgaacctgaaagctccacacttctttttaagccatatgtaatctacaagtaaacaaagccatactcctgcctcatatgaaaatatgacatatctctcctgccttataactgaacatagacttagtcttcattctaacggttacaaagtcccatttcaaaaagcagttttcttctttcatctgattcacactccttctttaatatcctataacttacttagtgagatatgcactgatagctactattaatgcattgtgtgtttggcgataggggaataggaaggggaaaaacaatacttgttatatgtgtgtgcatgtatttgtgtgtgtgttcatataactaaggaagaaaaaactattgtagtcttaatttctgcaatcagtcatgtggttgcagcagatacttctatctgcccttttccactgcccattccattttctcagcagtggtcaactacctcaagtgagactattacaggttctacagacaagggaaagctagctttctcaggcaggaatggaaagaaaagtaggcttagtggaattcagggattcaatcttgtcatttcatctaaatttgcctatatgtccccatcctaattttcagggttccatttatttccaattaatgccccaaatttgagaaaaatgattctgtgagttaggaaattcaatttgtattgtaattcagccattatgattagattttgggtttggtttcagatctttcagacctgaggttataggagataaggatttattttagggaaggcttagaacttacccaggttcttactgagattcaatctgagaatttaaagccatgagattattttcctttgataactactaaatactgtatcaataagaagcagaatcactatgaacattatacacacacaaacacacacaacttgttacaaggatttgagtatatacaattatgtgagctggttgcaacagtctctgtaaatttgctgattttggatttgatactggtgcttgaagactctagggcaggatcagtcaggaaggaaaaagaaggatgtaaagtgggagagaggaaagccaagtttaaacccacaaatatgagctgaagcccctgaggacaaactggagcacatgttcattctacaacattggtgataggggttccctacaggagaaaccggtacttcctttttggcagtaagcagaaacctctcccaagagtttgggaagctgcaggaaggtccatgggtagcctagccactgcaccatggtaatcagttgagcaagcagatgagtgacatgtattaacaacaaaagctctcttgactgtctcaatctctttccaaacataagaaaccatatgactactgcttggcttcttccctctaaattgcacacgaaaatgtctctgtggttcactctaatctgaaatatcaagggaaggaatttctggaaatgtaatttagtctaggcaagtctacacattactaagccaccacatggtatctttaggttgtttcgatattgtttgggtattgtgtgtatacaattgattaatatttctaagttttgttttataaattgactttcattgagatctatttcttgtaaattcaatcatgtggaaaatacaaatagtaaatcaaatataattttatataggtttgagaaatttctgcatttctattggcagtaataccccagactactctctgattagtcttacgtgcatgtaatgtactttttggtctttgacattccaaggcagctcagtttaatgattttgtcccccttatttcattagtactcatattttatagtaattaaaagcacaggctctggatatagcctaaaatcaaatgtcagcatcaccacttattagctgtgaccccaggtatactacttaactgctctttgcctagttttttcttgtgtaaaatagtctaggattaaattagctgatatttataaagtgttcagaatagtgcttgtctcattatgttctgtattttccccatatggtatatactaggggagggattaggctttttgttgaattttttcttgtttttttaatgaatattcaccaataatcattcacccaaaattgtcacaaacactcatgttggccatatggatcaagctctcctaaaatgtggtaatcatgtataattttttgaacatgctttaatacacacacatacacatacatgcacaactatttccagaattattgtgtctttttttatatttccagcagcaaggtataagaaatccagtttctctgcatcccttgcgagcatttcatattgtctatattgtattattttatctgttctaacaggtagtgatatattgtcatggttataatttgcattttcgtaaagctaattatatcagacatttttttcatgtgtttatttgtctgttaatgtcttttgtattattatgaattggctttctttaccattgaatttttcaggattctttaaatattctagatacaagttctttgtgagatatatggtttacaaatacacactctcaatctataggttgcctttttatcctctgaatatggtctttttaatcttgattaagtacagtttatctgtgttttacttttaccgatcatgattctgtgtcatgtctaaaaattctttgcctagctcttggtcccaaagattatctcccgtgtttcttctaaaagttttattgtgttgcattttacatttcaatctgttatacctgggccatcttttgacaacttctatggttcactgcccggcatcttctatctagttgttcatagtctcctatccttttataaagaaatgttagtggcatcactgggtcaaagaagtctttttttacagctccgggatatggataggtgtttcaaacaccattctaaatttctgattagcttcatgtgcaaacgactattctaagcaaatcttggataacctctacctttggttaacgatattttgaaatactgatgtaattattcttccttatcctaatagtaaaaaggatgaatgaacttttttcttcagtagtctcaatataagctgtgggactaatacttgtcataggccctttgaaatagcaaacacagtgactttcatactatttccacatccccctaagctcttgagctcacatttgcatttctcttcccacttttcccttctatatacagatagtaaatacctttgaagatatcattcaagtgagataatttgttgcaatttttcaatgtttcattctagtttatacaggtcaatgcctttgctatgattttaaggcttaagcaaaaccttggtgttttatgaatttctacttattgagcaaaacctatatttgagaaaacaatgtgtatagtggcaaattgtaagaaaatatatccatctctcaaaattgtataaaagtatagtagctttgaattctaaaatagatccaattcctcaaattgactatcattatttttttcctttggaactataaacaatcaccatttctgattaatttctgtcatataaatcacaatccttgctttgtattattttacttgatatattctatatataaaacatacagttcacatatagttaccatttcttttccatacaacagctaaagatgtatttgactattgaaatgcttaagccttacttaaaaaattttacatttttataatactaatttttaatagcacttttgaagataatttgaaacaaaatttgagaataataaaatttgtcattttataaatatagaaattgatagactacagagttgatgattgcaggtttgtagtttaaattggaaagattttgtacaaatctctctgatagtcaatactaaatcagtaatggagtaataaaaacctcttaaattgctttaattcatatattcacttatctaaataccactggcctgtatcttaaattattgagaacacaactgaaactcagtatgtcaatacaaagggttctgaacatctaaataacaaatttcaaaacccatcaaataataattctcaagaaaatctttcaggtaactttcaattctaatggacgcttgaacatctattgtttttgtttgtttgtttgtttgtttgtttgttttaatgttagcatattagaagttgcaatgtggctgggtgcaagtggctcatgcctgcaatcccagcactttgggaggccagggcgggtggatcacaaggtcagaagatcgagaccaacctggctaacacggtgaaaccccgtctctactaaaaatacaaaaaaaaaaaaaaaaaaaaaaaaaaattagccgggtgtggtggtgggcgcctgtagtcccagctactcgggaggctgaggcaggagaatggcatgaacccaggaggcggagcttgaattgagccgagattgcgccactgcactccaccctgggtaacagagtgagactccatctcaaaaaaaaaaataaagaagaagtttcaatgtaaaggaaaaagaggctttaaaaacagcagttctcctacaactagaaatggcaccactatcaatattatattaaatgtcaatggagaaaaaaggaataatgccaatactatcaaaaataatttaaaaattttagcagttaagggatgtttaaacggtgaatgatactttgaaaggaccactgtagagtaaaatatttgatgttcatagtgattactctgagttattagaaaatatacatcgagcattacattctgattttaaaagggtagtgaaactactccatatgatactacaatggtgggtacatgtcatcataaatttgtccaaacccatagaatgcataacaccaagggtgaactctaatgtgaaagtgtgaactttgatgataatgatgtgttcatgtaggttcatcaattgtaacaaatgtaccattctggtgaccaatattgatgacgagggaggctgtgcgtatataggatcacgaggcatataggaagtctctgtaccttctgttccgtttttctgtgaacccagagctaatctgaaaattaatgtctatttttaaaaaactctttgagctggatattggagggaagaagaaaaataaaacgatttgtatggaaaccctgggctctggaccctagattatacatatctgaaaacaaaagagaactttagcttgttaggctgaaatatctgcattcaaaatactccactgttttacctagtgacaatggatgaaaaaaattgatttacatatgtataactaaaacacatgttggggtggtatggtatgctatgctgttggaagttaggataacggtaatccttgcaggggtagtaactgaataaggggcttctgggatgaagataatattgtttctttgatcctggggctggtcacataggtgtattcagttttgagatgagccttacctccaaatctgtccttgaataaatttcttgttggttccccttggttgatcaaatcctatcatctgctttataataatacaacttaatgattaaaattttaaatgtacctaatccctaatcaaatataagaaaaatgaatagaacttaattgcattgcagctaagttccaatttcataagtgaaaaggaaattgttttcgtttattttagctttatattaaaaaatacacgaacaattgtttggagactgttatggaatttcctagtcatttccatgaactatttctggtgggttttgaaactaaatgtagttacagggcaattgtttttgctgtgtaattctttatgtctaataattggtagtcttcattcaagataaaatgtcttagatattataaattttcttctctgcccgaatatgctgctatagactaaagtgagtatctttaggaaaatacatttgtttcaaaagtacatcctgctattatgcacaagtattaattgttttgatgtgtgcctttttttgtttttgggacggagtctcgctctgtcgcccaggcgacctcggctcactgcaagctctgtctcccaggttctcctgcctcagcctccggagtagctgggactgcaggcgcctgccaccacgcccagctaattttttgtatttttagtggagacggggtttcaccgtgttagccatgatggtctcgatctcctccgcccgcctcggcctcccaaagtgctgggattacaggcgtgagccaccgcacccggccgatgtgtgccatttttatcatgactagaatcactcatgggatagatttgcacatttttacctcaggggttgttgaagaagtcaggccatgtagtactcatgaggccttgtagtactcatgttaatttatgtcatgttcattttgtttcactggtaggcaaggaagaaacctaggccttcagatttttggttttgctcaactatcagaaaagcctacatgaattatgtagacactgatttggttgcagttcatttataacttatgagcaaattatatttctagtaagaaaagtattctataatttgaagaatctcaatattttatatgcttcaaaattgacagtttaatttcagggatttgtactttaaatatgtatattagaaagaactttgaatagttcatggagaatctctgaagtctcagaaagaatctgttccatatcaaagaaataagtggcagctacagtttaaaattaaacttaaataagaccttttctatgcctgtctgaacgtttcatttctttagatcttgatgttaatagaatgtaaatattctccaacttcattatttcactgaaatttccaagtattcaacatgataaaattctttctttttaagtctttaaaatattttggtgacctttgctggtcttttcatttttaccaaggcagagtttattaggtttatgttttctatttccatatcaagttttattcatgttaaaaacttaaaattaatggattatgtaaagtgataagtgcatcaatgaatatataactggctggattttaaacatacataaataagtatgttttaagtccttcaatgaaggcacttaatctatttctccctcatttcccttctgtaaaatggggatataataatatacttaaaaccttagcagagtgcttgacacataagaagcgctccttgagcattaactatattattattttacagtgatattgaatatttgatgctgtatatggtacttttaaaaaattgattgtctaataagcagaaaataaggctgtggtaaatcaaataaaggataaatgatttagaggctaatttgaagtaaagtataaagtatgctcttttaaatttttatgtttttatgaaagttttgggtgcttatagcaacttttgaattcctttcagcagtgtgttctttcttacacaatttcagagttttgaatctcttccttgggaaactttttacagaaaggaagataatcatcaaaaatttgtgattttaaatatcctcttaaaaccaaagttcccctttttaatggtttactgttacaacctattctctataaagagagaaaagatatagtccacatttatactagcttcttttaaaatattttagaagaaacagaagaatgattagtagaggttttcattttccattgataaaaaatcgagaatgagtctttctacctgtagtttttcctataattgttttttcaaatgcagtctactatgtgaattaactactcagaatccattctcaatccctttctcctttgtcttttattacttttcagaatgggaagcttaaatttttgatttcacaggcttctttgcctctagggttacttggttactcatgcaacacaattctgctatgaggaggtgtttccttccagaataaaaaggcctcaaaacaccaggagaaaatcctatgccttttctccttcctctgaattaaaatcttacaagcctactccagtctcatcttaagccctcctgttcttctctcactggctggtgtgctccactttttgcttaaaaacgtaccctgtgcccagaatactctcctcagcaatcctccccttctgctatcaacttcctcataatctagcccctctttccccaactcatccaactagatcaggcttcctctctcatgtattattcctgtgtagtccttatcacatttttatgtatatatgaaatatctggatacaagccacaagcagcagggacatctatcttctttatccctgtaccttaaggagcaagcatttaatgagccagttatcatggggcaagcactgttctaagcactttacatgctgtcactcatgctctgttcattacaatatcttattttataggtgaggcaactgaggtagtgaaaggtgaagtcgtgcatgggtagcagagctggatcaaatgtaaatagcttgccccagagtctttgcacttaaccataactgccaggaactatgtctctagagaggtgctggagtgaagagtttgaggcattttatttgaaaaacaacactaggccaggcactgtggctcacgcttgtaattccagcactttaggaggccaaggtgggcggatcacgaagtcaggagatgagaccatcctggccaacatggtgaaaccctgtctctactaaaaatgcaaaaattagctgggcgtgatggcttgtgcctgtattcccagctactcaggaggctgaggcaggagaattgcttgcacccgggaggcagaggttgcagtgagctgaggttgtgccacagcactcaagcctggcaacagagcgagactctgtctcaaaaaaaaacaaaaacacaacactaatagccactctgttgtgtaatgttctaaatgacatttagaaacctttgtgcattattgtgtattcttcaatagctcttatgtctaaccatccattgcttgcacaacttccttttgccacatttctttgttgtgttatatgtgaaagcagttgttctctagtattaaagtgcatgagcaacatggcagatacctttagaaagtgtacattctcagtgcttcctctaccagtattctgattccacagatattctaaggtaggggccaatcatcttaaaaaaaaaaaaaaagaaaagagaaagaatcccaatggactcacagagtgggtttgctgaaaatgaatattcccttaatgaatatgataaaaatgaaacagattttgttttaaaaaattgcaattataaagttaggatagttacatcattttttaaaatatagcatttttaaagtgtcccagaggctagaattattttttaatattagatttcctgtggatgatacaactacaagcagcactgtaaatataaaagatcaaagtgggctaagcaacatttctaggagatgattttcgactcacaaagcaacttcctggactttttaaacacatttaagcacagtaaacaatgctatctcaaaatgaggcaaattcaactttttctattccagtaaccatattaagtcagtattttttttccattttctaattactgcacttattttatcagtgtgttgttaattatatttaatcctatgaaagagcaaaattaaacaaaactaattgttccttgctatttacttatatatttatatacatctgtatatatgtttatgtgcaggtttatttttatcatattcattaagggaatattcattttcaacaaacccactctgtgagtccattgggattctttctcttttctttcttttttttaagatgactggcccctaccttagaatatctgtggaatcagaatactggtagaggaagcactgagaatgtacactttctaaaggtatctgccatgttgctcatgcactttaatactagagaacaactgctttcacatataacacagcaaagaaatatggcaaaaggaagttgtgcaagcaatggatagttagacataagagttattgaagaatacagaataatgcacaaaggtttctaaatgtcatttagaacattacacaacagagtggctattagtgttgttgttttttttttttttctgagacagagtctcactttgttgccaggcttgagtgccgtggcgcaatctcagctcactgcaacctctgcctcctgggtgcaagcaattctcctgcctcagtgtatacatatgtatgtatgtatgtacatatgtgtgtatgatgtaggtgttggggaaaagctgagtgttgggaaaaaagctgagtcagggcttgcatgtctgacataatgtaaaagagtcttggaacatgtctgggggccaggatttaaaaccccttgtagcctttggaacagcaagctctgtgccaaagggtagaaggctgccctgctgcaccataatctaagtccagggcataaaatccctcttggcttggatggaatccagggctcaggggataaaaccccttgtggcctctggaatgcatctagacttgctggctccttgcttcaagcactcccaggatcatagatcgattgcatcttaaactagaagaacatgttttccattatttcaagtagcagaacatgttccatatgcttcaaaagaaatgctaaaccattacagctgtcgatcatgtgcttgatatactgctttctttcaacccccacatcttcaccacctgcttctttgtttgatcaccaataagtagtgctggcttccagagctcagggcctttgcagtctccatactagcatcggccccctggtcccactttatgcactcttaacttgtcttgtctcattcctttgactctgccagatttcgtagcccccactgcctggtgttgggtctggtcactccaacatataggtagccttggtccatggtggtgctaggtctctggttggtgtttcaccatgtgtttgtgtaatattacataccaccacttttatcttaaatatatgtttggtgtgcatacagtttacctaagtatgaaaataaatgttggaaaatctttgtagaatatgcctccatagactttaaaaggaagtattcacagttgttagtaaacatatcctttggttcttaatgatattatagattgctttctcactgaatagaatttttgtttcagattggataaaaactgaaaagataaatatattctaataatgattaagatacaactattttaattaacattcacatttaatttgataatcagattgtattaaagtatttgtatttttctaatatgaatggaatgctaggtgtgtactcaccagacttctctattatacctcgattatactcaaacttaaatagattgatcaatatttaatgggcttcagcatgtgaaagtgggatattttgatttgtttcttttgattttaaaacactggattttgaagacttaatgccaaagtaggcttcaggttctactgctactttaatgtaaaaatttccttcatcactcattttgtcttttgtttaaaagtttgttttaaaaagcacagcattttaatgataatgttattgtttttccctgaaagataatttaattaaaatattcaaatattctttttgtcaaaaatgtgttacttatgttcaattatcagtgaatccagataataattcctgaattaccccaccttataattatccagaagaacctggtttctatagaagtatatataccatctttcctcctcaaagactgtgctgatgttctgctaacagaatgtttatgatacttatgtattattgtgagttatgtttccaggatttctaaaatatatttctatcttttccttagcagctattttcacctataatatacagtattgataaaccttattaaaaaccttctccaggccagatactaggctaggtgccaaggtttagttgtgaacaaatggtctatcaaccttatatagttgtggggaaaggtgaggggtgagggggaggggaaaggtttggaaagatagacatcattcattacaaggttaaatatggaactcagatctgaagtatgagtagcagacaacaatttgtaggaggtgggaggggtagcttaagacttctctaagtaaaaggattagcctatgcaagaactgaaagaattcatggaaagtgaacacagaatatccaaggaactaaaagaaggccagtgtggaaaaaacgaaaggcaatagggaaagttatgagagatgaagctagagtggttgccttaggccacgccatgtagttgcaaatatattatgtttaggattttgtgtgttatcccaagagtaaatgaaagccagtaaatgttagttgacagtacaattaaaatctttgcagtatctaataggaatataatatgacatatttagccatataccaatactaagtaaggaggcatcatttgaagtttgaagataatacttaggccaaatttgtcaataactgattttttttcattgcattcagtaataattttttctcttttcaagaagcttattatttagttgggaaagcaatacagaaataatttacttactaatagttaacaaaatataataaatattatagtgtcaaaaaattatgacagattatgagttgctgagatctctaaagagatcagattgtattaaagtatttgtatttgacaaatactttgcatttgacaaatgtttgtaaatgaaggacaaaaaaatacgattcaatattccaagaggttgtaataacctgtaatgtagataggttcaagaatgtataagacatatttcttgaattatgtaattagggcaccaataataggtcatgatggtaatttgggcttagatggacatcaatctgaaatctgagaattttcaggttaatttctgtacaggagctaatatatttgcccaaaaaattaactttagtgtgactgtatgatcagatctgttgagctgtgtaggaaacatctgccagttcacagaaggtgtttattttcatgatgaaataggaaaataaaaaattctatagtgagttcttaatcccttctgtacaccatgactatggttcctctaattttaatcaaatatggccttagatttttatgcatagactcaagtttagtttacaatactaaataaacattttgttaatgtgaaagcgttcaacaatatatgcatttaaaaaaataaacagtaagcagtgtttaaaaatagtaaacaaaaaagtaaattaaattgttgtattttgtatgtaacactagcaagtatgttttttaagtgagaaccatcaaggcagttcattattttaaaacaagtgaaatggttgctttcaaacacacttagaggattataatcactaaaacttttatggacagcaatttgataacgtatacataaaacatccatcctgtttgatgcaatagttacattctgacagtcttccacaagaaacattgaaacattttgataaggatttattgagaaaaatgcattttgaattatttttgcttcctatataagatgtaacagcaactaaatatctaaaaatacaaagttggttaagagaataatggctcatacatttgatgagctattatttaatacacaaaaagggtgcatacaaaaactttaatggaataagaaaagtttcatgatattatcttagtgggaaaaagtgggaaattaaattgtatctgtggtgtgcatgatgtattagttttccattgtcactgcaataaattagtataaacttagtttaaaacagcacaaatttattatcttacagttctggaagtcagtaaaatcagtctcagcgggctaaaattgaagtgttgtcagggctagtttcttctggagactctacaggagaattagattttttgcctttaagtttttagaagctgccttcattctttggcttatagtccctgtcatattgccttttctccctctgtttccactgtcacataggcttctctgtcactgacccgttggtatccactttataggagccttatgattacattgggcccaatcagataatccaggatttatcttcccgtcttgaaatcctttacttaacacatctgaaagtcacttgtgtcatgtaaggtaacattatttataggttcctggaattaggatgtgaacatcattttggggacattattttttctaccacacatggaataactatatttgttatttaaacaaggacactgttgaaaattaaagagggcgttattaataattatttcaggataacagaggtaaagaggagctcttcttagaaaatccagatagtaacctaagtacacggctagagtgataagaaatgacaagctctctgagtttaaacagatttcctttctttgaaagtgtcatgtttttgttatcttgaaaaactagttttttcctttttctttgtagttctggaatgtcaccattatgtgcctagtcgtggatcttttaactcactatactcaaggaagctcattatactcaaggattcttggattctcagactcaagagaaacactaagaaatttctattattactctgactttttcacctcaaatattttttctctttcctctttctgaaacttcatatatgtgtgtgtctgtatgcatgcatatatatacatatatacacacacatattcatatacatattgacccttctaagtgggttctcaatttctcttaaatttttgttgtattttctatctctttttgagattctgagatttagtacactttatgttcctatttactactatactcagcttaacttgcctgctttatggatctgtggactttgattttgaaacatctcacatgtttgcccagcatttcttctgctctggtttctctttcaatattttcccttgcacatttcagcttcataaaagttattagaatttctggttctctgatggtatctttttctgttcttagtgctgatatagattaattcatttttaaacatttctgcaataatttaaatgaaatttgaggagcacatgttatgtttatattagctttccaactgaagctaaattgtggctgcatattatttcactgtacaaaaaggttataattagcttacccaggtacttaatataagttgtttctactttaatagctattatgatattaagtattccatgctggataaacacacacacacatacacacacaaacacacgtgcacataaattagggaacatatctgtgattatttccctattaagggacaaggatatgttgaattgaggttttccttttccacaagaaagattgcaaatttcaaatttctactaattggtctgagattgttcagatggtagagtttcattatctgatagtcatgttctataaagtgaaggaatactgaaccattgcttctaggagaaatgaaggctcaaattcctgaagatctctggtcacatttcatcaaccaataaatacataaccttgttttatgtgtgtttatttttaaagatgccttatttcatattttttaaattaattaacattgaattcatggccaacatcactatcactcatgcctgaatgaagcctatctaacaaacatattttctctgtgaggtacatcacaatcttctcgagcttaggaacactagctagacttcctcactatgcttgggagctgaaatcaagccacttaaaatagagaaatcaccagcagaaagcaaaatgatgcaaaacacctggcactagaaagaccatgaaaaggacacttatttacaatgtgagagttgaaccatgaaggcagagaaggccttattggaccttagttagaaacatgtgggttgggcgtgaaagcactgtgagcattgatttggagattacaaaatattttagtgagtgggcaattcataaatgtaaaatcacaaataatgagaatagattgtgtttcctttctacatattccataacatctattaacaactttggaatacaaaaattaatccccccaaaattcgagtttttcttttttttgaactagactgctttatttcagggagctctcaagcttcttgttactttgttaactaatcattgaattttccctcttggtcaatcatacaaaatttagaattaatacaatactatcattccccccttttcaataaacttactgtgtaatcttcagcttggcatatattaactgggagcaaaattttgacactgcgaaagaaaagattcagtgatatcattagttatcccacctatatgcttagtcttataaaacctaggactgcatgtatcatgttgaaaagatacttcaacctttgcctaacaccagtgtcccaatcagggatctactttcatttttcatttactggaccattactaatgtccaattgacaagtttattaagctttgccctcacccactttgatctacaaacctgctcagttcagaggagagaatacaagacccactgctattcgttttacagaaattcaaatgttctttatttataaatataaaagagggtttgattcagtttccagaagaagagaagacttgaagagttacactgaggactacctgatggctctgtaggtggagaaggaaggccagtacaaaggaaagtgcaggagttcagattagaagagacacatccatggcttaagagagtagcaattctaaaacattctaaatattctaaaatattatagaatggaaatctggatacaatggtgactctacaaatggagcaccataaaccagttgtagaatgcatttctatgaagtccagaaatgtattgatactcacttcaagatctcttgcctgttagaatgaggatggtgattgaggaggtaatggagaaaaggttaaatcatctctccaagtcatattcttctttttgagcatctaatttagatttcttatagaaaaagtgttttaaaagaataaaacatagacatgaatctggataaataatattgtttgtatcagtcacggactggaaccatgagaacatatgacatgaactacatgttggtgttaaataaaataattaatgcaatgtaatataaaatagatcactaggaaattcaggaggggaaatttttgaagcagttccatagaaacagagctactctgggagtcaggagttctgggagatgcaaaatccaaagcgggttcttgcacccactctgggatattttggccagtcaggttcttggtgctttgggttcctcaattgtaagatgacagaggtaaactaagtgatctctaaaacagtcccaatatctactattcaacaagtcacagtaatagacagagaagtaggaaaattgtgttttaagttcctgtcttagatgctgtaaagaagaaagtgatacttctacaaagtcaaagagattgacgttggagagatcctcttctgatttagcaaggacatagttattgaccacattagatatcatctgattataattaagttatggaacatttaagtggggaagataaagagagaaataaacatatttatattccaaatatagcaataactaaaaaaatcggcaagtcatatctcacatacatagacatgagaagaaatgtggtcactggacattgccctttttctatttttacaaatgctttctttagttttttccagagggtggtgaggtacatagggtagagtacatagttaattttatataattataaacgagtgtatttgaataaaaattctactatttatttatttatttatttatttatttttgagacaaagtctcattctgttgcccaggctggagtgcatgatctcggctcactgcaacctccgcctcctgagttcgagcaattctcctgcctcagcctcttgaatagctgggattacaggcatgtgccaccacgcccagctaatttttgtatttttagtagaaacggtttcaccatgttggccaggctggtctcaaactcctgacctcaggtgatccacccacctcagccttgcaaagtgttgggattacaggcatgagctatcatgcctggccaaaattctattttttaaaaagtatatcttacctatgtttagataatttttctgatgagttagtactcatatgggtgcttttttttttttgaaatacatagactattggtcttagacataacaggacacacactaaattctattaaaacaattcagggactcacccatgcatacagcaattatgattgtgaacatccaagacaaattagtatggaatgtcttaattaaagctgggtaaagtaatttttttacagatagattgaattttattaaatatttagagtggtatattttcatttcactcttatgtaattaatatttagcacagttctttgggtatcaggttgcattatttatgcacattttttgagaaatataatagtgtttttttgttttgttttgttttgttttgtttgttttgcgatggagtcttgctctgtcacccagagtacaatggctggagtgcaatggtgcaatcttggctcactgcaacctccacctcccgggttcaagcgattctcctgcctgaacctcctgagtagctgggattacaggtgtgtgccaccacgcccagctaattttttgtatttttagtaaagacggggtttcactgtgttagccaggagggtctcggtctcctgacctcttgatctgcctgcctcggcctccctaagtgctgggattacaggcatgagccactgcgcccggcctgagaaatataatagtatttctaagaagtctctggaaaatagaccataattttttttattatattcaaaatgcaaattttgccttttgctaaccagataaaaatacttatgattttcgtatttgcttagttacaggtattaactgagcaaaattgttaaaatgtgtttgattttgtttggatagggatttgttttcatgttttcaaactaaagttgagaatcttttccagtggcattcttaactcatagatatgatgtgaaaattgtagttgccttaatcctgctcttgttgtctttaggaaaactgtgactcatatcagtagcttattaccaaagttacatggctattagagtttgagccttgggatagaagagtaaacattctgcttttgtcatgagatactgtttttttggctatagtattccctctaaggcagcctctaagaaaagcatcatttatcttagtttagctatgagaagtctacagaaatcctttcctcattttaaaaaaatgagttttcagaaatatccacaaatattcaatgaatagttaagcacaaaactgtgtaatgtttagtaacactcaacagatgttttgctaagccttttttaaaaattataaatcaataaatacataaagaaaaaacaccttgaaaatctttatatcctttaatggtaaaataggacagtatgaattctcatctagtcctatggttttcacattgggagtaaaagcgcttggatttaatgagaagtgttctgttggaatgaaagaaaactgaatttcttaactctaggcagtagcttattagcacagtattgttctctggtaaatacctttgcttccattttctcacctgcttccactcgtaaattctcacctcctgcaatagaaactttgcctcttagtgactttgtggttgaaactagagaaaagctgtttactcagcaacatctagtattttgctgcttcttcctgggtgattagatttagaaatcatgaaaatggaggcttttttcttctactttttgtttggcaagcatgttctaattctttttttttttttgagacaagagtttcgctctgtcacgcaggctggaatgcagtggcacgacctcacctcactgcaaactctgcctccggggttcacgcccttctgcctcagcctcccaagtagctgagactacaggtgcctgccaccatgcccagctaattttttttgtatttttagtagagatgggatttcaccatgttagccaggatggtctcgatctcctgaccttgtgatctgcctggctcagcctcccaaagtgctgggattacaggcgtgagccaccgcgccaggccaagcatgttctaattcttaaaattgatctgccaatgactgtggaaaaggtaatcacttatttcatacagcaataatttattattaatattttttaaaaatactaaaaattaacctcatatcacaaacttttttttctcataaactgttgtgtcactagtataatctagaatttaggaggggagttattttttaaagaaatcacttatttgtgattttttttttcctaaaaggatgatttaaaaattatcttttgacttttcaaaatcaaactttttctccttgagtttaaatatttattatgtttcaaatgtcttaggaaaaataaaagataattttttcatgtactgatagtatatacattaattttccagagctctgtctaactagtgctgattgatcaccagagcactaatttcttcacattatgcatgcaaatataaaactgctctcttgtctgtgttatttctggcttttaaatgtgtttacaatattttagaaagttgcttagtttttgaatttctcaaatgccgcatatatcagtaagcaaaataaaggccattaaaaaattacagcagaattaaaatttcaaggcagaagtatgtcactctcacacgataagccaaaagaggtcagacttgtctttctaattatttccagagacctgccctacaaatcaggaaccatcacatggatacataaaagtgtctttaattgtgaaagcaactatgcaaattattcattgctatcatccctgatcaattcccagattattttcaaactgagagacccaaaatgacataattttaagggagttacatggaatagtcactttgataattgtgtactcattttaacatactagaaaaatatgatatattaaaacaaagctttgactgatattgtttaggataaagctaaataaaatttataaataagtcgatttaaataaaacattaaggagaaaattggaccctattgtaggagcttgactatggcagccattctaagggtagcatgtgattgaggttcagtaaagtgaggtccaaagcagcccttttggctctgtaggtattatttgattgaaaggagtcaagatttctctaagaactctcagagtaaggagccttgttttggggaagatgtccatgagtggcatacatagcagaactgtgagcaagatggcacttcagagccactgctgtcaccatctctctccttgaatcttggtctttttctccctctggtgcttctgctgtctcccatctcctccataagatttcttcctctaccctccttccaacttcaactattgctctaaataacttaatgactatggtgtttccctatgtatgttcccaaaagttatttcccagaccttgctctctaaatttagatggtcttgagttaagcaccgcacctttggtataatcagttatggccagggtgctgcagggatgccagatctacttagagctgtgagcagggcacgttcattcagacagtctgtgagctgaagaagacagtttgatgtcatctccaggatatcattaatgtcacccaggaggaaattgaggcctaggaatgattatacagcaaatgaatacacattcaagactagagtccattgggttcattgctaatcaaatattatccccatttatctgaaaatatttattatgcatcatcagcacatgagatattatgaagtaactaaaagtgatttagccatagagtctttcccctttagaaaactaatataggaaatagatcccagcaatgtcgagaattattatggactgtggaaatgaataggtttagactactataaagttgtgaaacaatgaaggttcatttcctgaatctactgaatttctttgattttttttttttcatttccttttctgtctttcctttccaggggcctagtactatcatgacatgtcttgttctagaattctcttcttttcctcactcagtccctatcaagctagatatatttgctccccaaagaaaaaaatgtttctttcagctcttttttcttcttttcctttcctttccttcctcccttctttcctttctttcttccctatttctatccttcctttctctttctttccaacattgccaactgacaaacaacccttctcaggtaagattttttaaaaggaagaacctctggaactatatttatttttttgtgcgtcactgattacttttttgttccattgtttacatttcccgtcatcttactgactgcctactgctgttcttcaagagctctatatttgtacctctttgcttttctattttattgagtctattgtcatgtcatatatttttgcatcccttcttcttatattatcagtttctaatcatatttccaactgcttttataatatttatatgggtatcacattattgcctcatcttaatgctttgaaaattaaagcatcacattggccctgctctgcaatagggatattcctatcctaggaattagttctaaataactaattttcatcaatgatcagtttttttttgtttgtttgttttattttgtttgtttttttttttttttttgagacggagtcttgcactgttgcttaggctggagtgcagtggcacgatcttggctcactgcaagctccgcctcctgggttcacccattgtcctgcctcagccaatgatcaggtctttaacttgatctttagtcttctctttcttgaatttcaggatgttaccactttttgcctttattaataatgtgcgtgtggatattcaaaaatttttaaatctattttcctctatattcaaacccttcctttccttcaagaacccaaaacctaccacactcataaaattatcagactgccacagcatttggtaacctctataactgtatttttctgacaccacatgaattagcaatcattaggttaaagagatattttaagaataggaattaatatttctagaaataaaacatctaaaaaatggtttataaaaagtcacttttttaggctaatcaaacataatatagtcattataatgttactataggcagagaaacttacagggctgatgtacagtattaatttttaggttcattttaacatgcagttattgggtccagatattataatagagtggaaagattcaactgtctattaataaaagactagaagcaatcatggcacctccatacagtaggctgttttatagttttgaagaagcttggcatatgtcctgcaagaccattgagtcaagggaaaaagcacattgcagaagaggatacacaatctaatatatgcatacaacaaatgttcatacaaatatgtacacacattttatatttgtacagggtcagtgttgaaaatggtgcaacaaattgtccacactggcttctactaaggtaatgtaatagttactttatacattttattatattttgaaatttcccaataagcctaaattaatattataataaaacaaatgtattacaaacaacaaaaaaaaataaagaacattggaaaaataaatgctatcactttaacggacatactcattccatttctagttgtttaataattgtgaaagtgaaaaaagtctcatgttacagtacattcattctatatgaaatattaacaactttaatacttaatagttgcaagtgtcatttataaataaagttatatttttaaattatttcattattttggtgctgtttataaggcttcaaaagatactcatattacttgagaaatatatgttgtcttttcttctaggtgttataaactttaaacaaatttaatttgctgtgtattttagttgaatatggagaccgacctgctgaagtaaaaataatagtaaaagtaactctatatcattcaaaaatggcatgctgttataattttatagtttcatttataattttacagtttgtaatttcatccagttctctacgacaacatacttgattcttttgggattagactttggagcaataagatgtgattttttttcttaaagtcattgtaatctaaaattgtccaggtctcacaaatcttgctgctctttttttttttcattattttttattattatacttttaagttttagggtacatgtgcacaatgtgcaggttaggtacatatgtatacctgtgacatgctggtgcgctgcacccactaactcgtcatctagcattaggtatatctcccaatgctatccctccccctttcccccaccccacaacagtccccagagtgtgatgttcccctttctgtgtccatgtgttctcattgttcaattcccacctatgagtgagaatatgcagtgtttggttttttgtccttgcgatagtttactgagaatgatgatttccaatttcatccatgtccctacaaaggacgtgaactcatcattttttatggctgcatagtattccatggtgtatatgtgccacattttcttaatccagtctatcattgttggacatttgggttggttccaagtctttgctattgtgaatagtgccgcgataaacatacgtgtgcatgtgtctttatagcagcatgatttataatcctttgggtatatacccagtaatgggatggctgagtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaagtggtgtgagatgatatctcactgtggttttgatttgcatttctctgatggccagtgatggtgagcatgttttcatgcgtattttggctgcataaatgtcttcttttgagaagtgtctgttcatgtccttcgcccactttttgatgggcttgtttgctttttccttgtaaatttgtttgagttcattgtagattctggatattagccctttgtcagatgagtaggttgtgaaaattttctcccattttgtgggttgcctgttcactctgatggtagtttcttttgctgtgcagaagctctttagtttaattagataccatttgtcaattttggcttttgttgccgttgcttttggtgttttagacatgaagtccttgcccatgcctatgtcctgaatggtaatgcctaggttttcttctagggattttatggttttagggctaacatttaagtctttaatccatcttgaattgatttttgtataaggtgtaaggaagggatccagtttcagctttctacatatggccagccagttttcccagcactatttattaaatagggaatcctttccccaatacttgtttttctcaggtttgtcaaagatcagatagttgtagatttgtggcgttatttctgagggctctgttctgttccattgatctatatctctgttttggtaccagtaccatgctgttttggttactgtagccttgtagtatagtttgaagtcaggtagcatgatgcctccagctttgttcttttggcttaggattgacttggtgatgcgggctcttttttggttccatatgaactttaaagtagttttttccaattctgtgaagaaagtcattggtagcttgatggggatggcattgaatctataaattaccttgggtagtatggccaatttcatgatattgattcttcctacccatgagcatggaatgttcttccatttgtttgtatcctcttttatttcactgagcagtggtttgtagttctccttgaagaggtccttcacgtcccttgtaagttggattcctaggtattttattctctttgaagcaattgtgaatgggagttcactcatgatttggctctctgtctgttattggtgtataagaatgcttgtgatttttgtacattgattttgtatcctgagactttgctaaagttgcttatcagcttaacgagattttgggatgagacaatggggttttctagatatacaatcatgttgtctgcaaacagggacaatttgacttcctcttttcctaattgaataccctttatttccttctcctgcctaattgccctggccagaacttccaacactatgttgaataggagcggtgagagagggcatccctgtcttgtgccagttttcaaagggaatgcttccagtttttgcccattcagtatgatattggctgtgggtttgtcatagatagctcttattattttgagatatgtcccattaatacctaatttgttgagagtttttagcatgaagggttgttgaattttgtcaaaggccttttctgcatctattgagataatcatgtggtttttgtctttgattctgcttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccagctttggtatcaggatgatgctggcctcataaaatgagttagggaggattccctctttttctattgattggaatagtttcagaaggaatggtaccagttcctccttgtacctctggtagaattcggctgtgaatccatctggtcctggactctttttggttggtaagctgttgattattgccacatttcagctcctgttattggtctattcagagattcaacttcttcctggtttagtcttgggagagtgtatgtgtcgaggaaaggaacaaccggtaccagccgctgtaaaatcatgccaaaatgtagagaccatcgagactaggaagaaactgcatcaactaatgagcaaaataaccagctaacatcataatgacaggttcaaattcacacataacaatattaactttaaatgtaaatggactaaatgctccaattaaaagacacagactggtaaattggataaagagtcaagacccatcagtgtgttgtatttgggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtcctgagtgatctacaaagagaattagactcccacacattaataatgggagcctttgacaccccactgtcaacgttagacagatcaacgagacaaaaggtcaacaaggatacccaggaattgaactcagctctgcaccaagcggacctaatagacatctatagaagtctccaccccaaatcaacagaatatacatttttttcagaaccacaccacaccgattccaaaattgaccacatagttggaagtaaagctctcctcagcaaatgtaaaagaacagaaattataacaaactgtctctcagaccacagtgcaatcaaactagaactcaggattaagaaactcactcaaaaccgctcaactacatggaaactgaacaacctgctcctgaatgactactgggtacataacgaaatgaaggcagaaataaagatgttctttgaaaccaaggagaacaaagacacaacataccagaatctctgggacacattcaaagcagtgtgtagagggaaatttatagcactaaatgcccacaagagaaagcaggaaagatgcaaaattgacaccctaacatcacaattaaaagaactagaaaagcaagagcaaacacattcaaaagccagcagacggcaagaaataactaaaatcagagcagaactgaaggaaatagagacacaaaaaacccttcaaaaaattaacgaatccaggagctggttttttgaaaggatcaacaaaatagatagaccactagcaagactaataaggaaaaaaagagagaagaatcaaatagacacaataaaaaatgataaaggggatatcaccaccgatcccacagaaatacaaactaccatcagagaatactacaaacacctctacacaaataaactagaaaatctagaagaaatggataaaatcttgctgctcttaaccactatcggtacaccttcagaatggccatgttttatgccggaaactgccttgtttactctgcaactcccttggtatttcactttcacccattatcagttctttcatgtttttctgtcctaccctcctactgcagaaagctcacttcctggcagtgcccagtcactgttcctagagcagccctagggattgctgttttctgctatctgtggaagcccaaggacagaaaggttgtacgcaggcagcacttcctttcagctttaccttaccagagacttgctgtttggaacacagaaatgggtgaggacactctactcttaccgttttgcccccatctcatcctggcaatgcttgtgttgtggttcctttacctataacttcctcctgtcaagacttgtaggaggtttaggagaggctgttctggggaatgtgcagtttgtgtctgttgctgcttccttttcttggttcctggttcccacctctcaggcatgcaccagacatcctccttagacttccttaacgaaggacaccttctctgcatgcaaatcagctcttaaaaatggatacctgggggtgaatcaatgtctaacctaattctaaatataaatttaagcttagcctgcaattctgtgacatgaaacagatttataagtttgcttaacattatctatacactatggtcatgtaaaattgctttgactggaaacctgagaaaaacatttttacttacaatttctttttaaaaatttgctttctttcagagtttgaattggtatttccaagaaccagataataattacaaatttctattcttttgcagttttgctcctttcccataattctggtactccagaaagtagaactaaccaaataaatgtgcaatttgatttaaaattgtaccactggtcctgacagtaagaacaattgtaattttgccttaacgtccttttttcacacttaccagatgccttgaaactgtaaatacattttaaaaacgtggagaaactttttttcccacttcctacttattttgttctaactgtatttcacaattccctgttgctccggtgatttatgtgtttgccattttgtctgtgatgaaaatatttgtaaagttaccttcagtaaaaagactatatccattaacttaagaatggcatgatactttaaatttttaaaatgaatttgataagggaattattttagaaaaataaagactttaagtttgatgttttggtttatttttcaataagatgacaaacgaagggtaaagtacatggaagactagatgagagggctatcacaggaagcacccatagactttagatacatatgcaaagggatttaataatctattcaccaatttggtgagggagggattcttgttttaggattatggggatagactaatacacaatattcacactagattgtacagatgaaattgatagcagattatcacatatacacactcctagcacagggaaagaggatacagcacaccaccgtgggccacatgaagttgcactcaaaagcagaaggaacaagtagaggctgtgggagagaggcttcatagtgtcaagagagcagggtgacacctgattcccatgggaggatgtggttggcttatttgaaaaattccaccactggcagaaaattgaaacctgctactcaggtatcagcaagaactccacctagtccctttgataaggagccttgtttggctgggggaccttatccacaggagcataatggagaagggagcttgtgcgtaagccatttgagtccttattggtttcaccagagggccttagttttggcattacaactcaaaatgactcctgtgttgtctttacttacgaggaacaaataccttctctagtagttaaaaaaaaaaaaaagatgttttattacaaaggcaaaaacaagggctcttatggatgtccaaggccctgcactatgggaagagttcaagaccctaaacctgtattctatgttctccaagagcagtcctctttctctcattcgtggatgatatgctcgaatatgtgtagagcatccttgcaagtagggagctacttacactttctcttcctaataattgtcaacaaaaagagtcaaactctgtaaaatattttaagagatttattctgaaccaaatatgaatgaccatggcccatgacacagcccttaggaggtcctgagaacatgtgctcaaggtggtcagggtgcagcttggttttatatatttttagggaggcatgagacatcagtcaaatacacttaagaaatacattggtttggttcagaaaggcaggacaactccaagttgggggtcttccaggctataggtaaatttagacattttctggtttacaattggctgagtttatctgaagaactaggatcaatggaaaggaatgtttaggttaagataaaggattgtggagaccaagttttatggtgcagaggaatctctcagatagctgacttcagagagagagagcaggttataaaatgtttcttatcagacctaaaagggtacctggctcttatttgattgtctcctggacctggaaagaaaggaaggaaaacaaaggggaaagaggattctctataggatgtggatttttcccacaggatactttgcagggcaatttcaaggtatggcaaggaaatatattttggggttaaatattttttccttgtcttgtaatgttatgccagagtcagactgaaaagtaagtcacaatatatagggtcaaataaaatccatctaatgcgaatttatggttgtcaggcatgactccctagaccacttaggtaggaatttgggtaagataaaaaatcagaacttagtcctcataatcttgtatgtttctcttgagagtcttgactttccagctacagtgcttgctaacaactctttctatgctttccagttccaattccaaagagatctgatgatctcttttgccattgttgcagagggattaacacatggccaggttatgaatgagctgcttctgagacaggcatccattcttattatactcagtggtagctaaaatagatgtggagacacataacaaaacatggctaaataaagaagcagaaattgagggcatgggtttcctcatcaaggaaagatgtgggaagcaagaccttctgaaatatgcatagcaaaataccccagagcctcaaaccagttctgcactgcatttttttctttcataaaataaaactttaattttttaactaccaagtcaaactagtgaatcagccttggcttttccctctttcttctttccactccccatctgtatttttgacaaactaaagatgtgaagttttctttcttaatatttctctcttcctttgaaatataaagacattacccagatccaggctcctttcccttcagcgtgaatctgttacagctgtcctctggcacctttagggatcctgtacctccagaatctctctttgtcagtccctgctgtacccagcccaaccaatcctaatgaaacaccagtttcaaataggcttatgtatctccctattcttccagaattgtcctcaaggcaataccttgaattgactcctatctttctatgtatctgccctatttcctgacaaaaggaggctaactttagggaattttacacctgcatagacaactggaattgcaggttaggatgagattaagatcaagattgttatatgttttgctgcatttgttgttttccaaaccagatcataaccccctggaggataggaattaagtcaggttctttttaccctagaacccattcaatcatatacactttgatgttgatttctttatactttgaaagcatttataggaagttatttgtgtaagagttaaagaagaaagaaacacaaaaagtggctcaacagtcaaagacaggtttattttggagaataaacctgagaggggcatctggccaattttggtcaggagcattctctcttacagactaagggtatttaagcgtttaggaagggagagcttatcacaagctcagaatgtttctgtgcacaggagagttttattgtggggtcggcatgtctctggacagagggtaggttatctcagggctggcatgtttctggttggagtggaggttatctcagggctggcatgtttctggttggatggagatttatctcagagctggaatgtttctggtcggaggtgtcacttgtagtttatggtcatgctgacattagtcattaggctaatggtttggggctggatttacgcggtttttaatcaaggggaacttaaaattgctgtgtttgtcctagatggtgatgatcctgctctgtcaatttgtattggttatttgattcaactgcttagaaaaaaataagtatggctattttgtcttatctgatgggattacatagtataaaaacagactggcttaagtatggcatctcaacatctcacagccacaaactggatattgcgtcctaataatgaattcacgttgatgatcttttcagtggtattgcaaaagaactcccttattgattaaacacagctcttgatttttctaagcatataagtaaaactcaaagaattaaaacaataaagttttcctgggagaggaaaatcaggaaatctgacataaaatgccagtttgccttaaattagtaattacttgtgtaaagtgtgcattaaaagatacatagcctgggcacagtgcctcacacctgtaattccagcactttgggaggttaagccgggcagatcacttgaggtcagaagttcaagagcagcctggccaacatggcaagaacccatctctacaaaaaatagaaaaattagctgagcatggtggcatgctcctttagtcccagcttctcaagaggctgaggcaggagaatggcttgaacacaggatgcagaggttgcagtgagccgagatcgcatcactgcattccagcctggatgatagagtgagactccatctccaaaaaaaaaaaagatacataaataccacttaactatgtgatttgttgaaattatgttctatgtatttacttttatcacattgaaatacattctgttcttatatattttttttcaagttaagggtgaatgccaaacatgcataaacctcacctatagagtctattgcctttcagccttgttatgccttaatactgattctgtatgcatatatacataatttggtagatatttagcaatgttacatttggaaaaactaggccagtgtactataatcagctttggaaaagttgttctcatttgcaatttttcttacaattgaacaaatgactgttaaatacttcatttttctaagtatatggattaaaatatagcttgtagaaatgtcagagtattctaacttgaaatgtaggaaagcgttttgtgtagttttgtaagttctttcttcaattttgtggattagtaagtacataaaaagaattcattctgactgtaggctgacaacattggattggcagctgaaaaaagttgtcagcattgcctgtcagattcaaacttagcagtgtacaaggtttataaaagcttgaagctatcctgtcaacactggcatttcattaaagattaattaacccgaatttgcttgctaataaagatcaaaatatcagtcatttctctcacaaaaaacgtgtgactaacttgtagcttatgccttgtgtatgtgcatattcatggttaagaaatgaagtactataggtcttttttaagtttatactaaaggcaatggtgtgcaaaggaaagtggaaggttttagttaaaattagatcagagcatacacatagctaaaactgacttcagtatttgctgcaaccaggaaaatagaggaaaatatctcttttctttgaagaccattccagaattgattttacacttcacttttctaatgttcacatattagaaaaaaagttaatcctatttaaaatgtgaaaatagatcacttcatatttccaactgactacaatataatacagtgaaaatgttgctaaagttctatataaactatatgtgttaaataagtaaatgaaattaccagaccctcatgacttttccgctcttatagcaataataaaaacatcatttaaagctgctgtgttacattaagtcattactgggcaacttatttaatgaaaaataagcttatccattatgtaacaaatgttttattggtaatgtattgtgttccctgaactctgcaatgtaatgaggataaatggtaagcaaaacagacacattatgtatcctcacggatttaacaatttattgggggaacaactatgggtttaagtcatactacaatgcaaaattgcagctctacatgtgctatgaaggagtggtttccaggaccataagagtctgtgataagggggtttacagaataaagcagatcaaggaagtcctctttaagaggttgccctggagtttagacctgaagaatttgtgaggaggtatcagttgaaagagtcagggaaagatctgcccagacagaagggctgaataaaagaccctttggcaagaaggagtgtaacaaacacagggactgttatgggttgcattatgtcacaccaaaaagatatgctgaagtcttaaccccaagtacctcagaatgtgactttatttggaaacaaggactttgcagattttacaaagttagaatgaggtcactggggtagaccccaatccaatatgacgcgtgttcttgtaagaaggagaaaggtgggcatggacatgcagaggaaagactatgtgaagagacacagagaataaggacatattcaagccagggaattcctgaggttaccagaagccaggaaagaggcctggaactgatccttccctagcaccttcagtgggagcatgactctgctaacaccttgagtttggccttctggcctccagaagtgtggcacaataaatttctgttgttatcagtcactcagtttgtaatactttgttacaacagccctaggaatgtaatacagggactgaaaacatatcagtgtagattgcaaaggaagaataagagcaacttgatctgaagagaggatagaacaataggcagggacaagacaataggtcctgaaggccatttttatgagtttcctttttattctaagagcaaaggatttaagaagtacaagaaaaagatgatagtagcttggacactagagtggtagtaatggttatagagagaaatcattggaaatagggaagtgaataaaaaattatgaataaaccacaaaaactcaggcttactcaaggacatcatttaagccattgtgtttgcttttgtcatcaatttttcaatctctattaaaaactggttttcgttaacagattgaggagtagttggcatgtaatataatgcatgtttaaaaagtgtgaaatttaataaattttgacatataattataaaggtatcataatcaagatagttaacatccaatcatctcatatccaataatccaataattaatgtctaaacccaaaattttcctagttcctctatgtgttactttatttatttatttattgagatggagtcttgctttgttgcctagcctagagtgcagtggtgcgatcttggctcacttcaacctctgcctccccggttcaagtgattctcctgcctcagcctcctgagcagctgggactataggtgcacaccaccatgcccagctaatttttgtatttttagtagagacggggtttcactatattggccaagctgatccaatctcctgactttgtgatccacccaccttggcctcccaaagtgctgggattacaggcatgagccaaagcgcccggctgttactttattttaatattcctttctctgaaatttatttttcttatattgtcatcccagttttttattattagcatgacgtattatttcccactattttaaaacttatttgtatctttgtattaaagggagttccctgcagacagcaaataattggattttactttcttgtttaatttgataatgtctgccatttaattggaatatttagttcacttacatttaatgtgactattggtatggttaggtattaatccaccttttttttttttttttttttttttttttttgagacagagtctcgctctgtcacccaggctggagtgtagtggtgccgtctcggctcactgcaacctccacctcctgggctcaagcgattctgcctcagcctcccaactagctgggacaacaggcgcgtgccaccacacctggctaagtttttgtatttttagcagaggtggggtttcactgttttagccagggtggtcttgatgtcctgacctcgtgatctgcccacctcggcctcccaaagtgctgggattacaggtgtgagccaccattcctggctaacccaccattttctacttgttttctatttgtttcctttgttctttgtaatttttcccttttttcctgctttctttaggattatttttattccattttatgtatattgttaccttattagtcataaccctttattttggtggttgtttcttgcttcaagtaatattaagttatgtacctcttcacatatagtatgaggaacttgtaagaaaatattactacttccaatttcttctcctggcctttctgttattattgtcatgcatattattgtatatatgttataaaagtcacagtacaagtcatttatcacttgaatgcatttaactattaaggaaaatatcttatgtatttacccaaaaaagttaattctacttgtgatcttcatttctttgagggaattttaatttttacatgattatcattttactaaattacttttttggacatttcttgtagtgtggggtttgctggtgaaaaattggttcattttctttgtctgaaagtacttattttagcattttttaaatgatattcttccaggttataaaattctagattggcgtcctattatttcttttagtatttaaaaatgttgctcaactgactgcttacttcattgttttctactagaaattggctgtcattttgatctttgtcttttgtaaaggcatatgtttttttgtctgacccctttcgagattttatcactgattctgagcaatttgaatataatgtatcttgacatagttttcttcatgtttcttgtggttgaagtttgatatgattctcggaactgagagtatatagttttcctcaaattgcaagattttggctactatttcttcataattttttgtccctttttatttctcctttcctttagagactcccattgacaaaaagattcaaactctgtaaaatatttgaagggatttattctgagccaaatataagtaaccatgacctgtgacatatccctcaggaggaactgaggacatgtgcctaaggtggtcagggtgcagcttggttttatacattttagggaggcatgagacatcaatcaaatacatttgagaaatacattggtttggtccagaaaggtggggcagtttgaacttggggggaggatttccaggctataggtggtaaatttaaacattttctagttgacaattggttgagtttgtctaaagaccttggatcaacagaaaggaaatgttcaggttaagataaagattgtggagaccaaggtattttgaattctcatagtggctgccattaaagacaatagatgacaaatgtttcctattcagacctttaaaaggtcctagactctcagttaatctcttcaggaatgggagggcctgggaaaacaaagatctagctatgttaatagagattctttacatatgcaaattttctcccacaaagtacagctttgcagggccatttcaaaatgtggcaaagaaacatgtttggattttcttctttgtcaggtaatgttacacataaaatatttggattttcttctttgtcatgtaatgttatgccagagtcagattggaaagtaagtcacgatatatagggttaaataaaacccatctaatgagaatttatggtttgtagggcatgactccccagatcccttagataggaatttgcatgagataaaaaaaatcaaagcttagtcttcaatcccattgcatttatattagttcactttaagtattccacagtttatggatgctctgttaatttttttttcagtttgtattgttttgaattctatgcctccaaattaatttttctcctgcaatctctaatctgcttccatctagtaaattatctcagatattatattaataattctatcaccagacattttatttgatcctttttaacttccctgtttcttcttaacctatttaatctttcctctcattttttgaacatatgaaatttgatgtaatgacttaaaatgttctctttttttgagccagagtctcactctgttgcccaggctggagtgcagtggctcgatcttggcccactgcaacctccaccaccctggttcaagcaattctcctgcctcagcctcctgagcagctgggatcacaggctcctgccacggtgcctggttagtgtttgtatttttagtagagtcagggtttcaccatcttggccaggctggtcttgaatgcctgacctcgtgatccacccacctcagccttgcaaagtgctggaattacaggcatgagccactgctcctggccttaaaatattcttgtctaattttatcatctgtgtcagttatggattggttttgattgacttttctcttcacatggttcagattttccaatttctttgtgtattgttaatttttgtttggatgccaaacaatgtgagttttactttttgggtactggatatttttattctatattctttagatttcttttgaaaagcagttaaatcacttagaagcagtttgatccttttggatcttgattttaaacttagaacagaatttagtgctggggctttttttttttttttttttttttttttggtctcacttcaaaagtgtgacctctctaagagcagtgcccaatagccatatgaattaataagattttttagtttgaaaacactcattattctcagccttactgagttctgaatatattgttctcactattcttttcaggtggctcttttcatatccttggttagtgtcctaacaaacatgtgctaattagtacccagctgaatattcgaggagaattgtttacagatgtctggaattttctctctgctgccctcttttctctttagtgtgcactttactatgctgctgtagagaggctatcctactccagaaagacttgtttataatttcttcacaccactcatttattcattttctcctttatacttcttccaatctggtttttacatcctctgaaattcttatcaagtcatcagaccatcattttgctaaatctagtgtttatttttggtataaatattctggcctccataatgtctgacctcatcttttattaatttctccttcaatccatcacattaaaaaaattcttcgatcacagtaggcatgattttgtcttagaacatttatactggctattttttctgcttgaaatgccctttcttcagatatttgcctcgttaacaaactcctctatttctagacttaactcttcgtcttagtcttagtccatttgtgctgctataacacagactgtggaattgataaaagacagatatttatttctaacagtctggaggctgggaagtccaaggtcaagtcaccagcagatttggctctccagcaagggctgcatcctccagagtgaaggaaactgtgtccttacactgcctccagaggcagaagggcaagagagagacactccctctatccactgctttgataaggatacctaatctcattcatgagtatgatggttaatattaggtgtcaacttgactggattgagggatgcctagatggctgatgaagcatgttaatagatgtgtctgtgagggacacatctatttgccagaggagactgatatttgagttagtagactgggagaggaaaattcatcctcaatgtgggtggcaccaaccatttgtctgccagtgcaggtagaacaaagcaggcagaagaagaggataggcagcttgttgagtctttttgctccttctcttcccatgttatgctggatgcttggcttcctctcctcgtgcccttggatattaactccaggttcttcagcctttggtctgtgaggcttgtaccagcaacctcccaggggctcttgggcctatggcctcagactgagggctgcactgttggcttccctgatattgaggcattcagatttaaactgagctatgctactggcttctctctttctctagcttgcatatagatagatacagatatagatatagatatatagatatatatatagatcctattggttctgtctctctgcagaaccctgactaatacagtgacggaggagccctgaaggcctaatcacctcttaaaggccccacctcttaatactatcacactggcaacatctgaattttggagagggcacattcaaaccatagcactcttcaataagcctaatcaccctacttaaaattccagcaacttcccaggatagccagtctctaaagataaccctcaataaaccttgtgtaaccctttcctcttgaatctgggctagccctgacttggagccaatagaatgcagcaggtgtgacaatctagatcttctgaggcagtcagaggacaacttgcaaattctgactgggtctgcttaaatgctagctgtcagggtgctcactctcagtacacatggagaggccacctttaggcaccttgatcaataacctcagctaagcctacatttgacaaccagtatcaactgctggccatgtgatggagctgtcttggacctctagcccagactaaagccctggctgatatctgtctgtaaacacatgagaaactgtaagtgagagccaactagatcagctaaaacacagtaatacaagttaataataaattgtttgaagccactaagctttgaagtggtttataggcaaggatagctagaaactctgtttgccctgcacttcaatttttaatctcttgctctttgtctttttccctcagcatttgttatcatttaacatactatatgatttgtgatttattatgtttattatttattttttgtcttgttgtccccaccagattgaaagctctaaaaggtggcaatcattgtttgttgtgctctctgatatatctcagttgtctagaacagcatggctaatacatagtggaatttcaataaatatttgtaaaagtaatgaagaaggcggtagtctatcctaaaaagttaaacaagactcattcaaaagatgatcacaaatttactcaaatgtggttcattcccaaagccaaaatgataaattaagatgtcaacaaatatctatggaacacaagctaaattacagacttgtaattattaatagcaaactggagagtaattattagaaaaaaatgaaatttgaaattactttcaaatattacaccattataagcctctgggtagtgattttagattaatataaaatttgatgaaaccaatcataatgaaaaagatacctaattattgtcactcaaaaataataatttaaacaaaatttaagggcatataaccacaatgttcaatacttggatttgttacagtaccttttttaagtgattacagggttaacataatttgagttgtgcatatttatttacattaatttcacttcacttaatggaatctgctggagattgacttgtgtttgtactaaaaatacataaaatatattaagaaaaagcagagagagagccactgatttattgtgtttggtgtccaagaacagctcaaactgctttctgtgaaagagttatgccttactgtttccttaaaaatgttttgtctgccgggcatggtggctcatgcttgtaaatcccagcactttgggaggctgaggtgggcagatcacaaggtcagcagatagagacaatcctgtctaacacggtgaaaccccgactctactaaaaatacaaaaaattagcccgccatggtggcgggtgcctgtagtcccagctatttgggaggatgaggcaggagaatgccgtgaacccgggaggcggagcttgcagtgagccgaggtcacgccactgcactccaccctgggtgaaagtgcgagactcggtctcgaaaaaaaaaaaaaaagaaaaaaaaagttttatcttgaaaactatatgtcagttcttagttgagttagtaatatgaggaatggctacaagtttttaaggaaaaaatacattttaagaatgttcactgaaaacccttttaaaacaacaggttctgaattttaaaaatattcagatagatttctttttgaacatataactggaatctttattacaaaagaatcatcaatgtttgacttctaattcatatgccaacatgcatttctaagcaaactataaccaagaaaaatgccaagcacactctgtaagcttagaatgcatgtgaatttcatattaattctttttgactcctcctgaacttgagcatcttacaggtctgattgggcaatttatcagttctcatgctcaatgaattcagtcgtagggcacatgcaacttaaagcaatgaggcctaactgccagggtgcttagaaccatcagtagggatgaatagcacagagtcagcatacaaatagaacatgaacatagagcaaaggcgaacatttagcctgactttggagcaaaaccagagttaagaccaagccctacctcagcacactgacgcttcagttttacatgtttgcttcgtagacagaactacttcacatttatttaccttccattatacaatctgcacattaaaaacaaaagaaaacaaaacaataatggccattaaacaaaaatacatgatgtagcttgctaaataatttatgggctttttggaagtgttttgggcagatttcaacctaacattactcttatttcctattcttttccttatagaatggagtatcatgataactaggtactaagtcaagtcaacagtgggccaagttgcctctgtggaatttaagctttacatgaagagagacttaagtatatttagtccttggtggtagaactctttagtgtgaagtcaagtagttgcttttgtagctttgattcaaagaagccaaaatcaaatgctatggggcctggaacatggtgaaagtggactatctggcactgaaacttggaaaccctatctaaaggaagcagtcactacttagctctaccaatagttgccatgctagattgtgagaccagggatgccaggtattttgtttctgcaagagaagccagaaatatggatttatcatgtcaactctcctaataaatactgaaatgtacttcattctttggtgctttatgcaagacaaaaaaaaaaaagaaaaaagagagggagagaaagaagaagcgaagaaaagacatggactctcatgtagattgaacttggtccacagtttactagcttgagatctgtaagaataaactaaggaggtaagagaaggaggagggcatattacttaggtgagaagtaattgtaaaatgtattataagcatttattagcacagtaaaatttatggacaaaatagaaacttcaaactacattaagccttctgtaatcgagctgtatcacctgcttctcattgatatcctttttcttactacttcctcccttattcagagaagtgttggctaattgttcacaattttactatgcactcactttccattctactctattaattaacactatcattcatttatttaatgaataaatatttttcaagttccatatgcgttgctttctagtatacgtggaaatgtggtatagccaaaaagtcacaatgatcacgtggatgctattcctaacgccttggcctctcaatatgttgacttccctgaattccaaaaggcatcatcattttgcttcagctcaacattcctaaggtcataatctggacattgctgttaccaggaagtgttccatgtctaaattcatgaattcagatttttaactcattgacccacccttccttccttccttccttcctgcttgcattcctctcttcttgccttcctttctttatccttctcttttccttctttccttccttccttccttctactctcccttgcctctcctgttctgaattctgtaagtattattgcactccatctattttttgctctcattaaattctttgaatcttgtaatttctcttatatcaacatcttctacctcccagtagtatggggtcctgttttattcaagctaatcttcatgctctttcatattagtgaatctcatgacaaaatctgtactctttggatcttgattttttatagacttgacatgtaaaattctacctttttgttaatccacttccctccactactggaggttgataccactgtgagtttaggttcatcaaatttgattagacctcaaaattctctagatttctagatcttttacatatcttttaaccatatctttttcttactcttcacagtggctattttaaacctttctcattctactcaagctccgactgcaactttttcttacttaacacatgaccatcagggcaactgttcttaaatttcttcacttacctcatctaccaacttaactaacaaggtatcatggttttaaaaagtgctatgttcaggataattccttcaactatgcttattatactatccgctaaactgtccttatttttcattcattcattttataaatcatatattaatcacctagtttgtgacaggtactgttctgggctctttggccacaccaatgagtaacacatattaggatcctgttctcagaaagacgttccactgaaaggaggtaatcagctgttagaaaaatattagtttcagctagtaataagaactgaaaaaatactaagacaaggtgatagatatatcagatagtgagtacctgggtgtgaagacacttccctgaggaagagacatttggtcagagaatgacaagaaggagccagccatgagaagacgtagaggagaagcatgtgaattcacaggaaagaataagcacatgcatcctaacttgggaaaggacttggtgtgtttcatcaatgcacatgcagttgaacaatcatgggtaatagtgggagatgagattagaaggtcaatcaggagcttaatgtaggttatgcaggaagccttttgtggttgttaagcatgggattgatgtcatccaatttagatttttaacaaaaacccataccatgctgaatgttgatggagttacgtaagggtagaagaagagatattatttagtaggtaattcaagtaatgtaggtgagagataatggtggcttgattttagggtgatactagggaaagagaatggttgacagattaagagtatatctagagggtaaagccaaaagatttgctgatctatggatatggaagttaagagaaagaaaggaacaagaataactcctagtgttttttgtttgtttgtttgtttctttgcttgactaattttgttatgtcattcattaaattgagaatgaaagaacaatatttttgagatcaaaataaagttgcaatcctgagttaagttttatgcatgctaaatttagatgctttattaggcatgcaagttaagatgtctaattgacaattggatatgtgagtttggagttcagaagagaggtcagcactggccatcaatattcagtacccgatgtcttgtgggtggtaaagccatgggactaagtgagataatctagggagaaatcagaaagagaaaaaaattcagggcacatccctggctcactctaatacttaaataataattagagaaagaggaaccaacaaaagagactgagaaatacctagcaagataggtgaaaagacaaggaagagtgatacatgctatagaagctaagaaaagaaagtacttaaagaggatgcaaatgtacatacttgccagagctaaaaaagaaaaagatgcaaatgaccaactgtttagctgagaaactagtaatgttaaaactgtgaaatagctgttgaagttggtctggaggggtgtcatttgttataagaactatttcaactgaattggagtcatttgaggagagaatgggaggtaaacaacaggagacagagacaacagacaactcttcttgtaagttttatcatgaaaggagaccaagaagagaaatagtagctggaagagaatgtgggctaaagcagggttttataaagtgggaagattctagaatatgtatgctgctaggattgattcaatagaaacaaattgatgatgtaggaggaagaggatacttgcaggaaccaagttcattagaaagtgagtcgcagatggagctagagcacaaattgagggatagaactttgacgtgagcagggacacttcatttattgtaaaagaaagaaaggggatgggtagaagtttaggtaggtaggtaaattttgtgatgaaaacaaggaagccctagattgaatctatttaacaaggtcatcatttgaaagggaagagtgggtggaaaagaggtagggctggaggccactacacaaagggagaaggtatgaatactcattttacatagtgtcagagtaaatatgcagtgcagtggagttgcagagtattagagaatgccattttgtcactcatggtcatgtatttagagtgagacaaaatagaattgctgtgcatcttgaagcctgcacaatgtgataggctgaataatggtccccaaagatattcagattccaatctctggaatctatgaatgttaccttatatgacaaaagagactttgcagatgtgaaaaaattgaagattttgagtacatgagattaccctatatttatcagatctgttctaaatgtagtcacaactgtccttataagaggaacaccatgattttagcccagtctgactcattttgtacttttgacctacataactgtaagataataaatttctgttgctttatgccactaagtttgtggtactgtgttgcagcagcaataggaaattaatacagtccactacttcattcctttcctttgtatctttatcctctctcttctttcaggccatttcctgttagcaggtaaacatgcttaagagtttccttttaaaaaacaacattaataaacaaaaaaccacagaatttcctacctctacctgctcagctctagctaccatccctttttatatagtccttttaacaactaaggcttgttatttttattatttccttctcatctctcatctactcaaatcttctgccaactctcgtcaacttcttttttccttagtaaactgctttcaatatttggcaaggtgctcttattcttaattccagtatattatttttacttctacccttttcaacctctttgttaatcagttgatttccccattctggtgatattctctccccttgggttctatgataccacatttttaaaaaattacatatttgctctctgaccgttcttctttattctcctttatgggctacatttttctcatggctttttcttggtgcaattttttaaatttattattattatgatgattattattattttgagacagggtctccctctattgcccaggctggagtgtagtggcacaatcatggttcactgcaaccctaacctcccgggctcaagtaatcctcacacctcagcctcctgagtagctgggactataggtgcatgctaccacacttggctaattttgttattttttgtacagatgaggtctcaccatgttgcccaggatggtatcaaactcctgggttcaagcaatccgccttcctcagcctcccaaaactctgagatcataggcgtgagccattgtgccttgctttattagtgttgttaacagggctctacttttttctcattctacatattcttttacagttatcttagctatttcccaaaactttctatttgacactcttagtactcacctggacaaatatactctgttctgtacaccttattgtcatgctaaggtgtcctgagttggaaagacaggctctcttgtcctgctccatggcacactcatgtccgactgcagtgattaactgtattggatttggtgtcactgaactgattttgaattctgaccttgcttttttcctacctgaaatagcaagtgatttaccacctgaatgtgtaaaacagtataaacccactaaactgtattaattaaatgagataatgcacatcaagtacaacgcatagtacctggcatatagggggttaataaatgtgggcaaatattagtatcgctagcttcttcttttcctctctaagttctgtttctgctggtaattctaccatggaacttctcttttccattgctgttgttgtagtagtttctaatgtctcctacaacgtttgatgttcacagcccaccattgccacccccactcctctttttatttttctgcttcacctttcctattactcttgtattatttttatttttcccccattttccccattattcccacattctttattttttctgttttccttacgttgttctccttctcctccaccttttattttttctgaatttgcacatctcaacaaatagtccagaccactctttgcagacttcttcattgccaggatctgcttcttagttttcatagttactgtttactttttcattatgatttatagtaaagatgggaagaaaatgactagtggcaggcctgcaggcctttcttaactaaagacagccctagaaaagaaatttaaagaaaatttctcaaaacatgttagtgacagaccacctggcaaatactaataatatgggctaatgggagagtccttatctatggactgctgcagcaggatgtctagtatgcttatggaaaacaaatctagaacctacggatttatgtgtcatggcccctggaaatgtatataccctatgtaactatcctaatataaaatttaaatgtttcataccaaaatagcttccttttgtgtaagttatgtgactatgcacattccatagcagctttgtttgttaaatctgggccactgtgtcctgatgtgataagaaaggcctgggaatttgtcattgtctttctggatctttccctgctttgtctgtgctgtttgattacatttgtccttgaagtcatcagtaaagcttgatactaagtaaggtttataatttgtgtgagtctgataggacagcttgaatccttccttgtgttttctcattggatatggtggcattccagatgattacagttgttaggaaatttctctctggatatctgaagcaatagtaggctatgattccaacatatctatctgtcatgattacagttctctttgtggtaatatattatcatatgtaattcagtaaagaaatgtgtatacatgcatgtaatacatcaatgtctatatctctgggtccatacaatgccataagagcaaatgtcaatctaagcattgatttgatgttatagagcctctagaatttttgactgctaaaaaaaaaaaacaaataatttgttaatttggtttctatttaagaaaccatttccatagaaatagatgcagttcttttactgaattacatatgaatcaaattcacaaataaagttagctcactttaaaatcatctaatctccttttaaaatgtatgacataaattatttaggtgttatttataagaggtggaaatataacacatcatatttatatcctttttttgctgtaatgatgaatattacaatttcttgagtgtgctattttccagacaaatgtgtattccattgtattgtcattagaaccataacattttctagaatgttacttacatcttaatgaagggataatcatgctatgaagcttttatattttcaacattacatttatttctcagtaattctctcactttgcagaaatgattttcattcttttacatttttaatgtgtgatgtacctaatggaaaataaagataatgctaaatgaaaatgagtgttattcattgataagaattcaattaatctatacaaaggtccctttcattacctcttttacagatttttaaaaattctctatttcttttataaggtttccttagatattctctatcattgtttttctttgtgcatttaaaaaagatgatctaggccaggcgtggtggctcacacatataatcccagcactttgggaggctgaggttggcagataacttgaggttcaggagttcaagatcagcctggtggccaggcacggtggctcatgcctgtaatcccagcactttgggaggctgaggcaggcggatcactaggtcaggagttccagaccagcctggccaacatggtgaaaccccatctctactaaaaatacaaaaattagctaggcatggtggcacctgcctgtactcccagctactcaggaggctgaggcaggagaatcgcttgaacccaagaggcagaggctgcagtgagccaggattgtgctacagcactccaacctaggcgacagagagagattccatctaaaaaaataaataaataaataaataaataagatgatcttataggaaggggatactacagtctgtaaggacgtaggagtctcaaaaatcatttgagttcaaaagaaatagcatttaataacaattacaatgtaataacaatgataacgagaggtgccaacgtgctagcagccctcactcactcttggcgcctcctcggtctcggtgtccactctggccacgcttgaggagtccttcagcccgctgctgcactgtgggagcccctctctgggctggccaaggccagagccagctccctctgcttgtggggaggtgtggagggcgctgctctgtggcgcctggtcccatcgaccttccaagggctgaggagtgcaggtgcgtggcgcgggactggtaggcagctccacccgcagccctggcgcaggatccactaggcgaagctagctgggctcctgagtcgggtagggacttggagaacttttatgtctagccggaggattgtatatgcaccaatcagcactctatgtctagctcagggattgtaaacgcaccaatcagcactctgtgtctagctcaaggtttgtaaacgtgacaatcagcactctgtgtctagctcagggattgtaaacacaccaagcagcactctgtgtctagctcaaggtttgtaaatgcaccaatcagtgctctgtgtctagctaatctagtggggacttggagaacttttgtgtctagctaaaggattataaatgcaccaatcagcactttgtgtctagctgaaggtttgtaaactcactaatcaatgctctgtgtctagctaatctagtggggacttggagaacttttatgtctagctagaggattgtaaatgcaccaatcagcgctctgtgtctagcttagggatcgtaaacactccaatcagctctctgtaaaacggaccaatcagctgtctgtaaagtggaccaatcagctctcagtaaaatggaccaatcagctctctgtaaaatggaccaatcagcaggatgtgggtggggccagataagggaataaaagcaggctgcccgagccagctgcggcaacccgcttgggtctcttttcatgctgtggaaggtttgttctttcactttttgcaataaatcttgctgctgctgtttgggtccatgcagcatttatgagctgtaacactcaccgcgaaggtctgcaccttcacttctgaggccagtgagaccacgaactcaccaaaaggaacaaacaactccagccacaccatctttaagaactgtaacgccgcgagggtccacagcttcattcttgaagttggcgagaccaagaacccaccagttccggacacaataatatttcatctttgtatagtctttttaatttttcaaaattatttcatcatatgatacttccaatatacaactatccgtaatctatgacacatagaagctgagacctcaaaatgttccagtacagtgaattacaagggagtgtaatttgacacattaaaatctcaaaatgtattttattttgactgttctttgaaaaggcctatttctagagttgatatatatcaagaagatttaagattggcatggaaaacaacaagctgctaatgggaagggaagcctaacaatagtactagcactcagacccaaggaggtgggcttctctttgggttttgccgtgactgtgttagtgttcatccacgcgctctacccttctatgtgggaggattatacctgcccacaatgtgaaactcaggtgtgctcatgtgatatggtccatgaaatgtccatagaagtggagggtgtcacttcctggaagacgttttaatggtcagtacacactttgccattctctttttccctctcctgtgataatagacatagtgggttccaaaagatgacatgacagagctgcagccaaccaataacggacatggaggaagagtgagatctaaacctgagtgttataggtctctgatatttgggaatcatttgttagtgaagcacaacctagactgtcttgactgatacaggtttgctcaaagattattaggaacttggctgtcctgttctccagcattgtcctttcctttttcatgttctcacctaaatgtggtcacaaaatactcttgttgattctccagcgcagagagagcaccaacgttttaaagactttactaaaattatgtctcagaaaactgtgaaacaaacccagggcctagtataattcactgtatttttgcagattcctcaattccatatggaaccccaagataaaaacatcttgatggaagtctagtctttcatgctcctggctaggaatcaaacggctcttaccatatgtggcagacaccacagagatgcaccaatcagctcccctttcaagaaaagactcattgtccatctgtgagggccatctgtgaacttcgcaagtccatctcagcttgagcggaggtcatgctctcctcagagtaacctcagtcagtgactaagcaagaatgtggtgcaagcacctagccatttcttttcaacaggggacttctgtaaaaggtgatctttgctctgaggctgtctgctgggctggcagatacgttgtcagatctgcattgcagtctggcagatcctcctacccaatcctgcattccccttgtttcttcacagatattaccttccaagatattttgtactcctaaattcagctcagcgtctgtttctgtgagtgggaaaagaaacttacataagatctacctacttattgagagtgttctcctagatataaagtcaaagatgagagtgccccatccccttgttcttctggctgttctcagtacctgttccctgtctgtgtttattcactgggcagccttatcatcagaaagacaatcatgcactataatagaacaatatcttataacagccatataacaatataacatacatccttaattctgtcaggattttgaaatgaaatgttctccttgataattttctcaagtgtaaagtgggaataataaaagtaattttctcacagagttgtgagaataattaatagccaaagtttattaagtgttcactttatgtcaggctttacaggcactacagtatttcattttattcaataggtgaggctattggggcaaagaaaggataagtaacatatagctaatgataggctgagtgggaactggggtctacacagagtgacatcacagcccacttacacaattactctctgctactctgtctctcaaagagatctgtcaagaccttagcaacgtgcctgcatggattaagcttaccatttgttggagtaggcaccccacaaatgttaaccactatgattacttattcattttcaaagttgaacaaataaaaaaaaaaccctgaataattcaaatacaaagaaataaaggtccttttaagctacctgttctccagcgttgtcccttcctttttcatgttctcacctaaatgtggtcataaaataagccaagtcaatgagtttggactttatcttttgggcattgaagagttattggagagtattaagaatggactgacatttagattcacagattaaaaaggtgactctatttgtagtgcagtcaatgaaaggaactgatgcataaagtggggtaagggaatggtagaatttgtccagacgaaaagcgaagtctgcctgaactacggtagtggcaacaggaattagaaaaaaaaaattaaataggctaggcgcatgggcttgcgcctgtaatcccagcactttgggaggcggaggcaggcggatcatgaggtcaggagatcgagaccatcctggctaacatggtgaaaccctgtccctactaaaaaaaaacaaaaaacaaaaattaggggggtgcctatagtcgcagctactagggaggctgaggcaggagaatcgtgtgaacctgggaggcggagcttgcagtgagccgtgatcgtgccactgcgctccagcctgggcaacagagcaagactctgtctcaaaaataagaaagaaagagagagagagggagggaggaagggagggagggaggaaggaaggaaggaaggaatcaagtagactagttaattgatttaaagtgtcacactggtttggacacttcatctggatgggcttcagttgatttatttgtgaaaatcttttggatgagatggttgctaaagtggtttttttgtttgttttgttttttccaattggcatctcttaagagggagctggaggtagaaagggtgggggaaagaaggaaacagagtaggtagaattgtaggaataaatatagtgaaaaacttttggaatgactttggtttggaaacttggtgcatttataacattattaagaaaatttttttaggcaaaaatctaaataaaatgcctttaacatccagctttatgttcccctaattttccaatttacttctaaactcccttaaagcaatacatttatctagtcttttgaaagagaatttataacatcttggagctctcaaataaaaagaggagagccaatcatggtggagggtttgttgttgttgttgttgttgttgttgttaagtataagaagcattaagcaagctcccaatgaaaccaagttttctttttaaaaatcctacaatttatgcaaatcccatatgggatttatgcaaattccatacgctttggtagtcagggcaaatagatatttgccataaagagaagtgagttgagtctatcttgcaaacaatatagataattgcagagaaagtaaggaaacaagctgcactttactattttatgctttggcaaattgtgttgcattgttatatacctggcaaaagaaagtgtatcattttggaaattgctgctgagtgtggttattgtgcacaaccacagcagagattttgaagtcatcatggagccgaggtggcagggtcactacgtgttctcactaccagggctatctgttagagtctgctgaatagctggcatcaatttcaggaggcaggaggcagaaaagtgctggactctatcctcatttggcaaagctttgaaggataatggttgagtgaataaaacttctactagcttactttcatttctagaacttcatgttatttctgtgaatattgaattaaacgagaaggctaagaaataattgaattcaaacatatttatcattctaaattttttttggaaagaatttatattttaaagtaatatcagtaaatgtaaatggagcaatgaagattaatgcaattctaaatatttaccctagtgggacaccatcacttcttgcctcaaatactgaaattgtctccttagctcccatttttgcattctgaagtttttctacacaatgtagtcagatttttctgaaatcaaaattggatcacggcactccctatttaaaaacctttggtagattaattaattaactaatgctacatcataactcactaaaacttagtttttcggaatgaaaactttttgttttttttcctcacagtttctgtgggtccacaactccagagtggcttagcttgggggttatggcttgaagtttcatgagattatactcactgtctgtagctacagatatatttgaaggcttgactgaagctagagaatctgcttctagtcattaacatggcggtcaagttgctgatgacaagttgtttttttctccacagggttgcttgagtgtcctcacaacaaggtggctagcttaccccagagtaagtgatatttaaaaagcaaggcagaattcttcactgatttttgtgactaacctcagaacttatttcatcacttctgtcatattctattggtcacataggccagtactgtttcactgtgggaggtgactatacaaggatgtgaaaaacgggaagcaaagattattaggcaccatcttgaaggcttaatatcacagttggttttcatttactttgggataaagttcaaatttttagacactgcttacaaaacctgtcatgatatgacaatttcttacctcttcaacttcatcctgcccctcatgaatcatgttcaagccattaaaaacgtatttcttcagttcttctaatgcactacactgttttcactctcttgttggatcttttttcccatcctttaaattgactcactgttactcactcttcatgtcaagttattagaaattctctttctcaaaagtttccatttgacttccaaatcatggattagtcacttggttttgtgaacccctaacatcttgtctgtcttaattatagcatttattgcacttacttttttataattattattttttcattgtgtaccctagtagattgatatgaaagtaggtgctctgcatatatgtgtgtgtatatgtatatatgtcattctgcctcattgcctatcatgtgcctaaaatgtaggaatatttattgaatgaatgattcaataaatgaatgagagactatcttgactctcactcagtaagtgatatttaccctaattttctaaggtgatggaaaaaaatctaataaactcacctataattacttttttgttagcttatatctctttataaacccaaacagaaaagaacaatctgatatactgatactggggtttggttccatgtgtgataatactggtaatttgttgaatctggagatatagatcctatatttatcttctaatgaacaatgatagagtaatgaaaatgtttttatctttctaggttacaaatcaatactatgacatatgagagtcagtgaaagtcaataaagattttctaccaaactatttttttctctcaaaactgtgaaattacaatactatggttaaaatagactgatccaaaatttttatatcattacatttagtaatgcctacatattattttccatagaccagttttaaagatgaacaaaatattacatagcaaaatatagtgttacttattaactgtacaaaacaaagatcagttgaaaagatttcaatgaattttaaatgctcccattaggtatgtcattttccccttctaacatgccacctaaaataaccagatcactattgacaataaaatatcctatactgcataccatttatagaaatagtagcacttaagaagagtatgtcagtggtaaaatttcagtcaaagatttcaatattttaaaagtattggggtggccgggcatggtggctcatgcctgtaatcccagcacgttaggaagtcgaggcgggtagatcacctgaggtcaggagttcaagaccagcctgggctgggtgtggtggctcacgcctgtaatcccagcacttttggaagccaaggtgggtggatcacaaggtcaggagttcaagatcagcctggcaaacatggtgaaacccctactaaaaatagtatttgaaatctctactaaaaatacaaaaaaattaggcaggtgttatggcacacaccgcaggagaatcacttgaacccaggaggcagaggctgcagtgagccgagaccatgccattgcactccagtctgggtgacaaagtgagactccatccaaaaaggggggaaaaaagtactggggtatctatttctcccaaaatgttaaatggcaagtgagtggagggaaacagaaggggatagttcatgtcccatcttactggtttacaactgggaaagcagagtaagatcttcatgtgggttgatgtgatatctgtatatatcagcagacataacagaatcttcttgttggcctatcctgtttagactaacattatggtattagttcctttggggctcacatttattctctgactgccctctagcaaaacttatggggcagacactttggtaaaaggtcccaaactataatgattaccttatattttgtcagtgcaccattggcattgaacaaaatttagtacattatttaataaccatggtagttcatggcaatccatggccctcttgcatattggcaaagttgaaacatcaagtaatctacattttaaaaaatgtctttgatcctttctcgtttgaaatatggatgtaacaggtgcaatggaaaaggaaggtgtgagagtcctttctataatgtttacataacgtctgtctataggagggacaagacattcccttcgagatttgggggtatttggacatagtcttgcaaattcacaaatatcttatgaaagaaaaaagaattaggaaacacttatggaatatttcaagctataattcagttaatcaaagttttaaattatgtttcatgtacctatgattaaaagagctttaattgattaaacaggggttcattttacttttgttaacttgacacatactacaaaaaattcaagatactaggagggaaaaaataaacactatcaaaagctatgttgtggaccttactctgtttttttcaagtatacaggtagaattttactaaccaataaagaaaagttataaaaaaacatggagaatatagttctttttatatacctgatgccccatcctccagtccctcttaaagagatagagtggtgacacacacttccttcaaaggctgacaaagaatatttgatttcataatgtttaaggtcatttctcagaatacacaggtttgaccattgcctaaatgctaatcattaattcaaaggctatattttattttttaaagaaagtttattatagtttgtgtattttgctattgaaatcaatgtgtaagtgcaagttactgtacacaaatttagaagttataggaggtcaggcacagtggctcacgcctgtaatcccagcactttagaaggccgaggtgggcggatcacgaggcaggcagataaggatggagatggagactctcctggctaacatggtgaaacctcgtctctactaaaaaataatacaaaaaattagctgggggtggtggcacatgcctgtagtctcagctactcgggaggctgaggcaggagaatcacttgaacccaggaggcagaggttgcagtgagccgagatcgcaccactgcgctccagcctgggtgacaaagcaaaaatctgtctttaaaaaaaaaaaaaagaagttataggaaatgacataaatcttcagaaaaatgataaaattacatgtaattcataaacaattacgtcatgctttttaaagttcattttattataactaagcgtaaggtatcttaagtctctggaacaagggtataagcatgtatctatgtattaaatagtaatgaaacatttcacaaacatatagttcaatgttcatattcaaaaacatatattaggatgggaatcacattgtatggctgtgttgtagtggtgtgttagtgtggcgactctgaaaaattactcttacaattaggcgtacataaatatgacataattctctcaacacactttagtaacatggcttttcccccaatgtgcaaggtaaaatagttttcctctgaggtactactttcgtggcaaaactttagtgaccaagaccttttaaatgaaagaaatccataccattgttgttaggagtccatattaagggcctatactggtatcgaagtaacttaagatgttgaccgtgtggtcaattttcttttctcccatcctgatataatgtaatgtggccatttaatgagttctaactcatttactaatgagcatattgtttcctcatcacatgctaggcaaacagaaagtaaacagcatctttttagcaaaaaccttttctggaattttttttttaattgtaataatataggaataaacaacgaaaacctatagcaattaccataaaagttttagtgcatttgtaatatgctaagtatttgatatattccttgtaaaagactatttaagtaaatctttagctgccggtgtttgcttgctgtacagaatcataaactatcaatattcctaaattagcatggtccagtcatccaacttattgcctcagtcactcaattttcaagtttatgtactttcctctcagttatcagatggtgacttttggataaattgttatggcaaaaattttttttaatatcatggtgaatacatgttgatgtgatctgaatatataaaatatcaatatctaaagatcatttagaaaatgtttatttttactacaaaagttatgcatgtttacataagacgttaaaagtaaagtaaaaactcatttcctgtgaccctgacaaaacatcattagcattttattaaaatttatcctagttattttctgtgtttatatatatttttgcctataataatttttatttattttttacaattttctttcctttttttttttttaaagacagagtcttgctctgttgctcaggctggagtacaatggtgcaatcttggctcactgcaattccacctcaggttcaagcaattcacctcccttagcctcctgagtagctgagattacaggtgtgcaccaccacacccagctaatttttgtatttttactagagatgggatttcaccatgttggccagggtggtctcgaactcctgacctcaggtgatctgcctgccttggcctcccaaagtgctgggattataggtgtgagccaccacgcccgacccgttcttacaattttctatttttatttatctctgtagacatctaacactatgtattctaacatcaagcttagtacacagtagacatttaataaatgtgattagttaagtatgttaaatatcagatgctagaatatttatacatatatataatgtatatttttaagggtttacacaattccaggaggcaccattctcattatctacacaaatggcattctcaggagggcacatttatttacatagactgcaatataaatggcctaggaaaatggtgtcttctagatgtacaatgatatggccatggatgtatatttgtgtgtatgtatacatgtatatgtatatacatacatataagtatacgtgtaatagccgcaggtatttcagtccatctataaaaccaaggcaaatgtcctcaaaattaaatgcattttcactcatttattatttattcaacaaatatttatgttcactgaaactgagctgagggctagggaaataatatatcagcaagatagacattgttctatatcctttgaaaatatcataggtgacagtgtacaagagtgttaaaaagagacttctacccatataagatacttaatagctctaacactgcagacagtagtcaggaaataccactgcacttcaaattagagtgccgcaccatctaagccagacttgtaaaagatgacaagagaaattattctggcagtatcacaccctctacacgtagtaagacaaggctgaaaattcatttgaatctggtatttgaaagatataatttcattgaaagaagtcagcatcctgtggcatttgcccttctttctctctagggaagaagaaagcttcttctttccttccatatcaagtgaagctgtctcaaaaaagaccatactgagaacttacttgagtcctcagaaattggaaaagtatcaaagctagattatggtttactaaaataaaataaaaataagcatcttttatttttgtttgtcttttaaaaggtaagaagatagacagcttccctgcttacctggtggcagggcgaggagatactgtctgtattagtctgttctcatactgctacgaagaaatacctgaggctgggtaatttataaagaaaagaggtttaatggactcacagttccacgtggttggggaggcatcaggaggcctgcaatcatggcagaaggcatctcttcacagggcggcaggagagagaatgagtgccgagcgcagtgggggaaagcccctcataaaaccatcaggtctggtgagaattcactcactaccatgagaacagcatgggggaaccgcccccatgatctaatcacctcctctgaggtccctcccccaacacgtagggattataattcagattacaattcaagatgggatttgggtgaggacacagccaaaccataccactgcctttgtcatgaaggacacttcttgtgaggcaggggatgggccatatttcttgtaaatcggatatggttgccacacaagagagagaactgggagaagtcttgaataggactttgtccaagatgtcctgctgaagggatgtagtaaccacagcaaaaggaggctggaaacagtactaaggggcattataagtgtcctgcatttggaggaatcacttcttaggaataacaaatgaggtctctaggggaggattctctgaagaagtcacaagtaccctacaaaagaaaaaacaaacagattttggacatcagccactttagggcgtcaatgacataaggcaactgtgccagtcatttcagctttcctctacttctcaccacttctccatcccacacagaggactcaagagacaatgtagagtaaaaattcaaggcagggaaagaaagaagctgtaatgacttcctgttttatctatttcaagacaaactggaagatagaaggtgagagtgattagctctcagggtttttatatcagactggactgggatttttaagaccatgaggtagcttgaaaagcaatgaactttaattgaaattttatctatcacaggaaagaagctgttgaaaggggaaattgaacaaagtataaaatcatgttcttcttacattttatccagtttgctttattctagtaaccattcacaaagaacaatgataacaaactatcaaaagttctataacatgagaaaaaaaggatgttatgggaacacaggaagagctttgcttccagcgacccaagctactctcctagcaaatcttccactgatgacagtaaagagagagtgatcttggatccctggtaaatcctgcctcagatactgaatgtagaggtgagctctctccaagaggtggatggaaagccagaaatccaggagctaagtaggtacaaacaactcgaggacaatatattgcctgtgtctcaggatgtgcagtggaatatttttagtgtactcaactttcttttgtggtgtctgccaaaaactctcataagcatcccataagggaaagaaagctttaaacacctgtcacattcagaaattgctgagccatcttacaataattccagtcaagaaagaacttaggtgttcttctcacccttttttttcttcctcctctttggccctagaggggagacagaaataacagctaacaggtggcagggaaggggaataaaagagatttttacagttgaacaaaattggaaactcaaattattcatatggtttagggcttttataattactaaattactaaactatatctttgactttaaagtcagccaaatttttccatttcctaataataagaaaaataatgaacaagcatggcccctactatgtgccaaacatgattgtaagaactattacctcctaatcctcataataatgctaaaatgcagaaattcataacactctgcatttcatagggaaaactgaggcacacagttaaatgacttgcccaattttattgggatttaaacccaacgaatctggtaacagagtacatgatcctaatcactactttataagttaaaagagaagataaatgatgtagttttcattaagtgccagacatcgggaacccaacccccactaagtaggtttgaatggagagagggagacaataacaaagttgcttctacggctataattctttgttcaatgtactgattgcttactttgtacttcagctggccgttagaagctactgaagagttttaaaatgatttgttcctatgatgggatttgcttttcagtgtgatcactgtgacttctttgtagagactggtttggaggagtataagagtggaagaaaataggtagatcagaaagactattatgagcggactgctgcctgaacaaagtaatgaaagtgggatggatggaaaagattcaagttaggtagatctatctgtctatctatctatctatctatctatctatctatctatctatctatccattcatccatctaagacagagtaaattggacctaatgattggatatggaggtgagaaaacattaagttataaatttccatgtgtgtatgtgaaactgctaaagtacatcataaaatatcataaagttagagtaaggatcaaattagataattcgtgacaagcgcttaccaccatgaactgtaagtggctaaggaagtttgctgaagtgaaaatagcttgggttctagcaccgtgtgtatatcctggggaaggtgttgtactctctgttcctctggcatcttatctgtgaaatatcagtaccttcctcatggtatacattgagtgaattacgtgaaatgattcttgtgaagagattagcacaattgctgacacactatagatctcaattaatgctagccatcttttactagactgttttcttttcatctacctgacattagttgtatggctttttgaggttaatttctgcatgtcacaaagcacactgttttcctcagaagaagctgatatttcataaagctagtttattgctcttatgcaaatggggcagtactttaagactgttaactactgaaaaaactagtattttgtcatgatgcaagtgaggagggtactgggacaccactccttccccatgggtcagataattagttaagtgggaaaaagttacaaaccacacagtgcactattgtatctagtaggaagtgataaaactattatcaaggattaatattgccctcatctatttgtttaaggcctataacaaagatttcatgggaattttctacatttttattttctaatttttacatatgacctctaatttggttctgaaatgaaatcaacttttagttctttttttatctcaagtgtattacatttttggagatgttatttataatactttgatttttcaaattaataaattgaagatgcaatacagtattcaatttgctgcaaaactctactcttcatacgaaaatagagatagagctatgacctaaagattaatacacagctccatcacagcatagcttgaaatgttaaacagctgatgtacaaaatgatgtgagagtatcagtgaataatacacagaagtgcatactgtaaacaaagcaaacatttctaaattgagagctgtctaattctagaggcaaactcagaatttggatttaagaagataattataggggagaaagaaagtaacaactatgttttcttaaaccaagatagagagtaagaaacatccttaaccaggaagctattgtcttaaactgctgttgttttggcatcattcataatcacttaccaactatttttttgagggtaaatcaggttatcttctgtttataattcttctgagggcaacttaacttcttttctttaacctatcatttctaactaccttcaagtttagccgtatacaacttaaatcacattttgctacactttttagatcttgagattgttttttggctactctgtcatcagtgtaatttttaaaattctatttgctatcggtaggacctggagtttacacatagccagaattaaaatgtattgacaagtgaaaataagttctttgatctcagtggggaaaagggatgcagctctgcactcctgaattctaccactttcatattctgagcctttgaagtttttctttgctttcctgcacatcctttggttcatagtttgtgcttattttttttcctgataaaattgtttgacaggcttagagctgtaaagataggagtgttgtttaataaataaaaataaaaagataattaattgtttctgtaaggtcgaatgcataatccatagagagcttctttctgctgtactcgctccctacgtaactcaactgtgaaaagcagaaacttttcatttttttttttttttttgagacggaatctcgtctgtcgcccaggctggagcgcagtggtgcctgccatctcagctcactgcaagctccgcctcccaggtacatgccattctccggcctcaggctcctgagtagctaggactacaggcgcccgccaccaagcctggctaatttttgttgcatttttagtagagacagggtttcaccatgttagccaggatggtctcgatctcctgacctcgtgatccgcccgcctcagcttcccaaagtgctgggattacaggtgtgagccactgcgcccggcaaaagtaggaccttttctatctccagtgtgaatttaaccacctggcaatatttgaaaggtagagattctgactcagaacgtccggagacttaaactctttttttttttaaacaagtttccagatggtcttcaggggaccacattttgagcagtaaagataaacaggaagaaaggaaagcagaagtattctaaatacattacttcaatactgttcactatgttagacatcttacatccattatctgctattaactcctataatatgtagtattatccctaaaatataggaaaataaatagacacagatgtagcaatacatagtaacaaactgatctttttgcaagatacagattacaaaattatttaacctctgagtgtcttactttccattttacaaaatggggttttaaacataagacccaaaaccataaaaaccctagaagaaaacctaggcagtaacattcaggacataggcatgggcttagacttcatgactaaaacacgaaaagcaatggcaacaatgccaaaattgacaaatgggatctaattaaactaaatagcttctgcacagcaaaagaaactatcaccggagttaaaaaggcaacctacagaatgggagaaaatttttgcaacctatccatctgacaaagggataatatccagaatctacaaagaacttaaacaagtttacaaaaaaaaaaaaaaaaaaaagaaaaccaccaaatagtgggcaaaggatatgaacagacacttctcaaaagcagacatttatgtggccaataaacaaatgaaaaaagctcataatcactggtcactagagaaatgcaaaccaaaaccacaatgagatactgagaggtgacagcatgctggcagtcctcagagccctcgcttgctctcggcaccccccctgcctgggctcccactttggtggcatttgaggagcccttcagtccccccactgcactgtgggagcccctttctgggctggccaaggctggagcccactccctcagctttcagggaggtgtggagggagaggcaccagcgggaaccggggctgcctgcggtgcttgcaggccagctggagttccgggtgggcgtgggcttggtgggccccgcactggaagcagccagtcagccctgctggcccggggcaatgggggacttagcacccgggccagtggctgcggagggtgtactgagtcccccagcagtgctggcccacctgcgctgtgctcgatttctcgtggggccttagctgccttcccgcggggcagggctcgggacctgcagcccgccatgcctgagcctcccacccactccatgggctcctgtgcagcccaagcctccccgacgagcaccaccccctactccacggcgcccagtcccatcgaccacccaagggctgaggaatgcgagcacacggcgcaggactggcaggcagctccacctgcagccctggtgcgggatccactaggtgaagccagctgggctcctgagtctggtggggacgtggagtctttatatctagttcagggattgtaaatacaccaatcagcaccctgtgtttagctcaaggtttgtgagtgcaccaggcgacactcggtatctagctgctctggtgaggacgtggagaacctttatgtctagctcagggattgtaaatacaccaatcggcactctgtatctagctcaaggtttgtaaatacaccaatcagcaccctgtgtttagctcaaggtttgtgagtgcaccaatcgacactctgtatctagctgctctggtggggccttggagaacctttatgtctagctcaaggattgtaaatacaccaataggcactctgtatctagctcaaggtttgtaaacacaccaatcagcaccctgtgtttagctcaaggtttgtgaatgcaccaatcgacactctgtatctagctgctctggtggggccttggagaacctgtgtgtcgaatctctgtatctaactaatctgatgcagaggcggagaacctttgtatctagctcagggattgtaaacacaccaatcagcaccctgacaaaacaggccacttggctctaccaatcagcaggatgtgggtggggccagataagagaataaaagcaggctgcccgagccagcattggcaaccagctccggtcacccaccaattctggacacaataccatctcatgctagttagatcggcaatcattaaaaagtcaggaaacaacagatgctggagaggatgtggagaaataggaatgcttttacactgttggtgggagtataaattagttcaatgattgtggaagacagtgtggcaattcctcaaggatctagaaccagaaataccatttgacccagcaatcccattactgagtatatacccaaaggattataaatcattctactgcaaacacacatgcacacgtatgtttattgcaacactgttcacaatagtaaagacttggaaccaacccaaatacccatcagtgatagactggataaagaaaatgtggcacatattcactatggaatactatgcagccataaaaaaggatgagttcatgtcctttgcagggatatggatgaaactagaacaatcattctcagtaaactaacacaggaacagaaaaccaaacaccacatgttctcactcataagtgggatttgaacaatgagaattcatgggcacacggaggggaacatcacacaccagggcctttcgggggctggggatctaggggagcaataagattaggagaaatacctaatgtagatgaggggttgatgggtgcagcaaaccatcatggcacgtgtatacctatgtaataaacctgctggttctgcacatgtatcccagaacttaaagtataagaaaaaaaataggccaggcgcagtggctaacacctgtaatcccagcactttgggaggccgaggtgggcagatcatgaggtcaggagatcgagactatcctgcctaacatggtgaaaccccatctctactaaaaatacaaaaaaaaaaaaaaaaattagctgggcatggtggtgggcgcctggagttccagctactccgaaggctgaggcaggacaatggtgtgaacctgggaggcggagcttgcagtgagtggagatcgcgccactgcactccagcctgggcgacagagaaagactccatctaaaaacttaaataaataaagaaaaaaaatatttacctcacagtgatgttagaagggtttgggatatattcacatcatgtagccaagtgcctggccgaagtaagtcctttttttttttttttttttttgagatggagtctcgctctttccaccaggctggagtgcaatggcacgatctcggctcactgcaagctccgcctcccgggttcaagcgattctcctgcctcagtctcccagttagctgggactacagttgcctgccaccacgcccggctaatttttttgtattttttagtagagatggttttcactgtgatagccaggatggtctcaatttatatttcttgacctcgtgatccgcccacctcagcctcccaaagtgctgggattacaggtgtgagccaccgtgcccagccccaagtaagttcttaaaacattttctatcattattataattccaattttattttattattagtttttgagatggagtctctctctgtaacccaggctgagtgcagtggcttgatctcggctcactgcaacctgtgcttcctgggttcaagctgcctcttgcctcagcctcccgagtagctgggattaaaggcacctgccaacccgcccagctcatttttgtatttttagtagagatggggtttcaccatgttggcgaggctcgtctcgaactcctgacctcaagtgatctgcacacttcggcctcccaaagtgctgagattacaggcgtaagccaccgcgcctggcctataattccaattttagcagtatatcttgctaatcaaccaaaaggaacacttaagtgcttatattttatatttactgttagtcatttagaaatgatacaatttgaattatagatgtaattgacaaatttgtactttcattgacctgattggttaagatacttaatcatatgataccacttttcctctttaaacggtaataaccattcattgcaaattactaatatactgacttactcatagttttcactagtcagcactgaatcatactgcatgtgtattttgttctcagcatggaaaagtacatgtcaaatagtaaaccctagtatgccaatcatttagtaacttcaagattactaattaccataatgttgaagtgctaagattatcagggtataatgcattcattatgttaatgattctttatcttatccaagaatcacacattttccctgggagcaaaaagaatcaaaagaaccaactggaagcttttaataaaagtttatgcatttaagcgtgtgattaaccgacaatcatattacaagtgctttattttaaaggaaataataaaaagaaaaaactgtttataacgggtaagattttctttctaaacataattgacatttcactaactgaaattggaattaccaaagaagtgtaagacatgtcttgtgccctcaagggggaagaaatattacatacaaataatgaaactaattatagtctaaactcatagaaaaacaactacttataaagaattaaaaatgggagaaataaggttagataggagtagtcacagaagtgatgaaagagacgttaactcaaatttgaaagataagtacaggtggatagagtgtagaaatgaaaaacagctactcagaacaaagtatctctttttcttttttggaagaacatagtactaagcatcagaaaatttgaatttaaagttgaatttaaattgactgtacattccttgaaatgtgttctctcatttgtagaatgggagatttagaaaagaggtttccctaactactctatgcttctttaactgtaaaattttaggcctagctatatagggcaggaaatagaagggcacatgcagagcacaggtattagggcctggtagtaaacatggttgtgtgcagagcatgggtcaaactatacggccttcagaacctagtacttgagatggaatcagtacctgctgctaaggatggtaataagaaggaatttcacatgagatcaggattatgatgcggtttaggacaagcaatccagtggatataaaaagtaagatacaagacagatatgacaatattggaaaggctgtgtaacatgcagattgactctgaattgtcagtgaaagtggatgacatcaccatccaagcagttgaaatgggctctgtggggaaatgtcagagctgtacagaaaaaaaaataggtgcccagaattcataacaggaaactcagttgtttggggggcttaggatttgatttttatttctaagcctcttttataagggcatcaatttcacttatgggggttctggcctcatgatccaatcacttcccaaaggctccatctcttaataccaaaatgttggggattaagtttccacatgaattttgaggggacaccaacattcagaacatgaacagggacttccatttggagagattttgaagagtaacactcctggcctttcctccagcccggattttctcctctcctatggataaagagtgacttatctgattggaaattatagctcctttcttgctcttgttataattagataagcattctggtctactctttatcatccagtaagtagcctgcccctgtgtggatggcatgtggctggccagcttagcctctctgggatttagatactaatttagataatcatactaataataaagagctgactctctgctctttgttgttcagggtaaaatcttaggaaacccactgtgtttgcatatgaaagccaggttctataatccatgctacgccttctgtctgtctcatttgcttctgaagtctgagggaaagatgggtgttattttgcactgaattaccacaaaggatcaaattgttgaattgaatgtagaaggacagagagcttacccagtctcaaattttaccaatagcttcaaggatgcaagcactcaagaaacatggacaaaaaagagagtggttggggacatcttttatggcttgccaggtcttcctttgcttcaagagaaatgcattctaacccagaggaatagaatgtttgcagatcacctcagctaatagagatttttaggttatgaaacaagtttatttcacagccaaattgttatagggcttatataaccatttccagggagctgtgcttcaaaaattcacagactctcggtttgtatactatagaaaatgccaaaccagggatatcctgtctagatcattctatagataagaatggtcttccctgtaaatacctttagtttatttaccaggaagtgcctcatcagcatgtttataaagattacttaggtagcttgcttctttctttggcatgtctcttggtcatcagggtgagagagagaaagaaagataaaccacaggcacattgctttaacttcttcctccccagacccattaaatttccacagactggaatagggaagtgtaggagtgaaaacagacataggtctgcttctagcattaagccaagtaactatttttacttgacatgagtggaaatagtataaggaaaatattgtcttgggaaaaatagctcactgggacgttatagaagagtttaagggtgaataaatggagatgcaatgactagtcagaaagcatgatttagtgagtctgagcgttactgtggtagcaatgacaatggggaggaaggagtaaaacacaaaggtattttaaagaaagaaatgacagaaattggtaactttagcattaaggatagaagaaagataagactaaaatgttaccctggaatttctagtgagggagacaatatttaaaatgctaaaattaaaataaaccatgtatttccagagtaggtcaaagtcatttaaaaaaaggataaactgggccgggtgcagtggctcatgcctgtaatcccagcactttgggaggctgaggcaggtggatcacctgaggtccggagttcgagaccatcctggccaacatggtgaaaccctgtctctactaaaaatacaaaaattagccgggtgtggtggcgagtgcctgtagtcccagctacttgggaggctgaggcaggagaattgcttgaactcggcaatggaggttgcagtgagccgaaaaagcaccactgcactccagcctgggtgacagagtgagactctgtctcaaaaaaaaaaaaaaaaaaaaaaaaagaaaaaaggataaactaagtttaattgatgagtatgaaaacatgccagatcatcccaaaggatgtattagggaaaagcagaatttgtgagtatgtgaaaatttggaaattagttggagaaatctaatagttgatttattcagtcaacaaataggccagtatgcacactctcaatttaaggcatgagagatataatgtgactaaaacgtccaaaaccaaataagactctgctcctttttttttttctttgaggcatagcctggctctgtcgcccaggctggagtgcagtggcttgatcttggctcactgcagtctcaaactccctgagctcaggtgatactcccacctcagcctccctagcagctgggacctcaggtgtgtaccatcatgcccagctaatttttgtagagacagggttttgtcactttgcccaggctggtctggaactcctgagctcaagtgatccagctgcttaggcctctcaaagggctggtattacaggcatgaaccactgcactgagccaactctctggtctttgttattcaattgctgtgtgcctcactaatctgattcttagtactcccaaactctgaccttagtgatataaccatattctaaattcatcatcatggaatgcccatccatcctcatttctgttctgtctagccaaacctgcagttggagtcactacaaaactggtggcacagaattccaacaaaggacttccccatagcatcccaagatggggctgattgagattccaaagaaggaggtactagatgccaggaaaatcaatcccaagcatttattaggggaatttacataaagaagagggtgcggcgtgtcttagcaacagtgagaaaagagatattccacctagatatgtctgcaatgaggggatggagttaatggagttgacttgagtgtttaagaagtttggctcagggccaaagctagtttctatgtatgtaacaacatggctgatcttttagtgttttccaacagcaacctaaatagctttatcaatttctgagaaggttcaagactgaaggggaagacatagctggctgggtcacagagcagttaggtcactgtgtttctgggtcaggacattgaaagaaggcagggggaaagtgggggaccctacaatctgtcacccagagaccatgtcaagagagatctctttttcggcatttctcaacatctgtagtatttacagtcaatgctctgcccacgttcccttactcctacagtgcatgccagcctaatacccaactgccaatataataggcaaggagatactgaggacttcctctccctgctgaagttcactttgcccacctatgtggcagtccagaaatgatggggcattaaaactttccaggagcaaccctcagtcggtgactggcagtagacagtgtgtaaataaataccccatctctctcatccctagcattggctatctctcagggatgtgtcctgcactgcagaggttctccagcaggactgagatccagtcctccacagtgagctggattgattcctacccttcattaggtacctttcctttcttgccttagttggaagtactgtaggcaaggataactgaacaccaccattcctatccaaaatactcaaagcatattaatgtgtttagctagagaatacagttagagattattagttgccaaaccttgctttgaaaaaaaagtgaagaattttagcttctgaaagtcattgcaatcaaatattgagcaacatgaagataaatcgggagctcgccggtttctatcagaaatgtgcccacatacgcaccacactacactggtcttgaattggtatttggcatttgctttgaacatttcaagagctagaataacaaaaacagctgtgtcaaaagtaagtgtctacttggtttcattaatgtgatcacactcatatggattgttttaaaatatccaaaagactgaaggtcctgatgaatccgacaaaatagagtactttttagggaaattagcagccttaatgtcaaagacaaatgtcagattattttgttccaatttactcattttaggcttaaggattctcaaaagatagtgaacaatatataatacactagacattctactccgcaaatttaattttgagcatataataatagaattttatctttggaaagtttgtgaaaattcttatgcattcaatcttgatatgaatcattgtctttatagttgttttgataataatctaatattatcaaatcacgatccccaacttctcaagacataatgaatatacattgaaatttaaagtacatgtgtttaccagacaatgcctagaggaaataaataattcaatttcatatcatacaggaatattggttttctagacaattgcctttactgtttcaatcaattaatcatttgtgctgggcattacaaattaagtagtaactgaaatatacaatgcaaaagaacctcccttcctggagattaattctgcagaagagactggcagtttttttaaaaaaaagtttaaaaataatttaatggtgatatgtgctgtggagaaaaatatataaatcaatggagtgtgacaggacctgctaatgttggtttgagtgcttgatatcaattttaaataaggtggtcaagaaaaaaaatcaatgagaagataattgagcaaaaacaggaagccagtgaaagggtgatccatgacagtgcctgcactaagggtacaccaagcaaggagaactggtacaaaggcgctgacgtggaaatgtttctacatagcaattgcgttagtgtgacatggagaggaataaatgagaaaaggagtgttgggagataagggaagaaaagtagcaatggggctgaagctattccaaggattttggtttttaagctgagtgataagggatacctctaaggatgctaggcaatggaatgacatgaattgacttacattttactatgatctaactggctaacatgtaaagaacataaaagggaggtgctttagtcagattagatgaatgactttttattttattttattttattttgagacggaatttcactcttgtcgcccaggttggagtgcaatggcgtgatctcagctcactgcaacctccgtctcctgggttcaagcgattcttcttcttcagcctcctgagtagctgggattacaggcacccgccaccactctcggttaatttttgtatttttagtggagacgaggtttcactacgttggtcaggctggtctcaaactcctgacctcaggtgatctgcctgcctcggcctcccaaagtgcttggattacagacgtgaaccactgcacccggccaaatgacagttcttaaatctcactggcttaatgcaataatcattttttctcttatttatatacctaaatgaatgtgtttggcagagaggaattctgttccaagtagttggtgagagattcagcttgtggagcttgtggcttccttagagtctcagcccccagagtgtctactgcctccttctacctttctgcagtcaggggaagagaaacgaaaagcacttgagcagcagtggttattattttcaccagtaactcacaggcaagaactcaatcatatgctgtacttagcagcaaaggaaactgggagatgccgtctaaatctgtgttcaggaggaaaaggaaatgggttttagagaacacgttatagtctctgccacagggaataaggacagaaacagaatgctacttaggaagatgttgctttatacaaaaaggagatgatggtggccaggcccggtggctcacgcctgtaatcccagcactttgggaggccgaagcgggcggatcacctgaggtcaggagatcgagaccatcctggctaacacggtgaaaccctgtctctactaaaaatacgaaaaattagccgggcgtggtggtgggtgcctgtagtcccagctgctcggcaggctgaggcaggagaatggcacgaactcgggaggcagagcttgcggtgagctgagattgcaccactgcactccagcctgggcgacagagtgagactccgtctcaaaaaaaaaaaaaaaaaaaaaaaaaaaaaaaaaaaaaaaaaaaaagatgatggaatgatggcagccttgaccacagtgcttgcatgggtataaggagaatgatgtactggaaaatgtcccaaactatttattttttgatggggatagtaacattaataggtgatcaatgaaaaattgtttcagaagtaaaatacgattaggaaatgctggatttctctacaaaagatttcttgcaacatttattaggcttgaggatctttgttattttgttgtaaaaatataaaatatgcggttatcaaaatcatcaggaattttttaatagacaatatcacatagctaatattccaaagaatattctttaagaagacaagtgaattattggatagaagatagggtctggtttttgacacgtacttcctgtgtgactctggatgactctttaacctctttgagatttacttccctcaattctagaatggacacactaccttttagattgctcaccttacagggctatacaaagctaataaaatgtacatataagcactgtaagcatcagtgagtattattataagacttagcgtggcaacaaaggagcagagcaaactgagatgcttagtttttgccaggaggagcctgaatgtcagccatcaaggagtcttatcaggtagcattatcttgacagtgacccaatggccctcagtcctttgcctctggaattgatcaaactatatttacagagcctaactacatctgtcagcttataaacaacattgaaataagaatttctaccgattaatgtaaagttgtctagggacaactgtgctgatgttccctatttattataacttattttcaaaatgaggatatttgggaatggcaagcaaagacatttgtttagtaaacaccaaagatcagagagcaaaaacatcagatttttgtggaaggtattctctttaggccttggtgagaacagactaacatcagtcctcagctaggcagtgaccaagtcctctatatttaatgtctagatgaactctctatcactggactgagaggatgctccttttgtaaattaaacaaaatgagcaactctttacgtgcagacactcttgctccaaattagagagaggaccagtgatttgattttcatttataaatcatggtctgtttccacttatggttccttgcaattacctcaggtctctcagaaatatccagtggcctaaatcactcattcacagttgattaagctcgtccactttgcagattttagcagtttaaccatcagaggaatcccatttctaatataaaagacattgagtcaatctcactcattgtaacaccaactagggaaagactcagttaaggaagaaactgcagtggctgtggttgatggcaaagtttatgaaacatatcataagtattgtatagtgaataaagaagaagtttgggatcaaaatacaattatagggaaatcagtagcatatttttaccataagagcagctgattttgtatcctgccctttgtgggataattggattgtcttgacttttttattccatctcttccacttaattttgctgaatataactctagattgataggtttttctttcaatactttcaataactcacttcactctcttgtttatatggtttctgactagaaatctatgctaattcttattatcgtttctctatagataaggcattatttcccctatgggttctttcaaatatttttctgtctttggttttctaaagtttaaatatgatgtagttctcctacttggtgttctctgagcttcctgaatatttggtttagtgtttgtcattaatttggaggaagttctagccattatttcttccaatgttctcctactctgttctctcttcttcttcaggtattccaattaggcatgtgttatgccttttgattgttccttagctcctcaatgttgtgttgttttgtttgtttgttttacttgtttgttactttgcacttcgggttgggaagtttctaatgaccaatttttaggctcactgattttttcctttactgtgccaagactactaatgagtccatcaaaggcattcttcatttctattacatttttttatttttttatggtttcttagagttttcatctctctgcttacattatccttctatttttgcatattttctagttttccactagagtccttaatatattatacacagttaatttaagttccctgtctgataattccaacatctacattatatctgagttttttttttttttttttttgagttggagttttgctcttgttgcccaggctggagtgtagtggcgcgatctcagctcactgcaacctctgcctcccaggtccaagtgattctcctgcctcagcctcctgagtagctaggattacaggcacccactaacatgcctggctaattctttttgtatttttagtagagacggggtttcaccatgttgggcaggctggtcttgaactcctgacatcaggtgatccatccacctcggcctcccaaattgctgggattacaggcgtgagccaccatgtccagctgtttttttttttttttttcttttccaacttttaagttcaggggtacatgtgcaggatgtgcagatttgttacataggtaaatgtgtgccatggtggtttgctgcacagatcatcccatcacccaggtattaagcccatcttccattggctcttcttcctgatcctgcccctcttcccaccccctgccctccaacacgtcccagtgtgtgtgttgttctccacaatgtatccatgtgttctcataatttagttaccacttttctgttcctgtgttagtttgctaagtataatgtcctccagctccatccatgtccctgcaaaagatatgatctcattcctttttatggctgcatagtattccatagtgtatatgtactacattttctttatccactcttgatggttgtcttttcactccgttggtagtttattttgctatgcaggagctctttaggttaattagattccatttgtcaatttttgcttttgttgcaatggcttttgatgtttttgtcatgaaatctttacctgtgcctatgttctgaatggtatctcctagattttcttctagggtttatatagtttttggttttacatttaagtcttttatccatcttgagttgatttttgttgatggtgtaaggaagggatccagtatcaattttctgcatatggctagccagttttcccagcaccatttattaaatagggaatccttttcccattgcttgtttttgtcagacttgttaaagatcagatggttgtagatgagtggtcttatttctgggttctctgttctgtttcattggtcaatgtgtctgttcatccatcttggcaagccaaatcacaaatgaactcccattcacgattgccccccccgcaaaaaaaatgcccaggaatacaggtaacaaagaaagtgaaggagggatgtcctcaaggagaactacaagccactgctcaaaagatccactattaccctagattactgtagccctgttttggttactatagccctatagtatagtttgagattgcatagtgtgatgcttccagctttgttctttttgcttatgattgccttggctattcaggctcttttttgtttccacatgaattttaagatagttttttctaattctgtgaaaaatgtcatggtagtttaatggggatagcattgaatgaatctgtaaattgttttggggactatggccattttcacaatatcaactcttcctatccatgagcatggaataatgtttttccatttgcttgtgttatctgtgattttttttgagcagtgatttatagttctccttgaagataagcacttaggttgagttcatgtctttgttattgtgaatagtgctgcagtgaacatatgcatgcacatgtctttataataggattatttctatttttgtgtgtatatacccagtaatgggattgctgggttgaatagtatttctgcccctaggtctttgaggaattgccacactgtcttccagattaattgaactaatttacactcccaccaacagtgtaagagttttcctttttctcacaacctcaccagcatctgttgttttttgactttttactaatagccattctgactggtgtgagatggtatctcattgtggttttgatttacatttctgtaatgctcactgatgttgagctgtttttcatatatttattggctgcgagtatgtctgttcatgtaaagggttcatgtccttcacctactttgtaatggggttgttttttttttcttgtaaatttaagttccttatagatgctgaatattagacctttgtcagatggatagactgcagaaattttctctcattctgtaggttccacattttttgttgtgacaggaatgctggaaggggttgaaatgggaacagttttcttcctccagttgggaggaggaatatcccaataaaggtgggggaaagtgattttccttggagaacagacctgagtgtatttcacaatgattatttcttcatttcttctgccagagttatgaagggattttttttttttttttttttggtgtgtgtcttcatgagaacatcgtggggattctgaaagtaaagcaaacaaaaatgtaaaggcctccccaagactatggcctccaagactttcttgtatttggtttctagttagtttccaagctagtccatccttaacctccagtactttatcaacattaccattttgtggtgtcctcatcaatttatggttccagtggcttctgtttcaagtgagacttctgttgtgtttctcttgtctccagatttaagggtgatggtttgcctagtgacttcagttctctgataggttcaagaaaagttcatggtttttagtttgttcaactttttcttattttaaggatggagcaacttgcaagctcttggcatattagagttaaaaccagaagtcctttattctgttttatagccacttttatattcctttttttggaaatgagtttctagagaaagaaaggagtccgttactaaacctgaaacttactagatttagaagttcacatcacactgagactcactgtgattctctgtgaatataacatctgtcacttctctgtctaaattctggggaaagtccagtttaggcctactcttgtggcgtgcatttatgcccctgggtatgatttaggttacctaacagttttcattcttgatcgagtgatgggaggaaagaattgcaaggactgtaaaatgaaactggccatgagcaggacccagcaagaaaagagataaatgctagatggaaactgccatttgcccacaattctaacatcttaaattcagttcttagctattgggtgtcagtttttagaagtgaaaaactaacactcttctctccccaccaaaccaagagaaaaaagcattgagacatttcttgatagtcactataaaaaataaagataaactgagcaaagattaagtatttttccttcttccaaaataagataaaacttttattataaaatatgctgctaaatatggacatgctctttgaaaaaataacagaaatcatatgcttgcagtagatttatagaatcaagtttttagaattggaatgtattttgaaggtgagtgtctttttaataacttttaaataactaattttatccagttgcaataaaggggttatatgcaaatacaccagaatgctatgggttcttctttctcattctttcattttatgtagacttggacatgtttttttttggtatgaacatgaatttctttagttttcagtggcatttattataagccagacaatatgctatttatttttttgaattatttttaaacttttgaaaagtagcatatccaataaattctgtaattataaaataaaatgatggctttgtacttcatatgatgtgacaattgttaatctccatcgcctgtttcagtaggtctcaaccttttattcattattgtcccctaaggtgcctttctagatatttttttttcctaattactccctctcccataaaattttattactattgcagatatactccatatctgcttatgtactgcagcccttgagaagtccaaaaacactgtaatatctcctaatttaccccttccccataaaccagttttcacctcttgaacatgctattatcctagttgagaatgcatgccctatttgattaataataatggttatcttttataaatcaccaaactaaatatgtaggtgctggttctagagtcacattatttaggttagtattctggagcaactctttaccagatttgtgattgtgaattatttattaaactcaaagttcctcaattttctcaattcaaaataaaaataatagcacccgaattggtgaaagtaatactgacagttgtaacaaacatccccaaatgcaggatgtttcaaatcctatagaagagtatttctcagtaatataaattccaaacagaatgttactgagtgtcaggttagctctagtccaggtgctggcttcttccaccatgcgattcatcaactgaagctcatattgtttcccaggttgcactgggagttggtatccagccattagtcaagacaagataagggaaaattgcaaaataatgaaaagcctttaggggccagtgtggaagtgatacatactagttttagccacgttcctctcaccagaatttaggtccagctatgattgccacacttaagtaaaagaggggaatgggtgggaaatatgttccatctctgtgtttaggaaagataggagatgaatttcattaatagctagtcagtctctgccatggcagttatttcatagcattgtgaagattattaaactatttgaaagatatattatgtctagaattgtctagcactacaactgggatgttttgaatattatggatggggcataaaatgtaagtttagataccgtcattatacagatgagggaaatgacaggcagagataccactatcctaatgaggatgactggagatgagggaattgatatttatggagattaagaatttgctcaatgtcactgaggtagaattttaatacagcttaataaaaatttaaaacccatttgtttcctctcatttcactgtgcttactctattcaataatttaattagttacttttgctttttaaaaggcactgtcattctgttttccatgataactcaaggtttctttaatagagtgaataaataattatatcattttataaaatgttttgggattatcataataaagataatgatgatgacatcaattcttgagttcctaattgctgtaggttcagatttttttttctttttttgagatggagtctcactctgtcacccaggctggagtgcagtggtgtgatctcggctcactgtaaacttcaccttccaggttattctcccatttcagccttccaagtagctggcattacatgcacccaccaccacacccggctaatttttgtatttttagtagagacagggtttcgccatgttggccaggctggtctcaaactcctgacctcagatgatccacctgcctcggcctcccaaagtgtttggattacaggttcagattttaataagatgacaactgaagtgtgtttcacaggggtaataaaaatagagatcttaataccaaattaagaaataaatttctccaagcatatagaaattaatctaattgatgtgtgcatatatttttaaataatttttttttttttttgagacagagtttcacttttgttccccaagctgcagtgcaatggcgagatctcggcttgctgcaacctctgcctcctcggttcaagtgattctcctgcctcagccttccaagtagctgggattacaggcgcgcaccaccatgcccagctaattttttgtatttttagtagaaacggggtttcaccatgttagccaggctggtcttgaacgcctgacctcaggtgatctgcccacctcggccccccaaagtgatgggattacaggcgtcagccaccatgcccagcccaatgctgttgatcttttcaactaactcatgttagcagccctattaaggcagccaacattttatcagtttcaaatttattcactatgtcactaagatgatggttcttgatttatttttattaatttttatttctatagaaaatctatgaattgtgattgcagttttatggctgataactttctagaaaaaattatgatatacaacaaaacttaacgaatatcagcaaaaaggggaatctacaccttcacactattctattcacgtttgcactttcttccaattttctttgtgcatacgtgtttgcagttatagcatactatactctttatattttttgttgtttgctaatgtaattctgtatttctacggagtcttcaaaattatcacttttaatggcttcaagacattctctatgctgttatataattggtaacatttaaccgtttagtaccaactttttttctccttactttttctttttcttttcttttttttttttgagacggagtctcgctctgtcgcctaggctggagtgcagtggcgcgatctcggctcactgcaagctccgcctcccaggttcacgccattctcctgcctcagcctcccgagtagctgggactataggcgcccgccaccacgcccggctaatttttttgtatttttagtagagacggggtttcatcgtgttagccaggatggtctcgatctcctgaccttgtgatcagcccgcctcggcctcccaaagtgctgggattacaggcgtgagccaccgcgcctggcctctcattactttttcttacatgtatactttcttcttaacattagtaaatgtaggttgagaagttattttcgatttttgtcagcatgacattttgccccagttgtgtctctttttctgtctatagttgctacctatcaatatttttaaaaaaattctgcccctcttttaagccataattatcactcattcattcattgaatttcttaagtgtttctcttcattgtagttttaaatttttctctttctaaacactttatagttttctaaaaactttagcattcaaataatatcctggttttattgccttacagtgcaagataattcatattgaacagcttgttattttactgactgtaaattgattacattctcaaatctcattattgaacattttgtagagccagtatagttaagtatagtagtccgtctttacatgggggatacatttcaagacccccagtggatgcctgaaattgtagatagtactgaaccctaccctatatatgctatgttttccctaaacatacatacttatgataaaatttaatttataaattaggcaaggtaggagattaatgaccagttattcagaagatagagcatatgagagtgatgactgataaacctgtaaaagattttccacattccttaaaatataatgcctttaaggatatgaaactaatttatttcataacagtagctacattactattcttggcatatgaaaaattgaatgttgagaagtaccactataaaattttaaaaatgagaagtcatggcaaatatataccttataacttatatcaatacagaggtgccataagacattaaaaattatcattgctttctgatattagtttactattattttattgtttttgttattattgtcagtttagcatagttaaaaatatactgtatgaaaaatatgatagttataatgctgttcaccaattatttccaactctccgttcttttttaacacatggtaggattgcactttttaggggctccatttggggagatagggctttaagacaggttctgtccagtgggtttggaacagacatatcttctggccagatttcattgccagtatgacattctcaagctcattttcttctgccacaggtagccacgttacagagagtgactgttctgctcatattgatcttgatatgcatataggataaacaggaaataagtctttgcttacttttacttaaacaactgtgatttggggattgttaacatagcaaaatcaatcatcttctgctcatgacagaaaagtcagtttttgttttatttgggcaatttgctcatctaatatttgctcatcttattattatcctagtagcaatttataacaaatggttcatgaagagttctgatttcagattatttatttcccacgtagcctcagtaggataatgtggtttggttaatttggccccctattacttgtacttcaacaggttaattttataactacttattttataatgtaggtttcattgcttttattcagaattaaaatgtgtctttgcatagtaatatttcatttacaggataaatattcattgaataaattctcaaatgcacatctgttacctttgaaaaagttctttcttccctaagtttcatttagttcttaccttacttagatagatatccacaagtttatcatgaattctttaaaaataaactcttaatctaggcatacttatttagtggagcatagttcagcatatcatttatggaaaaaattgttttgacactaaattacaatattccctaatttaaaatctctgctttttcttttttttcctcctgagacggagtcttgctttgtcgcccaggctggagcacaatggtgggatctcggctcactgcaacctctccctcccaggttcaagtgattctcctgcctcagcctcctgagtagctgggaccacaggcatgggccaccacggccagctaatttttgtgtttttagtagaggtggggttttaccatgttggccaggttggtctcaaactcctgacctcaggctatctgcctgcctcgacctcccaaagtgctgggaccaaaagcgtgagccactgtgcctggccaaaatctctgcatatcctttgaaaaattaaatataaatataacttgtattaatatatttgaatttcaaatacatttggaagcacttagtttttagggcaacaatactatgaattcttttggaaagccaagatttattttgtccctttattcttaagaataaagattttataaaatgactcctttccttagactgaaaaatcatattacattacacattacatatatacctaaaaatgaagttaaatttaatatcatgttacatcagagatgtagctgtaagataatttataattacaaattatttttagtaatgtctcctaaattagagctaagagtggtaaaataatcaatataatctctattctgaggtttaaacagatgactccaggaatataaaatctgaggtagacacttcattagttgagtgaagtttctgtaacaaactgtaaagaaaggttgatgtcttatgaaatgtgaaaggttgatgtcttatgaaatgggagtggaccagaaaggaacagctgctcactaccaaaaagaggtgagtgaaggctctgcctgtaaagagggccacattttcttttaagaagtcaattttaagtcttctggtagattgcgttgtagttcaggccatcatcatttgcctcactctcatcatgcttactgaaatgagcaaatgaataaactccagggggaagtcccgtatcagcaaggcatcatatgccacagacttctactagttatagggcatatacactgtgtaaagtgaaaataacaagggtaacttactaacctcctcagtgagaggctgtggcaaagtcagtaagaggaagagaaagggtaactgttggctgaacacccaagagtgtggggtaaagatggggcgtgaaggtgaagctgggctatggacaaagaaagaccaattacttggaacccatttcactatcatttattgacagcattctaaccatccccatcagtgactgctgaggcaatagaaaccactttcaaacagattaaaacagaaattaactgttctttcaacctatgtttccttaaaatatatcatgccatagtgtgagtttttaaagtttggggaattttagggctaaaacagcaggtgctgagcattaagttattcaactattaatttaacgcctcataactttagttaatgtgacaactaaaagaaattaaaatataataaatgtttcttaaggagaaatcttattaatctttattaaaggtaagggtaaagtaagaatatatgataaaaatctgaataaaataaaaaatactagttaagcgcatgtctacaggcaccactttaaacattttctatgtataagtatatttaataatacattattgttattatttccatttcaaaaataaaggaagttaaggacagacagattgggtgatatgctgactcctatatgttggaatttgaattaaatccaatcagtattctctacctccccaagtctgagtatgctccattgccttcaaaaaccagaagcaaatatctgttaggatcataattgtaaatgagttaaccttacctgttgaaagactaaggaaaaaaaagtaaaccgctgagtaaaataaaatgatacacagagatgataaattaaagtttagtcaaagttatattaatcaagtacagataaaagaaagcagagattataatgttgatttcagattttaaaaaataattcatagcaaactaaaattgaatgtttccaagaaggccatttttattgcagtgtaaaatcttagggattttacaatgactaaacattacattagtcattttatatatgtgccaaatagcttgataggtatattgtaaattcagctttataaatttagagattatattattaactcaaattggatttgcaattgttatatctacctgttgaattaaacctgtatcattttgagttgttctcttttttccttgaactctcttgtctaatatttatagagttacactaggtttctttggcttcatatgtgcatggttattatttttcattcttttttcaacctttctgtgtaattgtgttgtagaagtcttttgtaagtggcttatagttttgtttttttaatctagttctcatttgtttttaattggagcattaaatcaatttatagttgatgtaataccaatgtgtttgggtttaaatctgccatctggttttgtacttgctgttctgtgtttagtattttttttttactctcttttcttggtttcctttttattacaaaagcattttcaattaaattttttccctaagaattttggaacttacagattgtttactaattttggagacagtacagattctgtcttatatacttctagttgaatattaataaattcatttgtcttccctttcaagaatacaaggacattagtatagtccatttgcacctcttctgactgacatgttactattgtatattttaatttcattctgttatgatactaacaagacattatcttattgttctgttcaattactagtttataaatttactcacgtatttaccatacccactgatcacctcacataaaattataaatacctctacaggtacactcttgatccctcctgtcttattttgcttatttcttttttttttttttttttttttgagacgaagtttcggtcttgtcgcccaggctggagtgcgtggcgcaatctcgcctcactgcaacctccacctcccgggtgcaagcaattctccagtctcagcttctcgagtagctgggattacaggcgcccaccaccacgcctggctaatttttgtattttttagtacagacagcgtttcaccatgttggccaggctggtcctgaacccctgacctcaggtgatccacccgtctcggccttccaagtaatcctgagtagctgggattacaggcgtgagccaccgtgctcggctgcttatttcttaattctacaaatttgccagtatttaacatgccgtattgttgtttttttgagacggagtctcgctctgtcgcccaggctggagtgcagtggtgagatctccactcactgcgagctccacctcccgcgttcacgccattctcctgcctcagcctcccgagtagctgggactacaggcgcccgccaccacgcccggctaattttttgtatttttggtagagacagggtttcactgtgttagcgaggatggtctctatctcctgacctcgtgatccacccgcgtcagcctcccaaagtgctgggattacaggcgtgagccaccgcgcccggctgtattgttgttttttaaaaaattattttagtgtttattgtatctcctcttccaactaaaatgtatgttctgaatacactgacattcatggattttttcctagtgcttagaacaatgcctggcccctataggaagcaccaattatatatttattgagtgaaagaatgaatttattcttaagtgtcttacactccatcctgagatcaacttccttctgtccaaagtatatcttttatgttccctttgtgaagatttgctgatgtgctcccttattttttccctagaaatatcttatttcatcctaaaaaatgtttttcagcatacaggaatgcttttattatttaatattaagacatttaagatattaattctctgacacctgacttccattattgctgttgagcagtctgctgtcagtcaaactgtccctcctttgtggtaaatttgtctgtcttctcgggctactactaaaaacttcttttcacattctatactcttcattttcacagtgttgtatttgttgcgcatttcttttttaattaacttgtttttgggttcattagatctcgtcttgtcttctatcacttctagaaaattctcagccatagcatcttcaaatacttgtctctgtcccattttcccactgttctccttttaaactttaaatgtgttagaactcaatctgttcttcatgtattttaacttcctttttagatttttcatctctgcttctgctgattcttattcctgctttttctgcttcgtggtaccttgcctcttgcatgcttagttatattttagtgtgagcatctctttttccttgggaaattatccatgggaatatttgaggctagaatgaaggtgtattcattccttcagaggatttacttttgctacctcccagagcactccctatatgagagtagtttatggaggttgaaggatgttttgtctgctcagttgatatgtattaatatttggacagctctgaaccaaagcagctttttctttttttcagcttccttgggttgtcaatgaagtaggtgcacatatttctgggtcgcatgtgccctctgaggatacagttatataattgagaatctcctccttgattttccatgttggctggaaactggattttactttatttctctcttaccaccccacagtcatcccaagcttcctgcccaggttatcagtctgtgatcatggaagcttgagctctccaagcttggcagttatctaagaataaggaattctgtctttactcttttttttgtcaggtctttagtgagatatttatacatgtaatcacaaaataatatattatcattacctagtttttaatactttttagctagagactccatctgacaatggaatcatccatagtatctttgtgtcattgttctctacaaataatgattttaaatcaatgggaagtattaggaactgtttaataataaaacactgggagaagtggttaatcattaagggatggaggaagactttgagaaggaaaaaggctgataactatgtgatttgaatctaattcatttcacactgcaactggatacatagtttggcatatggtggtttaaataccatacatataaggtgccattagatacacctttaccacttccatattaacatttctggtgactcacaagaacatctgtaacaaaattctggcattcatagattttcaaacaaaaatacatgtttacttttaattccattttgcctatttttaaagttttatactcatttatggattttgggtattgtatgacatacgttgatttttcttcatttgaagatcaaacataaattcacctacacaacttttccaaaactgttatggtttcacgttttcaacttctatttgtgaattagctttttctttttttctaaaaagttaaccagttatacaatgcaattaattaaatgcagatgtctatgattttaaaaaactatctatactacataaattaatttgatctatttctgatacattcatattttaaatatgtagctatttattttttttcttttgagatgaagttttgttcttgttgcccaggctggagcgcaatggaatgatcttggctcactgcaacctctgcctcccgggttcaagcaattctcctgcctcagcctcccgagtagctgggattacaggtgcctgccaccatgcctggctaatttttgtatatttagtagagacggagtttcaccatgttgactaggctggtcttgaactcctgacttcaggtgatccactcacctcgacctcccaaagtgctgagagtacaggcgtgagccactgcacctggcccaactatttcatacttattaaatatcatgattttatatttaagttatagatatattcatacttttaagaaaaatagtatatctgcattttccaaaattgttatatttaaaaatagctttgaattttgcgtacatgtttcacttccttattggtatgtctttagtatatggtgctttattcaaatgccataattataaaaatatcttataataatcaactttaaaaagggacatcggtttgattttgaaaaatcacttcttgaccttaaatactagaatgtaataataaaagagattatttgaaatggtgaactgagtacataaaatttgatggtacacttttaacacagatttttctattgttcatgtttaacttaagaaaggtggtaggtttcatctctttatgtcttgatttctcgtacaattgcttcatgctgttatgctaagatcagaattacagatctttcctggctgaaatgaatgatcaacatttaattgactaagttcctcattgtttaagatgctttgacttgtggacgtcagatgcagggaaacagatttactgaaattctgacccctggcatattttttgtcatagacacatagatattacttgaaaccaaatatgtatttttcatcatactttatccattaagccactgaagtcttttggaatattgtcttttatttaagtgccatccatctaaagccgcctgaagttgcagagttctgcaattactgacagtaatactctctgaaaaactatgttaatccagtcttatgccacttaacctcattttggtcaatgatgaaccacatatactatagtgtcccataagattataacagagctgaaaaattcctatcacctagtgacactgtagccgttatgatgtgttagtgcaaggcaatactctgtggttgtggtgatgcttatgtaaataaacctactgcaccgccagttatataaaagtatagcacagtccgggtgcggtggctcatgcctgtaatcccagcactttgggaggctgaggcaggcagatcacccgaggtcaggagttcgagaccagcctggccaatatggcaaaaaccctgtctctaccaaaaatacaaaaattagctgggcgtggtggtgcgtgcctgtagtcccagttactagggtggctgaggcaggagaatcacttgaacccaggaggcagaagttgcagtgagccaagatcgcaccactgcactccagcctgggcgacagagcaagactccatttcaaaaaaagaagaaaagaaaaagtatagcacatatgattgtgtacaatacgtaatacctgatagtgataatagatgactgttcctggtttatgtatttactgtactttttatcattattttagagtgtactccttctacttatcaaaaaaaagttaactgtaaatcagtctcaggtcctttaagaagtattccataagaaggtattgtcataaaaggagataacagctccatgcatgttattgcccccaaagaccttccgggggacaagatgtggatgtagaagacagtgatattgatgaccctgaccttgtgtaggcctaggctaagtatgtgcttgtgtcttagcttttaacaaaaaagttcaagcagtaaaagataacagtttttaaaaatacaaaaagtcttataaaagaaatctataaagaaaatattctgtatagctgtacatgtttgtgtcttaacctaagtgttatttcaaaagaacaaaacagattttaaaaaatttatgaagtaaaaatatagaaagctaaggttaatttattacttaataaaatattttttataaatttagagtagcctaagtgtacagtgtttataaagtcgatagtaatgtacactagcgtcctaggccttcacatttactcgccactcactcactttcttacctagatcaaattgcagtcctgtaggcaccattcatagtaagtgctcaatatgggtataccattcttatctttatactgtattttttgcacaaattttctgtgttcagatacacaaatagttaccattatgttactatcgctacaatattcggtatggtaacatgctatacaggtttgtaggctaggagcaacaggctagaccatatagcctaggtgtggggtaggccctgctatctaggtttgtataagtacactcaatgatgttcgaagaaggataccatctcagaatacatcaccgtcttgataccatctcagaatacatcaccgtctttaagggatacatgactatggtttagcagaaagatcatttatttgtctgtaacgtttgaatcagttcatctgatgatcaaaatcttgccacaataaaacatattctgtcattcagaagtatgctattgagacagctgaactttcacctttgctttccatataaaactcagggttctatagcaattaatttattcaagttggacgattattgttaataatacccttgtctttaaaaaagttattgacttaatccttttggattatttaaaaatgtatcaattcttttttttcttccagtatccattataaacttacagcacagttcatgaatttcaggttacaaaaaatagacatagagttgttaacagcatagttcatgaatttcaggttacgaaaaatagagttgttttcctcaagaatattttatgaaatacttttaaaaggaacatattcctaaatgaaaaaatatttcattgtgcatgtttcagaagcacttttattcaggtatgattaatacatagaactggaatgaacatttgttcatattctttcagataaaacacaaataggagtatatacatgtctttaaaaagatataagtaaatttgcattaaaagtttatgttcttttccaagtctatattttctctttttattaagttgaaaaaaaatgaagaaataattaataagttttatttcattagttctttgtaaaatattattagaatatgtaaaaatagctcatgctactgaaagttattaattggatatgtttactgtgtttatttttatgtatatcattcattaacatataaataagaaaggaaatctgaaagtaagcgtaaggactattatacataatcttgtgtaatttcccaaattcagaaatcaatacatgtgatataattactaatacctagatgatcaatttaattcttttttagatatgtaatataaatagaaaatttcttagggcttaagtaaaaaacaacagtgttttagtttttttctgtgtgaaaaaatactttcatttgcctcattctttacctgttaaaaagcctctcagggtggggcgtggtggcacacgtctgtaatcctagcactttgagaggcctaggcagggggatcatgaggtcaggagatcgagaccatcctggccaacaaggtgaaaccctgtctctattaaaaatacaaaagttagctgggcatggtggcgggcgcctgtagtcccagctactcaggaggctgaggcaggagcattgcttgaacccgggaggcggaggttgcagtgagccgagatcgcgccactgtactacaccctgggtgacagagtgagactctcagaaaaacaaaaacagaaacaaaaacaaaacaaaacaaaaaacactcagaaaaactttatttgctcccacttattttctactttttcttcttttgctattatatttatatttatgtttaatggtcatttatatttaatataaatctatttatataattgtatttaatggccattttatatttttctgtattctcccagttaacatatcctggcagcataaatgaaatttgatgatttcattatcagttatccaaacaagctttcctatccctgacctgtgaatctgtgctaggtggggtagattagaagcttcaggatcttgtaagggtgacgtgacaagggcagataactgatggtcctgatagcacccagagaaaagctacgttaaatctctgtcctccatatagctgaagtagtgtctagtatcagtttatggttcttcacttgaaatgagaatatgttgtatactatagatttaaataaaacaaacttagatttaaactgcttaagctaaagatcttggctatttagctataatttttagtgaaaatatcctagtttattgaatcttacctagatattctttttataagtttgattttattttgttctccttctttcctttttgtcatttctttacttaggctataaatttattttaaagactgagttttctcttgaccaattctttccataagttcacctgttttttatatgacttacactataagagcctatgtagacactcaataaatgtgttttattttgtagcagaatccatgacttattatcagtaaaaccctggttgaggtacttttaatcttgttttccacacctaaacctatctagccctgttgcattgtatcccgaggcccagcattattcaatattttgtgtatttacagtaagccaagtggagtacttattgtatcctggaaataataactatgtcgactaataggcatcaaaataagaattaatttttactttgcaggacaagtactccaagaaacctgagttgttaaggtggtaaacacagaaagcactatacaaagtatttgtaaagattaacattgctacagttatgcaagcacatatttgccttaacaagattagtaatgccagctgcctgcattcaaagagacaatttaacttcaattttaatattacctgaaacagtgtaaaatgacaagagttacatcgaaatatgtatcacaatttcaaatgaagaaattaaagcatacctttatgttatctgctgtgacttttataaatgaatgaaatggaatatatgaatttttattatagaaagctatttgtccaaaattaaaataatattttattacaatatagtttttactgatgtttttacaagtattgtattctctttgatggtaggttctcttgttggtaaattccaatcgattaaaaattcatgttcctttgtttaggcgttggtcatagtggatggtgaattgagtcacttcctcacctctctctattcaaccttttgtgctgcacaggctgtttcctaggaccacttgaagcttgagttctgttcataatttgggttctgccaattagatgcacttgagtaaaatgtggaaggtggaaagcagtctaggctatgtttctaaggtttttctgctggcagactcctgatagaattatctgatatctgtagagtgtcttaccagaataatgcttcccttaatatgggttgcatcctcatcataacagcttcctaatcatggccagcttctggaccaccgatgatacattaactccttgggtcatctagttctgtgaccctcacagttgttctgttaaatgcaatgtaaagtctgttttcagccttcaatatgattcagaaagttatttaaaatttcataatgcattttttatgtttatactacaaaaatgtagttggtctctgcatttaattgatacaattaacaataatatattttaaattttatttacttcaattgttaatttttttttttactaaagaaaatgtacttatatggtaaatgttataaattttatttactatagttgctgcctctacatttatttttagggctgacatagttatttaaaacctggtcataacctagttaaaatttctcctccacgtatggttgcttgcaatatagcccacttgttcctcatcccactgaccctaaactcaacataccccacagctgctaatcacgagaaaacctagtgttcaatattagaataatgtaaataagttctcccttcacacgtgttttctttaaaccagctaatccacaacctctgagggaaagcctaagtggtaacactcataggccttaataatggtgtagccacccaggttctctccatcgtttcctgctcactgggtgaactccctgccacctccagtcttaccgtcagcctcctgttgtcaccccaacctctctggaatctgtgagtaataaatatcttctattttctgcactgtggcttcacttccttattgtgtctcccctgacgcacacgcacgcctgaacttaaccttatattcagccagagctcttttgggcagtggctgtcttgacaagaataaacaagggtatctgctgtataaacaagtttcctgtgaaaggacgacctggtcacagtgagatacttaggcattaggccatcatcaggataaagaaatagcccaaaaaaggcatgctacaaactctcaggcccagtttttttactttccaggtcagaacagggctggagcttatggccagtcttgagagagaccacaaaaccaaattggaaacaattcataacaaattaaatcaaaactgtaaactaaaccgaaaaagtaaaggtgatacctataattaaaggtagcaatttattggccccactactcccactccaaattgccgtagctagaaacaattgctttttaatttttctgggttttgttattttggtggttacttcatatctctgaataacacacgtattccaacaatcatgattttctcatgcgagacatattccgttgatttttctgctagactagataaggactttgtcttcttaaccttcttcccagctcctctccccatagccacccaatgtagttatatcaccattttaatttctttattatgtttttaatttaaataatatgtacttttatcacctttccatcagctctagaaatatgatttttgactcccctctttgtaagatattatcagtgctaatcttccctgacctttctctcctctaccattctttcctccacttctgtgtttcttctgtagttataataaatagtacattttctttctcttgaaaacttctaaaatgcttaaggttttaagctttctttaaacatagtgagatcggaaaataaaggccttatcgaattactcatgattttatcttttctcatggtcatttaatgcctgatctttcaaaagtttcactttcttttactgacattcctctgttgccttggttttgtatttgctgccttcttactctttttctctgctttgtattttgtgaagcacaaaaagctacacagtacactaaaacacaactaattatacttcacattaatgaataggctaatgcttttccggtgtggtgggggagtttccaaaacctagattaggaagactatcaatttgttgactattcagttagcagtagaataagggaacagtatagagagactccagttccctttcctagccaatgaataaaagcttacaaaccatcgtcttatgttcatagattgttttccctaaatattttacatgtatttatatatactgaagttcattagtcaattctatgctaactcaaaaagttattattttttcaatttttttcttttttgagacggagtctcgctctgtcacccaggctggagtgcagtggcgtgatctcagctcactgcaagctccacctcccaggttcatgccattctcctgcctcagcctcccgagtagctgggactacaggtgcccgtcaccacgcccggctaattttttgtatttttagtagagatggggtttcactttgttagccaggatggtcttgatttcctgacctcgtgatccgcctgcctcggcctcccaaagtgctgggattacacgtgtgagctgctgcgcccagcctattttttcaatcttatgctatttatcttactactttctttctcataagtgcataggaaaatttgacactgctgagaaatcactgaactgtttgtgggataccaccagattatttatggttctataagatatttctcaggccaggccttttataaagcaattttaatatatgtatgaattattatatgtcatgtaattattctataattttagaatgtatattcagattaagacattagtttcatgtaatactttcaggcatgctgaagtcccagtagctacaggtagggaagaagcaggaaactgtaaacaggtggacccaggatcaggtacctcacatagctctaggactagtactacagagagtaatagtagtatagtcaacactgtacagtgtggatgtaatatggcagcaggttcttccaggacaggtgaggatacttgcagattgactggtaccatcactgcaattgtagatggcatgaatgacttagacctaactaggaacatgaagacatgtgtggtcttaggaaaaagggttgagtagatatggccagattatcaggaatcaggaaaatgctctaccttcataagaatgataaatcacagtcaagaaacaaaaggataattccagttgcatgttcagcaagccgtgacataggttagaagcaaagtctgcagctcactggacacagagatatcttgagagttaattctaacctagtatttatcaaaaggtgatctattataactctctggaatcctggtcaaaaactaagataattaggcctgttccaactcttagacttcagatcaaatccaataatctctgtgaacctccctgagtgatccttatgaatcttaaaatttgagaaccacatctttagacataccagatactaagtttagaacagaaagacaaatttgaggcattttatttcacttgcttactaccctttaccaaaatattgaggctagttttcttaatttactcttgtcaatgtggacaaaggcctgaaaacactgtgcttatagtttgaaagcatttatatttgcagtgatgtggagctggaaaatgaggatttgctcatttttatttatttttctatactagttgagtgttataataaaatataaaaactcattttagcttcatcttagtctaatgtgcttttcatgacaagtacttaaagattatgtctagtcagtgtagcttcataattgatgtaaaacaatgcagaaacatattaaacatatgacagcttatgagatctaaatttgtaaacttcataaatattaaaaaactttcatattttaaactttcatattttaaaataaatatgaaacctacgatagtcttacattagtcaaaatgaaataaaattaatgtatcacagcccaatgactagtttcttctcattcacctgatgaatgcaagaaagcctgttagttggagtaaaatcatctggtgtgtgctcagctgcatttaactgtagaggccttaagacatgttaagcaatgtgattttgatttcacctgctgactttccgaaggcaacttattataagaaacagttgaatagtgatatcatgctgttggcacttgagctttctgctggaggttgcaatctaatctttgcaaacctgtaattactatttcctaagtaattctaggtttccattattgaatctctaaatgtctaaaaggtactgagatgtaatatacaaaaaggcatagggatcaaatgataacaacaaactctttgtgtcagtaatactcaatttcgatgtttttgatgttataatgacatgttactggcaagaatatttggtgcattttgcaggttcagtgtatttttttatgttggtgttatgaagtctttgaaataaaaagatgttttattccagggttatcaatccatgcatcacagtttagagaaataagtgaaagatagtgattctactttgaaatttaaatgtttgtctctggttattcaagttaagtattttaaaatagttttgactgatatcatgttatatagaaaatgtgaagtcataggtgtctgtgtaatggaatatgaaaaacattgtttattaaaaaaataaaatcctggtagagacatcatttctcctttgaaatatatagataagtgatccactaaaaaagtaaacatctcaaacacaaagtttaattctgcttgtgagaatatgccatacattgcactttttttgtgaaagataaactactcttttttatcatttcattttaatgtgtttcatgtactgtcctaggcacaaggaatagaatcgtaacaaggacagggtttgcttttgtagagcatagattctaatggagaagatagaaagttaaaaagcaaacagaaatttcaagctgatgataatgatgactgagatgatagctgtcacagtgaagatgataggcagtggactttagtagatattagaaagatatacccaagagcactgcatgagatatgtaactaatagagaggaatctgtaataactcaagaaaataaagttctgtgaccaaattattcagacatatatgataaaatattataaaatagtagaaaagaatatttgcagtccctgtggctgcatttaaccatctaaatatatcaatatctatatacctatatatgaaaatccctatctaatgaaatagtttaaaaatcttcccaagattatgcagctacttaaatggctgagtaggactagatctgcagacccctgaggccagcctcagatatcagtcagagtgaacataacaaatcaaagtagtgtccttccacagaggagttaaaatatttaaacataagtaattttagcaatccaataggtgttaaaaaaaagaaaaaagtctatgggccaggcacgatggctcatgcatgtaatcctagcactttgggaggccgaggcaggtggatcacctgaggtcaggagttcaagaccagcctggccaacgtggtaaaaccccgtctcaaaaaaataaataaataaataaaaattagccaggtgtggtggcatcctcctgtagtcccagctattcggaaggctgaggcaggagaattgcttgaacctaggaggcagaggttgcatgcagtgagctgagatcacaccactgcactccagcctaggtgacagaaaataaaaatctatgcccagataaatctttagactaattgagcaaggcctttgcttatacatctttggtgtaccataggtttggatttgtagctgtagactttaacttttgcttgtctatagccactgcattacaaagatgcaaataccagacttttccaaacatgttaatatgggatctctgggagcgggaaccccctaaatggctaatgtataccaggccaattaaaatttaacggcctaggatatgtgtgggtatgcatgtgtatttatttaaaaagacactcaaatagtttttttttatatgaagaaagtaaagctttgacactgaaattaaatgatgtaataactgttatattcagctaatatctcaatgatggctttgaggcagttgatagtagatagcttttttaaagaagtgtttttgaatgtttagcatatgaaacccttatggtgttgtctttatagagcaaagagggaataaagaaatggaatgtaaaaaatcctaaatattccacataaaaaagcttactagaattaataaatgtattcagcaaagttgcaggacacaaaatcaatatgcaaatatcagttgtgatttcatatactaacataaatctgaaacggaaatttttaaaaattgggttaaaatagcatcaaaaatacatagaaatataaacttaacaggagactaaagacttgttctctgaaaactacaaacatttctaaagaaaataaagatggtaataaatagacatatatattcatgaattagatgacttaatattgttgtccatactacttaaagctatccacaggttaaataccatccatatcaaaatacccatagctgttttttttttctgaaatagaaaaagcaattctaaaattcatatgcaaccgcagagaaccaaaaagagcccaaacaatctaaagaacaagctggaggtcctgcacttcctgacttcaaaggatattacaaaattacagtagttaaaacattatggagaaatagttatagaaatatggtggagtaggaagcaccaggaatctgtcttcccacctagagaacaattgtactggcagaatctgtctgatatataactattttggatttttgacatctactaaaggcttgcaacttctaggggaaagcttgcatggcgaattatgattaatttcagtcaatttcagcacttaaccacagtagtagctacccatttcccacagtcacccctgtagcaggcagctgtgcacatgttactggagcagtctgcacagagcatgcaggaaccagagtgggcaaaaaaaggacctgtcatccaaatatcggcaatctttgctctgattgctgattgctgtttctggtcacaaagatggacgcaaagaggtgagtggttattgttgcacctctatccattattgcaagcccctccctgctggctgaagtgacttccagaagattaaaagggccagtgcccttctcctactttatttttctgtttttccccctttgacagctagacattaaaaagtagggcattcaaagtaactgcacatatggtgacaatcagaaaatgactaagttactaagtgtaaacttaaggactgtcttttctaagcctgtgccttgcctttcctttggcacaggcttagaaaagacagtctttaagtttacacttcagactgattcttggcacagagatagcctacaacagaatcctcttatgacaatataaaaagcaaaatcattgactgaagtaaccgcaaactctcagtaagagggagaatctaatttttagagttactatgttattagatccaaaatcacaattcatacaaaaaattaagaaactatgtcttgtccaaaggaaaatatgaaatccctaaaatgacttgatggtggatctgctacagagggactttaaaataattgtgttaaatgatcaaagaactacaggaagatatagagaaagtcaagaaaatgatatatgaacaaaatgaaaaaaattcaatggataggaaacctcacaagaagttaaaaaaaattgggagctgaaaagtacaacaacttaaataaaaaatttactagagcgattcaaaggaagatttgagcaagcaaaggaaacagtcagtaaacttgaagataggacaatggaaatcaaggaacagaaggaaaaagaattgaaaaaagtaaacagagtctaagggacctgtgtgacacaatcaaggagtcacaggaggagaggagaaagagaagagaaaacttgaagaaacaacggatagaacctttccaaatctgataaaagacattaatataaacattcaagaaatccaacagaattcaaggaagatgaactcaaaaagacataaactgaaatacattataatcaaagctttaaaaggtggagacaaagatagaatcttaaaagcagcagaaaaacatcaatatattacttataaggaataatcagtaagattatcagtatatttctcaccagaaacgttgcaggccagaaggcagtgggctgacattcgaagtgctaaagaaaaacaaaaacagaaaacattatcaaacaagaatcttatatccagccaaactgtccttaaagtgagggcgaaattaagacatccccaggaaaacaacagttgggagagcttgttaccattggacctgacttgcaagaaatcctcctgcagagtgaaatgagaagacactagacagtaacttgaagttgtgtaaagaaataaagatcttaataaaggaaaatacatagaaaattataaaagcttatattattgtaacaatactttttaactgcacttttcgtgttctacatgctttaagaggttaatatatatatatttaaatttgtataaaagttcatattatgctttgtaactccaattttgttttgtacataatttaagagactaatgaatttaaaatacttacatgtttatatttttgtataatacataaagatataattttgtgacatcaaaaattgagagggtgggggaatggagcttttgaaggagccgagtttttatatattattgcagttatggtggtacaaatttaaattagaatgttatatatgcaggatctaaaatataatccctatggtaaccaccaagaaaatagctatatacaaggaaatgagaaagaaatttaagcaaatcactaaagaaaataaaatagacaactaaatataaaagatagtaatgcaggaaatgtagggaaacatctataagctataacgaattcaaatagtggctgggcgcagtggctcacacctgcaatccctgcgctttgggaggccgaggtgggtggatcatgaagtcaggagatcgaaaccatcctggccaacatggtgaaaccctgtctctactaaaaatacaaaaaatagctaggtgtggtggcacatgcctatagtcccagatactcatgaggctgagggaggagaatcacttgaacccaggaggcggaggctgcagtgatccaagattgtgccatggcactccatcctgggtgacaaagcaagactctgtctcaaaaaaagaaaaaaaaaagaattcaaaaatagtaaaatgacagaagtagcttccttcttttcagaaattacttataaattgattaaatgagctaatcaaaagactggcaaaatagatttttttaaaaaagatctatgtgtgtacaagagactcattttagatccaaagatgcaaatagattgaaggtagagggacagaaaaagatttctcaggcaaataaccaaacaagagcagggtagctatactgagaacagacaaaatagactttaatcaaaaagtttacaaaaggcaaagaaggacattctatattaataaaaggtttaatacagtaagaagttataacaagtataaacatttatgaacctagtaacagatcactaaattatatgaagaaataacttacataatggaagggaatgatacacagttccacagtaatagttgaagatgaataaatcactctcaataatggctagaaaaaaaaaacaaagataaataagaaaatgcaatacattaaaaaaaaaacaattagacctaactctgtgcaacaacagcgtacacattcttctcaagtgtacatggtacattttccaaaatagactatatgttacttcataaattaagtctcattagattgaaaagatagttatagaaagtatcttctctgatcctaagaagattgtcttagttcattttttgctgttataacaaaatgccacacactggataatttatataaaaatgttttttcctcacagttttggaggatgaggaatccagaagcatggtgccaacatttggcaagggacatcctatggcagaaggcattagatggcaagaaacagagaaagagacagacatcaggggctgaacttgtttataactaccccgctacttcaataatgacagtagtagttttagtccttatggcaggatttatgggaggactctgcctgtatgacccactcaccccttatttggctccatctcctaacactgttgcattggagattaagttttcaacatatgaattttagggggacatattcaaaccatagcaaggatgaagttagaaatcaatataaataaaaccagaaaaagttacaaaactttggaatttaaacaatacactcttaaacaatgaacgttatcaaagagaaattgtaagggaaattcgaaaatacttggagatgaaggaaaatgaaaacaatatatcaaaacatatgggatgaggaaacagtgctaagggggaaatttatagctataagttcttaaagatctcaagtcaacaacctagctttacaatgtatggaactagaaaaataacaaattaaacctaaagctagcacaagaaaggaaataataaaaattcgaccagagataaacaagatagtgaatagaaaaacaacagaataaaccaatgaacccaagacttggttctttaaaaagatgaacaaaatttacaaaactttagctaaataaactaataaaaaatgagagaaaagattcaagtaacaaagtcagaaatagaaaaagggacattcaggctgggcacggtggctcacgcctgtaatctcagcactttgggaggctgaggcaggtggatcacgagatcaggagatgagatcatcctggctaacatggtgaaaccccatctgtactaaaactacaaaaacaaaaaattagctgggcgtggtggcgggcgcctgtagtcccagttactcaggaggctgaggcaggagaatggcatgaacccgggaggcagaggttgcagtgagccgagatcgtgccactgcattccagcctgggtgacagagtgagattccgtgtcaaaaaacaaaaataaaaacaaaaaaacaaaacaaaaaaaaaccctacagaccaatatctcttacgaatattgaggcaaaaatgctcaaaaaatactagaaaacagaattctgcaacatattaatgtatgataagccacaatcaagtgggatttcttcttggaatgcaagggtgactcaacatagcaaagtcgatcaatgaaatacaccacattaagagaacaaagaagaaaaaacacacatgattatctcaattgcagaagaaaaagtatttgacaaaatgcttagagtagtcaaaactgtaaagccaaaaggtagaccagtggcttccagggactgggaggaagggagaatgaggagttactgtttaaggggaatagagtttcagtttataaaataaaaagagtgatggagatgaataatggtaatgtggttgtacaacattatgaacacatttaatagcactgaactgtacacttaaaataggctgataaattatatgttatgttcattttaccacgataaaaaatggagaaaacaacaaaaaacaaacagtatggtactagaataaagacagctatataaaccaatgaaacagaaaacagaacctagaaataaacccacacatatgcaatcaaattatcttcaacaagggggctaagaacacacaatggagaaataatagttgtttcaacaaatgaatttggaaaaactggttaccctcatgtaaaagaatgaaattgaacccttaccttgcaccatacacaaaaataaacagtactaaaaattttaacaaagacctgaaactataaatcctatttaagaaaacttaggggaaaattttataacatttgtcttggcaatgattgcttggataaggcaccaaaagcgtaggcaacaaaggcagagataataagtcgaactacaccaaactaaaaagcttctgtacaacaaaggaagcaatccaacagagtgaaaatgcagtccacggaatgggggaaagtatttgcaagttgcaaatcttataaggggtcaatctttaaaatatggaaagaactcctacaactcaatagttaaaaaaaccaaataaccttatttaaaaatgggcaaagaacttgactagacatttctccaaagacataaaaatgttcaacaggtgtatgtaaaggtgctcaccatcactaatcaccagagaaatgcaagtcaaaaccacaaaatatatcacctcacacatgttaggatggctgttatcaaaataacagaaaataaaaattgtaaggatatagagaaatctgaatccttgagttgtgttagtgtgaatgtaaaatagtgtagcctcaatggaaaactgtttggaggttcctcaaaaaaatcaaaaacagaactatcatctgatccagcagtcccacttctgggtatttagcactaagaattgaaattaggatattgaagagatatttgtattcctatgttcattgcagtattatttataatagctaaaaattacaatgatacaatgtggatgaaccttaagggcattatgttaagtgaaataaaccagttatagaaagaaaaatactgcatgatctcacttatattaggtattcaagtagtcaaactcatagaagcagaaacttgaatagtggttttcagaggctggggagagttgctgttcaattggtgtagagtttcagttatgcaacattaaaaagttctaggtatttgctttacaacaatgtgcatatagttaacaatactatactgtgtgcttaaaaattttaaagggtggatctcattttttttttaccacgataaaaaggaaaagaaaaatgaactggaagtttggaatagaatatcagctgtgatgcaatatgatattgtggaaagaccgttcgttgcactcatgatgccaagatctggatgaccgtcttgctctcatccttatgaactattttacctggcacaagttacttaagctcattgactattttaggactattgtgagaagcaaatgaaataaactttgaagcagcagcttttaatatgagaaggactaatgagcgaggtttgcacagttgggcttcaggaggtgtgtgaaccaactaaaataaaacacaaatgtgaagggtgggtgtggattcatttccatagctctctcttttcagagtcacaagtgaatctctaagataccctcaaagactcaggactattgctcctaagtgttacacaaatattagttagatatcttgtgagttaattaagttattcagaaagatggtgatttagaaaaatgctgactatgtaaacgagattttaaaatgatgactaagtttttttttctctttttcttcatttctccaccactttgccttttaggagtaattttctttcagtttttgaggtagaacccaaatgaatgcttggaattttttttcttttttcatttgttttgttccccatactactttgcagtgctttatcagcatgggtgacattaggaacattcagggggaaaaaaaaaacctgagtaaattaaaattgtcagttgctggatgagaataaactacaaaagacaataaataggcagtgaactagatatagtgtccttggacttacattttgcaacgtagtagatgatatattgtattccacatattttttttaaactctctgaaaaatagagaatctagaaaagaaataacttctaggaacttcttttatttatatagctaaattgtttcatttttctggctggcttttctccgaattcagttctggtgttactatcttgaatcaaagcaaaatatttactactactgagagaacatgatattattccccaaaagctaatattaatgaaaagaatatggaaaagattatgaaactataaaatattaagttataagtgatattttaattatatgaagtatgtaatatattcaatattataattcattgccatcttgaaatcatttataattattacattttaacactttgtttctcaaagaatgctcattatgagaaggatattttatgcataaaagtctgaaagcacatcatgtcaattataaatgcttgactcaagcaagagtcagtgctcttctgtcacatgaaatgtgcctttctcatcattgcaggccttttccacttccggccactgaatcacatggaaaataaacaacaaggtcaacaaaatacaaaaattaacattaaaacagaggccgggcacgatggctcatgcctgtaatcccagcactttgggaagtgcccgaggcgggcggatcacaaggtcaggagaccgagaccatcctggccaacacggtgaaaccacgtctatactaaaaatacaaaaattagctgggcgtggtggtgcatgtctgtaatcccagctactcgggagactgaggcaggcgaattgcttgaacccgggagtcggaggttgcagtgagccgagatcacaccactgcactccagcctggtgacagagtgagactctgtctcaaaacaaatcaaaacaaaacaaaaaaagattaaaacagaaatttcagtgatttattttttcatcaggcttagaagaatggagatagaaaaagcaagcagattcccaattatggaatgccttctatgtcctcttgagtctatatgtgtatattcccagttagggaatccacttacctttttctgtctgcattcttacattccttacatttattcattcacaatgtcacgtgtgtgtgtgtgtgtgtgttatttacttgtttcttctatctcaaattcttccagtatatactcattcttcttcctccaaccttgttttaaaaatatgcttcttttaaaattaagacatttataggaatcacattaactttcaattaattgctttgttcctaacactgaagtactaggggggttctgtttttggtaatgacagaggtatggttgtgctggaagttgatgcttttgtagttggaaatgtttaggagatagaacaaacttaagcagctatgtagataggtttaggacaataggattagggaaacagatccagatcccggttcctcagtaaacgagaacaggccagagtcaaacaagaatgaatgtaacattgacctggaactgaccttggactgaaaggtataggaggacttctgtttcatatactgagagcttcgtggctttaacgctacatttcagtcttatggaagaatacactgtgtcttgggaattccgtattcaaggctctaaataagaaactggcttccacatggacttttataaaatgccatgtattgtatgattccatttacttgaaatctccaaaaccagaaagtgcatagaaatagaaagtagtttagtggttaccctcaggtaaagaacaggagaaagggagtgactgttgagaatacaggtttctttcttaggtgacaacaatgttctggagttagatagtggtcatggttgtacaaccttgtgactctactataaaacatgaattgtacacttttaaatggtgaatttattaaattatatcttaataaaaatacatctagtcacaggttgggagctctatgcagtgatctctgtcagcagctcagctgaaattaaaaaagagctgaactttcaggtgtcagggagctgatgaaagccacaagtcgaaaatgaaagttaagcctttaatcacttactgctatgctgtaagcatgattcaaaccagagaaatctctgacagctcagatatgggggtggtctcagtgtcgagaaagcaccaaacaaaaaggctctagtagttttatgagccttagattagggatggggagcagaagaggctaggaatggaaaagtgaagtacaggctactgagtcagagtggtgaaaagtgtcttcgagatgtgccacacttcacagtgaggaggtctcagcagagacacatgggctaggtatgcaaatatgcaaagagaatagctagctagagaggactgaattctggcctgcagcttcctttcaacactgtgatttattacctgagcacaaagtctgggttggagagggtagctttctcctgcgaggcctgccgggtaaaaccttaggaattacccatggtcaggcctgaaaaatcatggataggttttcagtcaggagccagactcctcaatctccatatcaccagttgtttttgtggacatagccaggcatacgtttatcatcccttacattcactgattggattaccatgtaggtcatcatgtcattcttcaaaggaaaaggttctcttcgttatcttccaggtgggaaattaattcatacattgttgggcttgtctttaccatcaatgatttaagttgtcttaacacgcattatatgttctattatccaagtattaattttctatcatataattatcactgaatatttaatacatacccataccacgcagtagggtatcatgtaataaatgctctcccttttagagtaaggaatgaaaatcagtagtgtaggtaggaatattagaaagtaaattaaggctgggtgcagtggctcacacctgtaatcctagcactttgggaagctgaaatgagaggatcacttgagcccaggagttccaggtcaacctaggcaacatagtgagtccccatccttacaaaaaataaaaataaattagccaggcggttgagaggtcgcttgagcctgggaggtggaggctgcagggacctctgattacattactatgctgcagcctgggcaatggagtgagatcttgtctttttgaaaaaaaaagagaacaacatacttcacacacacacacacacacacacaaaatcagatataagaatttatgaatcctttaggttactaaaggcagaagttttaagctatttttgatgttttgcctactttctccactggaataacttaaaattaatgtagttcaaattaatgtgacatttattgggcaacaaatgagcctgccactgagatggctttgagtgataaaatggtacagaagtagacaagatgtagtctactctttcagagtttgtagactagcaggcatgtataaataagcaattatagtatagtgtaacaaatattctgatgagagaaatggcagtgtgtcaaagtgctgcactggaacagctcttaactcagtttggcaatggtgggtaagtttgactgctttttaagatcttatccccaaattatgtaaagaaaataaaaaaggaggcaataagaaggaaagggtatctagtgaagaggaaagaacatgggcacacacctacaggtaaaggtgtactctggggtctaaacagattttaatatggtttgagcataaagtattgggggtaaaggactgatgaaagcaggagctagaaaaaagagataagaatgcaataaaggcaggctttctaagctatattataggaaaaatttgtcactaaacagggcaatgacataatcaaatttacatttcataatgagcctttctaacaccagtgccaagagtggattgcagatgagcaagagtgtagacagaaaagttactctgaaagctctgttgtgaattcaggcaatattgtagagttctaacttagactagtagacttcacaagacagcactatatatgaatacaagtaaatctttagaatttaatatttacgaggacaggtgactgggtatggaaggtgtggaaagagatctaaattttgaatttggacaactagttggaaaatgataccatttgttccaaaatggaacaaagggaaaataataggtctcagatgatgaaaataaatttcgaatatgttgaatttgcaatgtttgtgagaaatccaaatggaaatatccaatcacatatctgggtgtgtggctcaggagaaagatctgagttgtggctataaatttgtaaatcatcagcctataaggcataagaaatgtatgtcaatagatgtggccatgctggacaagtatgtatcagagaggaatgcctagaacaatgcccatctgaacacaaaaactttagaaaagagaagggggtaagtcaggagaaggctataacatagagaatccataagaaaaggtctgagaggtaagagggaaaccagaaaagtagtgtcaggaaatcccaggaaagagatggttggttatgagaaagaattagttgatgatattataaaaagggtgaggtcaggtaggaaaaggatgggaaagaaactagttcacttagcattaaagaagtattggtagcctaggcaagagcactttcactaacatgcttggattaaatccaaacatgagttgaatgaggaattggggtggataaagtcaactctaagttaaatgtttggggatacatttattaattttatattaccaattctatcttgaggaatttctcctccttttatatatcagtgagttgtagagatctctttctagtatagtgaaaatttccatagaagttgaaggtagtacatccttagttcatttgcggtagaatatggacttgaagacagccttactcagactttgaattgacagttggtataaagaagtagtgccaacagcatatcttttctggcagtggcattggtgacagcgttatcagattaggtggtataccagagtcagaagtccaagctgtggcacgtgcttctcagtaccagtatcagaaacaagggcagaggaatcctcatctactagttacctggcatgcttttgaacatagttctgatttttataaattctcttgattcctgctgatttccccagcctggctttgcaggatccctggaaattgctcactacctaatatcttttaaatatgtctctttctgtttaattaaaattcaatttctattgcttctgctaaaaaattttgactgatacacaatacaacaaaatgcacagacgtgtacagtttgatcatctttgacaaattcatatacccatatacagtttgatcatctttaacaaattcatatacccatcaaacccctatcaagacatggaacattgctatcaactcacaaagtgtgcccaataagccactgcaccctgaagcaaccagcatctgatttttactaccatagattaattttgcaggttctaaaacttcatataaatagaagcacacaatatgtactgttttgtccctggcttctttaactcagcatgaagatttgaagatttgtccatgttgttgcttatatcaatgctctgtgtatttattttactgagttttatttcaatatatgaatatatcacagtttatttatatatgtgtattaataggcacctggttgtttatttccagcttggggctattaggaatgaaagtgctataaactttcttgtacaaggttttgtgatgatttatttttttcttatttttttgtttttacggatatgtcatttttattggataaatacctagaagtggaattgctaggcatcatgataggtgcatgtttaacgttttaagaaattaagaagcattgttttctaagttgtataattttttgctctcatcagcatgccttttcattttcatcttctcaacactgtaattttaggatcagattatatatttttaaatttaatttaattttaagttccagggtacatatgcaggacatgcaggtttgttacatggggaaacatgtcccatggtggtttgctgcacctatcaatccatcacataggtattaagccccatatgcattaactctttatcctgataatatgcttcccctaacacccccttgacaggccccagtgtgtgttattcatctccttgtgttcatgtgttctcactgttcagctcccacttataagtgagaagatgtggtgtttggtcttctgttcctgtgttagtttgctgagggataataccttcaagctccatccatgtccctgcaacagacatgatctagttcctttttatggcttcatagtattccatagtgtatatgtaccacattttctttatccagtctatcattgatgggcatttggttgattccctgtgtttgctattttgaatagtgctgcagtgaacacatgcgtgcaagtgtctttataatagaatgatttatattcctttgggtatatactctgtaatgggattgctgggtcaaatggtttttctggttctaggtctatgaggaatcaccactctgtcttccataatggttgaactaatttacattccctccaaaagtaaaagtgttcctatttctccacagcttcaccaggatctgatgtttttgactttttaattatcaccattctgactgacatgaaatggtatctaattgttgttttgttttacatttctctaatgatcaatgatgctgagttttttttcgtatgtttgctggatgcatgaatgtcttcttttgaaaagtgtctattcatgtcctttgtccactttttaatgtttttttccttgtaaatttgtttaagttccttgtagattctggatattagacatttatcaaatggttagatcacaaaaactttctcctattctgtaggttgtctgttcactctgatgatggtttcttttgctgtgcagaaactcttttttttaattagatcccatttgtcaatttttgcttttgttgcaattgcttctggtgttttcatcataaaatctttgcccatgcctatatcctgaaaggtattgcctagattttcttctagggtttttatagttttgggttttacatttaagtctttaatccatcttgaattaatttttatgtgtggtgtaaagaaggggtccagtttcaattttctgtatatggctagtcagtttttccaccatttattaaatagggaatcctttccccattgcttgttttcatcaggtttgttgaagatcagatgatcatagacgtgcagtcttatttctgagatctctattctgttcctttgaattatgtgtcagttttggtaccagtaccatgctgtttggttactgtagccttgtaatatagtttgaagtcaggtagcataatgcctccagctttgttctttttgcttaggattatcttggatatacaggctctttttttgtttcatatgagttttaaagtattttttttctaattctgtgaagaatgtcaatggtagtttaatgggaatagcattgaatctataaattactttgggcactttggccattttcaaaacattgattcttcctgtctgagcatggaatgtttttccatttgtgtcctcttatttccttgagcagtggtttgtagttctcattgaagaggtccttcactttccttgttatctgtattcctaggtattttattctctttgtagcaattgtgaatgggagttaattcatgatttggctctctgcttgtctattgttggtgtagaggaaagcttatgatttttgcacattgattttgtaccctgagaccaccctcaacatgccagatcttgactatctcagaagctaagcaggattgggcctggttagtacttggatggaagcagatattttttactttttttcttcagtgatttgaacattttgtatcctatgtagcaaataatcttctaacataaggtcaaaactatttttcctgtgtttttgcctagaagttttttaattttagcttttatgtttaggttcttcctcattgaattgctgtagtactcttgcgaaaagagtactactatatatatgtgggtttatttctattccattgactggttagtgcatccttttaccaatataacatctttctgattagtataactttataataagccttaatgtcaggtagattaattctcctaaatttgttttctttcttatcaagtttgtttgggctactttagaatcaacttgtctatttctataaaaaagcctatgcattttggttagaattgagttgaacctgtacatcaatttgaggaaaactgacatctaacaatattgtcttccaatctatgaacatgaggtatttgaggtattctcctattccttttagcataattttataatttcactgtaatggttttatatatctttcattaaattggtccctaataattttttgagatgcttttatatacaatatgttctattttacttattctttttttttcaattttttcattcatatggtttgtttttcactaaagcctttaacatattaatcacaattattttaaagtctttgataattttgatatatgcatcatatcttgatatcatttggtttatcccttttagagttctttttatcatttttttaatttagtgtcttataattttgtttttaatgatggacatcatgtcttagtttcaggcagtttctacggaattctgttttatagatgagattttctcagcatttgtgagttttttcccacaaggcattcacacactcccttgaatctgagcaaagtcatttaggagagattttctgtgctctttcaagggaaggtgactttaaaacaaattgatgcataagaaaacttcatatttatggcatatagagtgaaatttcattacatgtatacaatgtgtgattatcagttcatgtaactagtatatccatcacctttcctgcatcagatgacgtttgctcatggcataatggtagtgtatcctttcctgggaatggtgtttctttttgttttaatttggaaatttttctttctttcctttccttttttgatggagtctttctctgtcgcccaggatggagtgtgcagtggcatgatctcggcttactgcaacctctgcctcccaggttcaagcagttctctatctcagcctcctgagtagctgggattacaggcacctgccaccacgcctggctaatttttgtatttttagtagagatagagtttcaccatcttggccaggctggtcctgaactcctgaccttgtgatccacccgcctcagcctcccaaagtgctgggattacaggcatgagccaccaagcctggcctaatttggaaatttctattgacctctcttcaagatagactcttgtctatctggtcctcaaataatccaaccaaaagaatttcttatattcattatcatatattatatttctaacatttccttttagcttgtttttatagcattcattgctcttttagaatcctctgtctgttcactcctattttctattcctattttttaccgcaatgtgtggtaaatggtgtaatacatttatcatagctattttgatgttctggttagataattctaatatctgggatatcttttggtctctttatcttgactatttttcttttgcctattggttatgtgtcagtttcttagggctgctgtaacaaattaccatacactgggtggattaaagcaacagaaatttattttctttcagttctgtaggttagaagtttaaaatcaaggtgttgacagggacataatccttacgaaaactctatgagagttctttcttgtcttttctagcttcttccagtttgcttataatctttcatgtttttgtcttgtagatgcatcactccaatccttaatcttcacatggcatttttcgtgtgtctgtctgcatgtggtcatcttcttttaaggacatcagtcttattgatttaggggtctaccctatttcctgtgatctcatattaagcaattttatatgcaatggtgttatttccaaataagttcatattctgagttaatgggggttaggatttcaacatattctttacaggggagacaattcagttcctaaaagagttctggtttcttgtttcttctctggtaccatcacttttaaaaataaaataccagatatttgtgtaaagaaacacttaacactgaagtcaataatacctgtgccctagataggagatggctcaatttcttcgaggccagtagtgtggcaggctgactcaacctatattttatctggacctaattttgttgaagctttagttagattcacttctcaggcttcaaatggtctaaaagcagaatcacaaatttttccttagtacgtgcatgaagtatgcatgctggagggttttctcatatctcctactcagctcccattcttcagcaggcccagtgtacctgtgtctcaggttggatctgtctcggcactactgtattgtttctaaattttctcaagacttgtcaaaaagagtttgttagtgagctcagattctcagagtacaactattttcttctagccggcatttatgacgacttgctccttttcctgctgctctgccaaagacgaaagcatcctgagtctcttctagattgaatgccttacattttagattttgttttaaaaattttctttgcatcctcagttctttgctgggctttataaatcataattgtatataccattttgtatttctttgtaattgaagtgctcttgcaacttttctaaatcactttattgtagtataattaatatataaaaatacatgtttaatgtatacaactaagtttgaagatatgcatatagctgtgaaattattactacattctattttataaacacagctatcacctccaaaagtttcctctcactctcctaatttgttattacctattttgtgataacaacacttaacataagatctatctaccctcttaacaagtttccaagtacacagtacagtattgctatctataggcactgtgctgtatagtagatcttcaggacttattcatcttacataactgaaacactgtacactttgactgatgcctcactgttttcccatcccctcagtccctgctacttaccattctactctccgcttttatgagtttggctattttagattcttcatataagtgttataacatagtatttgttcttcttgcaactttctacatctttataagtagaagtcactgatatcctttttaaaggtcttttcataattatcctttaccttagatttattaagtggaagctgcattttttggttttatttgtgtataccattacaactaagaaacacaatgtacaaactctcagtcaaatttattgaactggagattgttagtaaacccctaataaattagctccaaatagctatgattgctttctttccaagggttgtgtatttgccacattggcataaatgtaaactagataaagaaagcattataaattattttgtgtgtagttacatataattcaaggtctcagtaggcaaagtaaccccttcccaacatcccaaaatatctacatcccaatcattgggatttatgttacctcatatggcaaaggaactttgtgacagtgattaagttagagccctgatttgtagagattatcctggattatgttggtggacccagtctaatcataggagcccttaaaagtggataaatttattctggcttctgttcatgggagatgtgattgcaggagggagagagacacaacattgctggctttgacaattgggagagggctataagctaaggaatgtgggtgatcactagaagttggaaacagcaaggaaatggattctccaccagagcactcagaaaaacatgaagctcttctgggtccttgatttaagttcagtgagacccatgtctgactgctaatctatagaagtggaagataacaaatctgtgttgtttgaaaccaagtttgcggtaatttgctacagcagcaatagaaaactagtaaaaggccagaacaacaacaaaaaattctgaatatcaatttgtaaaagttgtgagggtgaaattttaaaaagtttttttttcttattctcccatgtttagttcgctaggttagttttataagaaataaaatagaaagctggaaaagacattgacttttttacagacattacttttagagactaatatagagaaataaatttggtttcaaatttgaagatcacaagaaaaggagatctcataatatcttaccagcgttctatgccaccccccccccaccccaggacccgagcattattcttaatataacacatacatgttcttaataagattaacataattttagcaaaaaatttcataagaaggaaatgttgatgggtctataatagtggaaaaaaaggtaaacttagagttatgtaagattaaaaaaagaaacaaaagtaactgactttttgaaatactgtacattaaccgtagttattaaaatgtcataggtttctttgttacttcacaattgagaacattatactatttttccctttttcatgtatatcatttgaaaaatatttcctaaagaaactattgtttttcctacttaaattcaactattctgacaatatattaatactaaccccaaatcttctggtcattcttcagcaagtgtccagtttgtaggaatttttttttttttttttttttttttttgagacgtagtctcattctgtcgctcaggctggagtgcagtggtgcaatctcggcttactgcaacctccacctcccaggttcaagagattctcccacctcagcttcctgagtagctgggattacagtcatgtaccacaacgcccaactaatttttttttttgagatggagtctcgctctgtctcccaggctggagtgcagtggcgcgatctccccttactgcaagctccgcctcccgggttcacgccattctcctgcctcagcctccccagcagctggattacaggcgcccgcctccacgcctggctaattttttaagtatttttagtagagacggggtttcaccttgttcgccgggatggtctcgatctcctgaccttgtgatccgcccgcctcggcctcccaaagtgttgggattacaggcgtgagccgcccaactaatttttgtatttttaggagagatagggtttcaccgtgttggccaggctggtcttgaactcctgacctcaagtgatctgcctgcctcggcctctcaaagtgctgggattacagacttgagccactgggcctggcctgtaagaacaatttaattgcactccagttgtgcctaattcaattgcactccaagttttttttacaggcaatccaattatactctaaaatatcatcttcctgaagagcaaagaattaggatccttgaaaaacttgctcttttagttttgctcttgagattataataaatttcttaggaaaggtgctagataataaatttctggatatgtaaaaatactgtatgtataagctgtccaacccaggaaatctaaatatatagaatgaacgttatactgtttaatattaaagtgtttgattcttaaatatcctgatactagatgagaattagataagtacatgtactacaaatcacacgatgattgtcatttccacaaggttgcttaacatctttaattagtctatctgaattcttagtttaacatatatacttaactataaaagttaaaataagaaagtcatacctagacttttttgacactattttgagaattgacacctgaaaacctgctattgaggataaaagaaaggggaacacacttaaaaaatagacttaattactaaagtcaaataatctttgattctttataataggggcaaaaatttttatacctttcactttcccagggcagtatgtagtatgctttattacggaccatatcaaccctagtgctttcatctctattatatcttcatccatcttttcaaataactctatcctaggttttgtcataactctcagtacccaatccactggccataagtcaagagcttaccaactctcatactcttagtacacattttcttcttttccatggtatattatctttctctcccttctgttctgtccctacttggctaaatccatcagtcatcacttcaaccaacctctgccactatctctagttctttggccccactgatctatcttcattaatgtagctgtttaccaagcaaacttctcttatgcaactggaaagccttgagttaatattaatgaatttttttcagttccatgtctgcagtgattctcagcaagccttctttggccccttaattatttacgttttcttcatactagcaatttcaaagtatttctgctccccataaactaatgacatagccaccatatttcattttattctcatcccatcacttaattcttcaaaagtaaagttaaaattgccttgagtgaagttactcaacttcccaccactaaacctgcacaaatgccttcatctatttcaatcctttccagttttccctttaacttttcacactttaaagagatgtattctttcctacttaatgtttcttgagaatattgctactccataagttttctttgtttttagttatacctccaacttctttttttccagatgtcctttattgagttcttaaatacgtctgtttcttctacattagaattgataacagtagtagtataatcaaaccaaaccttcaactccacattccatttttagatctgtaatatttaatatggcttaagctgcaaattagagtaaccttaacctaaaatgaatttaaaaattttaaaaaaattgtgcttgcctaacaggatttccaggaagtcagtgttccaactctattccttttgtgatatgttcagttctgccctcttctatattttggttttgttattcatggtcaaagatggctgccattcacagctaaagcaacatctgctttgttaatatcaagaaagagggagaggtaaccgctccttcaactataaaaaaaattatcattccctgaatagggtcatctggtgccctaggatcagtagtagtcatgagatgttgagatgattgacatatctggagcctgtaccagtcattggcaagaggaatggaattgctgtgatcaacttagcctactcaggattcttacctggagctcttggtagggataacatctcctgaatcataacgatgatgtaagggaagtctgaatacttaaaaattgaaacgtgttattttatcccagtaaggaagaaagtggaatacttgataagccaccagtggtgtctattacatgaagaagcaaagggaatgaagtaaacttaagtgcataaaaatgacttctcagaaaagtacagatccagatcctatggatacccaaattaattcctaatttattgcttaaaatagctactaggcatgctgactcctgtttcaccctgtcagagggactttgaataaaatggtactagattattaattatggggactagtcatgtacttcatgctctctcaaagcaatgtctagatctgtccttgctttggctgctcttcagccagctctggggtctggcctcatcctgcactccaccctcccaaccttttagtgagaggtacttttaccatctgcaaaggtaaaagagatacctttactatcacatggcatcacatttgccacatgatgtctctatcaaattcaaattaacctacccttaagggtaactgttgcactatctttagtctttctgattccaggtctcttcccatttttctctgacttgtgtgaaatatatacactttccttatatttccaggcatcttctcctcttggggaattgtacctttttctcttattattcctattttctggacctaatgttttttcaactatgtggaatctggtgttagtttcaagtagaaccttcctatgtatgctagtttaccaaagcaggtccaaacatttttcttttctttcttttttttttttttttttggtggtgagcgggggtgaatctcaactatcttagggaattccttttgactttggatttaagaactgagggaaagcatttagctctttgtgtatttgcaaaggagaataatttatgtactattacctttgtttccttcttattttcccaactttgagaactctattttgtttcctgaaactgcctgtatgctttttttgccagagaagtcatcttataaatacttggctatctataatttggcaatgataaaactaaaacagaaaatagcacacacataataataaagggtggtttggtcacaatcaatttctaatagtatacattaccactagctgtatatcatattccacatgatactattggtagtccacagaagactagacatttgctttacctgaaggcccatgtcaagtcattgtcagaaaaagccctgaaaaataatataggcttttacaaaattgccttctgaagtggtggcaacagagttacattacagacattatatgttactcagcaaaactcctttaaggtcttccttggttgagcatgtcttcctcttggttcctccattcctcaagccttccatcttcatagttcctacctccccttttttaggcggatgcctctgccttctgagaagctatctgttagtgtttgtctaagtcttctccattatggagagggaaaaactatgaaaacttatatagaatatttttgtccacatcacccaatgagaaataatttgctttttatagaaggcattaatagatataagatatattaccttgataaaataaaaagaaaagcaaaaagttgatgccctctcctaatcccccccaggtttcttcctgccttcttaatgctttcatgtgtagctctgctatctagagtgctcattctcctaacccctcccctgcccatactttccccatggaaggaaagaataccttcctttattccttacaaatgactaaaaagtctttagtcctgctcacaacagtatttaaattcaaacggaaagcggtattttacattaaggagaaaaatctttaatttaggacttttgcatatccactctgtacctagggaaggactgtgcactgggtaaattttctagaacttctgaaatcacattacgtggacaactttgtatttgcagtttggtcatgaagaagactgctcttgaatgtgttcattgaagagctttttccttctgtgattgtcttttggagcatgaaagtcaaaataccaaagaatgataaaacttaatcaaaatttaaattactgtttaagatctccaaaatccttttggaaaataatttcatagtacattttataactagagcaaaaagagctaatagaggcacgttttctatagcaataactacctcctctgtgttttcacctcttcagaggctaataacactgtcaaattgatggaaaccttcctgcttactgaattatagcacctccatttacattagcataatatatgccaaaaatgaaatactatctcatttcaaagtctgtgggtttattttattacttgtagttgatatttcttgtactctaaactgtaatagtcttcagttttttttttttaaataataaaaaaaggaaggaaagaaagagggatggaaagatgaagggaaggaagaaactgttttttagtgttcttcctcccatggtagataattaataaaaacattgatactaaacaatgatgtaaaagattatatggaaacagggaaatctcaaaaagaaaccaaatatttatatagtgaggtatggtacctaatggaagagcatttaagaagaattatgtagttataatagtcgtatagatatgtagtaccaaatgtaacaacttaacatgattacttcagcaactttcaatgaagtatttgtttcaaatattctttgatccctttcaaaaagaaattacatagctgttattcaataaagataatcgaggtaggtggaactgaaggttgaaattacaggaatctatattggtcataacacagaatttttgaaagcttcacaacaacccaaacaagtggttatggtaggttttaccacattttacagatgagaaactgaaggccagggaattcactgataaaagtatgagagggaactggcagtgggacattgactcctactctaactttagtgaaattctcactatgccatacttttattttttgcagatagatgttctaaaagtaagaattaaatattctcatgtttgtaatttttctcaagcaaactttcattatctcatttaactctgggtgcttctgtaaaagagttctaagaactgtgggagctttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccaagtgatctcattgttcaattcccacctatgagtgagaatatgctgtgtttggttttttgttcttgcgatagtttactgagaatgatggtttccaatttcatccatgtccctacaaaggacatgaactcatcattttttatggctgcatagtattccatggtgtatatgtgccacattttcttaatgtgcacatgtaccctaaaacttagagtataataaaaaaaaaaaaaaaaatcttaatgacttaggaagaatcagagtgaagattttgaagcctttttatatataccatgagttatacagtcaatacatttttgaaggcagagtatctatatctattattttttttaagaacacattgttttacacaattattttacttccagaaacctatgccacagaagacttaacaccctggacaaaaaaatatatacgtatgaggaattttgcataattgtccatagtgaaaatttggcaacaaccaaaatctcacccccaaataaatgattaaagaaaaatatatttatacagtttatgttgtacagttacacaatggaattagctagttctaatgaaaatgaaagattttcttcagaatacagttagtgaaaattgccagttggagaacatatacaacactacttttggggaaaaaaatatgtaggtgtatgtaaatagtgaaaatattttaggcatgggattttggtaatcttcataatctacatgttaggagtgaagttttggtaatcttatgtagtctacatttgtacatttttgtattatgaagagaaactacagagaagtttgcattgtcatctcattaatataatttttaaaatttaaaaaggcttctctgagattgcaagaggtgagtgactttgccacaggtttttagaaaagtagatgactacacgcttaacatgttgttgaggtcatctatgcatcagcaatgggaggttcaggtattatctggtgtccttctagttctaagactctgtgatgctgagagatgggagagatatgaaatctgctgtgctgaaatggaagggcttagcttactcgtggcactccaactgcaatttagaatttcttatctcactccttcttcctggaccgaatcattctcactgtcccatcatattttaaggaataccattaggaagtcactaaagatttcactttttaagatttcactttttctagcacaactagaaacaatgtgatggatttgagttcttaatttaaaaattgtatgcttcatatagttatctagtccaaaaatattttacattgtatgtttataactaaagtgtatcttgttctccctccaccttgtgtagtttatcagtaaaaccaataaagcctactgaattaacagacatataatatcacttacaataaaagtaaatgtactttttacttacagtaaaacaatacaattttacttacgataaaattgtatcacttacagtaaaagtaaatttgtaataggaaaactggaaaataaatgcacagcaattatttctaaaaaaaaaaaaaaaaaaaaaaaaaaagaactgtgagagctccgtgatagaactatatgctgtttgctctctaagagattccaatataatggaaagaaaagagaagcacatgtcctaaagttcttacacctccattgtactggaaacttgtgcaactcttgaacaagtttattattttttttttgtagctaatgtccctacttttatgctcccttgagattttttgtatggtgctatttatgatatccacatgtattaagattatttgtaattatgtttcaaaattattttcaatcatgtcttggacttgtggaatgtgaagattagttcctattcatcctagttctataaggctaagtgtagtgcttacaacacagtaaatgttcagtacatgcttgtgtttggtatatatttattattagaaaggtctatacctctcatataaaattcaagcaatatggacgtatataatgtaaacagttaaactttacatgtctttcacccactcctactgctctcaggtaaccatcgttagcattttgattcagaactacttagactttttttacatggacaaatacgatgtgatttttgaattcataagttaaattcataagacgcactgagaatcaaaaatattctataagctgaagacattatataaaattaaaatattattttatgattttaaactacttcaactgtgttctgtagaaagaaaacaattgaacaggatgatcttaaaactttgatagttgtatagattatcaatagtattttacatgttacaccaaaaatattcatttcatattaacattctaatttatcaggacaacacactaaattttagttttctcattatcagacatcactttattttcacatacattggaatattattggtcaaacttttactctagtaagagctgacatttctatttattaggttctaaactagtgatttataaggtatttctgctttgcagagtattcccattcagtaatggaaataatccttggtcctttgagttaacatttgaaagtacataattaataaatgaacattaagaactttatatctatatttactattcttcaaaagaagtttagccaggcgcagtggctcacacctgtaatcccagcactttgggaggccgaggcgggaggatcaagagactgagaacatcctggccaacatggtgaaaccccgtctctactaacaatacaaaaattagctgggcatggtggcacttgcctatagtcccagctacttgggaggctgaggtaggggaatcacttgaacccgggaggcggagtttgcagtgagccgagatcacaccattgcactccagcctcggcgacaagagcaaaactccgtctaaaaaaaaaaaaagaattttatatatagacagcaattcaaatgtattttttagttttctttatttctatttcattaatgtgcttgactattgatagtcttgattaaggatataatatttactctatttctctgacttaaagaggaaatatatgctcctcattctctatgctacttagtgattttaatttttctcaaggaaactttcatcgtcccatttaacatttgcgcttctgtcgtaaaagaatgctaagaactatgggagctccgtggtagaattatatgctgtttgctctcagagagcttgttagaattttggagtttaagtggtgactttgacctaaaggctgaacatcaaattacaaatgttattacactttagtgagtattagaagaaagaaaaaaatggtacattattgagaattaatgaattatgattgaactaaatggattttagctagccatacagaaactgtgaggttaaaaacatggatttttctgtttcataaaacaacttataattatttgctatcatttaaaattttggactataaataaataaactattaccatgtaatttaattaaacttggtatgacaaacactttgtggcctcagatagaagatgatgtagagctatgcaaactgtgtattcataaaacatatggcagaaaagctctatgaataatagttgactaagagcttaacatatgtctaataatgtgttcagcatagattaatgggaaataaatatattgaaacaatatatttgatatttaaaaactgatttgagctgtgttctaattacctcattgtgccttaatttaatagtgtataaaaactgggaataatacaataaatttattgaggaatttgcaattagtaatagttactagagttaaaacaattctaataatttcatgtggaaagtgataaaaatgatataagtggtatggaaacaaatgaaggttatttattagtaaaattgattaccaacatttttgtgtgaaaggtctaagaaaatttacataatcaatattaagtttaatgtctcatatccaagtcgagtactagtagttaaatagcgttaggaaaaatagctaatgtatgctgggcttaatactgaggtgatgggttgataggtgcagcaaatcaccatgacacacgtttacctatgtaacaaatctgcacatcctgcacacgtaccctggaacttaaaataataataaagaaaatttaaaaaatacaagacttcatacttttctgaggataaagaagtagaagttgatgagtgataatggtattgatgctttctatttgcttttgaaactataagatataaataaatagaccaagagctactaagctactatttactgaatttttaccttattctaagtaattttcatatattagcttctttcatgacttgggtttagatgtgtgtgagaaactgaatgaaatataatatagctacaataccaaattcaagagaaatttggtgaggtgagcttggagataggaaggctgtagattttggatagccatgtaagtcatgtgccctttattttatgggcagtgggaaagcattgtgggttataagtatcaaattacattataggataaaatataattaaatgatttttaaattatatgaacaattcagatttgttttattattaaattggaaaacatcttaaaatttttacagtaacctcatgataggtggaaaaggaatagaaatttatacattgtttttaggagtggcagttgatacaacaatttttggatggcaatattatactatgaaataaaattttaaaatcacatactcttttacataggaatacaacttctaggaattaaaaatctggatactatcacaaaaatttatcgtgaaaactatatatttgaagatgtccaaaaatcctagaagagcatgtcactacttgagaaagactaacatatatgtgcaaataataagaaagaatcataagagctggtgttgttgataggacaattggcactcttaggcactattggattgaatcatcattatattcacacagaataatttaacctttatgaaagatttaggtttgactcagcagtttcgatcactcattctaagaaatttattggattccaatccaaaaatttaagtacaaatgtgctattgtaatgttgtttatcatagcaactaaaaattaagagttaaataaattataatacattaagcagctgaattttatatagtcaatataagtatttatagaagtaaatggtcataataacctataaaaaggaaataagctacacaatcacatttatacaaatctcatatgagtaagtcatatatacatatgtatataaatataaacattatgaaaacttatgctaagctattggtaatggtaaccctgtgatgatggaattttaggggttgttattgtttttgtggtagtgtttatctctacttccttttctttctgtgcaagattctttgttatttatttaattagaaacactaagaaaattatttacataaattctatatctcatagccaatatccacagtgtttttccttttaggagactcataaattcttcccctagaggagcctgatatgctaaatttcacaggaaggccttagaatagactacatcactgggacctttggtataggctgacttaatccctctgttcaaaacttgcttcaaatattgcctagaatatactcaattattaataaatgctgaaaggaataagacaacatctaaacccatctctcagctcttatatttgtttttgtttgcttgttttatggatgtgacattgatgatatacttgtgtgacgtctttatgagtgattctcaaattattgtgcaatttccataggtagaatctttccatttatattaattctaagtagtataattccttctctctgtttttatagcatcatttgctttataaagatagatgaaaaacaggagtctgaacgtttttcctgttttctctgtcactgaaagaagaatgtcagtatacttaaagataagcaattgaatgcaaataatttggaagaaccattttaatcaccataattgtactgaagcacttaaaaatgcatgtatggaattgaaaaatagattaaaaatcctttcaataagtgtactcatttatttaattactttgaagttggaagtaaaaccatcctttctgtaggctatagtatttcactttgggttaacaacttagtaagatgaacaccatttttgacagttagtgtgggtcttgatgttttatcagcattttaataaatttgacttcagtcatttatgtgctttatcattgagattttccaatatcttattccaataagaatgactaatagttatgctcatttaaaaagtaatattgcaatgctgagaatgatcattgcctttatgttcagatttatctgagagtatgtgtggcatctttcctgaaaaatacacacaaggtgattattttgttggagacattgtttgaagaccaatttatgtgttatcttttatttgaaaagcagcttaaaaagacaaaccattccagcacaacattcaacatttgacagttcggctcagtgataaccttattcactcacacgatgtaatggttatttttgttgcaaaggaaccctccctggttttcttgtatctccattatactttgtccgtaagctctatgatgctagaatttccaaatagattgatttttcaactaaaattgaatgtatctacttattcactttcaaacccaaaatatactcacctatttttgcctcaaattctttttaaagcagggaagttaaaaataatttgtaaatccctaatttctccaattttcggtaacgatatcattatcatccaatgtattttgagtcaaaactgtggtattatttttattcttcacttttctagatctttcttaaccacttatattaattaaaatctgcccttcaaaaatgatctctcatcttttttgtcccctcagtattattcaacttgattattgctattttagttaccttctaattccacaacatcatccactcccttgttctttccccagtggagtacctttgttctatggccaaaattattctcataaattaatcatgaattttattattaagcatcactgatgattcatcactgcctataaaataagatgcaattttttggcattcaagactctccacgatagtttccaaaattatcttttcagctctataatttcacttctataaacttttaactcctcatctccaactctcaactctcaacacttatttaggttcaagtccagtggatcatttatcattctctgaacattttctttgtaaagaactgccgtcactagcttcaatgttctccataactcagaccgttataaccaaaagcatatttttggtgtaatattatatctttcatgaaggtttaatggattatttttcttttttttgttaatttctacctcttctgtacttatattttcattaatatatttaaaatattaatattagtcttctaacagttattataatatttgttttggtctgttttattttgtgggtgaaaaacaccaattatatacaatgtgagcataccagtattgtgtatatatgtacatatgcatcctcaagcatctatgtgtatggtctaagtgtgtgcatgtgtgtatatgcatagaggtagaataatgaaggtagcttaagatgtaagaggtaatctttgcctgtataatgattttgtcatgggccaattctgattatgtcacatcagttgaagatgcacatcaagatgtctgaaataactttcttctgcctgttctgacctttgttgtctcactttaactcatcatccagctgctgcctgagtattttgctttaatctattctctactcagctaaattagaaatactattttagatgaaaatagcacataagtatccactgagaaatccctggtggtttaattatcactgattttttttagaagcaatttgaaatggtctccaattgtggttaatttagcaatgagttttcagtggtgtggacatagtaataagtgttaaaatattaaacaagccttcattttgattgccaaatttcttttagagcaaaactaatatagaaatccttacagtcaaggcttctttacaaatccaaacctggaatgtgtgtgtgggtttgtttttaaccttgcagtgaaaaaataaattcctcattaaagaaaactaaagtttgaaaaaaaaaacataaatcctttgcatataccccttatttttgaatcatgaggcatttttggtaaaagtggaaagcaaataatgtcacttatctttagtataacttctttttttatacaaagaaaatagttttaaggaataaaatggtacatcagattcaactcctgactagataatcataatatttacggaagactatttgacaacagcttaaaggatacacaaaataagagcattaaaccatgtaaaagggattagactagtgttctctcagcagtggtcagagttgcataaatctgaaacttgaatgggagaagaaatgtgtgcattctaatcctaaacatgaaaaatattcattctgaaatctacgttaaatacttcaaataaaaaagtatttataatatccatatgggttttctaaaatatattcttccaaaatataagtcaagcatggttaagacaggcccttatcatttaatggaaaggattaggagtgagtataaaaatgttttaagtcacgttttgcaaagtttattctgtggaaagtaagtcctacaaggtacttaatggaaaaaggtgttcatgaataaatgttttaaatattttgtacatattatgtcatcctgtattgaagttaaagcattcattaacatattaaagactgagtattttgcaacacattggaagccaacttttctcaaaattatttcagaacaagatagcttcccaagccaaatgtgtctttcttttttcttaaaacaccaagccagtattcatcgagacaaattctcagaaatgttgtttaaaagtgttaccaattaaaaacaaaacaaaactttacaggtttgtttgttacagaaaacagaattgaagtaagaactactttgcaatggctcatagtattaagtacataaaataaaagtgccaaggaatcccatagcttttgctgacggaagcaaatcgcactcactgtactgactgtgcaatattccatttgacttcattgaagttctgttttctcataaaggagcaacagttgtgcctccctcagtgtgttgaaaggatcatatacagctatttgttttaacagccctaaagtgctacaaaattttcaacttacatttgcctcacactgcctaataagcttgatttttcatgtcagttcaatttccccagtctgaaatgactattgtaaacatgttctcctctcacttctcttaggacactctagcagcattgttcatcaaacagcattgcttcctaattttcagtgaaaatgagtatcttttttttttttttttttttttttggagaccgggtctcactctcttgcccaggctggagtgcagtggcttgatcctggctcactgcaacctccgcctcctgggttcaagcgattctcctgcctcagcctcccgagtagctggaattacaggcatgagccactgtgcccagccgaaaatgagaatcttctgggcagtcctcagtgtctagctgccacatctctaaaactggcctccatcttgccagtgcttctcatctgagtgaaatgttggtgttcttttcttcaatcccaggaggtctgaatcccacgtctccaacactctaagatctttaagtaatttttccttctttagtattttctttttttttgagatgaagtctcactcttgtccccaggctggagtgcaatggcgtgatctcacctcactgcaatctctgcctcctgggttcaagcgattctcctgcctcagcctcccaaatagctgggattacaggcgcctgccaccgcgcccagctaatttttgttatttttagtacagacggggtttcaccatgttggtcaggctggtcttgagctcctgacctcaggtgatccacccgcctcggcctctcaaagtgctgggattacagatgtgagccaccgcgcggccttatctagtattttcattgagtttttctcctttagattcttactgtcaatattttgttattcctatcaaactaagataaacagtaccccaaacatacaaagcaacaaaacatgcaaacctttatcctgtacccgtcagctaccatcatacctcttacctctcaatgtcaaaaaattttaaaagagttataggtacatgccactccttctgcttaccttccagttactctgaataaataaattgccagtctggtttctgcacatacaagttactctcaaatttagttttaaatagctagctaccagtttgtttctatgtgacaactttaatatcctttgaaaaatacttatgaaaaactgacttcaagtgtctagttttctgtaagttacaaagatatatagtctacctacatctattgtaagcactagtaataattcaaaatgaaattctctaaaagatgttaaatgaataaagtaagatttattcccaaaatcagaatctcagagacaaggtaatgttaatgttgcctctttgaaatgctagtttcttcgctctgtggtccagtttggatatcccagaagtcataaagtataacgtcttaatacctccaagtatccattatctacctatataatttattaatgggccgtgcataaatgagacacttctcagtggattatgaatatatattgcttctcagatgtcttaggttgatttcctttttaaataaccagtacatttgaatttaaccacgtcttttgttcacaaacatcatcaaattcttaaatcttacattcaaatccaaactttagaaacttttcaaccttttacaaagtataataaagactgctcactgcatcagtgaaatgtgttttaagtccaggatgtattaaattaaagttcaagctttgtccttaactgtttattttttagaactctcttaatatcggagagtagttctcctgttgtattctaaaaagactcgctgaatttgaaataaaaattattttaattacagcaacaaaaaagtcaatattttcagcagttttttctgtatgagtttattcaagaagtgagtttttattggacataacttatatgcacattgtacagttttaatatataaatgactgtttaaatcctaacagtggcctaatttcataagtagtattttgaaacaaagtatctaggctctctgtaaatagtaagggctattaagaatagattccttttctgcatgttccctttcctggtctttttgggtactttgctttgactttttcctttcccttatgttgattatatcatttgttttaaacttttcttcccgaaatacttatctccaaaggcagatattgagatggggacaaaaaatgttgttggactggtagctaaagaacaaactatagttcagagaatatacttgaaatctcacaagataggtacattttgtttagtaactttgttatttagtaacttttacagcattatcactttgatcttaacaataactcttcgaaaaatacactaaaactatgccctgcatccagcaaatgagaaaacaaatttggataagataaacatctaagatggcagttgataagagacatagaattagaacacagatctgtcttaaatttcatgctctgattttcctgaaattaataaatggcatgaatctaaagctttagattacctaaaatttatttaaatttggctttagaatgttaatttattctctactggaccactattaaaattaatatgcattctctgaacatgtagcaaatgatgatgaaagactctgaagataattgagccgatgagaataaaaacctgtgcaaacttttaaaaattattgataagccccatttcagtatatcattatagataattgaaagttcattctcaaagtgtaagaaagttctgttcaatgtggtagttgtgagataaactctgtaaatcttactagtaatgagatgttatgtttagcaatgattaagaattgttattggcaaattctggaaaagaaattattttcatgatatgtttgtatctgtagattaatatatataagctatttacacagtactcagtatgtgaaattgtaatgtaattgacaaatacacaaaaaggttactaataccactagtcatttctacacttttatgtcttcccatcagtggcaaactaaatccttatgctttcaacatttttctacttagcatcaatatatccttcacacacaaaacattctgccttcaaaaaatacgccaatcctttaattagaaattacagacaattttctgtttgttcattcttgttcatatttctgacacttggtgatacggtctggatctttgtcaccacctaaatctcatgatcagttgtaatcctcagtgttagaggtggggcctggtgggaggtgattagatcatgagggtggatctttcatgaatggtttagcaccatcccctcagtgctgttctcatgttggtgagttctcacgagatctggttgtttaaaagtgtgtagcatctttcccctctgtcttgctcctactctagccacataaaacgtacctgcttttccttcaccttccacagtgattttaagtttcctgaggactccgcagaagcagaagccactatgctttctgtacagcctgcagaaccatgagccagatagcctctattcattataaattacccagcctcaagtgtttctttatagcagtgaaagaatggactaatacactttgtattccagatcatgaattgtgttttgaaggaaaaaagtcacataattataagaattttggaggatacgatatatcttaataaaacatctaatctattcaactccccccaaaatggttaaaaatttttattacagatctttcgtgggattctcaaatatttttgcatttttatttatatattatagtaatttaatttccataaaatttgcccattttaattctacaatgtaaggatttttagtaagtttacagaattgtgcaactatcttctcaacctaattttactctattgccattacccccgaaaaaagtccatacctattctgactttcaaccccaggaaacatctaatctactttctatctctctatatttgtctcttctggacatttaatgtaaataatttgtgttttttaatgtctgaattatttcattgagcataacgtcttcaaagttcattcacgttgtaacatttatcagtacttcatttctttttatgactgaataatattccattctatggatatacagtcatgtgccacctaatactttggtaaaggacagactgtatgtaggatgatgatcccataatattataatagagctgaaaattttccattgcttagtgatgtcatagctgtccttaagttgtagcacaatgcattacttatgtgttagtggtgatgctggtgtcaacaaacctgctgcacttctaatcataaaaaagtatagcacataaaattatgtacaatacataatacttgataataaataaagttactggtttatatatttactgtattatttattattattttaagtgtacttctacttattaaaaaaaagttaactataaaatagtctcaggcaggtccttcaggaggaatttcagaagaagatatggttattatgggtgatgacagctgcatgcatgttatttctcctaaagaccttttagtgagagaagatgtggatgtggaagaaagtgatattgatgatcctgacacgctgtgtaggcctgagctaatgtgtacatcttaagtttttaacaaaaaaattaaaattaaaaaaaaaaacattaaaatagaatcaaccttatagaataagaatataaggaaaatattttgtacagctgtacaatgtatgttttaagctaactgttaatataagacatccgtaaagttaaaaaattaaacagtttataaagtaaaaatgttacagtaagctaaggttaatttatcattgaacaaaattttttaaaaagaaaatttagtttagcctaagtatatagtatttataaagtctacagtaatgtacagtagtgtcctaggccttcacattcactcaccactgactcactgtctcacccagggcaacttacaatcctgtagttttcattcatagtgccgagaaaatgtgtatcatttttatctttatgctggatttttagcattacttttctatgtttagatatgtttagacacacaaataccattgtgttacaatgcctatagtatacaagacaataacatattgtacatatttgtagcctagaagcaataggctagaccatataacctaggtgtgtagtaagctataccatctaggtttgtgtaagtacactctattgatatactcacagtgacaaaactgtccaaggacacgtttctcagatcatattcccatcattaaacaatgaatggctgtgtaccacattttgtttattcattcactaattgttgaggaattgggcttttcccagtttgggggcattgtgaataagctgctgtgagcatttatgtacaagtctttgtgtagacatctgctttcatttctcttgggtagataactaggagtagagctgctgtcttatagggttaactgtgtttagcatatgagaaactggcagacagttttcaaactgcctatagcattttgcattcctttcagcaatgtatgagtgttccaccttctctcattctcatcaacatttgctgtctttcttttgattatatttcaatagatgtgaacggggcatggcattgtggccattacttgcattcccctaatgactactcctgagtaccttctcatgtgcttattgcccagtcatatatcttctttggaaaaatgttcaattcccttaaccatttgttgaattatttactcttttgttattgacttgtaagcgttctttatatattttagatataaatcccttatcagacttatgacttgcaaatattttctcccattctatggcattttttgtttgtttgtttgttttgagatgaagtctcactgttgcccaggctggaatgcagtggcacaatcttggctcactacaacctctgcctcccaggttcaagtgattctcctgcctcagcctcgctagtagctgggattacaggtgcccatcaccacacctggctaatttttgtttttttttatagagatggggtttcaccatgatgggcaggctggtcttgaacttctgatctcaagtgatcctcccaccttggcctcccagaatgttggtattaacagatgtgagccactgcacccggcctctgtggaatgttttgaagcataaaacttttaaattctgatgaagcctagtgtattgtttatttatcacttgtacttttaatacaatctaatgagtcagggagtgacccaagattatgaaaatttactccaatgttttctgttttataaccttacctcttatgtttaggtccgtgatccatttttatttaattttcctgtatgctgtgaaataagggtagaaatttatatttttacaatggatgcccaattgtctcagcaccatttcttaaaaagactattcctttcctattaaaatttcctagcatatttgttaaaaaatcaatagatcataaatgtaagagtttattactgggttcttaattatattccatttatttacatgtctgtcatcatgccagtaccctattccttactgtaggtttgtaataagttttgaaatggggaaatgtaattcctccaaatttgttattttttaaggtttctttggcaatttggcatctttgtatttatgtagacattttaggatcagcttgtaagtttttgcaaaaccaaaaaagcagagattttgatagagattccattgaatctatagaccaatttgtagagtattgccatcttaacaatattaagtcttctgatacatgaacataggatgctattccatgtatttaggtcttgtttaatttctttcagcaatgttttatagtttcgagtataaatttttcacttattttattaaatttattcctaaatattttattcttctggaatctattgtggatggaattattttcctaatttcattttcagtctgttcattgctaatgtataaaaatgcaatttatttttacatgttgattttaatcctatgacattgctgaatcaaatattttatgagagtttagaaaagcccaccctaaatacataatgataacattacagaaaacttagggggaaatctgtgagccaaccatcttgttaaaataattctgacattctgatgtaatttttttattttaacaaatttttgcacaactttgtaggatacatgtataacacaatacaatgtgccttctgtttttacatttattattgtattttatgtgtttttctataacagttttatagaaaatataacataaatgattacttgtcagagaagtaaacttgttataggacttatcagaatccataattgaggatatcaagccaaattgttttgtataaaagtgtttcagaataaatatatgggttccggggtcagaaatatggaagtcaatatcaataggaaacatataactactataacaacaacaaaatcagcaatgctattgtgaatagtgctgcgataaacatgcatgtgcagtgtctacccaaatgcccatcagtgatagactggattgaaaaaaaaaaaaaaaagaaaaaactgttttcagctctcacactgtctgttttactgtcttttaaaagttctttagttcacctatggctttcttaaattatgatgttgacagaatactttgacctgtataaagtatgggagactattgacctccttgttctggagattcattattttatttgctgcaatcttagcttctatgcagcaatattacagtctcagtttatacttattttgtgatcacctaatatcctggtttttatactcattaaatgttgttaaatcatgcttctgccatatttcttgtgtactttccttcatcttgtctccctatatttccctccctttctccttccctccctccctccctccctctctccctctctccctctctccctctctccctctctccctttcttcttttctttcttttgtctcactcttttgtccaggctggagtgtgggggcacaatcatagctcactgtaatctcaaactcctgggtttgagcgatcctcccaccttagcctccttgagtatctaggactacacgtgcacaccaccatgctcgtttgttttgattttttaaaaatttttatatggacagggactcactaagttgccgaggctggcatttattcttcctatgttttattgtgttgactttatcccacagtagtgtattctttaaaaatatctcttgacttatataaactaaaattaaataataaaaatagtcttggaagcaaaccagcctacaggtatactacatccaaaaatttctaaatctcataccaaatttgtagtgatgctttgtataaacataacgtcccaattctgcttgaactgttactacacttccacataatacagtagagtacgctgtgccaatattatgctatgctttctaccaagtgtcatgtgttttgccgcagcagaaaagattttagtcaaatcaaaaagcaatgaaactcaagaactttaccattatatttctagctttattctctcattgatgctatatttttgaaactttgatatcccatcattatcaccaatagcataaaaacaataatgccaatactacaaataataaaaatgtattattgaaatgtatatggattaaaacaaatgtgcaacatttgtaagtgttcatatgtcttcagatcttttctggcagacctggaaaatagttattgtcaaatcaacaatgaaaacaataataaactattaaatagaggagtgaggaaggagctttgcgtgtgtgtgtgcgtgcgcgcgtgcccacatgtgtttttggtggaataaatactttctctatttcctaatttatgattctactaatcaggtgtcttcaaaacaataatgtattccttggcaatacaaatctgaaagctgtcagtaaattctgtcatttatttccattgttttcaccacgtactaaaagatagaaagaacaagactataggagattgacagattgtccaggcatatgccacattagttccacagtcaaatatatattttgcaaatcataaggcacacagtcttttcaggattacacaatgaggcacagatctttacacactgtccaaacaaatgtcttccaagccaagtagacctatgtgctaaggttgatttcaaaaagagtacggtaaagaaaataagccaagataggagatcacaggagaaaatggaggttgacagatgaagcacaatggtaggaacagagactctgagatggaactttgagaatgctgaattttcaatctcaaactcatttacttatggtcataagccactgaatttacgtgtcaatatgagaagggatgaaagtattccaagcttggaaaaataactaagtttctgacgattgttgtgggaaccaattgtataatgtgaataagaattagtttatttgataagtttgagtttgctctattcatttataaaatcaggatgaaacactttataaacgccaagtcacattataagttatatataagacataggcatttacttaatcatagtgtcatttgaggcaaattacctacaacattttcaggtcaccatcacacaaataatgtctgaaaagaacctgagaaaagcccacttttttgtttgaatttattttctgttacaaggaaaagcttgagattatacagttgtttttaagttacttgagatggttttgaagaaatggacttgatgagagatgataaggggaggaatgttttagttcttgccatgtccctctctgattatctcctctgtggtcagaagatagggactggggtgaagatggcaatctggccaaagaggaggtgttagagactcattgcccttctttaccattttgcctaaaaccagccctccatctgattaacagaatatctgagaaagcaaatgtttacttaaaacccaaatgattcatgtctctatctatctatctatctatctatctatctatctatctatctatctatctacacatacctggagttcagtgtcttatcatgatctgattgtataacccaataattttctgagatagccaactattttttccagagacaatgtgagaaagaatagtttcttttgagaaaagttaaaaaaagcacctaccctaattctgaagacaaagaccataataaatgcttttaatattgtaccaaatgaaccaacatctgattccctaagaggaataacattaagagtattcatgatttaaaaaaggaacaaaggtgttaagaagaataaaatatataaactgtgattactcagagtttaatttgtacatttttgtgtggtgaattattcaaactctaacttctgtctctctctttttttaatcttaatgtcttcctttcaccacttgttatcacttccagaaaaaaaaagtagactaaaattgcaaaatagaagaaaatatagaaattatcaggggctgaagttactatagaagaagataaaaattattctgggcagctaccataactgaataggtagtaattggtctcatctggattatacttcagggcagtgtacgtaggaatcttttggagttttttttttgtataacctatatctgtctatgaagtagatatatctttataatatctgtgtgagtagaaataagtgaataacagaaaatttgagtaagccaggtaattccaagaaatgtatgtatcctacaagtaggacaatggacagataacctttaatagtcaattatagacatgagatagaaagtcccctggaatatggcaagatgacagattggacataatttgtaaaaggcagagatgtcccattccttgagagtgcataactcaagattaccctactaaaatgtaatgagagaataatgaggcatcataaatagaggagtgagacaaaatatcttgtgacaaagatttgatgttctttatcctaagggggaaaatacagaggtgagaagggagtgagagacagattttaccttggaattgtatcataagctagacttcccattgtctttctgtctcttctgagagactataagtaagctcaaaaatcaaagcctccagatagatttttttaaaagaaaaaaacgtttgaaaaaagaaggaaaacaaaacaaagcaaaatatatgaatagttccagggctcccaatccagagccgcgaggtgttcactaggttcttacctccaatttttgtcttctagcaccaaaagactactgaaaattttactctgtttttcagtggctttctctttaactttttttaaaaatgtattatgtatgtatatatttagaggaaggatctcgctctgtcacccaggctggagcacggtggtgccatcctagctcactgcagcctcaaactcctgggctccagggatcctcccacctcagtatatacaaaaataaacaaacaaatcagccagacttcatggcacaggccttgagtctctaactttttagctttgatcctttgcatctcagaattagaaaattccttgaggggagatccactgctaaatactaaattcatatccctgggcttttcctctttccagcctctccaactcttaatttttagtttctttgtcagtattgaattacaatttatatgatataaatgtttattgatgacctattatagatcaagtagtgggccacgtactaggggaaaattgggcacaaaaaaacagatgaggtcttggccctcatacaatttaaaatctgctagaggactcagacatagtcaagtaattacacaaacaaaagaagccgaatgagtggaaggaagtacatggtgccacaaacccatgccttaggtgattttaacttggttggggaggtaggcagaagattctcttaggaaataattctttatctctgactaaggatgggcaaggggtaagtaaggaaggagggctactaaagaacattataagggccgggcactgtggctggcgcctgtaatcccagcactttgggaggccgaggcgggcagatcacaaggtcaagagatcgagaccgtcctggctaacacggtgaaaccctgtctctactaaaaatacaaaaaattagttgggcgtggtggcaggcgcctgtagtcccagctacccgggaggctgaggcaggagaatggcgtgaaccctggaggcggagcttgcagtgagccgagatcgcgccactgcagtccagcttgggcgacagagcgagactccgtctcaactaactaactaactaactaactaactaactaactaactaactaactaagattacgagacaggaagcacagaagcataagccctgtgcgggatggtgagaataagaaaccaagagaagacggatgtgcctgaaaggagagagctctgggaaatttgacacgtgatgaggccagataggatgctggaggccaattcacgtcgtgcctcttaagccaaactaagaagcgttatcttcatcctcagagcaacggaagccattcaaagactttaagaagggaagaacataatgagaatggcttattggaaattttagctggctgtaatgtagctaatgggctgtagctcattacatattataataccaatgttactgttgaggagtataaatgtcaaagagattgtcaaatgtatttatggccacagagctaataagtaatggagttggaactcaagctcagaattctacttcctgacctggggcttctccctttaatcagagttgtctgatatgaaagaagaagagcacacatagaaagggctcccaggtaaacaccagcagtttgatttgattgtcagatgacaccaagaaaggagaggccagtcttggggtctatattttcaaactgggagaaaaagagagaaagaccagattggtggagaaactgatgtggcatgtgaggaatagaatactaggtatgtctaccctaaaggaaagaatatgtgggcggtgaaaacatggcaactgtcttcaaatagtgaagaatatgaatttatttgacagggcttcagagaaccaaccaaggccaatagagataagatacagggaagtaccttttaggtttttagaagagttatctgaggaggggtgttgtcgaaactgtagcagagttttcctattattgaaattatataagcagagctggataaccacttataataatagtgtagaaaatattcatcttttgggcagagaaacaaaccttctgatgtctgagagcccttccaactcctccattctgtgattctctgacacataattacacataacctttcaaatttcttaaagagaagatcccaatataaaaatacagtaaaatgtctataatgcaaataaacttgctcagagttcaaactatttttaaattttaaaatattttcatatagcaatggttgttataatgcctaaggcatggtaaaaagccaagttgtaggcagtgtagcaaattataaataccaggttgtatagtaaaacgtcattccttttaaaagcttactttagatataatggttattaattcttgaaaattagatatgctggaaatcgctttatatgtagcatatatggataaaattattattaggttttatgtataacttgattgctgatataaaattgatggtttctttgtcagcatgcaacattattaatgtgctcagcacacacatatcaatgttccaataaatactagagagcatcatcccactaaaacaaaaacaaaaacacctgtaaatgtttaagtttttcaagtgaaagatgatacttgcaatgtgggagattattttagaattgcttagtgaggcctggtttacaggcttgataagaattatgaatataacttttaattctgccaccagatggcagaagtagccattacttaggtaaatgtttacagttaaagtgctttaatatgttttacattattagattaaaccaaaacaaacaatttggatatttgtaatagcgtgtaacatgttttgtaatggtaaagatggaaaatattagcttaaatgagattttggaattaaattaatcataatgtttatgtatcccctgagaatagtatttttctttaataaaaaaactctcacaaggaattcccactgatatgttttaatgaatgcagtaaatatcttaattaattatttatacattaataattcctatatcttcctaaaggtagtcattggactcaatattggggtaaatttaaaagcattatgcacatgctgagtacaaaccaaagactaaagatattatatagttattgagttaaggcatggatgattttttaaaaagattacaaatgttacaaacgaaatacaatcacatgtacctaatacaaagttatttgcctttaataagttaaaaaataaaattaatttgtctagtctctagacaattttaaaacatcaatccaaagggatacatgtgtttctttactaaacagtaaatgccatggctaattaatgcgtgttttcaaagatcacggatacattagctgttttccatatcaattcacatttttgttgtgttgttttgttcagtcctttaaaaaaatctacttccttacatcccactgactctttaaccttctacatctggcttatcctaactatgacaaagaaaatagttttatccagtaaatttgactcttctttaccaactaacacactattttggtcctaaactctcagtattatgtgacaaagattactgtgtttttcttcttaaaacaggatctttccttgactcatttgcttccatactccttcatgtttttctttgcactgctttttagtctatttggagggggagattcttgtcctcgactccacctgcagatgtcagaaatcataggaccacttgttttcttttttttttcccctcaacatttccctacatagtgccattcattctgtcacctcccaatgttatctctatgatgaagcttcccaagtgcctatcccagcccacttctctctactgacctctagacttgtacatccaattgcctccttgaacaaagtctcttttattctagtacattccctttcttcatgagactgacttgatgaatgggctaggcacaatgttttaccttccagcaaaagtgtcgaaaatgtgctaaagtaaaaaccacacaacctattttcttgtcaagtgggaaaaagtaattgtacaggagaatggccacactatcatcagtttcatccagaagcaagatatttataaagggctttgaaaacttctgcttagggcagtaataactatatagttaaggtgtgccttaatttacagagtagacatattaggactaaagataagcttgagctaaattgtgttaattcataatgcattaattcataaagttctttgcagtgaagattcttggtttacactggttgttttatactgaaagacctgtcaacttaaatatgactgtgatgtatattttctatttattgtttcacctagctagtgacctatgataggccttggtgccaaatattctgcccaaatgaaaacaagatgcaatacagactcactttaaattagaatcaagaaacacggaaagaatgagacactggacaatgagatctacccatgtaaagttatggattaaattactgaagaggccatgagtaaagccacgtatgaatgaggctgttctataaggaagaatagtgtttgttaaaatgagtacctgctatgtgctgagtattgttctgagcacttgtttgcaggtaaacaagaacatttaccaagtaaggtgcatgttaacaagtaaacacattcaaaattttgtggaagaacattttaggcagcataaacaacaaatgcaaagatcctaaggcagaaactaaaaaacgaaagaacagccactcgtttacaagcaaacgagaacatttactggaaaacacaccttaaagaggaaagaatggtatagctatagtttagtgagtgagaggttatcagagaccgggggtataggaggatgagctcaatttctaaatcaaaaccagtaaagatttttaagaagaagttcatgtgatgtgatatgtgactactttggctgttgtatggaccatgggttgcaagcctaaggctaggaggatatctcagtgggaaacaaaagaaagcaatatgtattttttgcctcaaatatggcaaataggaaagattatgagtaggccaagtagatgacaggatccatgtagtactgttttgcttttgtttatattttttagaactgaggtatctttcatgtatatgtaggctaaaataaaggagaattagataaggagagttaaagaagcagagatagaagagtaaagatacagaaaagtgtctaatgatctaagatccttgttgaggtgtctacaattaaatttaagaagtgctggctcttgtcaggccccatgttctattggagttgtctcaagttgggctagaaattggaaaaaaaatgcacatcatagattaatggtagagttttattgaaaaaaggagaatctggcatgactgggatcagcaagacaaagatgtaaaagggcctcttgactcattatcattctacagtgcagcatgccaggagcagggcatctgctggacatgcatgttttcattttggtgaaagaatacctcacctctgtgtgtctccccattaacagagcaagcatgagaagtggccttgacagtaagggaatacattggatttatgtcatcgggaaatctggattttgtgtgcttgccaattattaggaattctctggggaagctagatattctctatctaaggaaataggaatctgaaaggtctgagagattctctgattcaccctggctaagagaagaagtctttggttctgtggaaaggtggacttgggtatgtactgtaagttggaaaaaggaaaaactcacccaggtcctagcaagctcattgtccatgcaacccacaggaaacatctaaggtcatttttagatatttctgctaataacacagtagctctaaatgaaaaaagaggtactacatccaatactagagaaaataattatataacaattaaggtatttgtggtgagaaggtgacaggagaggaggaatgtaaataactgatgttctcaattttcccaatgaaaacaagcagcaaggttacttgctgagaatgggagaggttgtgtgggaatattgtggaagtttaaaattacaattaaaaagagaagctaagaaaaagtgaaaagattgatgaacaattccaagggcccacatgatgcacttttatttagggggagacatggtttatcaatgttaatggtattgacatgcatgtgtttatatgtagatgtgcatgttttcctttaacaacattaactctgtttctagaaatcaggtgggaggctatataattgatttatatttggaatttttctagttgtatgtggtagaaggatgggattcatggtattcataattgaggaagctggtgagaggttagtttagatgataaaccatacaccatggcacccacgcatcgtacgaaaaggatagaagccctaagggggctgacaggtcaagaggaaagtattcatcaaaaagataatattctctctgtttaagaagttccatggatcagaagagtaagagagaaggatagttagaggcttttgtcagactatggaatgctggtatttacattgttttaaatagagccatttaaggtgataaatagaatataacattattattttgttgccaaagtagactgagaatagcatggacattaagaaggtccaggattttctggtttaagagtattggataattcatttacatgaatcctgaagccttctaaaattatagtgggagttctgatggaaagaaagagtatgaggtctcccaaattttggcaagtttaagtaatttattgaaaattcaaatgattgtagtggcaaggaagtagactcatatgacattatggcatgactcttcagagaagataagacattataagagatgacagttatccaagagaatgcagtcacccctcttccaccatatccaagtggtacaaatgtgaggacaggtgtcacctccttaaagaaagaaaaatctgctcagctaatacataagataatttgaagatatagaggacaattcagaagagtttgagggaaggaagtcaatacagcaggaggaacaagcagcaaagtgtatcaaaagaatgagagctctggggaaagactggtctttagtttcgtggtgcggaagtactagggtggggagcagaactaactacctagctcaaatattttgatattggtctaagttatttggttgcagaactggctgagggtctcaggtaatatctggctgtgttaaaatgtgtaatagataatatttcaaagttgtggcaattgtctgttttgcagaaagaccattccgatttggaacagtgaataggctcctggtgaagccaggactactgtgaggattgtggtgtagctgtttgatccttcttctgggttgtgtggaatgtggaaaacaagggtgtagtagtgatgaagggagggtctcctggaaaatttgttttcatattgacttttattaaattttaaaaggaagcaatagttaatatatacacttttacaaataattaaaatatacattaatattcagtttttacacttctgcttatttttaaacaaagatttctctctttgtttaacagtaagaacattaaggttggtgtctaatgtagctcttggaaatacaaaatctctttcatttattaatgactataattaaggtacacatttgctaagaccaataattaggttccataatgaacatactacagtaatcgttagctgtgacataaaacatgacaagatgagggtttgcttccctttctctttccctccagtttatattctctctaataaaactcttaaatcttctgtgtctgtgtatgtgtgtgttttgcacctaatatggaagactggtgtgctggcaggatggtgaggagagccaatggtctcatttaatgaaattggaagcttctctcttcttttgtttttcttctctattcctcaccatgtttcttctatacccctgtacatttcactgccaaccgacaaggcaatgagatgaaaaatacaacagagactagccagaaagagaataaggagcattgtcccaaccgtctgctgagaaagaaatgcattcttcccagctacggcattcagtcaggttagtggttgagaactgaaattatttttgctggtataatttatatattttctttatgatcctaacataaaatcagcactatggataagattgctgagacagatagctttaatatggtaagaaaaggaaaggcaagcagtgaggggtcaatcctggaaactgcaccaaggtggctggatgacacgggtacactcagctgcaggcgacctgagggagttcaggcaagcagagaacacagaaagagataatacataatcacagtttcaggggtaggaaatcttcaacaagagctaaaatgggcctagcaacaggagttagaagcatggtaaagaggaggtggagaacagagatggtgagattcaggctgccaggaagacagttttcagttgttacaggaacctgataagtgaactctggtcttacagaaaactgttaggacaaagtagaatcacagaatgagaggaacttaggtgcttgaaatcatgtcaaggcaaagtaccagagaaaaagagaaggaccaggatactggaataagtatggaataacttaagaagaactgggactcaggagtagagcaaagttttaagggcctatattatactgaattgcttttgcaaatgaaaccagagtgtggcagaggaagctatttgtctctgacctgatgcaggtctaagttagtagttggaggctaagagactcagctttaggttaatcggcaaagataaggacaggaaatctaataggttattacaaccaaaatatctttttaaaaagtgattagaattgagtttgaaataaaggtgattggatgattacctggtagcagatgtatgtttatttgtgggaggagggtgcagggcagtgcattagttcatgagagaagagactgcaacttacagtgttttggttccagaacatgctaggattttttttctctcctggtatctggaacatttggtatccaaataattttaattctgtttaacttaatagctaactttgggtttattcattcatacaacaaatatttagcattttttgttttattacatgtaactaggcaagtcctatcatctctaggaaactgggacgagtacttaaaactaaacatgttttgtttctttgctttgatgcattgtttcatatgttatcttttttttttgagtttcagataacctgaaagaaggttatgaggtttgtatgtgaaaaaataaagaataggatttttaaaagattaagaaacagccttcaattcatagtctaaatttgggtaagaaaagaaatgaaagttataaaattgacttcattccatgacttaaaatttcctttgagaagttctgcttcacttaaaaaatgagaagccttataagaatgtcactctaacccctaatgaagagagcaaagaagaacagtgacacgataactttttctgaacccctcagagaactgaagtcacaaaaaaatagatgaactgaattccaaaggggccataaacaccttcaaagagaggcagggcacacctttagcagagcaatggagaaagagatggaaaccattaaaatgggtaagaagcaaagaataaacattttaatgaaatctcaaaggtcaaatgtaggctagtgtagcagaatagaatccctaggagtactggacataaggcacaaaagcacctccaccctccacaccagataatttccacagatttccaccatgtgctcaaaagaaaagatggagggcaggcgggagaccacagaggacaggcaagatactccacatgcttgtcacacccacctctcattgaagcaaaagctatcttctgctagaggaggacaggaagcactcctgtgccctggtccaggggaaaggtctgctgctattgggggacaggtagaagcaaaaattgtctgccaatgaaagaggagcaagaaacatgcccagttcagattcctgtgctgatacagaagcagaggcggtctgctgctactggagaaggaacttaaagggaaaaattcctttgagttcaaattctccagttttggaaattttatgcaaatggactcccatgagataaaacaaacaaaaaacacaaactctctccccaccatggcaagaagcacccacaacacacacacatcaaaaaatacaaaacagagtttagctgacatgaagaggcaggaaagaaattctgagaagcccatactctgaggttcagatgcacaggcctgtctaggatcggggctttgaaaagcagcagtcacaagcctgagacacagagggagaaagtgggtaggaggagacggaggtagggagagagagagatcggtagggtgagagagagactgaaagagagatgaattgattgattttaagaaatttactgacatttttatgggaacagtcctaaatttgcagatcaggctgacggggtagaaattcagggaaaagttcatgttacagtcttcagtacaaaatctgcaggctggaaacacaggcatggtttctaattctgcagtgttgaggaagaattgctgctgctttgggaaacctcagtctttactcttaagacattcagctggttggctgaggcccacctaattatggagggtgatctgctttactcaatgtctaccaatttaaatgttaattacatctaaaaatatacctttataacaacatctagatctgtatttcaccaaacaattgggcactatagtctagacaagttaacatgtaaaattaaccatcacaatggtcagtatcagaaaggatacttcagaaaaattattaagaataatagcccaagtgaagtggctcatgcctataatcccagtactttgggaagccaaggcgggcggatcatgaggtcaggagtttgagaacagcctggccaacatagtaaaaccctgcctctactaaaaatacaaaaattacctgggcatagtggcacacgcctgtaatcccagctactcaggaggctgaggcaggagaattgcttgaacctgggaggcggaggttgcagtgagccgagatcgcaccactgcactccagcctggtgacacaatgaggctctgtctcaaaacaataataataataataataaagagggacattacatgaagataagggggttaacttttcaagagaacataacagccttaaatatatatatatatatatccatagcttctaaatacatgaagcaaaaaccaatagaactgaaaggagaaatccataaatatacaattatagtaggagactttaacaattctcacccaataatcagcagaatatataaacagacgattcaaaaaatataaaaaacctgaatagaactatcaaccaacttaacctaattagcatttatagtacactccaacctacaataacagaataaataatcaagatattctgggcaatcaagtttcaataaatttaaaaagattgaaacaactgaaacatgcatgaatatgtttgcatcctgagagcattttattaagttaaagaagacagcaacaaatggctacatactatatgatttcattaatatgacattctagaaaaggaaaatctactgggacagaaaggttgccaggagccagatttgcagggaaggtaattgactgaaaagaacacaagggaatttggggaatgatggaaatgtcctatactatgattctagggtagttacaggactgtgtgaatttgtccaaacttactaagctatacatttataaagtatgaattttgttcaggtaaattacatctcaataaatgtgatttcttaagataaattcctttgagttcaaattctccaattgtggaaattttatacaattagactcccatgagattttttaataaaacaaaaccacaatagtgggttatcaaatacccaggtggtactcagggccaaagggtatccctttgggcccctttgtatgaaagccttgtccttcctttaactaccataatggcacatgttcactaactagatcaatttttatctcaaagtaaccacaaatgaaatgttttttaaaatattagatatgttcattaatttttacttattatacgtataacaattatttataatttggttctcattacctagagcacatttgtaacttttttcaatagtagaaataaatttacatgatattgactcataattgagggctataccttattttcatcaaaaatatacttagttggactgtaggctaattggaacaaagaattaggcagctcacatactcattaaatattctattgaagattaatatgcagaaatacacacaaaatattcaagctagatagattttcatgaagtaaacctagatcaagaaacaaaacattgtcatctcctggaatccttattttgcctccttgcagtagctaccaactccccatatcaaaggttcctgctgtttttgaaactttcataaatggaatcatacagtatatacttttttgtatgtgatttttaaaatagtattttgtgtgagttacatccatatcattacatgccgttgtagtttggtcactgtcttggctgtataagaatgcttttatatgaatgactacaatcattttcccattctgttgatgaccctattgattttgttttcagtttgcactagttcacagcttatagctatgaacattcttgaatatttcttttggttaaaatgcataggcatttctgatgggcgtgcttctaagaatgtaatagctagatcgtaggacatgcacatatatttagctttactctgtaatttttttcaaataaaatttatttttctaaatatgtcatttgtaataaagtgctaaattttcggcattaaaagatgataaattattacaaacaataccactatctatctgcttgacatcttatgagatacttatgccaatatccagaacatattttatatcttggtgtgataaaaagatagcctttacacatgtctcttatgcacatgattcctaaggcatattgttttctaggcctccagtgacacataactttgacagtgcatgataacaatgctatgttcatggattaaaaatatgcataatttcatattttattccccttaggaaatgttatcactgaacttacagtgaatgtagttgtcagtattccacctgtgaagcccaatattactgtaataaatgctctagaaatatgataattgacttctctgagtgccaagaagaatcagtagtcaaactagggcctgcaagaatgagcttcccctacagcaatgtaataaaattttccagggtcttagatggagtattttcttatagagcctgatattttaaaaggcaaacttataaaacagataaaaggaattatttttgtttatttaataggtaaaattacacagtacactataataatagttatataatgttccaaaaataatttgtcagtacatataatagtttttatttatttcttgatatttaacttactactttgtacaaagcatgcatatatatatatatatgcttatatatatatacttatatatatgatatatatatatatatatcacagtcagaatggctactattaaaaagttaaaaaacagcagatgctggtgagactaacagagaaaagatgctggtgagactaacagagaaacactatatacactgttagtgggaaagtaaattagtttagccaccgtggacagaagtttggagatttctcaaataatttcaaactaccatttgatgcagtaatctcactactgggtatatgcccaaaggaaaataaactgttctacccaaaagatatatatatacttttatgtttattgcagcactatttacaataggaaagacatagaatcaacctaggtgcccatcaacagtggattgaataaagaaaatatggtacatatataccatagaatactatacagccatgaaaaagaatgaaatcgtgtcctttgcaactggaggccattattccaagtgaattaacacaggaacagaaaaccaaataccacatgttctcacttataagtggtagctgaacactgggtactcaggggcataaagatggcaacaatagactgggaactactagagatgggaaagagggaggtgggtaagtgttgaaaaactactgggtactatataggctgactacctgggtggtgtgatcagttgtaccctgatcctcagcatcacacaatatacccatgtaataaacttgtacatgttctccctgaccctaaaataaaagttgaaattattaaaaagtaaaggaactggaaggcgttaaatgctgcctaactttgtaagcttctcttgtttcttccccatccccaagcataaagaaggactctctctgcaatttccttatctaagtaaacttctttccatgagaaatgcagtcctttaaagatcccctccataggaatctcatcaaattagcaggaaagtttaatcactggaaaagagaaaactaaaagctgttaccttgcgcagtagatctttcatcagttctttactcctggatattacctggtagagtttatctcataatatgacaaccattgttcacagtaaagttccacccctcaccttcctgccacctccctgggacctcagaggaactttatctcaggtcattgttttcttggctcattcatttctcctaaaaatcatttacttcccctgtaatgtttcctgaagtctctcactttcctgtcccctatgaagagtgtatatgagcctcaaacatctggctctgccttgggtctcatatttgcaggactgccaagtccatgtatatatgaataaactttgtatgccctttttttactactcatctattgttggttcattccagtgaaccctcagagatggtgaaaaggaagcattccctttcctacaaaggcatgcataaataaacatacattatatggtttggttctgtgttcccactcaaatctcatctacaattgtaatccccatgctttaagggaggaacctagtgggaggtgattgtaccatgggggtggttttcctgctgccattctcgtgatagtgagttctcatgagatctgatggtttaaaagtggcagtttcccctgtgctctctctctcctgccaccatgtgaagaaggtgcctgcttcccctttgccttctgccatgattgtaagttttctgaagcctcccccgccatgtgaaattgtgagtcaattaaacctcttctgtttataaattacccagtctcagatagtaacttcatagcagtgtgaaacctgactaagtattaaaagtgtacattcattcatctgtatgtttactcttttaagaaatactagttatgacttttatttcagtgaagtttctcttgaaggagtggaacatttctttataaaatagagctccaaaatgtgtagagatattgaataacattgttattttattcccatgattccttatttaagcaggccctacaaagtatagtatctgaacgcccaattccaatcagagagttttgcatttcttactattttcttcaaatgatattcaagctattttatttcctggaaaatgccaacatgaaaaacgtttggaagtttgaaagacttctctgataaaattctaagctcaaaagtggcactaattactagccaacattttatgtgtccatttgttaacttgtttatttgattattatctgtcttccttttcagaaggtagatgggaactattttatgttcactcttatattctcagttaatatcacaggtgttcaattaatatttgttgtgagagtaaaggaataaatgcacattctttgaaaactttttttttttcccagaagcgtctacttctgtcacccaggctaaagtgcaatggcacaattatagctcactgcagctttgttctcctgggctcaaggaatcttcttgtctcagcctcccaagtagctgggacataggcgtgcaccaccacactcagctaaatttgtttggtcttgttgttttttgtttgattgtttgtttggttggttggttggttttttttttgagacagagtcttgccctgtcactcaggctggagtgcaatggcacaatctcggctcactgcaacctctgcctcccgggttcaaacaattctcctgtttcagtcttccatgtagctgggattacaggtgcctgccaccacacccggctaatttttctaatttttcgtgtttttttttttttttttagtagagacgggttttgccatgttggccaggatggtctcaaactcctgacctcaggtgatccacctgcctcggcctcccaaagtgctgggattacaggcgtgagccaccgttgtttttgcttttatttatttttgagataggatctcactgttttgcccaggctgaagtgcagtagcttgattacagctcattgcagcttcaacttcctgggatccagggacctcctacttccagcctcccaagcagctgagattcctggcgcatggcaccacacccagctaatttttgtattttttgcagagattgggttttgccacgttgcccataaatagatatcaatgcctgtaaatagatgtaaatttatgtttgtatttctttattgatttttggtaaccttttttttgtgtgtgggaaactctttttattttgtcgtagcttacagattcttcagtaaacttgtattctttggtgatgggctccaagtattcaaattaggactggggtgatttttggcagactgcacaggaatagatgcttaaaaagtgctttttcagtttttataagcacaaaaaaggtagaaccttgatttgctgagaatgaagtgtgaaaaactttctaagaacatcatattatttaaattattttatgtctgcatttgtttttgtctacttaatctgttagtgactgcaataaagacttctaaataaattttaaatttgctatatatattttattctatcccatcagagatatatagatttatgatttaatatcataattatgattgtatctttcattaatagtaaatgacatttgtgaccatttttatctttttaatgtaattactaattgtataaaattagtactatcaacctaactttattttgtttacttatatgtataatgcttttatttatttttgcatgtaaataattattaaatgtgtactaagtttgcccattgggcaaggatctgggcataaaatgctccaaaaatataaacaactataagaaattcctttctgaaattctcataaatatttacttatctttttttcctccttaaaattcctgtattgcagttttttaataattaaaatacagacaaattttgttctgccggctattttcttttcctcagtctgtgaattcttgtcttttataggttgattaaatcttgtaggttcattcttctgtcatattgttttctatttttatgaatttgtgaaaagtattaaatttattttctaacttgtccttataaagtgttttcttgccttttattcttctccagtaaattgacaagcttatagcctctaattcttctggcagtttacgttgacaaaatattctttaacctatgttatttcatcaaaagttgaaagcaaaatgatgcaattttaaaattttattttttcataataaacagggattaggttgttattaagttcttttttaaatttttaattgtgtgtatagtaggtatacatatttatagggtacatgggatattttgatacataaatgcataagtaataatcacatcaaagtaaatggggtatccattctttcaagccttcatcttttgtgttacaatcaatttatgtatactattttagttactttaaaaagtacaattaaattctaattgactgtagtcaccatgttgtgttatcaaatatgaaatcctattctttataactaatttttgtaaccattaaacattaacctcttcccccacaaccacactacccttcctagcatctggtaaccatttttctactatctgtctacaagagttcaattattttaacttttagctctcacaaataagtgagaatgtaagaagtttgtctatacctgtcttatttcacttaacataatgacatctgggtccatccatgttgttgcaagtgatgggatctcatttttttgtagctaaatagtactccattttttatatgtaccacattatctttatctattggtctattggtggacacttaggttgcttccaaatcttggctattgtgaacagtgctgcacaaacatgggagtgcagatattttttccatatactgctttcctttgttttgggtatatccctagtagtgggattgctggatcatatggtagttctatctttagcttttaaggaacctccaaactgttctccatagtggttgtactactttacattcccaccaacagtgtatgaggggtcccccttcttcatatccttgccaccatttgttattgtctgtctttttgatataagccattttaactggggtgaaattatatctcattgtagttttgatgtgcatttcatcgatctttttatatgccagtttgccatttgtatatcttcttttgagaaatgtctattcaaatattttgcccatttttttgagtggattattagatttttcctatagagttgtttgagctccttctgtattctggttatttatcctttatcagatacagagtttgcaaatattttctcctattctgttagttgactcttcactgtgttgattgtttcctttactgtgttgaaacctttaatttgatgtgatctgatttgtttacttttgctttgattgcctgtgcttgtggaatattactttagacatctcttttttcctttatttcttctaaaaaaatgagatacatgtacagaacgtgcaggtttgttacgtaagtacacgtgtgccatggtggtttgctgaacctattgacccgtcctctaagttccctctcctcaacccccagcccccaacaggccctggtgtgtattgttccctctctatgcccatgtgttctcaaggttcaactcccacttatgagtgagaatatgcagtgtttcgttttctgttcctgtgttagtttgctgaggatgatggcttccagcttcatccatgtccctgcaaaggacatgatctggttcctttttatggctgcatagtattccatggtgtataagtatcacatttctttatccagtctatcattgatgggaatttgggttgattccatgtctttgctattgtaagtagtgctgcaataaacgtaagtgtgcatgtgtcttatagtagaatgatttatattcctttgagtatatactcagcaatgggttgctgggtcaaatggtatttctggttctagatccttgaggaattgccatactgtcttccacaatggttgaactaatttacattcccaccaaaagtgtaaaagtgttcctatttctccacagccttgccaacatctattgtttccagacttgttaataattgccattctgactggcatgagatggtatctcagggtggttttgatttgcatttctctgatgatcagtgatgttgagttttttgttttgtttttatttgctttgttttgttttgttttttgagacagagttttgctcttgttgcccaggctggagtgcagtggcgtgatctcggctcaccacaatctctgcctcccaagttcaagcgattctcctgcctcagcctcctgagtagctgggattccaggcatgtgccaccatgcccgactaattttgtatttttagtagagatagggtttctccatgtttgtcaggctggtctcagactccagacctcaggtgatctgcccacctgggcctcccaaagtgctcagattacaggtgtgagtcaccacaccacacccggcctgttgagctttttttcatatatttcttggctgtgtaaatgtcttctttcgagaaatgtctgtttatatcatttgcctactttttgatggagttgtttggttttattttgtgtaaacatgtttaagttccttgtaaattacggatgttaggcctttgtcagataggtagattgcaaaaattttctcccattttgtaggctgcttgttcactctaatgatagtttcttttgctgtgcagaagctcttttgtttaattagatccaatttgtcaattttggcttttgttgcaattgcttttggcattttttcatgaagtctttgcccatgcctatgtcctgaatggtattgcctaggttttctactagggtttttatagttttgggttttacatataagtctttaatccatcttgagttaatttttgtatgaagtgtaaggaaggggtccagtttcagttttctgcatctggctagccagttttcccagcaccatttactgaataggagatcctttccccattgtttgtttttgtcaggtttgttgaagatcagatcattatagatgtgtggtgttatttctgaggtctctgttcagctatactacaaggctatggtactggtaccaaaatggacgtaccttagacatctttgcccaatgcaatgacctggagagcttccccaatgttttcttttagcagtttcatagtttgaggtcttaggtttaagtctttaacccatttatattgatttttatttatggcaagagatagtggcctagtttcattgttctgcatatggatattcagttttcccagcactatttatggaagagattttcctttcgcctttgtgtgttcttagcacttgttttcaaaaatgagttcactgtagatatatgtatttgtttctgcattctctattctgttccattggcctatatatctttttatgccagtaccatgctgttttggttactttaggtctgtagtatagtttgaagtcaggtaatgtgattcctctaattttgttcttttagctcagggtagtcttggctattctgggtcttttgtggctgcacataaattttagaattgctttttctttctgggaaagtcattggtattttgatagggattgtataaaatccatagatttctttgggtaatatggacactttaacaatattcttccaatctatgaatatggaatattctttcattttttgtctcctcttcagtttcttgaatcagtgttctagttttcattgtatatgtttcacttctctggttaattcttagatatttaattttatttataactattgtaaatgagattactttcttgatttttttttcaaattctatactgttggcatgtagaaatgtagaaatgctacagatttttgcctgttgattttgtttcctgcaactctactgaatgtatcagttctaatggtgttttggtggagtcttggatttctccaaatataagattatattatctgcaaacaagtataatttgaattctttctttccaattttgaagcactttatttctttatcttgtctgattgctttagctgggacttccagcactatgttgaataacagtggtggcagtgggcatctgtgtcatattctagatctttgagaaaaagctttcagttgttcctcatttagtatactactagctgtgagtctgttgtatatggctttaatatgttgaggtatgttccttctattcccagtttttttaagatttttgtcatgaagagatgttgaattttatcaaatactttttcagcatcaattgaaatgatcatatggtttttttccttcattctgttggtaaaatgcattgcatcgattgatttgcatatgttaaaccatccttgcatccttgggataaatcccacttggtcatgatgagtcatctttgtaatgtattgttgaatttggtttgctagtattttattgaggatttttgcatcagtgttcatcaggaatattagcctgtagttttctttctttctttctttcttttttttttttttttttttttgatgtgtctttgtttcgtttaggtatcatggttaacagtggactcatataatgggttcggaaaaattccctcctcccctatttcttgggatagttttagagggattggtattaggtcttctttaaatgtttggtaacattcagcagtgaagccatcagttcctggcttttctttgctgggagagtttttattatggctttgacctcattacttactattggtctgttcaggttttggatttctttatgggttaatcttggtaggttgtatgtatctaggaacttatccatttcttctaagtttttgaatgtattggcatatagttgttcatagtatcctgtaataatccttttaatttctgtggtattagttgaaataactcttttttcatccctgattttatttatttgggtcttctctcttttttcacagtctggtttaaagtttgttaacttcgtttatctttcaaaaaccaactttttgtttcattaatcttttgtatttttttcctttcaatttcatttatttcttctatgatctttattatttattttattattctaactttgggtttggtttgctcttttgtagttctttaagatacatcatgaggttgtttatgtgtagtttttcttttttgatgtaggcacttatagctataaactttcctcttagtactgttttcactatattccatacattttggtaagtttagtttcaattatcctttgtttcaagaaatttttcaatttccttcttaatcacttccttgacccactgatcattcaggagcatattgtttaatttccatgtgtttgtatagtttccaatattcttcttgttattgaattgtagttttattccattgtgttcagataagatgcttaatattatttcaactttttgaatgtcttaagacttgttttgtgacctaatatatggtctatccttgagaatgatccatatgctgatgaaagaatgtgtattctgcagctgttgcatgaaaagttctgttaatatctgttaggtccatttgttctatagtatggattatcaaatgtttctttgttgattttctgtctgggagatctctctagtgctcaaagtgaggcattgaagtctctagctatttttatattggagtctatctttttatctctaataatatttactttatatagctgggtgctttggtgttgggtgcatatatatcatcatactgaattgatccctttatcattatatgatgactttctttgtcttttcttatggtttttttatgaaatctattagtctggtttctgtcggcatggaataactttttccatccctttattttcttcttatgtgtatctttataggtaaagtgtgtttcttataggcaacagattactgggtcttattttctcatcaatttagccactctatgtcttttaattggagagtttagtccatttatatttaatgttattaatgacctactctggccattttgttttttgttgtctagttgtttcatgtttttctcttctttccttcctctcttccttttattgaaggtgattttctatggtgatttgttttaatttcttgcatcttattttttgtgtactcattgtatgtttttagatttgaggttaccatgaggcttgaaaatatctgataatctattattttaaactaatgacaacttgacactctttgcataaataaactaacaaaaagaaaacttgtataagttctacatatactatgtcttgaaaagttattgtagttattatttttgattagttcatttttctgtttttctacttaacatatgagtaatctacacaccacaattacaatgtgataatattctgtgttttcctgattctttactattaccagtgacctttgtatcttcagatgatttcttattgctcattaacacatttctttctgattgaatgactccctttagcatttcttgtaggacaggtctggtgttgaaattccagagcttttctttgtctgggaaagtctttatttttccttcatgtttggaagggcctggctatactattctaggatattttttttttccttcagcactttaaatatgtcatgccattctcttggtcagtgaggtttccactgaaaagtctgctgccagaggtattggagctccattgcatattatttgtttcttttctcttgctgcttttaggatcttctctttatccttgatctttggaagtttgactattaaatgcactgaggtagtcttctttgggttaaatctccttggtgttgtataactttcttgttcttgaatattggtatttctctctagatttgagaagttcattgttattacccttttgaataaattttctaccccgtctctctctttctctctactacctcttttttaaagccagtgacttagatttgcccttttgagcctattttctaggtcttgtaggtgtgcttattcttttttattctttcttcttttgtctcctctgactgatgttttcaaatagcctgtctttaggctcactaatgctttcttctgttttatccattctgctattaagagactctgatgcattctttcgtatgtcagttgcatttttcaactccagaatttcttcttgatttttctttattatttcaatttctttgttaaatgtatttgataggattctgaattactttctgtgttattttaaatttcttgagtttcatcacaactattttgaattctctttctgaaagaccacatatctctgtctctctgggattgttccatggtgctgtatttagttcctttggtgaggttatgtttttctggattgtcctgatgcttgtggatatacttcagtgtctgggcattgaagagttaggtatttattatcgttttcacagtctgggttggtttgtacctgtccttgttcagaaggcttttcaggtatttgaagaggctttggtgttttggtccaagtttttggtcactagagccatatctgcattagggagtacccaaagccccgtaaagctgtggttcttgaagacttgtaagggtatcaccttggtggtcttggataagattcaaaagaatgatctggattgccaggtagagactcttgttccctttgcttactttctcctgaatagagtccctctctctgtgctgagctgtccacagctggaggatgggtgacacaatcacccctgtggctaccaccactgagactgcactggcttaaacctaaagccagcatagtactggttctcacccaaggcccactgtaaccactacctggctaatgcctacattcagcaaggccctgggctctaacaatcagcagatagcaaagccagccaaattcgcatccttcccttaagagaaacaagttctcctgggctctaactgggtccagagttgctgtctgggagccagggcctagagtcagaaaccttagaaatttccctgaaaccgtaagacaaagttcttcccacttttttcttttgtgaccccagaaagatgagctggtgtcatccaccaccagctcaggcccacagggagtaccaccagggcattgccaatgtgcacataaggctcaagtgtctcatcggtaagcctgtggtgaatgctgctaggcctaggactcgctcttcagggatgtgggctccctgttgcccctggtaggcccagaaaagccatctaagagtcaaggcctgaaattaaggaccctcagagcccacttggtgcccttccccactatggccaagcaagtacctaaggtgtaagtcaaagtcccctttactcttccctctgcttttctcaaacagaaagaatctttctttctagccaccacagctgtgaatgtgctggatcacacctgaaggcagtgcatctcagaatctcacccaagtcccacagtgcatactacttaattactgctgctgaatatttagggcccagggactatttcatcagtaggtaatgaatccttcaaggaccgggtccttcccttcaaggcagcaggttcccttctggcccaagatgtatctagaaatgtcatgcaggaatgacggcctagaataagggcctcatgactttacccagtgcattatcctactgcggctgagatggtatccaagttgcaaaacaatgtcccctttactcttccttctcctctcatgaagtggaaggaaggggtctcttttggagctgtgagctgcactgtctggggttgtaggaggggtggcacaaggactctcttagccaccatggcttgtgtctttactaggtcacacgaccccaagtccactggctccattgccagcacagcactagaactttcctaggagtttcagtctttgtggcctagactgcctttcaagtttatttggaaccccagagccgtttagccctctgtagcaaggcttgccgaaactgaagttccaaccagtgggatggcaatttctctgtggctagggctggtctaaattctccctccatggacatcaactgagttcttcctggtgttggcagcactgagttccaatgcaaaatcccaccactgtgtggtccctccctaaagcacacagattctctatctgggtcactcattcactactgtgggatgggtgaggggtagtgttggcaaatcaagactgtctaccctcttcaatggtctttagtgcctctttcagtgatatgaaattaaaaacaggtactgtaatttcccacctgatttttggttcttataaaggtggtttttttgtgtagttagttgttaaatttggtgttcctgcaggaaggataattggtagaggtttctatttggccatcttgctctgcctttctccagtaagttgttcttttattagtaaattattattttcatgtaaaatgtgtaattcattgtgaaaaattatgagttaatttttgtcttctattttggttccacatttacaccaactacttgacattatcctgtattggattttgctcagtactccctgaatctcatttacttctttcgaaggcccactttcagtccttttccatcacaaatttcccaaatctgaattcttttatgattcctattttgttgactgacaaatatttttatgcatttgtctttcgggacatttgtattataagtgctgtgttttctgaggttttgaatagcttatgacctatacatatcaatgatatatggtagaataagggtctgatttataactctttctcaaaattccttagttgttgctttattttattttaatttattgttgaaaagtgaaacatgactttttttttttttttttttttttgagatggagtcttgctctgtcccccaggttggagtgcagtggcccaatctcagctcactgcaaccttagcctcctgagttcaagcgattctcctgcctcagcctcccgagtagctgggattacaagcactcaccactgcatccagctgatttttgtatttttagtagagacggggtttcaccatcttggccaggctggtctcgaactcctgacctcgtgatccacccacctcggcctcccaaagtgctgggattacaggcatgagccaccacacccggctgaaccatgactttttatctttgattgcagctgatatttctccctgccaaaatgcttttcaattcataattcaggtgtttttttttttttaacctcatattttcagaggattcctttcttacatttgtgtcaaattagatgaagtcctgttaactaacattcaaagttcttcatggttgtcgttgttgtgttggtagtttttgttttattttacattcatttgtttgcttgtttgtattcagctcaggaaaattttcttcatttgtgtcatggattttcatttgtcttcaattctgcatgttcgtttttacaaaagttataacactaaagcctgcaaatccccttcccttatctccttgaactgtctcttcatcctaggagagcttatgtatgccacatcacctgtttggtattgtaatcataaatgacatttagcattttaaaactttacaatattaattaatttaatcctcttaatcatatgttgaatatgtgatgattcttaccccattttataaacagagacataaccaggttttataatttgctcactataatgtgactagtaagagaaaacgcagtcttgctccaaaccccatgctgttgaacactgggctatattgcctctgaaaaggaaatttttgcttttaattctctttatttttttaattttttatttttttgagcactcactctgtcacccaggatggagtgcagtggcacaatcttggctcactgcaacctccttccccccgggttcaagtggttctcctgcctcagcctcgtgagtagctgggattacaggcacttgccacggcgcctggctaatttttgtatttttagtagagatggggtttcatcatcttggccaggctgatcttgaactcctgacctcgtgatccacctcccctgtcctcccaaagtgctgggattacaggcatgagccaccatgcctggcacttttaattcttgttggggctcagaacacgataccccgaagtatggcaccttggcatgctgaatactttgaactgaaggacatcagaaggctttggaatcaatgtctttctgactttctcccgtcttcctgtctctcatccctctttctcccctgaagcaagtgacaaaaacctgaattcctccttctcactatgggtcatagaaagtacagtccctctccctcaaaggaagacataaaacctagaaaggtcactctcttccttctcccttcttccttgaagacctttattccagaggagtccagccctatacctaggagagaggaatcctacacagagaggccaagaagaattggaacagacagtccttgctaggttttcccctcagtctattaccaagagatcaaactattttgtccaatcacatttttacacaactgtccattcttcatcaacctaagcttaaagatagacagttttctttgggcctttggatcttcatttctgaaggccctcacgtatgtaaatcttcgattaaataaatttgccatgcttttctcttggtcacctgacttttaagagagtcagcatgaccaagtgataggcgaggaaaggtatcaaaccattccacctctacactatctctacactatctacaatgcaaattttaattctgctatgaaatttgtatatatgtttcatataatactttttgattcaaatttcctttgaatttcagtcttcaattactgtgctgccttctctttttcatatcgctgtgttcttccttcattttaattattctttctggaaaccacacttttaatatatttttgtatcctaagcattattctaatttctataatatattctcctggctctgtcctccagatattatccttcctcgcttcaaatactgttttctttgtcttgtagactgtaaatgctattgttgcagcaggtgttttctctctgctcattttcaaatgagtagagatccaccagactgtttcctaacatatatagtgtatgaattgtattaaccctggtataaccatattttatacctacaagtggagagcagaggcatgaggcatgtgtgtgaatgtgtgtgtatgtatgtatgtatctatgtatgtgtgtgtgtatatatatatattatatatatattatatataataatatatatattatatataatatatatattatatataatatatataatatatatattatatataatatatataatatatataatatatataatatatatataatatatatattatatatatataaaatctccttgacctaacttgttcagatgtcattttatgtgctcctgttgcactgagataggatcttctacccacgtggctatttctcagaaatgtaaactgatagaccacgtaaaacaaactattttcttttttttccaacttaaatgctcttacttctatatacatctcccatgataaatgtatcacagccatttcctctgtctcttcatagtaattcagacccattagttatatggggaagaaaaggcaataccttttcctctcccatcacagggtcatggcagacactcataacaaaagacagatgatatggtttggctgtgtctgcacccaaatctcaacttgaattttatctcccagaattcccacgtgttgtggaaggggcccagggagaggaaatcgaatcgtgggggctggtccttcctgtgctattcttgtggtagtgaataagtctcatgagctctgatgggtctatcaggggtttctgcttttgcttcttccttgttttctcttgccactgccacgtagaaagtgcctttcaccttccaccatgactctgaggcctccccagccatgtgcagctgtaagtccaattaaacctctttttcttcccattctcaggtatgtccttatcagcagaattaaaacagactaatacaacagtttagcaggagaaaagcataaaaattttatttagcaaagctctacatgacatgggagccttcagaaatgaaaatatgtagacccagggaaaatggtgtgtttttatgctaagtctgatgaaaaaagtagatagttgtgaagaagtggattaaacaaagagggtatgatctaatagtattaaactaagtggagtttagcaagctcagattcttcttatcctgtgtagcatttcttcctccctggtatgggccaagacccatctggaatgaggattgtatgactcactttcaggacagatgagtaagagagtgacctttctaggttttatggcttgctttgtgggaggggagttctagtttctatgattcccctcaggagagaggaattctggggtctatgacatatcttttgggagaaaatgaagtggaaagaggtcagagaaaccttgcttcttaggccctctcaatatcatgtaccgtactttggggtatcattttctgagtcctgacatttacagaatctgaagtaatgcagaaaaaattgttatttaaataacaaaggaatcatattctgtttgccttcagaaatagtaccctttcagaggaagaaggactgatagcttttgtcatctgtttctattcttgtggggttgggcagattaaaatatcttcccagattctttcggtcctaggttcttttattgggtaacattttaggttgcaaaatatatttgaactctatcccagtttcctgatctctggttgtaggttactgttagatttacaatagaatatttgggggagtttctttttctttactttgatagacattttagtgggaaatttaggaaacccaagtccaaagaaattttatcaacacacagacacaaagcttagagattttacataacttgctgcaagtcctaatgctgaaccaagattggaatctagaaatgtctgattctagtgccaggctgtctcctctcttgtatccatgttcgttatgccatttatagcctaaatatcattttcctttttgaaaaacagagttccatgtaagttacagagaattatctttgttttataatctaatataataaatgttaaatcacaatcccacactgcgagcttgtctcataattattctttttgagtggaatagagcttcaagaattgcacaaactactcaaccattgcttttgaatctaataacacttattgtgaactttatgccctggtcacatttctctagaatccatgctaacacattatggtctccctggttggatgtcctgtgtttaatctccctccttctaaggtttcattgtgtactataatcttttttcctatttgtcaagtgattacataatgaaaataatcccaatgggagatttatgctctaaaattttaacctccataattatataataatatgtactgatttggcatgttaatattgtacattctcactggaaaaatactctccaatttggagtttatagaataacaacccataactatgtgaatagttttccagttttcatattttccaatttgtactttattttaatatcaaaaggttatgatttcttattaaaagcagagtaagaatggaagtttgggcatgtatgtgacattttgacagattccattattctgtggtttaaataaaggaaattgaacctatacccatgtttactaaattctttgaaagtaactgtttgtatatgttgataagtggtttctttatatgagacaaattcagtggaaattgagttacccagtgataacattatctgttacctgtcactaaccgtatctagaagcttgagtggacacaatcaactggtaatactaattttatctctaataaccaattcaaactaaaaacttaaggaattttcattattcgcccccccccccatttcctatgtctgagagaataaaaacagttttgtggatatcagatgttataattacttcttataattttttttcctttagaggaatatccaggaatatgttaaactaaaaggaaaagtaaattttacaaagttttaaactaaatacatgagaaatatgctttagtggaaatttttagttctattgtctaagagaggtattgacaaattttcaattaatattttttatcaaactcaactatcaaaaacattgctgttattattttgcatttgcattggttgttatgatgctttagggttactttttattagtcttttatggtggcaaacagctatccaaatgctctttataaaatttttctttgccttttagcaaccctgatttttttaatgagacctttttccaaatcttaatacttttttattttttatttttttatttttttagatagtcttgctcttgttgcccaggctggagtgcaacgatgagatcttggctcctgcaacctctgcctcccaggttcaagcaattctcctgcctcagcacccactgagtagctaggattgcaggcatgtaccaatacacctggctaatttttgtattttcagtagagatggggttttgccatgttggccaggctggtctcaaactcctgacctcaggtgatcccccggtctcagcctcccaaagtgttgggattacaggcatgagccaccaggcccagcccaaatcttagtatctttatgcctccaacagtgccttctctctctctctctctcataaaaataaaacaaaacaaacatgcattgtttctctgggtcagcttcagggacatccctgctatctttgaatttatcagagactcctcattttaattccgcctgctcttgttgccaccatcaattcttttcttttatcatcctgaagattcctagtggcttccctcttttatgaataccatattataggaatgaaccatgaaatatatttatgtatccatataatactcctgtctttctggaggatcaccatgccagataatggttcagtgatgtgctagggcactaaataggagaaaattagaatctatttactatataggccttataccaagtataaaaggaattctttttgttatgtcccaacacatgttaaaagaaacatcatttacagcctgacaacctctatgctcttcataaatgaaaattacaaatgactcccaattatgccaaatggtccttgtgctatgcaagaatcacttttaaacatgcaaaagtcacttttaactcccagaatattttatacaattttaaaatgtattctttcttacagccccggtaaaatgttgctattttgcaactaagacatcgggctattttcatagcagtttaaattaccagcattttattttgcatttttgctgaaggtaaaaaagaatattgtattaggcagaataatgcaccccagcaaatgtccatgccccaaaacccggaatccataaatatgttaccttatatagcaaaaggcacttggtagatgcgattaagttgggaatattaagataaggaggttttcctggattatctgagtaaacccaatgtaatcacaagagtccatataagagaaagagagaggtagacgagtctaggaggtgtgatggcagaagcagggccagagccagagagaaactggaagaagatgctatgccactggctttgaagatgaaggaagggaccatgagccaagaaatgtagttcagaataattaagatgccaaagaggcatattttagggtgaaatattcctgtctccaacgtcatattttggggtggtatgtcctgagcctcatcagtgttttgctgccgttcttacggttgtaagatgtggtactgcatttctaggcatcatattcatgatcagcaaaggaaaaaaaaaagaaagagacaaatgacaaaaataaaaggccaaagagttttgtccttatctctgatttctttttttttgagacagagcctcagtctgttgcccaggctgcagtgcagtggtgtaatcttgactcaccgcaacctctgcctcctgggttcaagcgattctcctgcctcagcttcccaagtagctgggattataggcatgcgccaccactcccagctatttttttgtatttttagtagagacagggtttcaccatgttggccaggctggtcctgaactcctgacctcaggtaatccatccgcctcggccttccaaagtgctgggattacaggcgtgagccactgcgctgggccatctctgactttatatgcaggaaagaatgtacttccccaaaattgtagcctatacctcattgagcagaactctgtcacatcaagagacaaagttataacagatttaaagatcttaattagcttttatttatgattctagaattgggcaatacctttttctataaaataggatgaatgttccgatgaggtgatcagaggttttatagacagagaagactgaggaaagcagaaacagagcacaagaagctgattggctgtttcaaaattactttccttgtaaaggttaaagcaaaggaaattttcttatgccagctacaacaggctcatttgggggattggctattatctctcgctttcctgattttttgaaagatcagataacccacttagttttggcttggcaacatggaacagaagcatgaataactccattgtggtttgatcagttgcacctagtgtagaagctcagtccaaaccactgccctcttataaattttatttaacagtcacgtggttaccgttaccgtcaagacaatatagaaaggtgttttagctttccaaggtttgtcatagaaaaaaataaaggaagtgagattgtagatgattggaaaagccaatcctcagagactgtgaactacacatttaaatgcatgatttctgtaagatggatttgttaactcttttgtaaatatcaccattcttcaactgtcaatactatttaaaatattgagctgctgagtgcttctatgcagacagttatagtggaggatcaccacacttattaattattaattattagttgaatcttttgctctttgtattctttgattcaaaagaaaatacttgcattgtagaattttaatgaagttattaaaaatgtattttttcctctctacatatatgagaaaacatttttttatgattttttccatctcttccaaaaataccatgttagaatcacaaataaatcctatgaaactgtctaccatatcaatagactttccttatcacaagatcttaggagtgactgatttaaaataagtgatccttattatataggctaatcaagttgcaaactttgaaaacattttgagaagtctctcacatatattatgtagccaaaaacaacaattctaaaatgacatttttttttaaattatggaatgatagttttcttaaaagtgaacatatttcacagcctggaatgtgacattattgttgtacagcagtaaagttgacatgtacagtatgcagcatgcatactaccatgtaacccattgatgaaatttcagggtttttattatgctacagtacaatcctatagtggggaattactcacattttcatgagctaccgtttaaaataactttttgaaatgagatttatgacttcctgctaacagctgtagaaaggagatgaggagggggaaataaggggaaggctcttcctattacgaaaagaagaaacattaaaaaggtaggaaaagaacatttatattggcattctctggaaagagaaagccatgtgctcagcaagctttcagcattccagctttataattactcttgaatatcctgagggcttctaaagcaggccatttctgaaaagcagatgtatactttttgccattgtttcaagtctggataatcttttcatacttggaaattaggaatgcatgttaaaatgttgataggaaataaagagaaggaatttgtatttttaatcgttgactttaataataaccatatataggccaaatctctattaacctactgaagaaaagaactgtggcaattacattgataattgagacaaaaccatccagaagacattatactgttcagttagctggataagaggcttgaaattgatgatgctttctcagaaggcactcagccactcaaaattgaatagaaactttccccctcccacaatctcagacaaactctgacattagtttcccttgctatagaaatcatttaaaaagcaaatgagaaataaacaaaatatttgttaaactttggaaaattaccttgaattttagaaagttcgatcactgctaaatagtttgggaagaaaaaaaaatcctttcaaggtagagtaaggtaaattccataactgtctacatcaacagttcaaatctggaggttgaaatgtgggagacgaccagttagagaaaagtaggaagggcttcttggaagaggtcatctttgagacaggatttctaaatctcaaaaagggctaggattggttagtgagatgggggtggcatgggtcttctggaggaacaacctgtcactaggtagtcctagtgacaatggaagcagaacaaggaagtggaaaattatagtgtgtgttagtgtccttgtttgtgaactggggagtaatgcagtttcgtggaagaatactggaaactaagaccataagctaaaataataagcattataaatgaataaagccatgctgaggcctaagcacattgtaggtctttaactatttctccacacacagcctctgctggtgtctgaaatagacttcatggctctggagaagttcatttactgtcaactaatttatttaggcatatagcatttctattcctgcaatacacacaaaggacatttgttgttattatagtgcttttttggtttttgttttttgattggtttcccttaaaaaaatgagagggggaaagaaagagtatgttcatttgtatgtcacaacccacccctaaaaaaatagtcatgagcatgagagtagtgggttggtgcaatgaacacatagaaagacttaagttggcaagatcattttttcacttggtacaaaaccagtggggcatgacataagggtagtttgtacatggtagtgccaggaaaataagggtttcatattcatgttagacccttggtctacttaattgcttttgcattttcctaatgcatcttaatgtcacttttttttccagaaaaattctctaacttagtagaatgagtaaaagaatcactttaagggaaatagagttaaaaattgaaagtcacttaactgtaacaataatttacatagcgttagcattgttcttttcatgcttataattttgacttacttgttgatgtattttaaaggtttcattatttttctggtttaagatagatttatattgttaggttaatgtagtacaattagcacctttgataattaaggacatatttgtaagtacagggaagtctttcttgtagaccaattatagctgtgtttatagtatcaaattatacatgcattattagaccttcaaaacccataataaatactgtatatcaatgttttggggcttacacctagtggcacaaatattaatataactaaaatctaagttatatgtataagaatttttttttctgaatctctacattctttaggatctacatttcccttaattgtaagaagcagaatattttaacggcaaaaatgagataggatatatctaggggttgaaatcttcctactaaatgatttttaaatttgtaactaagcatttatgttcatttccacagtcttgtgaaacaggtgtgcatcatgtaaaccttgttagggttgacaaaataggaaagcattataacacttcatatgatcaatgaattaagaattgtgtattttgaattttttttccaaaggcaaaattttctttcctgaattcacaaagcttttacaatctagatctttcacatagagaagcatctactggattagtaatacaggcaaggaactaaaaacttaagtctaataacatatcgtagcagatatattgtgcacttttatttgtatattttgaacataggttattttcttggcagtttcctcagaaaaatttggtgtttatcttctgttttattttcacggttttaacagtaagaaccaggagtagtaagaaatagaatgtgtatatgttttataaaaatttatatacatatatacaattcatatataagtagttgattctattggatataccttggcacttatataagtttactaagaagtgaatttttttaaaaaaataggaaatgattatattagatttaatttattttttgccaaactaacattttgtttgttttgttcatatcatcttaaactagttattgtggctatcagtgcattgaaaaatgaattactagtgtaatatgttcatctccttctgcatatgaattgtccttggatgtaagttttctgtatttccagagtcagctaaaagttaaaactaatttacctggaaaaactatgttttaggtgctattattatttttatcatttagagacaggatcctgctctgtcacccaggatggagtgtagtggcagcatcatagctcaatgtaacttccagctcctagactcaaacttcctcctgcctcagtctcctgagtggctaggctacaggcatatgccaccacactcagctaatattttcactttttgttttgtagaagcaaggtctcagtatgttgcccaggctggttttgaacacctatactcaaatgatcctcccactttggcttcccaaaatgctgattacactacttcccaaaaggattgcagaggtgagccaccgtgcctggcctttaggtgccattattgtagacatcttttttttttttaattatactttaagttttagggtacatgtgcacaatgtgcaggttagttacatatgtgccatgtgtaaaaagtaaaatcttaacttcttatatattttaagcaagtttattttttaaataagcagtaccagaggaatgctgatttttgtaatttaatgtttcatatagtttgagaaatggtctcatgaagccagtcatacagaaccgtacaatccacagtgactaatctatgcacttggttcatgttattcacaactttctacaatcctataaaagaagcagctaacccaaaagtacaagacacatcaggagctaccaaaaaataccaagatcaaatccagccccaagattatgaaagccatattattttagtctttcaaatgccagtgtttgtcttttttctcaagtttttctaatgcagagagtcaataaacacccttctaggccgggcgaggtggctcatgcctgtaatcccagcactttgggaggctgaagcgggtcgatcacctgaggccagaagtttgaaactggccttgccaacatggtgcaaacgcgtctctactaaaaatacaaaaattagctaggtgtggtggcgtgtgtctgtagttccagctacttgggaggctgaggcaggagaatctctagaacccaggaggcggaggttgcagtaagccgagatcatgccactgcactccagcctgggcgacagagtgagactccatctcaaaaaacaaacaaacaaaaagaaccccttcttttttggtcaagagctcactatgacctaagttaggattattgtcattatagtaatataatataaaacttataaaaattttaattatttaggaccatttgcaaaagctgtagattgtttatagttcagattggcaagtatgggtggcagtaatgttagaaataagaaagctaaaacctaaaggtcaaaaacctagttgccttctcattattgtcctcatgtcttcagattgtcagaggacagagggttagaaccaagaacactcagcttgcgtaaaggttttctacttcacttgacatttccagtaacttagcagcatgaccaatgaaacctgaagtaatgaatgggaaaagttagcggggaaggaatatccaacacaaaagttttatctcagcctaattaacattcagagatcagatggaaaagatggagtcaagaaggaggagaaaagttactgggaaaatatcataattggtaaaaagggactataattgatagaaaggaagaaaaacagtgatttcggttatctagcagactgaaggatgttaagcaaatgattagggaatttctaacaggtaacagatgattaggtcaataaattaattcatgtgtaatttgaaaaatataacatttcacataatattcataatattcaccatttttcagaaggcaaaattaaatacttcagattataaatctaacgacacagaaaagacattttatgttcttgttttttgatttacgaggacttggacttataatagtcaataaatgctaactgattattaataaggtgtagggtctaaggagcataaatttttttaaattagttttaaatattcatagttatagccagttttttactgtctttaccaatgaaaggaaacaatgtcataaagtaactatttttaatgtttttagtcattcgtctttatgtaacattactttttgaaattgatttgctttccaaattaaaggttgtcgtaggataatggtaaaattattttgcatacatagcaatacaaataaattggaaactgaggatatgatctaaaaatacactaagtggcagtgaagagtgaatctggaattcaacatttttcacaatgcatatgtaacatggtatatttggatgaaacattattcaaatgggcaatctcttctggctccattgtcttgtgactgtgattctaaatgctgtcatttctaaagtaacttaaatactttctcctgagaaaattgtcattaaaaacaagtgcatataatatctaataaaaagtttttatattattactattttgttttatatatctagtgttcttttttttttttttttgagacagagtctcgctctgttgcccaggctggagtgcagtggcacagtctcggctcactgcaacctccatctcctgggttcaaatgattctcctgcctcagcctcccgagtagctgggactgcaggcatccgctaccacgcccagctaatttttgtatttttagaggagacgaggtttcaccatgttggccaggatcgtctcggtatcttgacctcgtgatccaccctcttcggcctcccaaagtgctgggattacaggtgtgagccactgcaagcggcccttgttcttaatcgtaatgaacatgaacagtattaataagttcaaagcaatatgtacacgaagaatttcttctttcaacagcaataaatgggtaaaataagtacagaacaacttttatgatacagtgttataaaatgcatgtgtatcagttacctttcatcaccttaattctttgttaaaaacaaaaacaaaatgccataaaacctcagtggcacacaatagtaaggatttgaatgaagctcaggcatctgatacaatcagctgggccattctgctgtttgtagctgggctcaactggttggttattctcttcttaactgaactcactcagatgtgtggatcagctggtttggtttgaggtgaaaatcaggacatttttactctgctccatgtctctcaacctccatcagactgggacaggtagatatcttctcatgatgaaagtggggttggggtagcagtgggaaagggcaagcctaattatacaaatacttttcaagtctcttgagtgtgatacatttactagcatctcattggctagtgcaagtcacttatcagtcagataatttgagataaattcatgtgccttaattatttttataacttaaaacataccaacaatgatccaaaatattttttaaactactgtgatttttaagattgttgaaaattgttttgaaaattagtttcacatttatcttttagggaaaaagagtttaccattgataatccaaaaatctgataaaatcagttgaagcctgtttagaaagattgagaacttataagtacatacataagtataaattatatataatgtagtatattatatacatgtgtatgtatatatccctgctgaaattacctgccagtagtacctgaagaaactcctcttagaataagatgtattttaacatttcattgtaatggaagtagcttattttactcaccttttttgactacagtttttccgactcaattacagtgttcctgtgtggttcaaaaccaataaaaatgtcattagtaaaaccagtccatgtcataaaattgtattccatctagttaatttgacacaaaataatataattataaataaaataataatggagttatttttataggcaacattctaatacagtgagacccctttatcttatatttaaaatattagaagctataatttcatattccatgtaatatatgtcttttaatttaaatttaatttcctttgttactcactgctagactgtatctgttttctattgctgctataagaaatttgcaccaatttagtgacttaaacactaatttatcgcttcacagttatgtaggtcagaaatctgtgcaggctcaatggcttctgctgcttagaatctcagcaaaatcaaagggtcagcaggtctagtctcttatctggaggctatgaggtagagtgtgcttcccatctcgtccaggctgtgggcagacttcaggtttagtggttgtagaactgagcttcctgcttccttgctggctgtcaggtggagtacttgtcaatttccagaggacatcctgtttcatgactcttgccaacattccttcatcttcaaaataggctaggcagattaagtttcctcatgctttgagtctctctgacctaccctctgtctcatttaatttcccttgctcatagggactgctgtaattagactagacccacccctcaggataattttcctattttaagcatattcacaggttccagaggttttggcatggacattgtgttatgccattattgcactgctatgaagaaatacctgggtattttataaagaaaagaggtttaattggttcattcttctgcaggttttatgggaagcatcgtgctggcatctgttcagcttctgctgaaacctcagggagcttttaatcagggtggaaggcaaagaggggctggcatatcatatggcaaaagcaagagcaagagagaaagactgaaggagggaggtgtcacacactttgaaacaaccagatctcatgtgaactaagagggagagctcacttagcaccaaagggacggtccaagccattcctgatggacctagctccgtgatccaaacaccctacaccaggccccaccttcagtattgggattacatttcaacatgagatttgggtggggacaaatatccaaaccatttgattcttgtgcattcttatgcctacataagttaggtagtgagaggacaacaggatccaggcagagtttaaacaagcagattaaggagagagaaacactacagcaaacacggacctctccttgttactcttgcagtgagattctctctccttgataaggataacaaaatgttgtaatataaacaaatgacacacacacacacacacacacagacatataatacaaaaagtaactggaggcagtgccgtatgttatagaggaagctttgggtaattttgagaggggtatgtgctgcagacattcagcactgaaataaggcaagtaatttgagttatttattaaaggacaggtgattaagctgtgtgattgagagacttgggaatggtgcataccttttatttatttccctgaatttggtaaaactcagtgtagataataaattatgcaactgaatacctgtggagtcactcctgtttggcttgtaaaaatggaagctctacgtcttgtctggattgtagcaagttgctgtttagatgctccctctgtgctcttttcctacccacagtgagtagatgggagtcaatagattatctctttatttttgcttggtttcacgtgaattagaagaaaaaagatgtcagcagaatttaagatgcagagataactgcatggaagtaagagacatctgaagtggtgtcctactgcatcacagattatcaggactcatttcaggtctgttgcttggttttcttaatttgtcattgtttgaacccatttctggatactaagcttccttttttggatttatgtctcacagccttatatgttcattaattttcaccttggctgaattggccgcccaatccttccccttaaacatgtacttttcattccatttatccattgtagttatatctatctggttgccacccctgaattcaagttatttgtgttcatggagtaatttttaacaactttatcaaagcgtttttataatgccagtttatacccctgttcccttcgtcccatccctatatcctttctcccatctaatggaaactgatgcaagttatcgccccttgcagctcttcagcttccccttgccagcatctcaaattacatatagtgagtgccaaacccagacatttgatctattcctcttgttcacaacagtttctgcttgtggcctatgacgcaactgaaatatgataatagaaacttattcagtcttaggaatttttttagtgtagaaattgagactcagattgacatatatatataacttttgttaatttcaatatgtgcctcaaattccaaaccttatgggtttgtgttgctataaagcaatacctgagggtgggtaatttatgaagaaaaaaagatgtatttttctcacaattctggatggttggaaagttcaagattgtacatctgcatctggcgaggacctcaggctgctgtcactcttggcatagggtgacagagagccagcttatgcacagatcacacggcaggagatgaaacgagaaagagtggggaggtaccaggctctttttaagaactagcccatgcaggaactaatagagttagaactaacacatcaccgtgagaatggcaccacgacatccatgaaggatccacccccatggcccaaacacctcctacttaggccccacctcccgacaccaccaaactggggataaaatttcaacatgagatttgttggaaacaaaacatgtccaaaccatagcagtttattttgtgaaagtgctgaagtttgatgagtatacttcaatgataaaaaaattaatattggctttctaatttatttataaaatagatacaaaaaagtcattatttatatgtcattacaataatcacattggcttggtggtatctaataaattggagccacattgaagtgaattctatactatacctcagcatgtaaatttacctgaattttatgtcttcagttgtaattcttccagttatttctagactatatgtagtttatatttctagatattctcctagaaaagagatttttcatgttaaagtccttaccataaggaagtttgactgtcattccaaagaatctactctctgtcattaatataataaggagatatgaaatggaacattttacattcataacaacacaaaattcttataaattgctgaaacatgaaataaccaaataaactttattattgaaatgggtttctttagaacataaatgtgtaatgtatcttctcaaacttgttaaatcataaagaagtgcggtgatttagtaacatgaagcacagtatatataaaactatgtagcataaaatgttcagctgctaaggtagcaggaaggttccaggagatattttcataaatctggaagtagttcacctgtttcattgattgtcctcatttcatttacctaaatagtgggtcgtgattctcctgtctttggagtttacaaatttcctttagttgaatctgtgtgttttgaaatggtatttctttcacgtattagaaagttgaataactttgaagaaaatggaaatgacattgtgtggattgtcggaaaactagaaagatgtgatacctttctttataagggtcaggaccagcactactataacaaaggcatgttaataagagaaaagcaaaacaaatttgtttaatccaagttttacatgacacagaaaacttcaaaaatgaaaagctaaaatccagggaaaactgtctatgtttagatttgatgaagaatggacagtcgagtagaaatgtgattggacaaaaggctgtgctgtagtggtaataaactggaaggggaaacacagagaggcctgatggttcagattcttctggcctgcctgtatggcatttcttctttcgagtacagggcaggacctctctggaatgaaggtctttaaggaaaagaagagaaggttttatggcttgctttgtagcagatgggttctagtttctaagactcaccttcgagaagagaaattctgtttttttttttatgattttcttctgggtagaaaatgcgatgggagacaggagggcaagagaatgtgtgtcgatgaggtttggtcagtggtgacttaggaaacattattaggctgcttatttgcttatatgttgactttccataaatgatttttgagttgaatgttataaaatgtaaatctttatatttttattttcactttggattttttttctcataacataccagtctactaattttcaaggaacattcttattagtatatttaaaaggccaaaatagtattactcttatttaataattaatttaatcacagttagctaaaatttgactttatccaacctgaagacttttcctagagaagtgcttatattcataattaaactaaaattttagttcagaagtataaaatgttgctgtctaatttaagaataaaatacaagtttttagaaagttgtgtggaaagttttacattggacgagaaagaccaaagaattgatacgatgtttaaaaagatttgggttgaatctataaactaataatatgggccagcgtggtggctcacacctgtaatcccagcactttggcaggccgaggcagattatttgaggtcaggagttcgagaccagcctgaccaacatgatgaaaccccatctctactaaaatacaaaaatgaggcgtggtggcggtgggtgcctgtaatctcagctacttgagagtccgaggcaggagaatcactttaacccagtaggcggaggttgcagtgagccaagattgcgccactgcactccagcctgggtgacagagcgagactccctcttaaaataaaagtaaactgataatttggatgaatgttacaatgttctataacatgggtgaattttaatcgcagtaccattgagtatctattaggtctaagtcactacataaggcctttccctgcatttgagccagagtagatattccagtctcggctgcctcttaccttgccaatgattgggattagcactaccagccaggtggcaaggcatatacaatatgtataaggttggaagaacattgaacaagaaaagaaaactgaagctttagcttttatgactaccctctagggcattattaataagtccacaaactgtgaaaaaactgtaagaatgctccactctagtaaaaaatgaaaggacagtgctactttccagatcctaatgatgtaagtcctgctctgctttgaagaaaacctataatttcacaatatttaaaacttaaagtgctagggaagtattaagatttcatctttttcacatttacttagctgtcttctgaaaatgaataagatccactatcttattttgacagattttaaattattgtgttttgtatacacatttgttttgtgacttttattgcatttgcatttcaccttggcactttttaagtacacttaataaatatgttttaatgatgaggacaactgtgagttgacctttcctgaaggtagtggtgaaaataccaatatacaaaagcggcatctgccatgatgatgaggagccgtagtttaaatagatctgggttgctactgtactctccaagttagtgtcctagtttcttctcttgtttcttactttccattttccacagagcagctacagatatctttttaaaatatattaatcatatataattctcctacttaaaaccgtgaaatgatcttaggagaaatttagtcgtctttcttcagtctaaaagccctatatgactttggtactcgccttcctctcgctccctatccatcctcaacacagtcctccttgcttgttctcttcagtcacctcggctttccttctgtcccttgagtgcaccacctccttgcagccttagcacttttgcacttgcagtcacctgtgactgaaaccatctgcccttagaccatcctaaaggtacttcttgcttgtcattctggtctcagctaggaggtcatgttttcaatgtgggctcccctgaccacctcatcaaaaataacattctcccccaaattattatatcactttactacattttctttatagctgacttattttcttcagttattttgtgatctgttctcccctacacataagtaagtttcctgagggtgatgcctctgtattgcatgctacatcataggctataaacacatatttgctggaataataaaaaaattccatgtgaaagtactttatataaatgctaatgcacatcacgatataagatgcagttactagctaagcaacagtcagacaactcctttttatgtatttgttctggcaacctgaataaaagcatatgtaatctgtgagtgtgtattgtctttaaggacaggtaggtaagtggtcatctaatgttcacggggcacacattttgatacggatttattttccacccactgtgcatcttctgctgtggcaataattagagcctgtgaactgaagtgaaggaaacatttacaatgttgaataacctaaagggaagacaagggtatctaattagtctttcttgtgacaatctttttttggattaatattcttttcttttgaaaagtctaacagtggattcttatgtcactgactctactgataattaatagtgttcaccatacacctacacacactccctccaaaatatcctctcgtaatgccactactggaaagaacaatttcaattagaaaggagagcttttgaagtatatatcatgtggtctattataagaaatgtgtcctattataaacgaaaaaaatctctgccagaacataatattttatgtaacatgcctggtatattgtttaacaaaacattttatggatacttcattagggcatgacttgattaagaagcaggactagcattcacccacattgtcttttcttgaatctgtaagatgtgttcctgtacgattttcaccctacttataagcttattaacttaggaatgttgtgacagagcctttatttttgaatcttgtaattataattaatagtaagttaaagggaagtagaaagcttatattcaaagtttgaagtaaaatgactttgtggcacttagggcaggtgccaggaagaaattaagcaaaagcttattattcttatttattagaactttgggatgacatctttgaggatgatagtcattttatggttacaagagggagacctatttgtggacaaagcttgaggaggggtatcctgctatcttcagctccgcatgcccagggtctaaaatgagcttttcccccaagattagcaactactttgtgctagttgcatatgtgcaagtaaggataggagtgaatgtgtacatactctccactacttccctcagtgtgttcctgaaatccctatcatgaaagaaacaaccacaaaatttccttatattaacttgtgaaagtgttatttatgatggctacatttttgccagagagtgacttaacatcatataaaacacagtaatgtacgatgtttatcaaaactaagagaaaacatcgtttaattgtaaatatctacagttttaagtagggaatgtcctacccatggtctttaaaagaaaaaagtatgaatgatagatgttaactatatgaagggccaaattacaaggaagttcaataatgttgaataatagtaataatagttgacatttgtggaaagctgacaaatgttcagataattgttctaagtactttacatatatcaacttattttatactcaaatgccctgatggatcagtatttttaccctgttttcacaaataaaaaagctgggctgtacaacataatcagctagtaattaagttgtgggccattcttcaaatctaggcaggcaggccccagataccctgtctctctgtgctgtgacaatgttcactaaattttcactatgtgtctagcaccattctaagtcctgtacaagtattaactttaaaaattcccataataagcttatgtgatcaatcctacagtagtcccatttcttcaggtgaggtacctgacaaaattcttgataaggaatttatccaagaatgtctagctagctaacactggaacaagaattcaaactcacatcttacttcagagccaacacttttaaacattagtctaccccatgtcatgcaaatgtttagggatcagcaaactatggcccacaggccaaacctagcccacaaactggttttgtaactaaagttttgttggaacacatccttaatcattcgtttatgttttgtctatgtctgctttcatgctacaagagcagagctgaaaagttacaacagataacatatggcccatagcctaaattatttactctctggtccttttcagaaaacgtttgccaacctctgctttagaccatgagtgtttctttagcaattatctttgcttgatccatcccaccaccaccctgaatctagacaattttcagaaaatagcaagtgacaatagttttaactttttacacatggttagaaaatgacaaaaaagaccagttctttagaaacttcaaaatgcatctgaataagtaccctagacacacataaaacaacattctctgctcttgctttcatctaaaaaaggaaaagtcaacagaggtgttgagctaactctacttaaagatatggacttgagacagttcactcaagttcatgtattctggctttaccacttcctagctttgtgacctcgggtggatcacttaacctctatgtatcccagttcctccacctggaaaaatggggatagtggtaaacgtaactcataggagaacaggaatatctcattttatcgcatttcactttgttgcatttcatagttactactttttttttctaactgaagtgtattggttaatatgctgttataaagacatacctgagactgggaaatttatgaagaaaagagatttaattgtctcacagttctgcatggctggggagaccgcaggaaattcacaatcatggcagaaggcaccccttcacagggcatcaggagagggaatgagagcagagtggagggggaagccccatatgaaaccatcagatctcataagaactcacttactgtcatcagaacaacatgggggaaaccacccccaggattcaattttctccacctggtcctgcccttgacatgtggggattattataattcaaggtgagatttgggtgggtacacagagccaaaccatatcattttactcctggtccctcccaaatctcataacctcaaatttcaaaacacaatcatgtccttcccagtcccccaaagtctcaactcatttcatcattaactcaaaagtccaagtccaaattctcgtctgagacaagttccttctgcctatgagcctgtaaaatcaaaagcaagttagttacttcctagacacactggggatacaggcagttggtaaatatacccattccaaatgggagaaattggccaaaacaaaggggctacaggtgccagacaagtccaaaatccagtagggcagtcattaaacgttaaaattccaaaatgttctctttgactccatgtctcacatccaggtcacattgatgcaagaggtggactcccatagccttgggcagctccacccctgtggctttgcaggatacagccccctcccagctgctttcatgggtattgagtgtctgtagcttttccaggtgcacagtgcaagctgtcagtaaacctaccattctggggtctgaaggacagtggccctcttcttacagctccgttaggcaatgccccagttgggactgtttgtgggggctccaaacccacatttcccttccacactgctctagcagaggttctccatgaggaagccaccctacagcagacttctgcctggacatccaggcatgtctatacatcttcggaaaccttggcagaggttcccaaacctcaattcttgacttctgatcccccacaggcccaacacatgtaagctgccaatgtttgggccttgcaccctctgaagcaaaggcctgagctgtatgtttgcccctgttagtcattgctgggatgcagggcaccgagtcccaagactgcacaaagcagcaagtacctgggcctggctcatgaaaccattttttcattttaagttttgaggaaagaagctatctccataacataaaagtatggtgaagcaacaagtgctgaagtagaagctataacgagttatccagaagacatagctaagataatgaatgaaggtggctaaactaaaaaatcatcagcataggatgggtggctcacacctgtaatcccagcactttgggaggccaaggaggatgggtcacctaaagtcaggaattagagaccagcctggccaacatggcgaaaccctatctctatcaaaaatacaaaaactagccaggcatggtggcgggcgcctgaaatcccagctactcaggaggctgaagctggaaaattgcttgaacccgggaggcggaggttgcagtgagccgagatcactccactgaactccagcctgggtgacagagagagactgcatctcaaaaaaaattattcagcataaacagccctttattggaagaacatattatttaaaactcttaaatctagagaggtaaagtcaatgcttggcttcaacaactccacctgacaggctgactttcttgttaggggctaatgcagctggtaactttaagttgaagccaatgctcattgaccatgttgaaaatcctaggatctttaagattatgctaaatctattttgcctatgatttataaatgtaacaacaaagcctagatgacagcccatctgtttacaacatggtttaatgaatattctaagcccacctttgagacctactgttcagaaaaaaaaatgattctttacaaaatattacttcccatttaaaattcacctggtcactcaagaactgtgatgaagatgtacaaggagacaaatgttattttcatgcctgctgacagaacatcaattctgcttcccgtgggtcaatgagtaatttcaactttcaattcttattttttaaaaactatattttgtaaggctatagctgccatagacagtgattcctctgatggatctgggcaaagtaaactgaaaaccttctggaaagagactttcatgatttataggaagagatcaaaatataaacattaacagaagtttgaaagaagttgatgcaaactctcatggatgactttgagaggttcaagacttccctggaggaagtcacatcagatgtgatagaaatagcaaaagaaccataattagaagtgcatcctgaaaatgcgattcaattgctacaattttatgataaaacttgaatggataaagagttgcttcttattgatgagcaaagaaagtagtttcttgggatggaatctactcctgggtgaagatgctgtgaacattgttgaaataacaatgaaggatttaaaatatttcataaacatatttgataaagatgtttgagagggttgactccaattttgaaagaagttccactgtgggtaaaatgctatcaaacaatatcacatgccacagagaaatctttttgaaatgaaaagtacatcaatgtggcaaacttcattgttgtcttattttcagaatttgctacaaccatctagccttcaggaaccacaactctgattggtcagcagccatcaacatcaaggcaagaccctccaccagcagaaagattatgactggatgaatgttaagatcagccccattttttagcaataaagtattttttcattgtcagtttagacataatactattatatacttaatatactatagtatagggtaaacataacttttatatgtactgggaaaccaaaaagtttatatgatttgctttattgtgatattcactttgttgagattgtctgaaaccaagattgcctgatacctggagtatctccaaggtatgcctgtattatagccattgaatgaatttatgtatgcaatgttgggaagaggaactgaatcctataaagtattagttattactcctattcttcagcttcttcaaaagactgattcagaggtaaacagaatggtcgaaggtgagccctaagtataactgggtaaatttttaatgaatgaaaagcctgtggaatcaatgattattaagtattgttctacatttatttttagagacctctatgaaaataaaaaataaaaagtccgccaggtgcagtggctcacgcctgtaatcccagcactttgggaggccgaggtgggcggatcatgaggtcaaaagtttgagaccagcctgataaacatggtgaaattccatctgtactaaaaatacaaacattagccagacatggtggcacgcacctgtaatcccagctactcaagaggctaaggcaggataattgcttgaacttgggagggggaggttgtagtgagccgagatcacaccactgctctccagtctgggcaacagagcgacactccgtctcaaaaaaaaaaaaaaaaaaaaaaaaaaaaaaaaaaaaaactcaatgtcctctgacaacttgatgtataataccggacttctactattagcacaagaaaatgaattaaagatcttaaagatcttggtaagtgcagcatgtacatctgcacaaaaacttatgtagacagattgtgggagaggctctcctcccttggtttctctggcagtaccagagcatattaactgtaaagaacaggttcttctaacccctctaacactattgtgtctggtggtacccagctctgatacaatacactggcaatttctaaattggttctttacctcagggcttaataatgactaaatgacttaagcatttactgggaatgataatagttacatccaagctctgtaacaggaattattgatatttatagtacacatagaaataataaatgattgaagattcatactaagctggagtagctaaaattatgagtcttaaagccaagccatcctgggttcaaagttggcttccgttcactaccaaatgtaagcttgggcaatttatgtggtatctctactaactctgtttacaatggcataaaataataatactgatagtaccaacatcagtcactaagtcatgtatttgatgaatgtttattgaatagctactatgtgccagctactattggggttgagcatacagcaaataatacagatatgaaccccagctcttttgagctttcatttcacttgtgagaactaagcatttagtaccaggtatggggcacattaaattttcaaacaatgttaaatatcattaccattagttgatgatgatgatgatgatgatgatgacagttatgtctcattatggagttgagaataacacaatttctgtacgtgggaaatatttctggtccatagcccttaaactgcttccctcccacaggagtgatttgaactgagatttggaactcctccctgggggtctttatcgctatgtcccagtatttgctgatgcacttattccataataattcaaaaccaggtatttattaatatattatcaaagcattaaattcctttctatatatgctgaaaatatttctattcagctaaagaacattgtatgccttgctgaaatgtgtgtagaattacccacaaaagtcatttacagatatatatatatatatatatatgtgtgtgtgtgtatatctataaatagacagatatttatacatatataaatatatgtgtgtatatctatatatttatagatatatgtatatatatacagatatatctatctatatatatatatacacacatatgtgtgtgtacatgtatgtatctatgccagtgttagaaaaggaatatatggacaaatcagagtgtgattaggaggatcagttcatgtggaataggagtccaagttgtttaaggtgtcacagaggaggccacatagtggaggggatgagaagagtcagaaaaaagtacttccaaatctgattagctatcagtgggtttgtatttatatttttgccttaacttctacaaataattcctctcacaaaagtcattttggaaacttatctttcaaagttcgtaaaaacatcaatgattttagttatcttcacttaaagagggtaatttatcatctggtcaagggtgcatgtgtctgccaggaaagctgtgagccaacatacatcatactcagtagcttcaaggattcagtttgccttcttgtgtgtatttgaatacagaattcattttaatctgacattttttacctctcatcatatttttcttctaattaagttctataaatgtatcttctatccggtttgagctgtaataaattctttacttgaattggccttctgaaagtcacaaaccaacattatgatgaattgcaaaatgaataatttcccttccactgtgtttattttgagcagcaaaatgctggagaaaaatgaaacaatgtttcactagaaagaaggccatgcccatagtggttacatggctttgacctgaatgctgctaatgctgaagccagtagattcccaaaactgtgtaggtctaatttaaaaataatttttcagttgataattttagagtttaatgatattaatgtaagatataaataatgagaaatgttttgctctcatataagcctggagttagctagccatgttggtgtggactagagccatggtttctttgggaaatgtgtttcttaaaatccatattgcagaagaaaagaacaaggccatttatagaatagactaagggaaaaatgaacatgtgatcgctgttttttaaatcatcatatgtcttaccgcaccacattggcaagtaaatgtattattgtctttgaatttagatggccaaattgaaattgaacaatttgttactaatatttaggttggaattttaataggtgcttaacattggacacatctgttcccattacattgtaaggcatagatgaaactttatacaaataagattaaagcattgccatagctaaaatatcaggcattaaccttgtagacttttgattttaaaatagttgagctccagtattaaaatagccacagtgatcagagtccagttcaaataatagtgcttaatgtgttaatcattaatcttacatacttctttctcatttccctctatgcctttatagagtgggaattgccttatatcttgaattcattactgtaatttgtgtactgtgcattgactgaagccaatttaagtggtaatgtaggatagaattttagttccttcactttgtgtagatagtgggccatggagttaatgtttcatttatagtatttattacagaactatgataatgtggttatgattcatgatcttttcctggataatggctgatttaagacatattatagtttgaaaacaatgttgatgttctatagtaaccatgaccactggtccaaatatcccaacataaaaataccattggcataatttttcttcccttaaagaaaaaccataattactcttttcaaaccagaattagatatgcacaatcacctaaaccaactactttgtcttgcaaatgaggaatccgagatccagtgaagctgactagattgatggagatcagaaagctactagtgttagagctatagcagggatgcagaacctgcttcctcttattttggggccagtactctcaaaactatcctgccttgctaaaatcggataatcactgccatttcatttattcatattctgaaaacatttgctattatctccccataactcttttttctttctcctcgcgcagtgtctccatgcaaccccacaaagacatcctagtctcctgtggcgaggaccgactctggaaggtgttgggccttccaaaatgcaatgtgcttctcacgggatttggccacactgactggctttcagactgctgcttccatcccaggtcagtgcacaggacccctagaaatagcctaatctctctaggaatgtgctcctttactctgtctgctcactctgctgtctttgatgatgtttttctttctgcaacaacacaccctgcactgaatttcaaagtgtatagacaaattcccctttggttttcagtatattgacttctgattgtttttgatatttggtacatgtaaaacttagtccacatgcttatgcatttaaccaaagtaataagcttctcaggacaagcattattaaaattccttgtgctcacgagccctgacaaggcacagagatttctagtcaataatgcatgccagaatttacctttgttaatctttggagttttccttttagaattaatttatgtaccaaaaaggatcagatagctgcgatcaatttctctaaaaattcagtgacacacaagatattaaaaagaacaaagcaatactgagaacactgggccctgtaatttctgaaattcactgaacctaaattcatttgtacctaaaagaccaagggcacagaagggagatcattcttaaagacacagatggaaaactgcccatagttccttgtggcccattgctactgccaatcctgttttctgctcatcatacttcttggatctgcttcgttctaaaactctctggcctgattacttttttaacccatagttcttggtgcttttctaaaccattcttttggaaattttgttcttgggaagatttcttatgatttattttcatgttttcactaaactccttttttaaatcagtttttattttatctttgctatgaatgtctatgaaattagataaaaaaattttatttaaatttagaaatttgtaagttaatgacaagggtaaactaagtttgtttttaacttttgaaaatctttccaaaatataatttatctttagtactagatgtttgaccctactttatgaacatgcagtgtattccgtatccagtatataaattaaacagagccttgccaccctctcacctcttaggaacataaaacccatgttgcaagcagagacaatacaattagaagaatagccaatcgcttatgtagctactgggcatactaatcagattttgataatgccctgttaccatgacagccagtgactcagagattttctcattagtgtttgaccagcaatggtccttttaatagatcttcctgttttcccattcaattactgaaattaatatgaggtgagatacatcattattcactcataatatgaatttacatttagcactttcttacggcagaattgtagtaaaatactgctatactgtttgctttttttcagtgcatgagacaaatataaggggagaaaataaatataaccataagtgtttttaaatgagagatattgaatagcaaatgttctttttgtagaattaataaaaaagaaaaaatgatcattagaaacaacaacaaaaaaagctctattttggtttatttgtggtgaaacacattctgaaagagtttatatctcagaccacaaacattttataatccttgtatgcaaaccaacactaaatagcaaatgaatatgaaaaaatatatatgtacctacagatagtgttgatagattaaaagttgttggaatttatgtttcctggaatttaaatttgtaatatttgacttttgctttggcttatgtgatttggtaagaaaagatagttaattaatgaagataatatatttcctatctcatggtatacttcatctataatttaaaatcaaacctaaaataagtttgatttaaatatgatactctaatctgtagttgattttttaatgaatacagttatagtcttcagagtccagctctgggctctggttgattctgctttcttgggagaggcctagggtggacacagtatatactaacatttactgtcctcctatgctcttcacacaagacacatatactttttcttatttttttctttcctttgcttttaacatttcctttatttttaatttcagttgcttctagttgaatattttctctaactgttagctggatgtattcctgactacaatggtagctgacactgtcaggcactctatcttctgcaatgatgacatatccaaattttgtttgggggtcaattattcttgacatgattgtggtttaccttgactgaccccaatcaatcttctttgtcctatttctcgtatcatagcagacatctcaagtgcctaaataataaatacaatagacatagtaatactcatatcagacaaaagaagattaataggtaaaaaaataaactgaggggataactaacacttgagaatccagctaatatgatgtcgaaatatataaaacaaaaaatctcgtaaaacaagatgatagtaaaaaaatgtaataatcagaatcaaagacttcaaggtatctctctcaacttttaatctgtcaagtaaacaaaatttgtagtggaattagaagaattaacatggtagtataattaacagtatatatttacctctgtacaaggagagaatataaattttttgagttcatttatggttcaattttcaaaaaggcataaattctttacccaaaatctagcataaattcctcatagtataaattatacaatccataatttatgaccaagattcaatgataaaaggaagtgatatgaaattaataaccatgaatgagattaatcacaaatttttaagacacatgtaaatgaatactgagtcaaagaggaactataaactttcattacatagttggtaaacagttaacaactacaacacttacgaagtttatgagatgtatccaaagccgtattcagagtaaaattcatagctttaaattctttatcattaaataagaaaaaaagaaaataagtggattatgaattcaaattgaaaaaacaatgaaataaaaaatgcaaaagaataaatcaatgaaaattagaaattaataatgagaatagaaaaaggatgtatatttatgtatgttatatacctatgaaaacttctgaacttatatatatataaaatatataaacatttgtatataaattttttatatatttatatacatataaataatatacatatatacatgcacatatatgtgtaaattcagaatttgtctgtcctcaaggggaaaaataatgaggaggtacaatacattagatatcctggaaaactgctgaaaatatattaataagtaagaaaacagtaatatacatagcaacttggaaggagatagtactatatacacagaaacttatattatatatatatactatatatatatgtgcttaaattttttaggaaataataaatctctgtgaaagtaaacattctcaatgctaaatcaagatggaagaaaaacctggactagattaaaaactgttgaagaaactgagttttaaagttttaccttgcatgcccatctttagcagttttatgagtgagtttttagaaacttaccaaaaagaaagaaagaaagaaaaaaaagtgttagaataaaacaggtaatttttagtttcattacctagcccaaggacagaaaaaataaaagggaaattcattactggttttaaaaataaagcataaacataattttaaacctaacggatacagtactcacatggtaacagagacccatttcactattttgaatgcaaaactttaaaaaatgatatagaaaatgaaagcagttgtatgtttaaaaagagcaatataccatgaccaagtaagaattgtactaggaaagcatgaaatatataaatgatccgactatgaggacatcatataataaattatacttatagatattggaagttactttaaaaagtggcataaatctagcaactatacctgttaacacacgtttgcatatattgttaggtcccatgtgttgaaattgattaggggaatggattttggaacagctaaaactcttaataagatctgccaggtgaatgtcaaacctggatgccatgaagcttaatgagtcaaaagcagaatggtgcttacaggaaatagttcaagaggggaacataaaaccaaccaggtaaaaatgtagacaatccccaaagtcaaaacaggagcaagggtccaagctaacatctgtctatggaagcttaattacttctccagttggtgtttactctctttaaatgttgactacatattttatttttttcccttaataataatgactactttttgttgaacactaacaccgtctaacatatttataactcaaaaaatgaatgtggaaatcctttaagttttatacaaatataatgcagactatacaaacagaaggcatttaaaaattgcaagtcttcaaaatactgcattgcctcaaaataataactatacacataactgattatttctatctattgtttacagtggaattggttctgtttttatctaagtttttaatttcctcagtaggacttgtctgtccagatcttttttaaggacatggataactttcgtcacagtgtaactcatcattattacatatttaccactagattaaggtcatatattggtaagataaagcactctttgcatttacttggtagactgatggaaatgttggtagctgttgaaagtgattcatcaatcattgaaaatggtaaatgaatggatcaatgcagggaatgtgcattagcactatctttgtactactgaaagaagaaaatgtacattgccaaaaagtgggagcataaacatacccttgtgcaaggtagaggtcatacgagtggctcgttttagaatgctagcctcaccattgccagtcttttcaggtttctcttctgcaaaatagaaagaataatgatgcctactttatagtttgattgtgaagactagtgttataatatctgaaaaacacaaatacggttgctaggcacacatatgttcaataaatgttagctatcatcatatttttcattgatagaaattttgagaacttaaaaagatagctcggccgtgttcagtggctcacgcctgtaatcccagcactttgggaggccgaggcgggcggatcatgaggtcaggagatcaagaccatcctggctaacacggtgaatccccgtctccactaaaaatacaaaaaaaaatagccgggcgtggtggcgggcacctgtagtcccagctactcgggaggctgaggcaggagaatggcatgaacctgggaggtggagcgtgcagtgagctgagatcgcgccactgcactccagcttgggtgacagagcaagactctgtctcaacaaaaaaaaaaaaaaaaaaaaaaaagatagctcaaacgttgttataaaactgtcagccacacagtgggctacgaagggaagaggcaattgtgttttctggattataccaaactctgttggaaaaatgatatgcaaccatcaacattagttggtaaaatcatgtctaaaattcatacccagtaaatgattaagatagttataaactgaaaaccaaattcaattgcttcaaaatgtatgttatctaactcttctcagctcataaaatgtaaatgttactttaaaattgtgccaaactcatcctatttttttttataaaaatgagaattttttttttattttagattttagattatgttttagaaagaaaacaaacttggccagaaacatcaacagaattccattttaaaatcatctttttgatttgtttttttgcacaatataaaaaatacagtggttgaacttccttatccacaggcaggttctatttttgtcccatttagaccagctttgggcaacaaaaacacagagttacataatcaatattcaggttaataatgttatatcagtaaaactcatgctacattacttaataatatattaattggtctttacctacaccagacgactgcttcataatagtaacataattttgaatgtaaatacaatgtccagttcaccagtgcttggagttgcattttcttctgtatgaccacagcttattatgtgaaacagcatgtaactcctcacatatctctataagtgaaagcagtgggattagtggtttaaacaatttcacagtgccacattttatcctgagttccctgcctgaggcagaaatagagctgacagcatcctgttaaacagaacttctacccttaggagctgattcatgaattgtgaataaatggacctctccaaaatacctcatgttctctcttcactgtacaggctacctattcacatatttatgtagtgcctaaaaccatagtatgaaaaccccttgacgagtacattatttagatttttaaaaatatatatacatgggactgggcatggtggctcacacctgtaatcccagcactttgggaggctgaggcaggcggatcacctgaggtcaggatttcgagaccagcctgaccaacatggtgaaacctcatctctactaaaaataccaaaaattagccgggtgtagtgacaggcacctgtaatcccagctactcgggaggctgagacaggagaatcacttgaacccgggaggcggaggttgcagtgagttgagatcgcgccattgaactctagcctgggcaacaagagctaaagtccatgtcaaaaaaaaaaaatatatatatatatatgtatatatatatgtatatatatatataatatgtatacacacacacatgcaaaactttttatttggtgtaagctggaagttaagagtacaaatttcaaattatttttaataatacagatattgatatactgtctctctaaaaattatgatgtcctctttcttcctgagctgcagaagtagctgttttcataatctggaaaacatagtagacttttattaagacaattttgacatgcctctgttaagtaataatattcaactttatattctttgcagaggtgtatattatgcttctgttcttaatatagttatcacctttatgtgaaagggctaagcattaaaaataacagcatactgctttgagtagtttttttttttttttgtctaattccaaaagtaatacaggatcatcatagagaaaagtgttaaaaagaaaataaatatttctcacagtcctacaactcaatgaaaaccacattttctttgtaaaaccaaccttgcaagtattaattttagctttatacacatttacaaatgcccttataataatgtccgtacgtatagtagttacctgcttaatatttaatcaactaatgttaaggagggaaatttggaatggagaggatctttagacatatctgtattggggaaggcctggtttgaatgttgatggcagttaccttttaaacagcaactaccatatgtcaagtattgcaattgtacgtagcaattataatgctatgtatatttatgatgctgctttctcttcctcagtttatagaaatactacatcctctgtgtcgtttgtattcatagttaaattgaggccatataactgatctctggccagcgaaatgtgaatgaaagtcacattttcagctgttgcacattgaagagcaaagtttacctccttcaggctctcttcccttctcttcagaaccacatagctttatacaaagacatagctttataatggcataagactgcttgctttctgttgaaatgggattataaccaagacaaatcaagatatctttgttatattaagccttataagactggacggcttgtctattgtggcttgctagtgttaactatcctctgaatttatgtattatgtattatagataaatttatgtattatagataaataaataaatttcaaggcactgcccaagcgctttcctccacgaagtggcagaatctggttatacacaagatgcgacttttaaaatcagacttattttccagtatgggtgtggaagagtatttgctctgttattttacttaaactcccagcacctcagttgctcatttgaaaaggatggtaatatatatcaaaaggttttcatgaatgttccacgagaaaatatatataaagcattcagcacagttctgatctcagaatcagcatttggtaaaaatagcattattatggttgttgttgtttggcagaagtaggattctaacctaggtctggtttgctgtaaaactagtattgcctctaagtctattggcctgtctctctttttgtagaaagaaaataatttttaaaaaacccataggaatgctataagctctttaagggcaaggtctagatctcacccatctttgtatccctgggacacagaaggtaaactgaaacattatagagaatgagaaaatatttgttgaattagaataaacagaattgaagatgcgagaccagaaatgtagtcactttctttcatgctcccagaaggtattatgtaattttagggacatactcacaaatatacacatacacaaacacacacacataccattcattatttctgaaatcactttatcagaagaacctacaacctagtattagtcctgcattggacaaaaaatcctaaaatacaaaatcttctatgaataatattacaccaagaataaatttcagtcaaaacccaataatagaagcacttccagaatggcagaataaggacgttcaaaaatatattccttcataaaagcagagagaatatggggggagaggagggaatgttaaaatccacttttttggaacacaggaacttaaccaaaggcttacatcaactcaaggagcacttattcaagaaaaattgctgaaacttactaagaagagtgaactcttttatgttttaactttctccagtcctaaatagaaaagctggagagtgaaatgtccaaaggggatttgaagcacactgacatatttctaagactatggaaggacacatacatgcaagcggagggctgtgcacatgcataggaaagacttgagaagggtctaatctcttgcatctggttgacctcaaggacttgcacaagcaggaggtaaaggctaaggctaagttgtaaacttccagaatgttaaagatgtgtcctaacatgcacacagagacacttgccaaagattgggtgacttactggttcaaagcatttaatgaccagttgaccaatcattatttggctattaagctaatctagaagaaacttctgtgaccacaccaaacatggaatacagactttactgaattacctcaggaaattcacacacacacacacacacacacacacacacacacacacacagagagagagagagagagagcaaacagcagtaaaaacaaaccttagaaggaagcctgattttcagaaatttcaaattatttaaaatgtcaggttttaaacaatgtcaaaaaatagaaaacatgaaaaggatcaggacaaagaacaaaacttatgaatatgtcatgttatatgacaaagtgccattaaagttgcaggtgtgatggaaatctgtaatcagctgactttaagataaggagattatctttgattatctaggttgacccactgtaatcacaaagttcccttaagtgtggaagatgaaggcagaatggtcagagtaagagtgatgtgacatgaaaaagggattctcccctagagagacaagagagaaccagctcttataacaccttgacttcaatccaatgaaacttattttgtacttatggcctccagaactgtaagagagtaacttcatgttatgttatccactaagtttgtggtaatttgtcacagcacaaaaagaaaacaaatacactattcttccacaactatagttgagttttctatactaacctcctgtcaatatacaactttgatgagctcatttattaatttaaaaaattttagtatattttttagacttctctatatacaagatcatatcatctctgaagagagatcattttactttttcctttctcatctagatacctttgattgtttttttgttatcaaattgctctggctcgaacctccagtgcaatgttgaaaagaagtgacaaatgaagacatccttgtcttatttttgattttaggtaaaacgtgatcagtctttcaccgttaagtatgatgttagttgtgggatttttgtagatgcttttattaggttgaagaagtttatttctatttctagtcgaatatgttgatcatgagaggatgttggattttgttaaatgctgcttctgcatctgttgaaatgatcatttggtttttatcttttattctatcagtgtggcctattacattgatttttgtatgttgaaccaaccttgcattcctgaaataaatgctagttgcttatgatatacagtcatttatatatgttgctggatttggtgtattagtattttcttgatgacatttttatctgtattaataagagacatgggtgatgcctttttcaggttttggtattagaacaatactggcctcacagaataagttaggcagtgttccctcctgtcctattttttggaagaatttgtgaagtagtagtgttaattcttcttaaatatttgggaaaattcatcagtgaagccatctggtcttgggcttttctttgtggaaaggttttgattactgattcaagtacaagaatttgtctactctatccaggttatctaatttgctgccatttttttctcatatttgttgccatgttgttaacaatttcccttataaatcctttataattctgtaaatctggtaatgatgcctttatataattattgattttaataatttgagtcctctctatttttttgttgctcagtagagctaaagtcaattttgttgctcttttcaaaaaatcaacttttattgttgaattttctatatatttttaaattcttttatttatttacattcaatattattttcttctgcttgatttggatttatttttctcttctttttctacttgcttaagatagaaggtttggttatgatttgagatatttgttctttttaaatgtaccatttacatctgtgaattttctttcaagcaatgctagaattatcctataagttttcatatgttgtgtttttgttttcattcatatcaaaatattttcagatttcccttataatttcttttttggccgattggctattttaaagtgtgctgttccatttccatatatatgtcatgtgctgcttaatggtgaggatacatttgataaatgcatcattaggcaatttcatcactatgcaaacattggagcgtgtacttacacaaacctagatggtatagcctactgctcttccaggctatataccatagactatacagactatagcatattgccattgctattgctcctatataacaaacttatatagttactgtactgaataccatatacaattgtaatataacaatattttatatagaaacacagaaagatatagtaaaaatacagtataaaagataaaaagtggtatacttgtttagggcatttaccatgaatggagctttcaggaatggaagctgctctgggtaagtcagtgagtgagtggtgagtgaatgagaaggcctaggacattactctacactactgtagactataaacactgtacacttaggctatactgaatttgttttaaaatcatttttcttcaataataaatcaaccttagcttacgtaaccttttactttataaactatttaattttttaactttttgattattttgttaacagtttgaaacacaaactgtacagctgtacaaaaatattttgtgctttttctataaatttttctctattttttattttcaaactttttgttaaacacaaagacacacacattagcctaggcctacacagggtcaggatcattaatatcactttggcccacttccacattttgtcccactggaagttcttcaggggcataataatatgtaatatacccttaaacaactagcagtgcagtagatttgtttacaataacatcaccacaaacacatgagtaatgtgtagccatatggcattatgaaggttatcatgtcactaggccataggaatttttcagctccattataatcttatgaaaccatatcatatatgcagtccatcactgactgcaatgactttatatggcacatgactgtgccttattccattggccaaagctcagagggagggattgtggggactatgaagctacagggttaagggcttggatgcaggaagaagtggagaattaggaccatttttgaactctgtcatttatatgcatgggatgaccatacatctaggtttgcccagaaaagtcccagtttattcctgtcatccttatagaaatattattttttaagaaagagaatcttgctctgttgccctggttggagtgcagtggtgcatcatagctcactgcagcctagaactcctgggctgaagcaattttcctgccttactctccatacgacctgggactacaggcacatactaccacatcaaactaattttttttttttttgagacagggtctcactttattgcccacgctggtctcaaactcctggcctcatgggatcctcccactttgaatcacccccttgttactctaaaaagtgtcccaattttaatgataaattatatgggaactctacatttggagggttttaaatagaatggatgcactcattgaaaaaatctgtgaagtaagcagaagaattaagataagtttagagtccatcaaagaggttccaggaagcaagagatgagccaaaacagaatgggtctgaagaagcgaaaagggatacatgaaagagggctaaatgagaaggtcaacagcatcaaggcatagactatcaaatgaatgtgtctgttgtgtttgtcaactagaaagttttttactgactatgatgagaggcttcataggagtggttgcagtgaattaaagagtcaactaattcttgctctcacactgatttaaaaataaaactttaatttcactcttttgggtcttacatttaaaacaaaagggaccagactctgcggaattgagatcctctgagtgttaacattttcaggatctgaatactaaatacagatgccagactaaaaccaaatgtgtaagaaccaagacctgtagcttacatttattctctatccatcatttttgacactaaataaaaatgatctggtgtgtattcattgggaattattctgattttattttattacggctgtaaattcattttccttcacgtatttgatgtctttgattgatgcaaaactcaataagacttactgtagttacattaaatattaaccagaacattattttgaaacatttgggaagctgtgacatctcaacctgatccaaaaccttagtatatatattaaacacagcaactaaaagacttgccaagatatgtttgacaattgtcctaactttgatgaagaaaataagaaaataccagtttccccagtagagagtttactgtgaaaagcattgcagatttgacattgcgtgaaagtttccaactataagcaaatgcagacttaatggcagtaaatgacattaaattttttaaatgacaaaacctgcatttgaaatgtaggtacataacttttagttatttgaaacttcaaggatagctaattggctaatacataaggggacagaaaatctgactagtattaactttgaaccaaaaaaaaaaaaaaaagaagaagaaaagaaaagaaaaagaatctttgtgtagttgaatccttatcttggctgttacttacacattgcaaacctattttgtatgagtgcacatcaaattccctttgggattctcaatttcatttattttatcaataaaaagagcctccttgtggagaaaggaataagtcacatataaatgaagtagaagagattacaccagtacctgagcttttactttgactaatccaatagctttggccaaatatctcaatgtcaaaagcattataagtattctacgacgtaagtctggaaaagagaaattaataagaaagtattggattgattaaaatgtttacttttcccctccatccttccccttctcaagcttaatggctctttctcataccaatctgatctttgttatggttattggctggccttgtttcttgttataactccacatctagaactcatttctgcatcatatacttttctgtctctccataatttcagtattagggtcctcgctcagatgcatgtcctttgtcactgaacttgacgacaggctttaaagagattttacaagtcccatttacacaaattatttattttggtcttcaacaatgttaaaatgcatgatgtaatttttatagaagagaaaacatgcttagcaagataattctgccaaagatttctctgcttaactatatagttaagtcttttcaactattttgctcatcaaagatcttgtacatcatagaagattctagaaaagtgaccttgatatttatcttgcacctcagtgcctttaacatgtactttttctgcttagaatataccccaaactcttttcttcatcctttttaatgtgtcttcagggctgagctttcaaatccacttattaaggatatctttccccaacccttaaattattatttaagataatttcccagataagtttttctgtttatatgtctttatcagaattatgatacatgggtttttttgtttgtttttatttttgagacaaggtctcactttgctgtgtagtcaggagtgtggtggtgtgatcttggctcactacagcctcaacctcccaacatcaagtgattcttccacctcagctccccaaaaagctgggaccacagtcacacgctaccacacccaactaattaaaaaatcatattttttgttgagatgagatctcactatattgtgcaagctaatcccaaactcttgagttcaagtgatcctgctgtcttagcctcccaaaattctgggattataggcatgtgccaccactcccatccacataaggcattttttatgaatgcctgtgttctctactgggttgtgaacttagggagaggatgaggataccataatatccacttatgtatttccaacaccttatggcactgaaaaactattgtcatctgactaatggtctagttgccattttagggcctcatgatctcatttatgaatcatgacacaaactgccttattttccatgtgccaatctcaattccatattgtccaggcctgactgatttgtgatcttaaaacatggattttatcatgttacattctgcaaccacactgtcactatctgttatttatggaaagacaaaagtgatactcagtgtatcattcatgaccctccatagattgacctagatcaaatttctgaccttgtcataccctcttctctccaacacaagcactttgtctttgccatagtagctgatagaatggattcagaatacttcttcctgttcatctttattttgactttctacttgtgttcttactcattttgaattctctctaccttcttactagtttatattattgatataataatttcttttcatttgggtagatacctagtagtgagattgccggattgaatggcagttctatttttagttctctgagaaatcatcatattgttttccaaagaggttggactaatttacattcccaccaatagtgtataagcatttcttttccttcttatcattgccaatatttattttttgacttttaaataacagaccttctaactagtttaagatgctttctccttgtgtttttaacttgtatttgtcaatatgctttttggccacttgtctgtcttcttttggaaaatatctattcattttctttgcccactttttattggggctattgggaatttttgttattgcggagttttttgagttccttgtaaattctggatatcattaccctgtcagatacatagtttgcaaatattttctcccatcctgcaggttgcctgtatactctgttgattatttatgtttctgtgcagaagcttttcagtttaattaagtctatttgtctagtttggtttttgttgcttgtgcttctgaggtcttagtcataaattctttgcctaaaccaccatccagaagagttttctctgttttcatcattttaatagtttcgagtgttacatttaaattcttaatccatcttaagttgatttttgtatatggtgggagataggggtccagctttattcttctgcatatagcaatccagttttcccagcaccatttttgaaaagggtgccctttccccagtgcatgtttttgacaacaactttgtcaaagatcaggtggatgtggatgtgtgatttaatttctgggttctctattctgttctgtcaatctgttgtctattttgataccagtacaatgctgttttggttgctgtagctttgtagtataatttgaggtcaggtaatgtgatgcctccaaatttgttctttttgcttaggattgctttgtctatttgagctctttttttgattccatatgaattttaggatttttttttctaattctgtgaaaaatgacattggtattttgatagagattgcacttaaactgtagattgctttggatagtatagtcattgatattcattcttccaattcatgcgcatgagatggttttccatttgcccgtgttatctataatttctttcatcggtgttttgtagttttctttgtagagatgttttacctccttggttaaatatatccatgggggtgtgtgtgtgtatatacatatacacacacacacacatatttgtagctattgtaaatgagattgctttcttgatttaattctcagcttgatgattatcagtatatagaaatgctactgatttatttttaatttcagcttttattttatacatagggagtacatgtgcaaggttattgcatgggttcattgtaactaggttgtgagtgtagtacagaacaggttgtttttcaaaccatgaccttctccctccctccccctccttgtagtctgccatgtctattgttcccatttttatagcagagtgtgctcaatctttagttcctacttataagtgagaatgtgtggtatttggttttccattcttgcattggttcactttggattatgacctccagcttcatgcatatagttgcaaagaacatgatttcattcctttatatggctgtgtagtattccatagtgtgtgtgtaccatgttttatttatccaatccaccgttggtgggcatctaggttgattccttttctttgctattgtgaaaagtgcagcaatgaacatatgagtgcatctgtctttttggtataatgatctcttttcctttgggtatatacccagtaataagatagctaggtcaaatggtagctctgttttaagtttttgagaaatctccaaactgatttctacagtggctgaactaatttatattcccacagtgtataagcattcccttttctccacaacctagcaatagctgttatttttttacttttagtaatagccattctgaatggtatgaaatagtatttaattgtagttttaatttgtatttctctgatgattagtgatgatgagcattttttcatgtgtattggctccttgtatgtcctcttttgagaagtgtctgttcatggcctttgcccactttttaatgaggttacctgttatttgcttgttgatttgtttaagttccttgtagattctgtatattaaacttttgccagatgcattgtttgagaatattttctcccatttctgcagattgcctgtttactctgttgatactttcttttgctgtgcagatctttagtttaattaggtctcacttgtcaatttctgtgtttattgcaattgtttttggcaacttagccaaaaattatttgccaaagctgatgtcaagaatggtatttcctaggttttcttctaggatttttatagtttgaggtcttaacatttaattctttaacacattttgagttaatttttatatatgatgaaaggtaagggtccagtttcattcttgtgcatataactagccagctattgcagcaccatttattacatagagagtcctttccccatcgcatatttttgtcagctttgttgaaaatcagatggcagtaggtgtgtgactttatttctgggttctctattttgatgcattagtctatgtctctttttgtagcagtgccatgccatttggttactgtagctgttcagtatagtttgaagtcagataatgtgatgcctcaggctttgctcttctttgtttgaatgacctgttaaggctcttttttggttccgcatgaatttttgaatagttttttcctaattctgtgaagaatgatgtttgtagtttgataggaatggcattgaatctgtaaattgctttgggcagtatggtcattttaatgatattgactctcccaatccatgagcatggaatgttactttgtgttgtctgtgatttgtttcagcattgttttgtagttctctttatagagatatctcatctccttggttagctgtattttcctaagtatttcattttctttgtggctattgtaaatgagattgtgttcctgatttgactctcagcttgcacattattggtgtataggaatgctactgatttttacatattgattttgtattctaaaaccttactaaagttgttttatctatcagttctagcagccttttgacagtcttcagattttcctatatgtaggatcatatagtcagtgaagagagatactttgacttcttctttttctctttggatgctatatgtgtctgtttttatactgctataaagaactgcctgagactgggtaatttataaaggaaagagatttaattgactcacagttcagcatggctggggaggcctcaggaaacttacaatcgtggcagaaggtgaagaggggaacaaggcaccttctccacaaggcggcaggaaggagaagtgccaaggcagggggaacaaccccttataaaaccatcagatctcttgtgagaactcaccatcccaagaacaacatgggagaaactgcccccatgattcaattatctccacctgatctcttccttgacacatggggattatggggattacaatttaagatgtgatttgggtggagacacaaagcctaactatatcagatgccttttatttctttctcttgcctgttttcagtactatgttgaataggagtgatgagcataggcatacttgtcatattccagttctcaagggcaatggatccattttttgtctattcagtatgaggttggctgttggttcatcatagatgattcattattttgaggtatgttcctttgatgccttgtcttttgagagtttttattataaagggatgttggattttatcaaaagctttttatgaatccattgaggtgattgtgtgatttttattttaattctgtttatgtgttaaattatatttattgatttgcacatgttgaatcagccttgcattacaggaataaagcctactacatcatggtttgttaatgttttgatgtgctgctggattcagtttgctagtattttgttgggaatttttgtgtctatattcatcagggatactgacccaaagatcctttttttatttttgtttctctgccatgttttcatattaggctaatgctagcttcatggaatgagttagggagcagcacctggtcctcaatttttggaatagtacctgttcttctttctatatctgttagaattcagctgtaaatataacttatccatggctttttgggtttttttctgtattcaatttcagattttgatatttacctattcaggattttaatctgttcctggttcaatcttgggagattatttggttctagtaagatatatttcctctaaattttctaatttgtggaacagaattactcacagtattttctgaggatcttttgtatttctgtgggatcagttgtaatctcatatttgttatacctgattgtactgatttgtatcttctctttttttgttaatctagctagtggtctattcatctaattttttcaaagaacaaacttttggtttcattggtcttttgtttgcatttttgctttgcaatattatccagttcttctctaattttaattgtttcttttcttctgctagctttgtggttggttgtttctttgtttttgtttttctttttgtttttgtttttttgagacggagtctcgctcctcttctcccaggctggagtgcagtggcgcgatctcggctcactgcaagctccgcctcccaggccattctcctcctcagcctcccgagtagctgggactacaggcacccaccaccacacccggctaatttttttgtatttttagtagagacggggtttcaccgtgttagccagttcctttaggtgcaaaggtagattgttaatttgagatctctctaacttcttgatcaaggtgtttagcaatataaactctcctcttaacagactgcattagttacatcccagagattttggtatttgtttgcctattttaattaatttcaatacttttttatttttgccttaatttcagtgtccacccaggagttattgaggaccaagttgttaaatttccatatatttgtgtagttttaagagatctttttgatattgatttctatttttattgctctgttgtctgagagtgtgcttgactcccagatgattttaatctttttttaattgagacttgcttcatgaccaattatgtggttgatcttagagtatattccatgtgcagatgaaaaagaatgtgtatgttgtggttgttcggtagaatgttcagtagatgtttattaggtccatttgcttaagtgtcaagtttaaggccagagttcctttgttagtattctgccttgatgatctctctaatgcagtcagtacagttttgaagtctcccactattatagtgtggttgtctagaccttttgatatgccaagaagaacttgttttatgaatctggatgctccagtgttgggtgcatatatatttggggtaggcaagtctgcttgttggattgcaccctttatcattatgtaatgccttccattgcccttttaaatttttattggcttaaagtctattttatcaggtatgagaatagtgactcctgtacttttatgctttctgtttttatagtagatctttctctgtccatttactttgagcctgagtccttacatgtgtgatatatctcttgaagacagcagatggttgggtcttctctttttatccagcccaccactctctgccttttaagtggggtgtttagcccatttacattcgggattagtatggatatgtgagatttttattctgtcatcatgttgttagctggttgtcatgtagatttttattgtgtgattgtttcctagtgcctatgggctatgtgcctaagtgtgtttttgtggtagcaggtgtcattcttttgattccacatttagctttcccttaagaacctcttacaaggctgatgtagttgaaatgaatccctcagagtttgcttgtctgagaaagattttatttctccttcccttatgaagattagtttggtggaatataaaattcttggttggaatgtctttcctttaaggatgctaaaaattgtcccagaatctcttcttgcttttatggtttctgctgataggtctggtgctagtttcttccatatgtgatttgacccttctctctagctgcctttaagatgtttttctttttcattgaccttgatgaacctgatggctatatcttagtgatggttgtcttgtgtagtatctacgctgttctccatatttcttgggtttgcatgtcaacctctttagtgaaattagggagattttcatggactgtatactcaaatataatttccaagttgtttattctctctccttctctctcaggaatgccaatgagttatagactctgtctcattatataaacccatatttctcagaggttttgttcatgttttaaaattgtttatttttatcttactgtgttgatttgaaaaactgatctttgagctctgagcttctttccttagcttggtctaatcttctgttagtacttccaattgtattatgaaattcttgtagagaatttttcagctttagaagttcagtttggttatttcttaaaatggctatttcatctatcatttcttggatcattttactggattccttggattgagttttacctttctcttgaatatcaatgaccttccttgccatccagattctgaattccttgtttgtcacttcagtcatttccaactggttaagaatcattgctggggaggaactggtagactcctttggaggtaaggagaccctctgtctttatgaattaccagagttcttgtgctgatttttgtacccttaactgtagtttaaatatagtcagttggtttcatttctggatgtttttagacagccaatatgctctctgtagggtctttatctgtggctgatttcttgcctttgtttcacagaagggtatattagcaaagtatttttggtgttgtagtttgggctttcatccagaagatagcatttattagtaatgaccagtagatatggttatactcaactgcatggctcctttatatttcctagtatttgtagccatgaactatagtgtgttgggaagagagttcacctcctcaccaggtccattcttgggcctttgaggagcctctgctactgatttgtgcacattgattttgtttccttaaactttactgaatttatttatcatatctactagtttatcagttacaaaaattaattagttacagttggtgttcttttccgtgagacttttctttcatttataactggttttcatttcctttctaatttaaaggagcatatttaacattccatcttaaggcaatgtgatagccatgaggtctttgtgtgataatggtaaaaaggaagttaatctataatggaagtcaacagtagataaggaaggagtattccttggtacccttccatcatttacaacgtttcacaaaacaattcaggtaagaaaaatggcttaatctatgagataaaccttacagtatccatagttacacatacctgtcatgtgattcagaccctgtaattcacattcccttgacgctcaaaataattcagagatccaacagctgagattctgaattacatatttttacaggattatagttttacatgacctggaagtcttcagaatgaagaccaaaatatacaggagaaactctatttttatgcttagcttcaataaattatagacagccatgtaaaaatatgattggataaaaagggtatgatctagtgctaattttctaagtagggaaacccagcaaagcatgcctgttttggtttttcgtgacctctctgtgcagcatttcccctttctgggtatggtagaagattctgtcaggattggaatcttatgacctacagtcaaacaaggtaggtcagataatttctctgtggccaatttttacacagaaaggctaggagaaaattagagtaatatttttaggttttgtggttggcttttgagaaaagacgttctggtttctatgtcctgcctccatggggaacggatattcagaaactagaatccctttggcctgggcaggaggagagtggtggcgggtagaatgagcagctagagaaagaggggcattaagcaggaataggtcagagaggactattgattctgaggctgtatttgaggactgcattttaaggtgtcactttctgatccccaacactggccttgttgaaaaaacaaccacagcaacagtagcagcagcagcagcaaaaacatgagaataaaatccacccaaacaaatgatgaattgagatgcagtgacgaaaggattggtgtaatgcttaatgccaaaaaatatgagaggagtgccaacaaacttctgaggggaaacaagcaactatcacagcaacaagtagatctcaaatgtattagaacttgagggcatatgacttataaaccgtttatgaaaaaaaaaacttggaaatcaaatttttccaaccaaaaaaaatgaatcaaaataacacaggtgaaagaaactgtggataaaggactcatgaagatgactaaaaccatttaaaattagaacaatggacactatgctggtatatatcataacagttggagagaaatattaaaattatcaaaatctggtaaggagtagaagtttaacaattctgatttttatgtgctttcagagctgggagttggaagaaatgttataaaagtgaaatataagattttttttctatttttaaaactttaaaattttgttaatattttagacctacataagagttgtaaatatagtacagagagttctgatattgtcttcagtctgtcttaccctaatgttgacatattacataaccacaatacaattaacagaataagaaattaacactggcatcatacttttaactaaactatagacttcaatcagagttctccagtttttccattcatgttgtttctctgttcctgaatcctatcaagcatctattgttgcatttaatagtcatgtttctttcatctccaatctgtgacagttcctccattgttttttcgttttgttttgttttgtttttgacaatgttgacatttttgtagactactggttatgtatttcgtaaaatgactctcatatcgtattcgtctgatgttttctcctgattaaaattagagatttctgagatgaataacataaagatgatgtgtcttcaatacatcctatcaggtgatgaaacatgtaatttaaaaaatattaactactaaatgttttcataatttaaaactggaggggaagaaaaatgcacttgttcaaaactttctgcagtttaatttaccttttttcaggtgaattcagatcatagtaatttttagcaaaatattgtaaaataatatagagtatgactaattttaataaaaatttttaaaattatatatatatgttttctatgtatatatctacatctatttccagctgccaacatgtaaagaaacaattctaagatccattttaggaaatattgattatagatattaacggatggtagagtttgttatgtattattaaattgtactttatcttttccactttttctatttaggttgttgcaaaggtaattgcgacagttacttttgcaccaacctaatatgtacttttctgttctgatttattttaatttgcttttagaaagatagagttattgtttaaacaaaaattcaatgtttttgagcatatattatttattttgcatttttatttagtttgtatttctttcagaaacacaattctggaaagatacaacagtgtttaccttgaaggagcaagaactgtggatgctttgaatagacttatgttttcttatttgtgatgtgaacttttctacaagggaattatattacctttcaaataagctacatatgttactgtttcataatttctttatttttccatggaaattatttaacattttattttctgacaaagctcctgtttataagttatattttctgacaaagctcctgtttataagttagagcattcagagatttacttagaactatcctcagcttggccacttctatatggttttgagaaaagttaggtacattattatctcttaaaaaacttaaattagaccacaagctagttttgaaataactcaactgaggttattctttgatgactgacagtacaagagaattgtcatacactcagttattagttctttagacaaataaatatttaataaataaatatgttatatattatacatattaataggacaatgtaagtacacatgaaagttggtggtggaaaaattgccattgttactaatgctgtctcatgtctaataatgatagagctggaaaacagatgtttttctaaggcaaagaatttactcctaaccttttcttttatattgacatcatattgccattgtatgtcaggtaactgagtggaaagagagaatagagctgagggcacatacaattcatttagaattattctagtgagatgctcattagactagaaaataaaaacatatttggaggaaaacatttcttccctcactcctacaagggataaaaatgctaatatagttctcaatgcacagaacgtaatcaaatctacttcatagaactgatatactactggtatgaatgacctgtgatgatatactgaatttttgctttaatatttgttcttttcattgtttactagttttaaaacaccataaaatatttattaaaaaacctttaagggatttttttaaaggccatattgtaaatgtctttgcattaaacatttcataaggtatatttccaaatcttaaacaactttgctgtttgagtacaatatcagtaaatggcactttaagaagatagaaagccatctgcatccaaaatataaattaaaattatatgtaaaataaatcattttaactttagatagaaagtaacaacttaaatcaccttctatatagtgtataaatatatcatctaaaagatacctaaattttgatgtaaaaatgttctcaatatattttaccaggctgagaaaatcttacaagaattatctaggtatgtaatcattatattaaaatgccaaagacatattagacttgtggttatatttccttgggcaacaaaatagattttttttttaaatctatgtgtcttttaaggtaggggaaatagtaatgctgacaacaaagttttctcactaaatatatctgttcttctttgttaatatttacagtcaaagggggctgttctctggccaacctgcacccaggtgaaataaacagccttgttgctcacacacacacacacaaaatatatatatacatatacatatacacacacacatatatacatatacatatatacacacatatatatacatatacatatatatacacatatatatacatatgcatatatatatacatatatatatacatattttttaaccgcccacctatgtaaagtactctaccacatctgacaagttgagaaaaatgatgacatcaaatgttgcctatgggaagcctctaatcaactaaatatctcgacttcaacactcaaatatactgctacagcattgtaaagtgttttgtaccctctgaatataatactgtaaaatgttctacattattatttgaagaaaattgttgaggaataattttacagtgtgtaaggtggtagatgcagatgaaataattataatatgaaaatattgagatcataaagtaatttcccttgtagttacctttatgaaagttgtacgattgagtttaatttcaataaagcaacatcagccataatttagtgtcctttaagtgaattaagcaatttcaagccttataaacatgttcaagttcagtgagaaggacactttttagaaaatttctaagctaatgactttagtggcattggtaaatatccagagactgtgtgaggaaaacacccgaatatagaactgtaaaatctaaatagagaaaccattgtgttaaatctgaaaacatattagtaagtgacattttcctttaagtaatcttattgtatttttcgtgacattcaattatttatttgcaccaagaaatattgttcaggacttgaagactgagtaaatgtgcgtgagctacacaaaatatattttgttattagtaaatcatctattataaaactgagaagtctcaaaagtaggtaatgggaaaaaagtgtttccattgtttgctttcttatttcaaatatctttatgaaaaattcagcattttaataataaagagcaataattaaagatgactgttatttattattttggtagacagaaaggatggtttcatttatatttgttcaattattttctttaactcttattctatatataggccagttgtattttttgttttgttaattagctgcctattaagttttcttgcataattatattcagtttgtatgaactagttataaatcaaatatatttctttttatttataaaatagcagggtgttgctttgctcatctatcttttcattagttaaattttgatgtgttaaagtttggcatttgatgtagtttaattgacatcattttgaggaggtggggaatgaagagatttttctctatgagcatacagcttagaaagtcatcattccaacttaacacttgattaatattcaatcacttttttaatgttattttaaaatcatgttttctttgaagactttctgaactttgaaatacaatttttaatttagaaatcattggtatttttctttttgttttaatttttacactttattaaacatcattttataaacacagaatatacattaaaaagcataataacaattttactatggttatttctgtcattaatgggtcgctattaagagtttcaggtagtgctaatataattacaattcttaagtcaattgatggacactttgaatagagatttaaatgaagaagtttatcattggcatgcatgctgtatagtcccaaatatctcaatcctattatattaaggatgagtattatattggagtaatattttatggctttcaaaatatgttttaaattgttacttttagagataccaaccataatacctaatacctaagtaggcagagctgtagatacaatcattctgaggtgatctgaccctacactgacaataacagttgtcagtagagatcattgaaattcatatttttctactttagatgaaatgtattttgaatgtcttagctggtattcaaagaaaaaagaaaagatgattaaaagcaatacaatcataggaggcttccagttccaaaattgtgatgtagatggaacctggcttcacttcccctaacagaaagccgaaaacaaatatacaatgccaagattatcaccagaaatatcccagaactcaaataaggaaatgagaattcctggggccacaaagaagtgtaatattaataactctaaggagatggtaagataataggacttccacatctgcaatatctgtcccctcattctgcctgcctccaggtgaagagaaaaatttttcccaattcactgtttctgcactggcaaaactgagatcaagatggacaaccatcttccccatcatattgggtagcctggcaggagacatgtttctgtttttactcacagaaagcattacaagtacttaaagggataaatatcactgagaatagccagtgacaaaggatggaggtagaattatcatccccagacctggaaaatgtaatctgtaatttggagatgtaatttgccaaaggagatgccaaatcagaatgactgtatagcagcaccacacgaaaggaggttcatctaataggtccctagaacacaaaaccctagacagccttcctccctgccaggacatcccctttaggaccttctccacttgggaaaggcagcactttgagcttttactagagccaaggcaaacctgggctgaaggctaccacccagagctgaaaaggaggtgatgacctagcagtaaaaatctgtgaggaaatgtatccaataaaaatcaaaacaagcaagacagagaagactgaaataaatacctaatctttcaatgcaaagacacacatatgtgtctacaagaaataatagcaaacaggaaaccatgatttccccaaacataaaaaacaaggaattaataagtgactccaatgagatggcaatatgtgagctctctgacaaagaattcaaaatggtagttttaagaaagctcagtgatctgcaagataacacagaaaagaaattcagaaatatatcagaaaaatttaataaagagattaaaataattaaaaatcacacagaaatcgtagagctgagaaatacataagctgaagtaaaaaattcatcgaagactctcgatagcagaatgaccacgcagatgaaagagtcagtggactcaaacacagcctacttaaaaatatacagaggagaaaaaagtctaaagaccaaaaaagatcacctaaaagatatagaagagtacctcagaagactaaatttaagaattattagtgttcatgagaaagttgaacaatagcaagtggcagaaagcttactaaaacaaaccagcatatttttccaaacttgtgtggagaaaacacatgcatgtaagttacatccaagcacacataggcgaacaacatcatacagatttgacaaacaagactacccaagacctatgataatcaaactctcaaaagtcaaggaccaagagtgaatcccaaaaacagaaaaagaaaagaaggaaaataaaaaggagttccagttcacctggaaacagacatctcaacagaaaccatacaagccaggaaagagtagaatgacatttctactaaagtgctgaaagaaaaagaaaatcaccatacaagaatactgtattcaacaaagctgtccttcagctatgaaacagaaaaattctttcccagacaaacaagagcttaaaagagttgatcaccaccagatatgtcttacaaaaaataccaaagagagttcttccatctgaaagaaaaaaaaatgtgaaggaaacaaacaaaaacatctgaaggtataaaacccactgttataattaagtgcatggccaaacccagaatactgtaatgccgtaattgtggtgtgcaattcactcataactctagtatgaagcccaaaagacagttctatcaaaaacaataatagttacaggaacctgttaagagatatgtaatataaaatatgtaaactaacacaacaaagagccaaaatgtatgtgtgtgttgtggggatggagttaaaatgcagatttttcctgttttttttctttgtttccattttttctttgtgatctaagataacttgtcatatctgtaaaataactttattatatctataagatatttttgtaagactcatggtgaccacatacaaaagcctataatagataaagtaaaaataaaaagcaacaaattaaaccatactagcagagaaaatcaaaatcttttaactacaaaagaatacaacaagaaagaaaggaagagatgaattacaaacaactaaaaaacaagcaacgaaatggcagtagtaagtccttatttacagtaataacactgaatgtaaatgaacttaattatccaattaaaaggcatagaatagctgaatgagtaaagaaacaagactttatgctgcctacaagaaacttcatctgtgaagacatatatagcctgaaagtgaaaagattggaaaatgatattctatgcaactgaaaactaaaaaagagcagaagtagctatacttatatcagataaaataaactacagattaaaggctataaaggaggccaaaagtgcccactgtataatattagtgaacagggtcacaaaaattctcaagaaaatattagaaaacttttgtcaagaacacattaaaaagatcattcactatatttaagtgggattcatctcaggagtgcaaggatggttcagcatacacaaatcaataaatatgtacatcatattaacataacccagaacaaaaaccatatgattattttaataggtgcccataaaagcacttgataaaatttaaatcactttataatgaaaaccctcatcaaaatggatgtagaaggaacatgcctcaaaataataaaggctgcatatgacaagcccatagctaacactttactgaatgggggaaaattgaagacctttcctctagatttggagaaaaagacaaggatgcccacttaccactttaccactcttattcaaaacagtactggaaaccctggccagagcaattaggtaagaaaaggaaatttaaaagtatccaaattggaatggaataagtcaaattagccttgttcacagaagacaagattctatacttagaaaaacctaaagacggcctggcgcagtggctcacacctgtaatcccagcattttgggaggctgaggcaggaagatcacgaggtcaggagattgagaccatcctggctaacatggtgaaaccacatctctactaaaaatacaaaaaattagccaggcttggtggcatgtgcctgtagtcccagatacttgggaggctgaggcaggaaaatcactgaacctaggaggcagaagttgcagtgagctgagatcgtgccattgcactccagcgtggcaacagaacaaggctccatctcaaaaaaaaaaaaaaaaaaaaaaaaaaaaaaaactgaaagactctaccaaaaaacagtaagaattgataaatgaattcagtaaagttacaggccacaaaatcaacatacaaaaatcaatagtatttatatacactgacagtgaagaatctaaaaaagaaatcaagaattcaattccattaacaatagctacaataatataaaatacttagcaatcagtttaaccaaataagttaaatgtctgtacaaagacaactataaagcattaatgaaagaaatcaaagaggacagaaacaaatgaaaagatatttcatgctcacggattggaagaattaatacttttaaaatgacaatactacccaaagtgatctacagattcaatgcaatccctatcaaaataccaatgccattttcacagaaatagaaaaagcaatcataaaattcctatggaactaaaaaaggccctgaatagccaaagcaatcctgagcaaaaagaacagagctggagtcacactacctgacttcaaaatttattacaaagacatagtaaccaaattattgtggtaaaaatagactcataaaccaatggaacagaatagaagacccagatataaatccgtgcatttgcatccaactcatctttggctaaggtgctaagaacataatggggaaaggatattctacatatgttctcactcatgtggaagctatatttaataaatggtactgggaaaactatataattatgtagaagaataaaactggatccccatcttttaccacacacaaaaataaaaatggactaaagacttaaatctcagacctgaaactatgaaactgctagaagaaagcattgggtaagcaccccaggacattggtctggacaaagattttgtgtttcatactgtaaaagcacaggcaactaaagcaaaaaataaaaaataaaaaaaaatgaaaagaaaaaccaggattatatcaaggtaaaatcttctgcacaataaatggaattatcaacaaagtgaagagacaacccatagaatggaagaaaatatttgcaaattatccatctgatggaattaataaccagaatatataaggagctcaaacaactcaatagcaaatgaataaattgtccagtaaaatggcaaacagacctgaatagacgtttatcaaaagaagacatacatatggccaaaaggtatatgaaaaaaatactcatcactaatcatcagagaaacacaaatcaaaactataatatatcaatcctgcacctgctaaaatggcttttattaaaaggacattataaaaaagacagatgctggtgatgatgcagagaaaagggaactttcttatactgttggtgggaatgtaaatttgcatagctactatggagaacagcatggagatacctaaaaaaaaatagaactacatatgatccagcaattccactactgggtatataatcaaaagaaaggaaatcagtatatcgaagagacattacactctcatgtttactgcaacactattcacagtagccaaaatgtggaagcaacctaagtgtccatcaatggttaaatggataaaatgtgatatatacacacacacacgcacacacacacacacacacacacatagatatgtacatatatatgatattctattatgtgtgtgtttatatatacaattcaccatatatacatatatatgatagaatatcatttagctataccaaaatgaaattctgtcatttgcagcaacatggatggaactggtggctcattatgttaagtgaaataagcctggtacatgttctcacatgttctcactgtcttatgttaaagccaaacacatgttcttactcatatggaagctaaaaaagtgaatctcataattaaagggagtagattggtcattaccagagagtggtgagaaggggaggggtaaagggaggatgaagagaagttgattaatgggtacaaatacatagtttgatagaagtaataagacctagtgatagatagacttgtacagtgactatattgtacaacaatctattgtatatttcaaaatagctagaagagaagaatttgaatagttccagcagaaagacaagacaaatattaggtgatggatatcctaagtacactgatttgatctttaccaattatatgagtgtattaaattattatttgtaccctgaaactatgtacatatgttatgcatcaataaaaggtaataccatcatgtataatttgatgtattgaacagaaaatcaacattgatgcatctttggctatgacttacaagtatgagtttattttggaatatcaataccccttcaaccttcaataagtatattataataattctataatgagatactagtctttatgctgcttattgtgcagactgggtttcttcatgtttttctttgaatgttgcaatatattttaaacttcattactttcttgacactttatgattttgtatctatgactttattgttttcttggatatattttaaaatgtgttttttctttatgtttctacatccacccatatgcatttccttatggtttcatctttaagctatcttattttctagagattgtaccctcctcatctgcctatattggtctcagggcatttcttgtgcatagctcgagtgggtagcatccccagtcactgagctcatcacacgcggtgctaatctataccttcagatgatgtgcatctaatttctaattccagcttctgctatagctaactgttccatagccagtaatttagtccttacttagagtgattgcccagtggggttcacatttattctgctcataaaatcccatcttttctgcaagaaaggactgacttcctggaagatgaaaacaatagcaatcatcctcctataaaaaggatttcctatctttgggttacttcttttgtaaaatttcttcaaagcattgggctccaggcaagtgacaatttttaaaaaactattatatgaagatggacaaattttatctcttagtacccacaactgtgttgtaggttatattttggcaaacggccttagtttgatctaccctatagaatcacagtaaggagatctcattttttccttttattgatgagaatactgaaaaactaagtgtgtttcacaaacaacagaaaggtccagaaagactatgtatgtttcagaaacaaagcttttaaatggcaaagatgtgataagaacatgaacgttctgatttttcctgatgttctaatttatcttatttccagaacaactaagagccattgggcacttgatttgtatacctaaaatatcttatttacttaatcttgtaaaactttgggtaaggaattcacacagaaaactaaatgcttacctgagggttatcaattccttggtgaatagtacagtcctggtgaagtatatctgatctatagagacatgtgaaattcagatgaaaactgtgatcttttctggagtttattagaaacgtgatggagaatctgctggggtcatgactgttgctcccccactgaatttatggtggaacagatggttctcccagaaagaccaacaaagttttaatgattataaaatctttgtcagaaaattcacggacttggttatgcatgcattgttatcactgcttctttcttttatttatactttaaggatgaagagcctgatttacacagctggattttaaacatggtttaaatgaataaatttggatttctgaaaagtgacttaataaactgaaatactcagttggattcttgagtaggaatacagtatagctcaaaatattagagacggtcttacttgtcctgaaataaactgatcttatcaatagaaattcaacctgaatgtgagtctggttattaggaaaatagtatctctcatggaaaggaaaatagcaatttggaaatgaaacatgagaggtaattagtcaaaggataagaaagagtatctgttgccgcagggaatgaaaactaagtaaagtgaatctcatatttcagtgtgtgaaaatacatatgatcatatattttcttaccaagacttgaagggataggataccagattagaatagaataatggaaatatatgccttattcaatataaataggccagttgtgagttaggatagtgtggatgtgagctgcttagaacttggtgtacttgtaaagtggaaatggcctgaagaataatatttgggtgataaaggagatgaacggagtgtctttgtaggacatgatagctttcctcctgtactctaaaggctactgagtgaaagaggaattatttgaattctgaataatgccaaggatgatatcccttatatagaagaaaaacatatcaataaaaggaagactttctaacagagctacttgcaaccaaatgaactgtgttccctcttactagaagttttatatagagactgcatgataaaattataaaatcaatagaatattagtagaaaaaattaaaatgagagatccgtgattagattaaatggatttaaagcctcttccaggcttgggattctagaattctgtgatacatgacacatgaattcagtttcaccatgctagatttaaatgttttcaaattgtcactataatattctataatatgaccattgatggaaaacaaccacgtttatatgagaaacagaggcactattgcttccagaaccatagagctatcctgctcttcctcatcctagggccttcaaatagtgtggctttgtcaggtgtgcaataactgaaaaaatctgagccttaatattgaatgcttcttctcaaatatgcaataaagaggtttttttctatttttaccttccaaatgttatctagagaataattatttaaaaaatattgacctgagttttacttagaaccttcacaagtttgtgaaaaacaattctcttcactatccttgtcttgatgcagctttgtacaactcttagtaccaaagcagagattgcgaagaaagtattgcattccatatttagtcagagactacagatgatgacaaatatattctgcctttgttgacctagaatgcatcaacaaatcaatcctccttagacttgaactcagcatcacactcacatattttggttaccatgtattcctaaaatgcagaaatgggtacactgacaaattttgcaattcaagatttttaccagttcagctcagaggtcaaaagaagacagagaagcagatgcatcacaggggggatttttcactgcaagaatggcgtgtctccatttgttacaagttagacttggaaaaatcctttagttaaatgaaaaagacaaatgtgagacagactgcctcgagaatcatttaccaatatctcggaacgactgtgattatacaaaacaccgatattaaaataattaagttcaaaaactaagtgcaaggttgtaagataaattgttagcaattctttaacataatttctgtcctctccctgcaacaaaccgggtcttcatcatgcccctggagttattctaaaattaatacacgattatttttctaactccgcttaaaattctttcatctctcctcttggcctacagattaaaacttctcaggactgcctttcctaagcccttttattatttgactattgcttatctatttagactaattgttctgttactcttctcttcctgaatgcaaattacttaaaaatttctgaatgtaatgtccacatcctggacattcatcatttttcctctcctatttttacattgtgaacacctactcatatgtatagattttgttcagatgtgttcatcattttaaaggccatagccttcataaccaccttttaggcctagagaattgattacattctgctctgtcccataactatatcctgtgttttcatatattaaaatacacatgaaaatattacaattaattcattctaaggcagagtttattcaatcatctgtatatttctagaacattgtacaacttctaaattttaaatattttgtatcattcattttccaaagaaatttagaaggcttgatagcatgtatgttttttaaagaaataattgctgtagaggataacataggacatgtaaaataagataaagctaggagtcagattaatatttaaaatgcatgtaatatgccttaaatattttctactttatggatattcattaattaataaaagccaagagttttctaaattaccagaggagggcttcagtttgggcctaagtatcgtagcagcctacaaaaagaaggaggcttagtcagctatgtgattttcattgtcattgaaagaaatggtctcagactgtcagcagctaaataattatttttgctagtaaggcctgaacgcatttcaccctggtccattttaagagtagatgatactcttatttaaaacctattgagcaatagcctcaacaacaacctttcagtaatgcccataagaccatgtcttataacttttgttattgtagtgaaaaggaataataccactggtaattcagtaaaagtaattctatgctggtgaaggtgaggaggaaaaaatgatctctgaatgtactgccttctaattctcaatatttagtccaaagaaaacatgtaaacttgtacaggaatgtatgtatttttatatttgtcccacttattgtagtgaatattaaggaatggaataaattcataaattaaaaaatacaataatctatagcacagcatctattggaagatacatacccaagcagcagacaagaagttgagttgtagaattttctcagttgtataagcagactcagtgatgtgcagggccaaggttgagtgtaaagaatgcctggagtatatggttaaaaaatcattctgaatagagtggctttcttgtcctatagaaccatgtgaacacagggtgagaaacagacaaggggtttgtaaatggagagctcttgcctctggagctatcacaagctctggatcctggtctgaatgaaaatgaggcatctcctagagtctcgtgaaaaacaggtataacagctgggttttcatatttaggcccagagatctggtaatttaagactttgcaagaggataagattgaagctttcaataaaaaatatttttctgtaagaactggattcaggcagaaaatggagcctaagttaaaggcatttattttctgtggatataccaaagaataaagaagtaggtaaagcagaggcccacaaaactgtgggagcttgaggaaagcaaataaacaagaaaaatcagtaaaatacatagtacatttatgtattagtctgttttcacactgctgataaagacatacctgagactgggaagaaaaagaggtttaattggacttacagttccacatggctgaggaggcctcagaatcatggtgggtgctgaaaggcacttcttacttagcagtggcaagagaaaatgaggaaggtgccaaagcagaaacccctaataaaaccatcagatctcatgagacttattcactaccattagaacagtatgggggaaccacccccatgatgcaaattatctcccaccaggtctctcctagaacatgtgggaattatgggagtacaattcaagatgagatttgggtggggacacacagccaaaccatatcactctacccctggctcctccaaatctcacgtcctcacatttcaaaaccaatcatgccttctcaacagtcccccaaagtcttaactcatctcagcattaacccaaaagtccacagtccaaagtctcatctgagacaagcaaagtcccttctgcctatgagcctgtaaaatcaaaagcaagctacttcttagatacagtgggggtacaggtattggctaaatactgctgttccaaatgggagaaattcgtcaaaacaaagtggttattgggcccatgccagtctgaattccagtgaggaagtcaaattttaaaatgtcaagatgatctcctttgactccaagtctcacattcaggtcatgctgatataagaggtgggttcccatggtcttgggcagctccacccctgtggctttgcagggtacagcctccctcctggctgctttcacaggctagcattgagtatctatggtttttccaggggcacagtgcaagctgtcagtggatctaccatgctggggtctggaggacggtggccctcctctcacaactccactaggcagtgcccccgtagggactctgcatgggggctcagaccccacatttcccttctgcactgccctagtagaggttttccatgggcatcccacccctgcagcaaacttctgcctggacatccaggtgtttctatacatcttctgaaatctaggcagaggttcccaaactccaattcttgatttcccttcactcacagctcaacaccacatggaaactgccaaggcttggagcttgcaccctctgcaagccatggcccaagctctacgttggcccctttcatccgcagctggaacagctgggatgcagggcaccgagtccctagactgcaaacagcatggggaccctggccctggtccacgaaaccattttctcctaggcctctgggtctgtgatgggaggggctgccatgaaaacctctgacatgccctggacatattgtcctcattgtcttggggattaattccgctccttgttacttatgcaaatctctgcagctggcttgactctctccccagaaaatggatttttcttttctatcacattgtcattttttgaacgtttatgctctgcttcccttataaaactgaatgttttttaacagcacccaagtcacctgctgaatgtttcgctgcttagaaatttcttgctccatatactctaaatcatctctctcaagttcaaagttccacacatctctagggcaggggcaaagtgtctttgctaaaacataatagcctctttgctaaaacataacaagagtcacctttgttccagttccccacaagttcctcatctccacctgagaccacctcagcctgaaccttattgtccatatcactatcaggcttttggtcaaagccattcaagtctctgggaagttctaaattttcccacatgttcctgtcttcatcttagccctccaaactgttccaacctctgcctgttacccagttccaaagtcggttccacatttttggttaccttgtcagcaacgtcccactctactgataccaatttactgtatcagtctgttttaaagctactgataaagacatactggagactgggaagaaaaagaggtttaattggacttacatagttccacatggctggggaggcctcagaatcatggcaagaggagaggggaacttcttacatagtggcagcaagagaaaatgaggaagatgcaaaagcggaaacccataatgagaccatcagatatcaagagacttattcactaccattagaatagtatgggggaaaccatccccatgatgcaaattatctcccacttggtccctcccacaacatgtgggaattatggaagtacaattcaagatgagatttgggtggggacacagagccaaaccatatcaattaataaggataaattttgcaaaaaaaaaaaaaaaaaaaaacaaagtaggtaaagggcatagtgttagggatgagactggaatttagataggcctctcttctctgatgtgtctttctgtaaaggtctaaatgaagggaaggggccttgtcattggttttctgggaaagaacatttcaggaagaaagatagcaagagcaagtccttatgtggctagagtagaaggaaatgagatgagtagaaggagaagaagtcagagtggtaactcggtgggtggtaggcagattgggcagtgctttatttcgttgttagggtcttgttgttagggtttttaggtcttactgtgagaaatgagaaaccattggagagttttgagcagacaagtggcataaaaaggattcttcaggtttctgtattgaaaatagattatagaaagcaaaagcattagaatgaagaccagtctggaagctacttgtacaattcagatttaatgcttggaatttggtccactaacatgattttgtgaaatatcctattgtgatgatcaaaagactcgatggatttgacatttcactggtaaaagaagataagacatatgatttttacagtttattttatgggagcaaattgtttattcattaaattcatttatgtcatgcatctatccaaaaaaaaattatgtggttggggatatgctatttctcaaggttatgtgataatatcttccagcatagtcagatattttatacgtataataactcgggcaaaattcaaaagcaaatagtttaccatgttatgaaataaagcttctgtaagaaaatattcaaattaaatgtccagtggcaaatggcacatacaatccactggcatacatctttcttaatatttataaaacttgaagaagtgtttgaattatctacttaaaacaggattttagggaattcaatattgtgtttcattcatcaaatcattgattcaacagctgtttattgggagtctctgtgtgcaaagcagcatgctaggctttggggaaatagcagcaaatttaaaaatttcctgccccctatgtattacattctattggcagggagagagacaataaataagtgctatataattccttagatggtagtaagtactatgaagaaaaataaagcagggaaggatggcagggagagggcaaatgttgggaagataaattttaaaggggttataagcgatgcccaccctccaagataaggtgaagttagagaaaatgtcttcactgaagtcatgggcaagccatgggaatatcctagtagcagaggcagagaatgtgcctagatgttctgaaggaagcatgcttggtgtgtttgagaaacacaggaagatgctgggttgagttgtctagcacattgtaatcaactttgagatgaataaataaatttcctgtcttgaaatatcttagcacctacgctaaattccaaatatcttaccagcaacagacaggaaggtcttatgtgctttggcctctcatacttcagagacctttatttttaaccttccccactctatgtcccacccccacctccctgccacattcacccttagctccttgagcaagtcatgtccacctcagcagcctttctatgcaccaataatgaaccagctggaaaagaaatcacgaaagcaatcgcatatacaatagaaacaaaataataaataaatggataagatacctaagaataaccaatgaggtaaaaaatttttacaatagaaacctcaaaacactgatgaaagaaattgaacaggacacaaaaaatggaaagacatctcatgctcatggatgggaagaattaatattgttaaaatggccgtaatacccaaagtgacctacagatttaatgcagtctctatcaaaataccaattacattattcacagaaatagaaaaaataatcctaaaattgcagagaacacaaaagagcctaaatagccaaaataattctgaccaaaaagaacaaagctgaaggcatcatactacctgactgcaaaatatactacaaagctatagtaacaatgacagcttgatattggtataaaaccagacacattagaaaaatgaaacagcttagagagcctggaaattaatccacatatttacagccaactgattttcaacaaaggcacccagaacatacaatagggaaagggcatcctcttcaataaacagtgctgggcaaataatatccatttgtgaagaataaaactagacttctatctcaccacatataaaaatcaactcaaaatggattaaaggcttaaatataagacttaaatctataaaactactagaagaaacataagagaaatgcttcaggacattattctagacaaagattttgtgggtaagacttaaaaagcgcagatgacaataacaaaagtagacagatgggtctatatcaaactaaaaagctttggcacagcaaaggaaacaatcaacagaatgaagagataacctgttgaatggaagaaaatattttcaaactattcattcaacaatggactgatatctggaacatacaagggattcaaaggactcaacagcaaaaacaacggcaatgacaaaacctacaagcaatcccattaaaaagtgggcaaagatataaatagacatattttaaaagaagatgtacaaatggcctgatagcatatgaaaagattctcaacatcactaatcctcagggaaatgcaaatcaaaactacaaagagatattgtctcaccctagttagaatggctattatcaaagagaacaaaataaaaatgctggtgagaatgcagagaaaaggaaatttatacatgatcaatgtgaatgtaaattagtacagccattttggaaaacagcgtggaggtttctcaaaaaaaaaaaaatctaaaaatagaactgccatataactcagcaatcccactactggttatttattcaaaggaagtaaaagcagtatatcaaagtgataactgtactcctatgtttaatgcatcactattcacaataaatcaacctaaatgtccatcaatagatgaatggataaagaaaatgtatatatacacaatggaatactattcagccataaaaaagaatgaaatcctattattcacagcaacatgtatgagcctggaggacgttatgtaaagtgaaataaataagtcaggcacagaaagacaaatggtgcacattctctctcatgtgggagctaaaaaaacgttgagcacatagaaatagggagcagaattatggttattacaggctgagaaggggagggagaggatagaaagaaatggtacaaattacagctagaagaggaataagttcttgtgctccatagcactgcagaatgaatataattaacaataatttgctgtaagtttcaaaaatctagaagataggattttgaatattcccaacacaaagaaatgataaatgcttgacgtggtgaatatgctaattaccctgatttgctcacttactgtatacttatatattgcagtatcactctgtagcacataaatatgtacaattattatgaatcaactaaagataaaagagaaaataattcagttgaagatgagtaagcaactgacccaggtgaccatggagctctacacaatgcatccatccaagaagaggtaatagttctggcacaaggcatgggagaccttagtctggaggttcactctttttctgtgctgttctgcacatcattctccttttgaactccacctgccctgtttggggcatttaaaggagacatctagagtccctctgcaagaaaactcattgcaaagttattacaaatattcttagagctttcttggccatcgtgcaaatatttttcaggtttgtgtgtttctctatttctttcttgggttcagtctccctctgtgatctcactgaacttctttaaactactcaggcagtggctattctttccttaacgctgaaatctacctctctcattcgacgagaattcataatacctatatatagtgctgtcctctcagctccttttgtttgtgattcttggttgattctagattgctaaacaaaggaagagtatagtattttggagtgaaggcaggaacacttggatatagtcactgattacttcaggaaaccaaccaagatcattctttttttttgtctttttttttcctttttttaattattattatactttaagttttagggtacatgtgcacaatgtgcaggttagttacatatgtatacatgtgccatgctggtgtgctgcacccattaactcatcatttagcattaggtatatctcctaatgctatccctccctcctcccccccaccacacaacagtccccagagtgtgatgttccccttcctatgtccatgtgttctcattgttcaattcccatctatgagtgagaacatgcggtgtttgtttttttatccaaaatcaatgtacaaaaatcacaagcattcttatacaccaaaaacagacaaacagagagccaaatcatgagtgaactcacattcacaattgcttcaaagagaataaaatacttaggaatccaacttacaagggaagtgaaggacctcttcaaggacaactacaaaccactgctcaatgaaataaaagaggatacaaagaaatggaagaacattccatgctcatgggtaggaagaatcaatatcgtgaaaatggccatactgcccaaggtaatttatagattcaatgccatcccatcaagctaccaatgactttcttcacagaattggaaaaaactactttaaagttcatatggagccaaaaaagagcccgcatcgccaagtcaatcctaagccaaaagaataaagctggaggcatcacgctacctgacttcaaactatactacaaggctacagtaaccaaaacagcatggtactggtatcaaaacagagacatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagttgaaactggatcccttccttacaccttatacaaaaattaattcaagatggattaaagacttaaacgttagaccaagatcattcttgatgtgggcttgtacttactttactttgtgcgagtgccctcactttctaccctcaaaccctcatacagccagaagtgctgtatcaaggctaagggtttaaagaaacttgcatgaaaacaggccttttatttcaactcataaagattggagggttttcacaaactgtacattaaaggtatctcaaatatgccttaatatttttatgtaatctaaattctaagtgtttttctaatataataattttatgactcagtgaaaccaaaatcataccttttacttatacaaatacaatgcaagaagatatttgagcttaattttattagattttggttgtatgtaattctgctgcatgaaattaatacatacatattctatggtaacagaacattgtgactaatagcctttttatgaattcaaatagttctattgaatagatagacacaggtcaatgagactacaatataacgatagtaatttattttattccactagttacggaaatagtgataaactattctacataagaacttatattctgacttctcttcagatcatataaatctattactttttactgaagattttctaggagaggaacaactcatttcagcaaacaaaacaaaacaaaagtcttaactagagataacaagagaatttttacaaaataatcccaaatttgaaaggtggaaataattaaaaatttgcttttgtaagaattcttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgctaccacgcccggctaattttttgtagttttagtagagacagggtttcaccgtgttagccagaatggtctcgatctcctgacctcgtgatccgcccgcctcggcctcccaaagtgctgggattacaggcgtgagccaccacgcccggccaagaattcttttactagatctacaaaacaatcattaaaagtatatcaaccagaatttattatccatatttccaaataaagacagtaagtttcagagatggtaaatgtaaatattaaataaactgtccaagatcatgtggggacatttatgcagagccagaatgagaagccaaccaagtcttcttgcttctacactttccacttcctacttagtgatgtaagaactattgagtcctcctgttccaccccctctcataaaaacacttcagtacatttctttaaaaaaaaagtgattaccatcaatctggcacctgtaatatatttgattttcaaaactaaagtcattttcaatagaaacaagtttttgttttgttttgtttgagacagagtctcactctgcccaggctggaatgcagtggcacgatcacagctcactgcaacttccacctcccgggctcaagtaatcctcccaccttggcctcccagtagctatgactacaggcacacaccacttcactaggctaatttttgtattttttctagagacgaggtttcacagtgttgcccaggatagtcttgaactcctgagctcaagcaatctccctgccttggcctcccaaaatgctgggattacaggcatgtgccacggtgccctgccaatagttacaagctcttatgtttctatagttatgtaaagtctgaaaaatgccaagaatgcacatgaagagcatgtaatacgtgtaatgaaaccattataggaaatactatgtgttgctaaatataatgcttattatttgcaaattataattttggttgtcccaaacttgatgattatttgtatatttttcataaactgcaaaaagaattttcagaggacttagtgacaaacaaaaggtatgatataaagcacacaaaaacatattctccatggaaagaaaagttggaattgagaggcctaggagaggcagcctccatgtattgatgaaattacagttaaattagaaagcagagaacaattgagtaggtttgaaaaatgagaaacagttagcaaaaaaaaaaaaaaaaatacacacacgcacacatatatgtatgataagaagttttaaaaatgattaaaagaggtatccatgaagagatgaacacaatttgaatatgcacttagcacataaggatgtacaatcaatatgcaacatagtgttttgaatcctaactgataataaaataactacaaaatcctgcaaactcataatatttagctaggttattctgtaaactgtattttactgataattaaaagtaattttagtgagaataatagtgtgtattttatattatcaataatttgttttccttgcttatttctctttgctgcaaaatgggttagtaaaatactttgggcgtcagttaatgtacacttgaaaatgcttttagttttattctgaaaaagaaatgatatcaatatacatttataaatgttatgaatagttatacactttctgattaaacaataaaatccaacatctttagctttctaaatggtgctttttcttgtacgtatctatatttaatttttgtaagaaatatttgctatataagagagaaactatgagacatttatgtaatttataaataataaaaattaaacaaatagctgagaaactctgcctataattagatcaaaattatttttgtaaattatatggctcttcaaaatatttcttcctcgcttccttactttcctggaaatagtgtgctttcccacccctagaatttctgtttgtgcatttgacttgttttggccagtggatattaaccaatatcaagcattccaaggcttgctatgtgcattcggtgtagagcttgctgtcctgtgtttcctcaatgttaaaaatagccattgagtagttactgtgccttcagactcagccccagaatgtacctgtgtaggacagagttgctctagcagacctgaattgagaagcaattctaccccgactaccacagcctgaagctaagtggcccagctgacctacaaatcataaacaatacccccaaaaaacaaattatcatgttaaatcactgaaatttgaagtcatttgttcacaatagacttcaaatttcaaatagctaatcaatagatttaatcatttataggatagaaatcacctacctatttgacccattcccctacttagcacctagagacaatcaatcaacctgaacattttgaatggcactatctgtttttctaaacataattttatgtcacatacatgtattcacatatataatgatatatatagtatatctgaatattttatttttacttcattaagatatgtcagaatgtatatggtcatctgagtcttattttttcctcaatatagtgtctctacattttatccacattgttatgtgcagctgtagtatattcattttcactgctctataatatccattatgtgacttttcccacatattatttatccatgtttgttactaacatgttatttcgatgattttcattgtttgctaatacaaacaatgctccaaggagcattctgcatatctggagattgtatatgttgaagcacatgtgtaaacgtttctctagggcatcagttctcaaacttttggcctgaggatctgtatttgttaaggtttgccagagaaatataatagaacgaatatgtgtgtgtgtgtctgtgtgtctgtgtgtgtgtgtgtgtctgtatgttgatgtgtatatatacatatgtattgtgtgtatctctctgtgtgtgtatatatatgtacatgtacatatatgtatatgtacatgtacatatatgtatatgtacatgtacatatatgtatatgtacatgtacatatatgtatatgtacatatggatatatatgcatacacatacatgtgtgtatgcatatatatacaaagagatacatgcagagacagagataaagagagagagaacagactctctttggctcacatgattgtggggactgttaagtccaaaatttgtagggcaggtgagcaggctggggatccagggaagagtagatgtctgattttgcagcttaaatctgaaggaattccatcttatttggggaccttagtgtttcccttttaaggccttcaactgattggaagaagcccactcatgttgtagagaataatcagctttactcaacatctactgatttatgtgtttatttcacctaaaacatacctccacagagatatttagactgatgtttgaccaaacattgtggtagcatagcttagtaaaactgacgcataaaattagctatcaccatacccctttattaccttaaagattattaagtaccctaaagagatttggttaggggcttatatctattgatgcttattgtattataaattaaaacttagaaatcttaaagatatttattaatttaaataactatagaaagttcattgcatgttaactaaacattttaatgcaaaatcaatataatgcctaaaacaaaaaaattaatgaaaagtgtgacattattttatacttctgtaaaaatctttgtggcacctggctcaataaattgccagtagaggaaaatttttctgttcttgtcaaccttagcagaaatttatttattttattactcttcaaagaaccattttggtctttgttgatcttccattctattattctatcatatatatagtatacgctttctaacctcaaaatatatgcacagcacaatgattttaagtctgttctcttttcattataaccagttaaaattaaattcccttcaaaatactgatttgacttcatgtcagagttttgatgtgttgccattcagttctattttaaaacatttcttctcttatgtatgttatttaaaactgttttaaaatttgcacaaatatactttatcagcatatttgtatactgatcgatgagtgatattgatctttatttcataagcttgttggccacatgtatgtcttcttttggaaagagtctgttcttgttatttgcccattttaatggagttgtttgttttttgcttgtaaatttgtttattttccttacagatgctggatattagaactttgtcaaacacatagtttgtaaatattttgtcctattctgtagtgtattagcctattctcacactgctgataaagaaatacccgagactaggtattttataaaggaaagaggtttaatgactcacagttccacatggctggggaggcctcataatcacggcagaaggtgaatgagaatcaaagtcacgtcttacatggtggaggccaagagggcatgtgcaggggaactccccccacctcttttttttttttaattatactttaatttctgggatacatgtgcagaatgtgcaggtttattacataggtatacatgtgccatggtggtttgctgcacccatcaacccatcatctacattaggtatttcttctaatgctatccctcccctagtcccccacccctcagcaggccccagtgtgtgatcttcccctccctgcgtccatgtgttctcattgttcacctcccacttatgagtgagaacatgcggtgtttggttttctgttcctgttttagtgtgctgagaatgatggtttccagcttcatccttgtccttgcaaaggacatgaactcatactttttatggctgcatagtattccatggtgtatatgtgccacattttctttatctagtctctcattgactggtatttgggttggttccaagtctttgctattgtgaatagtgctgcaataaacatacatgtgcatgtatctttatagtaaaatgatttataatcctttgggtatatgcccagtaacgggattgctgagtcaaatggtatttctggttctgaggaatcgccacactgtctttcacaatggttgaactaatttacacacccatcaacagtgtaaaagccttcctatttcttcacatcctctccagcatctgttgtttcctgactttttaatgatccccattctaactggcatgagatggtatctcatagtggtttagatttgcatttctctaatgaccagtgatgacgagctttttttcatgtttgttggctgcataaatatcttcttttgagaaatgtctgttcatattcttcacctactttttgatggggttgttttgttttcttgtaaatttaagttccttgtagattctggatattaatcctttgtcagatggatagattgcaaaaattttctcccattctgtaggttgcctgttcactctgatgatagtttcttttgttgtgcagaagctctttagtttaattagatcctattagtctattttggcttttgttgccattgcttttggtgttttagtcatgaagtctttgcccatgcctgtgtcctggatggtattgcctaggttttcttctagggtttttatggttttaggttttacgtttaagtctttaatccatcatgagttaatttttgtataaggtgtaaggaagggatccagtttcacttctctgcatatggctagccagttttcccaacatcatttattaaatagggaattctttccccattgcctgtttttctcaggtttgtcaaagatcagatggttgtagacgtgtggcattatttctgaggcctctgttctgttccattggtctgtatatctgttttgataacagtaccatgctctttgggttactgtagccttgtagtatattttgaagtcaggtagtgtgatgcctccagctttgaaattccctttataaaaccttcagatcttgtgagacattcactatcttgagaacagcacaagaaaaacctgcaaccatgatttaattacttcccacctgctccccccatgacacatggggattatcacaattcaatgtgagatttgggtggacacacagccaaaccatatcatataggttgtctgattactctgctgacagtttcttttgctgttgagaagctcttaagtttaattaggtcacacttgtcaatttttgtttttgttacaattgcttttggcatttttgtcacgaaatctgtgctaaatcctacatccagagtgatatttcctaggttatcttccagggtgtttagaattttatgtttcacatttaagcctttaatccaccttgagtttatttttgtatgtggtataagggaggggtccagtgtcaatcttttgcatctggctagcacattttattgaatagggaatactttccccattgcttgtttttgttaggattgttgaaaatcaagttgaacatgtgtggcattatttctgggctccctattctgttccattggtctgtgtgtctgtttttgcaccagtaccatgctgttttggttactgtagtctagtagtacagtttagtcaagtaatgtgatgcctccagctttgctattttttcttaagattgccttagctatttgggctctttttttggttctataggaattttaaaatattttctaattctgtgaagaatatcattggtactttgatagaaatagcattgaatctataaactgctttgggcagtatggccattttaataatattgattcttcctatccatgagcatggaagatttttccagttgtctgtgtcacctctgatttctttgagcagtgttttgtagttcttgttgtagagacgtttcatttcctgggttggctgtattcctaggtattttattctttttgtggcaattgtgaatgtgactgtattcgtgatttcactctcagcttagatgttgttggtatatagaaatgctagtgatttttgtacatcgattttgtatcctgagactttgctgaagttgtttgtcagatcagggaacttttgggccaagattatggggttttcaagatatagaaatacatcatctggaaacagggatagtttgacttcctctcttcttatatggatgccttttctttctttttctttcctgattgctatggctggaactttgaatattttgtagagtagggatggtgaagaaggcatacttgactggtgctggttttcaaagggaagacttccagcttttgcccattcagtatgatgttggttgtgggtttgtcatagatggctcttattattttgaagtgtgttcttttgatgcctaatttattgagggttgttaatgtgaagatgtattttatcaaaagacttttctgcatctattgagataatcatctggtttttctttttagttctgtttatgtgatgaatcatatttattgatttgtgtatgttcaaccgagcttacatcccagggataaagcctacttggtcatgatggattagttttttgatgtgctgctggaattgattggcaattattttgttgaggttttttgtatcagtgttcatcaaagatattggcctgaaattttattttttgttgtatctctgacatgtttttgtgtcaggaaaatagtggcctcataaaatgagttgagaaggaatctctcctcctcaattttttggaacagtttcagtaagagtgataggagctcttcattgtatacatatggtagaatttggctatgaatctatctggtcctgggtttttttctggttgataggctgatatggtttggctgtgtcctcatccaaatctcatcttgaattatagctcccataatttccatgtgttgtgggagggacctggtgggaggtaattgaattaaggcaggacttgcctgtgctgttcttttgttagtgaataagtctcatgagatctgatggttttataaaggggagtttccctgcacaaattctctcttgtctcctgccatgtaagacatgccttttaccttccaccatgactgtgaggcctccccagccatgtggaactgtgagtctattaaatctctttttctttataaatacccagtctcaagtatgtctttatcagcagcatgaaaatggactaatacatagactttttattactgattcagttttgtaactcattttttttgtctgtgcagggattcattttttttcctgggttcagtcttgggagggtgtatgtgtccaggaatttttccatttttttctagattttttagtttgtgcatagaagtattcgtaatagtctctgatggttatttgtatttctgtgggttcagtggtaatgtcaggatcagtgtaatgccctttgtaatttctaattgtttttatttggatcttctttcttctttatcattctagctagcagtctctcttatttactttttcaaataaccattgattatttggattaattaatcttttgagtgatttttcatatctcaatgtccttagttcatctctgattttggttatttcttttgtgagttttggggtcagtttaatcttggttttgtatcttattaagttttttaaattaccattgattatttggattcattgatttttttcagtggttttttcatatctcaatctccttagttcatctctgattttgcttatttcttctgttagtttttgggttcagtttactcttggttctctagtccatttagttgtgatgttaggttgataaattgagatctttctaactttttgatgtgggcatttagtgctataaattttcctgttaacactgccttagctgtgtcccagaaattttggtatgttgtgtcttggttctcattagtttcaaataacttcttacttcttgatttctgctttaatttcattatttactcaaaagccattcaagtgcagctattcaatttccatgtaattgtatgtttttcagtgattatttcagtcttgatatgtaattttattgtgctgtgatgcaagagagtagttgatatgattatagttctcttgcatttgctgaggattgttctgtgtctcattatgtggtagagtttagagtatgtgcatgtggcaatgagaagagtgtatattctatttgttttgggaggggagagttctgtagatatctatcaggtccttttgatccagtgctcagttcaggtcctgaatatttttgttaattttctgactcaatgatctaatactgtcagtagggtgttgcagtctccactattattttgtaggagtctaagtctctttgaaggtctttaagaacttgctttatgactctggttgcttctgtgttgaatgcatatatatttagaatagttaggtcttctcatcgaattgaaatctttgccagtatgtaatgctccccttttttcgtctctatctgtttaaagtctattttgtctaaaattaggatagtaacccctgcttttctctgttttccatatgcttggtagatttttctccatccttttatttttgagcctctgagtgttactgcatatgaaacaggtctcttgaagacagcataccaatgaatcttggttctttatccaatttgccactctgtgccttttaattagggcatttagcccatttacatttaaagttattgttgatatgtgtgaatgtgatcctgtcatcatgatgttagcttgttatgcaagcttgtttgtgcggttgctttatagtgtcactggtctgtatactggcaggttaggatgcatgcacacacacgttggcatgggggaaggtaaaacccacccacgtacacacatgttggcaatgtgatatatgtggtggctctgggcctggaggaagctgcagtgggggtagggaataggcaggctggtgtgtggccatgggggctgccccattggacctctctgccagtcaggcacagttcaccactgcaggagctattatgtgggctcccagagcacctgcttgttctacaagcaggcatggccaggctggggccctggaagaggccagcagaccaaggggtgctcaagtcagactagccccatctgatgggcaagaccaccatgcagagttcaagtctgagagtttccctagggataatgtctcctgtggtagcatgtcgagcctacagggatggacatctcttgtcatactctgccacgagtgcttaggcaccaaatccttttggctctgcatcagctggcatgctgcccctaccaattctctaagcagctctttgttccaactcaagtatccgtcatagtttaggggtctcctcctgccaagattccagaggcctgtggcaagagtaggttgatccttgtcagttcaattcacccattcctttggagttgttggagggtaggaattagtcccctgcctggtagcctcctgtagggttcccagcttcctcccacttgagcacagcttttgtatcttccctccatccactctcacaggcttccctctgaagctctgtcaggagtgtgccaattttcttggtcccttggtggcagttgttccacctggttgtgtcaagttggccatcttctacttaatcaggtcttcttgttgaattgaaactattgccattatatagtgctcttctttagcttatttggtctttgttggtttaaagtctgttttgtctaaaactaggattgcaacccctgcatttttgtgtttgttgttgttgttgttgtggtggtggtttacttggttgatttttccccattcctttattttgagcctatggatgtcattgtatgtgagatgggtctcttgaagacagcatactattgggtcttccttctttgttcagcttgccattctgtgtattttaattgggggattaagctgtttacattcaaggttactattcatatgtacgaatttgatcctgtcatcatattgttagctggttattatgcagacttgtctgtgtggttgctttatagtgtcactggtttgtgtacttaagtgtatttttgtagtggctgataatgatctttctttttcacatttagcactcctttcaggaccacttgtaaggcagttctggtggtaatgaattcattcagcatttgcttgtttgaaaatgatcttatttctccttcacttatgaagcttggttgggctggatatgaaattcttgtttcaaatattattttaagaatcctgaatataagcactcaatgtcttctggcttgaagagtttctgctgaaaagtccagcctgatgggattccttttgtatgtgacctgtctcttctctctaattgccttttacattttttcattcatttggaccttggagaatctgatgattatgtgtcttggagatggtcttcatgtataatatctcacaggagttatatgcatttcatggatttgaatgttggtctctctagcaatgttagaaagttttcatgtacaatatcctgatatatgttttccaagttgcttactttccccctgtctctttcagggacaccaatgagtcatagttttcatctatttacataatcctatatcttttggagattttgctccttccttttaaattcttttttctttatttttgtctgactgagttatttcagagagccagaatttgagctcttagattctatcctcagtttcttctatcctgctgtttatacttgtgatttaattatgcaattcttgtagtatgtttcttatctctattagatgagtttggttccttttttataatggctattttgactatcagctcctgtatcattttactgtgattcttagcttccttggattgggttttgctgtttccctgtatcttgatgatccttgttcctgttcatattctgaattctatttctctcatttcagatatttcagcctggttaagaactcttgctggggaaatagtatgattatttagaggaaagaaggtactctggcttttcaagttgtcagagttctttcactggctttttctaatttgtgtgggctgatgttccttcagtctttaaagtttctgtcctttcaattgatttttttgtttttttcttcattgatgcccttggggattttattatgttataattgagtttggttgactggctttgattctagtacactactgggtcttggtggcaccctctatgattactgtctgcatgcccgcatttcttctgttgggctttctgatctattgagtttcctcaggcaagggctgcggttgacagacaagctgtattcttgccaggttggccttaatttgatgtccatgtgctccctggggaaacatggggttgcacttgcctgcagagttcaggcagaagtgggacctctgggttggaagctctagcaggtgtggtccatctggctatgggaggcaggggtgagtggagttgcctaccctgacctcctggtgtttccagggcaacaggagcctgcctgcacccctcagcaaattcagggaaaactaggactgttgggccagcagccctatcagatgtggctcacctgtccaccagtggcaggggttggtggggatgcttgtcctgctttctgggagcttcctaggacaataggagtctacccactggttgagttcccacagaagtggaactgctgggccaaaagctccagcaggcattgcctacctggctgccagtggcagtgtcaggcagcgtcgtgtgccctgctgtctgggtgtttcctgggacaacagaaagctgccccctctagatcagtccaaacagaagccagactgctgggccagaagccccagcaagtgttgcctgccttgcagggtcagtgggatcacatgccttactgtccaggtgtttcctgggacaacaggaggcttgtgctcctcagctgagttccctctgaagcaggaccactgagccagaaactctatcatgtgtcgcttgcctggctatgagtagcagggatggatggggttgtctgccctaccagctgggtgttttcagggcagcaagaggctgtgccctccagctgagttcaacaaaagtaggactgctgggcgggaagctctagcacacattgatcacctggcaaccagtgatgagggcaggtgaggtcacatggtgctgtgctctctgggtgtttcccagggcaacaggaagctgcaccttccagctgagctcacatagaggtgggatgactgggctggaggctctagcagttgttgcccacctggctgtccatggcaaaagtgggtggggtcatgtgcagcctcctgccacctgagtgtttcccgggacatcaggaggctgtatcctgcagctgaatttacacagaagtggaacaactgggctggaagctctagtaagcattgcctgcctgcctagcagtggtgggggtgggtggagtggcaggccaaattcaggctgaagtgggactgatgggctagaagctggtgctgagccccatctggcaagggggtgggtggagcaatcttactgctcccaggcactgcaactatgcctttattcaggtgatggcactggtgctggtctgctctggggttaaaggcttgtagtccccttggacttgatagttgcccctgcaaaatgtctggatggctctctccctcagtttggaagcacagctgggggccaggcagattttcctactcccagtcttgtacaggtctctgcagagagcatgaatctcctggggagctctcactctctcaccctttcccatttttgtagaggttcttctgcgccacattgatcccagacagatagctttgctcctctctgttctctgtgttctcctgctgccttcatggatcccagcatggtttctcagatgattggcctgcagggtcagtgttgactagccttttagttcctctctgtgagagcagcacatacaagctgcttctcgtctgccatcttggccctatccctcatctttattttcatttcctttggcctaggtaactttttttggtactttttcattttgctttgctttgctttgctttgtttactctcaatctttgtatctccttagaagtttagtgtgcctcgtgtaaaaatcatatagctgaatttgtttctttttagccaaactgaaaaatctttgtcttttatgtcttttagcttccactttagtctatttgtgtttgttggatttgttcatatgtttgtatttctatctaaaaacttatttttaaaattcattttctatttgtatcatttattctagtgcttttttcctcctttcctattttcttttagatatattagatgtttataattgtaagtttttcttacccatttctttttttcttatactggtttggaagtcatatgctctattactattcttatagtgctcactcttaacattttaccatgctgactgaatttagtaaagcctaaattgatcaaggttttacttctcttcttaatagcacatgaactttattaatactatatcattattgtttttttttatttttacaagcatttttgttttatttttgcaagcattttatttatctacacaaatatttctatatacttacatgtttaccaaattgtttgctcactatttcttccctttcagatcttctgtccctaaaatatatccttagtaatttctgtaggagaggactgctttgtttagttggaacattaatacttgttcttgtttcttttcttccttttttttttttttgaggtggagtcttgctgtgttgcctaggctggagtgcagtgtcacaatcttggctcactgcaacctctgcctcctgggttcaggcaattctcctgcctcagccttccaagtagctggggctacatgtgtccactaccctatccggctaatttttgtatttttagtagggatatggtttcaccatgttggccaggctggtctcgaactcctgacctcaagtaatctgtctgccttggcctccgaaggttctggaattacagacatgggcctctatgcccagccttgttcttgttttgagagagatttttgataattccagagtaacattattttctattagctctttgaagaaatttcacccctgtgacttattttctctgtgatgttgtttaagtgttttagagataatgtagtcatcttatgagtcatagtgaagatcaaatatatataaagagcttattagtgtttctaacacatatttatcactatataaataaataaccttatttttcttttttccctcctttttttcttataattcttattattgccaatgctgctcagcaattcactaaaatgcatctaagtaaaaatttctttttattgacaccactgtttatcctgtttggtatacatttttctttccaaacatgtggttctaggtcttaaattttctagtttctgtacattctcaacccttaattctttgaatgttacatctatcttttatttccattctcttctggaattttgattaggaaaatatacttttttattgtatcctttataattttaaccacctatactgtgttcagttcctcatctgtctatagttgggataattttttcaaatatgtactttatttatttttattttttatttccataggtttttgcggaacaggtggtgtttggttacatgagtaagttctttagtggtgatttctgagattttggtgcacccatcacccaagcagtatgcactttacccaatctgtagtcttttacccctcgccccacttccattccaccctttcctccaagtccccaaagtccattgtatcattcttatgcctttgcagcctcgtagcttaactcccacctgtgagtgagaacatatcatgtttttcattttttttccggatttatttcccaattcatttactctgaattttgctgtttctcatatgctatttaacccatccattgatttcttaatttcaataattttatttttaaaatttctaaatatatatttttttcagatttgcagattcatgttataaccttacgtcgtttgatctttttattgtagctgttatttccttatatactttacttatagttatattttgtaccctttaattataacaactagtgtccttcagggtatttgttaattttattagctcatcctcagtcatggcttcttatttcccattatgtgtttgagaataattttgtaagctcatacttggttgaattttatttgcagaattttgagtagctaatttctaataacttgggctgtataccaacagcgtggatctacattattagtcagctcagtctgccataacaaaataacagagactgggtagctcaaataacagaaattaatttctcacactcctggagcctagaagtctaagaccagagtgccagcctgatcaggttctggtgagggcccccttcttgccttgtaaatggctgccttcttgctgtgtcctcacaatgcagggagcgagttaactccagtctctttctctgattataaaggcactaatcgtattacagggttcccgtgctcatgaccttgtctaaacctagttatttctcagaggccctacctccgaatactgccacattggaattagggcatcaatgtacggatctgggaaaggagtggcacagtcagtcagtccataacattcacttgtgctctttttgagagctttggttccttctatttgtgtggagcccagggaaactctgatcttttgcatctcttaaaacacacttttttgattttagtgtaccattctttttctctctcttgatttctctcagccctcagaaatggcctttattttttcatgaaccaaagttatacagttttccatatttcaggccatgtttttgaaaggcaaaaccatttcaaaagaatgttcagaaatttatatttgatatattttggatttagtatatgagctctgactctatatattaaaaacttatgggaatattgtttatatttattgttgactaaatatcagttacagcactcacaaagaaataatactgcttcattctagttgtaattattccagtgtgatttgttttttttgcctggcacatggtttaaaacacaaaataagcatataaaacttatatgagagggtttttcagccacaggcagaaacataccacaataatttttatcctatgctaagattttggtccataataacatgatacccattggaaagatagatttgagaaagaagcatgcttaaataatttttaaatttttttacatgcatgtttttggataagtgtattgttcaatctttaatattaaaaactaaaattctgaatgacaaacatatgtgcaaaccaactattgtggcaaaaacagtttttgttggtgaagggactagctgccatttggtgatttttcagatagtcaaatttgaaaaatcaattggatcttctcttctcttctcttttctctttttgagatggagtcgcagtcccccaggctggagtgcagtggcatgatctcggctcactgcaacctctgccttccgggttcaagtgatttcctgcctcagcctcccgagtagctgggattacaggcacacgccaccatgcctggctaattttttttttttttgtatttttagtagagacggggtttcaccatgttagccaggatggtctctatctcctgacctcatgatctgcccccctcgacctcccaaagtgctgggattacaggtgtgagccatcacacctggccccttggatattcttttctaactcaaatgagaatatcctcattatataatccaccttctctccagaaacttcaagctctttctctctaatggtggctgtttctacgctgcagatagaaattacatttccctcttagctgaaaaatacccaagcctatgagcaagaaaacaaaatattttttgattctactattccctctgtcagagatgccagaaactttttcttcttcatttatagcataatttcattcatgcttgcatgcatttctatatttacttactctaaagcatttactaagcactttaattggtcagtcatgaggcttggtgccgtagaaacagagatgaaatgcaattctccatcataaaacagtctggcagggaggaggaggataaataagtggtatattacaattcggtgagagaaagtacctaagagaacacatttaaaaagcatgcaatgcagaaggatgtgtagaagatgatggaagtaaaattttcttgcagctgatgttacacacacacacacacacacacacacacacacacacacaaaaccaactagatgtttctgttggtgtcattgacacctacccatttcttttcttttctttttttttttttttttttttttttttttttaagactgagtcttactctgttgcccaggctgcagtgcagtggtgcgatctgggctcactgaaacctctgtccccggggttcaagcaactctcctgcctcagcctctcgagtagctgggattacaggcgcacgccaccatgcccggctagtttttgtatttttagtagagacggggtttcaccttgttggccaggtttttctacaactcctgacctcaggcgattcgcctgcctcggccacccaaagtgctgggattacaggtgtgagccaccgtgcccgagcctgacgcctacccatttcttaaactagcttttgtgtccaccacttggaagccactgctttaagatctactgattaccgaaatgcaaaattgaatgagtcatgctcaaccacccagcacttaaacatctctttgatctctcatgatctaactcaaaggtatctcattcctgattcacttcttccttcatccaaactgcactcctgaagcatttaattaatctaaacataagcaatgctgacttactgtttcatattgtattatgtttttgaaactgatttagcccatgtctgaatctttattgttctgaagcccgatcatccagagcctaatatatacaacgctgaaccaaacaaacacatgataacaaaaacactaatttagtgaattaatctagaagaatctagcagaattaatctagaaactgcacagcagcagtttctctcttcagcttgaattactaagcaattcaagttagcaattgtgtagacccaaataagataataatatttagtcatttagatatgccactacaagtaaaaataaatcagatacatacacatacacacaaattactcatagaatgcagtattcataaaaattatgttactttttaaacaagctgtctttttatgtttttgcaaatagtggcgacaaattggctacttcaagtggtgacactacagttaaattatgggatctatgtaaaggcgattgcattttgacctttgaaggacacagccgcgcagtgtggtcctgcacatggcactcctgcggcaattttgtggcttcctcctcactggataaaactagcaaaatttgggatgttaataggtaagaagtactttaaacattactaatcctctgtgctgatacatatacgtgggtaaagtggtaaagttcttttttttttttccttgatgctaccccagggaaacattaaaagaaactgttagttgataagattatagagagctacttaaataatctttgtgaaatccatttctaactccattaatctttgttgattaataatttctttctaaatgtaagtatcaagatcaagcctatgtaataagattagaattgcttcattggaaagctgtttgtttcaagcaggatagaaacaaatacttcttttaaagagttggatttttagttccgctttccacaggcttgttattgctctgtactattaaatgtaatagttcaacgaacgtaaatataacagaaataattattttctttatgcttaatttgttatgtcgtgatattcttgattaaatgtttcttgtcgattcacaaattgtaggaaatagtatactgtattgtatgtaaaatcctatacatatcatgtggatttggaagttttatgttttgattttaattcaaggtagacaaattcattatgtttcaaatattgaaattactatcacccatatatttttggatgctcattaccttctgttaggtttgcagatatgatacaaagaggtaaatttagctactatcaaatatgctaattccttcagctaaggggttatatatcatccatcaaactttctcagtagtctgtggtcctagctctggaaggacctccatccaccagaggaacacccataacagcagagaagtgccctctcctcggaggactgaggttccgttttgaaggtcctcccttcaagggtctaagttttaatattctaccttattccctgtgttcgctcagtcctaggggtggtagctctttcttgaagttgttatctccatgatattttaatgttcttttcccttttttagttacttagttagcaactttattcagtttttaccatcctgcatgtgaaattattattgttacaatgataggtgcaagttccgtttcctgacaagtccttgaaagatccagggcattagtggataaggagcataacccacctgagttataaagctatagctaaataaaattagcctgccccataggagaaaacatgactgtgaataacatattttagacctatgtctatctgaaatagtgacaatttcagatagcttttaattctcagatgggtacttactatttatctggaatatccaatcatttataattctttattatatttctataatgtgtgactggatttcataaatatttttataatagattaatggaattttagcactagtatttaatttgaattttgtatcacttttgacttggttgaggatcgtaatagaaaacagtgatcttttctaaaatgtaatatgtctttagaactcttaactacccagggtgtttaaaagcaaactatggttaaaaaactcagtagtctcagccctacttggaatgatttcaaacactttgacttgacaacttttctttatgaccctggtatctaaatactgacttccaattggtgcccagtaaatcttgatattacagatcaaaattgcttctgattgatgccaaaattctttaaacttcaagtttcccatcactgtcaagagttcactttcatcatcaaggacaaaataaattgtactaattttggcattgaggtggtggataagtattgacaaataaagtagaaattgattgtttctatagtggctattgatatacctttcagagtcacaatcaaagtaccaagctctaatttataattactctcagatcaatacaatatagatatgtctaaaactagtgtctttcttcaaaatttcatagattacttgaactggcttagttacttaaggcaagagattatttgccttggtaagatggatggtgctggagctatgtatgctgtgtcatatattcttggcttgatactgcatatatatatatatatatatatatatatatatatatatatatatatatatatttgttgttgttgttgttgttgttgtttttaagactgaatcttgttctgtcacccaggctagagtgcagtggcacaatctcagctcactgctctgcaacctctgctttctgggttcaagcagttaacctgcctcagcctcccgagtagctgggactataggcacgtgccaccacacctggctaatttttgtatttttagtagagacggggtttcaccatgttggccaggctggtctcaagcttctaagtgtttgagaaactcccaaagtgctggggttacaggcgtgaaccactgcgcctggccatgctgcatagttcttaataaataccaaatttatattggtagacagtattagtcaccagagaaggaagagtttagaatacattcttctcttttcacacccgtcctttccttcaagcttctggctcagtcttgaacagccttgattggtgttctatctctagctctgcagctgtttctgaattgggcaatacttggtaagaccatccatttagttcctcaccaaaaagttggatcactgtgaagcatcaacaatatagaaaatttcagatcaagattcatatttactgagtgctaatcagaatctatgaacaattatctatgacactcagtctgaataattccatactctacaaggtttctgtgaataattaacagtagcttttttattatcttctgaatgatcaggtatataaattgttatgtatttcacttaatggttgtttgaaaacacacacacacacacacacacacacacacacacacacacaccagtgtaacccagagagtgcttggcacatggtggtttacttacataaatgaataaagagtgattcaacaagtaaatatggcaaaagtattctaaatattctccctgacccatccacatttaaactacaatataattatgctgtcttatcctacacaaatcaataaaatgatgaaaatggggtagaaaaatcagaaaatagctataaaaaataatttgtatttctttagaggcatttagaggcatttgtatataacattaagcagtaagtattcatgaaatgacttaacaatgttggtctgtgttatagatctaagacaattctcatactcaaccattgccttcaatgagattacaagtaatttaaaatgcagcaattttaaagcaataagggaatatgcaatgcatctaccatttatatttataatatcagatcaggtattctagttgactcctggctgcttttcttccaaggtagctgggtatttgactgagcagttatatcacactgttactctgatatttggaaggcagaccatgtgcctgcttagcttgtagctcgaaggagaaggggtcggaaacagccaaaatgttactgaatgttgctattccagctgttttaacaaggtgttacacagacaagaattgggtggtttgtaccaaggatagtaggaaacagagggacttgcaaaattcaacagcttcttgacccctaatgttgggagataaatctgtggcccttatttctaagtgtattgtgtccaatactcttgtaattacatgggaagaggaaaataaagaaggtttaagaactgtgtttactttaatttgtggttactgtggcattgcgttgcctggaagcaactatattagaaacctaccaagtttttgagagaattgtattgacaaggaaactatgagcctatccttaaatcccgttgactcttcaaacagtgaaacagtcctcagagccccaaacttgcatccaaaaaaagtggacttgtatttttgcacagttcagaaggaaggcagagaccatagcaccaatctcaatatggccacagaggataatgaacaagaaggaacctacagtggaactaagccagaagctacaaagaacaatggggaaaggtgctcctctgggggacagccatggtccaatcaaggaactttcttcagtaccacggcaaagttcctcatgatgcctgcctagtttttcactatttggactagtgatgcttatatgtttcccatgtttccgttttctgtattacagtttatactgcagttattctgtccttacttcacaattgtgcattgtgttcatggtggtgatggtggtgggaagcagaaaacttgtattttgttttgttggttaccataatgcaagtgacactgctgaaccaaatgatgcagattgtgtgtcagccacagatcatgaactgtgagacatgcagtaactgaagaagagatctggggatgtttctttttttggttgtggagagaagaaagtcagtgaatattctaagtgtggaagaaaggatgacagatatttggtgagaaaaaggccaaactgtggcagagactgttagcttttcactagaatccactttttcctccttccatattagttaggcacttggctatatatctaaatgatatttattagcctcaattagttaagtatgtctgcatcactaagttctatacaatagaatattagttaaagtagcaggtactatttcctcattcttgcccccttgtggtggaatggaataccagtgacaatgaccacaataatcttagaagcctattattgaaactgaaagaacaattgtcaagctgcttgaagtaaagccacccctgttttgtaacttcagttaggctgcaacattctctggactctccagcaataagaaaatacacttccaggcctggtgcggtggctcatgcctgtaatcccagcagtttgggaggctgaggcaggccgatcacgaggtcaggagatcgagaccatcctggctaacacggtgaaaccctgtctctactgaaaatacaaaaaattacctgggcgtggtggcaggtgcctgtagtcccagctacttgggaggctgaggcagaaggatggcatgaacccagtgggcggagcttgcagtgagccgagatagcgccactgcactccagcctgggcaacagagtgagactccatctcaaaaaaaaaaaaaaaaaaaagacacttctatttggtttgagacattatatttccagtatatttgttacagtatttttgcttgcctagtctactataggcacccatgaatacttttcaggtgatatgtttttccctcatgacatattattaaggcaaccaagacaagctctgaagtgttctcaaattatttgaaggagtagtaatggaaattttctgctgataatagatggctagtctactccctcttttttcttcccttgccccttctttcttcccatctttattgtctatcgcaatgctgttggagtccatgaaatcctgcttgccaatagcaacatatgcaagttagtttgcatggaggtaatgcttgtaagactagttataaattataaaaacatgcaactgttgtaagtgtctccattagtaggacactgtttcaataatgaggatttcactgaaataatgaaaaacgccaaggatttaaattttatgttagcattgaccacatttactgataggaatgagttttgctcattgtagttaagctgatggaataaaaacagtaccttccacatggttgacctcacaggtttatttatttgcttatagatccaacaaatatgcattgagcacttacttcgttctatgccttattctagttactaagctataatagtgaaaaacttctgcccttatgtcattggcattctttcaggaggcagaaaataagccaaatgaaaaatgataataattaataattacatataatatttagagatgacaaattttgtagaggaaaactagagcacaggtgaaaagggatagcaggcattggaaagggttgcaattttaaacaggaaggtcgagaaaattcttgttataaagttgacatttggataacctgaataaggtgaatcagcaagccaagcagatacttgggaggagaatattccaagctcttctgatcaggaagctttcctatggtggtagcatgacccatgtgactgctaagcagcaaagaggccagcatgactggaataaagtgagcagatgagagaatggtaggggtaaggtagttaaatgagtatgtacatataatagagggccttataacccctgtcaattactttgacctttattctcaatgaaatgggaaaccattagtgggttttgagcagaagagtctcaatctgttttacactctaataagatgactctggctactgttttgagattagatggtggcagaggtggggtgaaagcttaaaagcaggtaaaagcagaaagaccaattggggaactattgtagcaatccaggccaaagatgtagaaggtttcagccatgagaatagtgaaagtcataaaaattgtattctggatagatttgaaagataaagacaacaggagtttctgaagtactgtgaattgtgagagaaagaggaaacaaatgacctgttacattttcatacacctgaaaggcaaaggctcattctccttatactgggacactaatataaacattataaaaggcttttccaaccaggtgtatcagctggtgatccagaagccatgacagaatgaggaatgccttctcattgttcatctaacatttccattaaagaaaatggaatgtttcccttctgcccacttcctagcatcacttcctttttattttaataattctgtagccaatcataacccctgtgctggatgagatgacagaaacagaagtctatttgtaaagaaaacagataaattaagaaagaggaaatatgaaatgttaagattgttatgatgaattaccttctgttaatgatatatactattattttgaaggggaaggcaaataatgcatgaaagtggactctaaaataaaagaaattttcttattacaaaaccaataatgataagatagcaccaaactagtaatacaatggagtttagtatttataacacaaaatgttccgttaatatattttatgttctttatgtttcatttgcaaagttggctatgctagcaaaggaggatatattgtataatattaatgggtttaaaacacgataatgtaagaagaagtattaagactcaagggcatggattattggtacattaatacctgtcttatattgccaagatccccactttgccttcttatacttgaaagggcacccaaggtatatattaatagactgccaaagtaatgcttaaaatataattatgttacagtataagaaatggtaagatacttaaattgacctcttgtgatcaatttctcctgttacaccaggataattaattattatatcttcttggattttcaagtacattcaaatgaattgtttccccttgacatatgggcttgaaatgatgtctgagtattacggagcatagacacataaataagcacaaaaaagtgaagaaaacagaatatagcatgtatttttttattttcctttcccccccaaaagtgcataattaataagcactattcaagaaatatctaccttatgaagaaaattgtattaaagccaaagttcagatttcatttagcaagttctgtcatgtttgaaaaattgagaatctctcacacattcaatatggctttgtatgtgtgaagaatggctcaagtaagtgtccactgcaataaacttgatgtgaacgttctttgataccaatatacatggatcaataataaaaaaggtaaatgtccttaggattttaaaattcatccctattcctttccacagcaaatgctattacatatcaatgaattgtataatttggatctgacatgctgtataatgtacactttctgtttgttatctcatacaccaaaaaagctatttattagaaataattagaatgagtataaatgaaactaaagatattctgataaaagcgaatatatatatatatattttataacatgatacatttctgctttattactgccaatcaaagcaagaactttaccatgttaaatatgcaacaccttttctccaactctgcacaaaataatctggtcaatgcataagtcttagtcctcctcaatgctgatgactaaaagggtttagtatatttctacactaatgtatggtaaaataaaatgatatgtagccatagtccatctgaggtaaaaaatgaaaatcacgtttgttttatatttaagatttacttgtacatgtatgtgtgtgtgtgtattctcacacatttatgtatatatacttatttgtattgatgaagtgagtttattcagctcaaaattaattttagagtggcaaaaactgtaattatttgactatcttaaatattttaaatttcaatcaaaatatttatttatgtgttatctatgactccaaaaccaagcttgttttaaaaccatttatttcagacaacaaccactattattatatccctaaaacattgtttttggaattattaaaataattttaatttaaataaaaatttaagatttgattcaattactgtggaaacaaatcaaatgtccaaggacatcaaatcaaaataaaagaagtaaactggttactaaatataaaaaatggcaagcaatacaattttggcagcattaaactaaatattttcttattgttaaacttactgttatatggaaaatcatttctatttagataataaagatgaggtttttttttctcttaaaggactaggaaatataattttgatagaaaatttaagtaatgtttcctcccattgtctgacatgagtttatgcaaaatcctaacacttaacaaagagagcagaacttgttaacttgtgttctgggtaaaaagaccataccatcttcagtcaaggaaccatggaataatctttggtctccacacaatctagaatgagccatgagggaagaaatacctccagcagaattccaccttctagaaaaatatcccttcctgattttttccatacttttatccttcactagatttgacaactaattactaaaaatcactactacttagaaactgattatttatttatctaatatttaccaactatgtaccaagtaatatagctggagctggggatatagcactgaatggaatggtccagacccttgcccttgtggagcttacattacagaaaaaagtgtcactggttacctgtgccttataaatcattagacaagctccctgacttggtcattgatcaaaagattaattcctttctgctagagatgacaagggggtatcactgagagtgactgtctttctcagatgtcatgtgtgaatcctagttctctattaacggaaagaattaaaaaccttcagagtaataagccaccaatgaggtgaaccttaaaaatggtgccaagccttcttatctttacaaagatgatttttgttttcacttgcattaggattcttttcaggtacctgtcacacataaaccacccaattaagatcatttgaagcggttttcacatgaaaagaaaactttcctgtgatggttctatttcagtttattttggggttattgtgtcagtttgctttttgttttaagtaaggaagaaaatagtgaattttagaaaagtatacattagcaagaatcaatataaaatgctattcaagcaataacaaatagagataatatacaaagatgtgctgtatctcaacctgtttatgttcaaaatttttatctctgggtagtaaaaattatgtcttatatatgcagacaaattcagagggatccaaaaatagtgttttcttctttaatgttgaagatgtagagtgacatagttgtttttcatatttcgtttcaatacatgtcctagtaaaatttcttatctacaaattcaaggcatacacctactgttgaaaatttatggtaattacataaatatgcatttgaaaaggtacaaaattttaaactagaaacacaaaacatataattatataacagccataactaccattaaaaaagtgagcatttaactttttaaaattagctgtgctaaaatatctgacaagtttatgaaaacctgatggttccaattttagaggtgacatataatttatttcattgcatatttttctagctattttgtgaaaatgtttaaaaagtttttttagagatgacatcttgctgtgttgcctgggctggagtggtacaatcatagctcactgtagcctggaactcttggtctcaagcaatcctcctgcctcagcctcctgagtagctgagagtacaggcaggcacaactacatctggataattatatatttatttttattttttaggaatagcgttctccttatgttgcccaagctggtgtccaatcactggccccaattgatcctcctgccttattctctagagtagagagaattacaggtatgagccacctgcttctggccacaaatcaaatgcactttttagaaaatattaatgccagtatctccagaataaattaacttcactactttacatacataaattaatatagcatatgtctatgcaaaactataatcataaattatgtatctgcaccccaataatactacctatgttcctaatctttatgaattgtaaatctcttatacaaataacattttagttaacaaacacacataaattgtatatgcaataacttcttacccctaactcttatttcctcctaacttatttataaacaggctacattatgtttgacttgaggctttcagtgatatcgctaacaacaaattatctcttcattacctgagttataatgattctcattatctatgttcatattcttacaaaccactgaggaaccaatccctaaattgaaaatgattgttcaccttctcttgaggccattgggattaatctcattaaattaacagccttatttatgtgggtcaccgcaaaatgccatcccttatattctagatattgttcatatatccaccagtcagactctatctctcacttacctctgatgtccttccactgtatggtttggaattaaatacctgtcatcaacaaaatattctatgtcttcaatcccttcaaggtacaatttatcttcttgcttatactggctatccatcccctgagaatatcaatttccttttctaattgagcctgtaactccttctttttaatccttctctggagatttataacttgtaatgaatgttaagcatgtagacgctatcactgaggtacataaatataatttattttagaattttgcatacatatatattaattgacacacacacaaacacacacatacgcatacatagagagagagagagattgttcttgggatcgtgacataaatttcccctaccgctggatctgcaggtttattcactaatgggtttccagtaggcaaaacaatgagcttggaacatactgggaaagtagtaaacatttgttgaattaatatcttaactaataacttatgttccctcctactcttcacttacttctagaccactttacttcctctctcctcccacaaaattacaacttcttataagtacatgctttgtgactataccattagcttcccttccattttattcatatactggcctcttcatcactctcatcatattttgaataacatagcacttgacttgctgtcatccttgtttgcaatgtggatattgaatccaagcagaaagtccagccaacaccctagcctcacagctccttcctcccttggtcccaacaactttcaagtcttaattgtaggttttctactctgtgagcaccatttcttatctctccagcttgtatattctaatcactcactgcaacaattctttgatgccagtggtattaataattaattgtttacaccattttttttgcccttgataatagccttcctcttcttttcttcttcccctgagtagatgccaaggtcttcctcacagagtttcaatttcttgcccctctcttcttccacatttcttgcctgtcaaaaccccaactctggttaaacctaattctctgcctgctttgcctacatctgttcagctgagcatagctatggaaaaaaatcagaatcaggctgacctgtttcatttcatgtttataacctcaactcacaagttgaattcaactgaattttctctatcaattaacttactacaatgtgagatgagtatttcacaccttcctcctccatattcaaatccctaacactctccccactcactttttctctgagtgacaacatggattttcatttcactgagcaaatagaagaaatcagaagaacatttttattcttccaccaccaaatccatcaatgatttatatttcccttttctctggatgttgcctcggtatttcttctgtattgacttacctggagctgggtagtctggaatagtcattcacgtgtttgaagcttcagttgggacagctggggaaagtttctctgtgatatcttattttccacatagtggcagaaatggtccagcagcaagaaaaagcaagctccaatgaacaagaactcatttaaacctttacttactattatatcattgaccaaagcaagtcacatggccaatattagagttcatgtgggaggggaatactcaaaagtgtgcatataggaaaagaaataatggcgactgctatgaactaagtgcttgtgtccctccaaaactcatatgttaaagcctaaatctcccatgtgatgatatttgaaggtgaggcctttgggaattaattaggtcatgaaggtagagccctcgtgaatgagattagtgcccttatataggaagggacaagagaccttactttctttgttgtccaccatgtgaaaatacaatgagaagatggccatctgcaaaccagaaagtgggctttcaccaggcactggatcttctggccacctcatcttagatttcccggcctccagaactgtgagaaataaatgttcattatttaaatcaccccgtctgtggtatttttgttgtaacagcccaaactgactaagatagaaattggtacttagaagtggagtgctactatttcaaatacctgaaaatgtggaagtgtctttggaagtaggtaatgggtagagtctggaaagattttgaggtgcatgctaaaagaatataatactgctatgaggggacttttaaatgtgaatctggtaagagctcagaaagtaaagaagagagctagaaaggtctctttcttattagagaatatataagtgatcatgtaatgtcagcagaaatatggacaataaaggccgttctcatgtgatctcagacaaaaattgggaaacatgttattggacaatggagaaaaggcactccttgttatacagtggcaaggaacctgggtgaattgtattcatgttctagtattttatggaaggtagaatttgcaagcaatacatgtggatatttagctaaaaaaaatttctgtgtatagttttaaaggatcagcttggttcctcctgactgcttatagtaaagtgtgatgagcaaaaggaattgaagagaaagaaggaatcattaagcaaaaaggaaccaaaacttagagatttggaaaattcttagcctatccatgttgcaggggaacacaaggggtgtggccaggctaccatttgataagaagattagtatgagtgtgatccaagaacctaatcagacatctcaacagaagccagttatagagacggaaatacaccacagaaatactggcaccaaaatggaataaaatgaagaaaagttgttggacttcttagacactacagcactggaccatagagctattcaactgcaaaaacatgttattcttcaagacaagagaagaatgaccctcaagtcattttcagagtttatcagggctgccactctcaccaaaggtccagagtgtatgggcctgggggacagggctgcctccatctcaactttaaagggcaagaccaatatgtgaacccaccaatgggtggggtaatattcttggttccaataggccatacagaggctgccctgagccatggagtcatgacctccacttggcagagcaactggggcctgtgtttcttgcctagcagtgctgcagaggcaaaacttacatcccactggatccagaggcagagcatcatcaagtcaagaggattattgcttaggtgtaagctcttacagagtttgccttgctaggttttggagtttcttgagacctgacacatctttctttcttctgatttctccattttggaatggaaatatttatcctatgcctatcccatcactttattttggaagtacataacttaacgggtttcacacgttcacagggagagaggaattttggctcagaataaatcatacctcaagattcaaccatatataatttagataatatttagataaggctttgaactttagatttgatatgagactaggtaaaacatttctgttggcatggaattaatgtatttttattgtgagaaggacatgaattgtggggggctgggaatggagtgctatgggctatatgtttgtgtccctccgaagttcatatattgaagcttaaattcccaatgtgatagtatttgaaggtggagccattgggaggcaatttggtcatgaggatggagccctcttgaatgggagttgtgcctttataaaaagagacatgagatggcgaaaccccgtgtctactaaaaatacaaaaataaattagccgggcgtgggggcgtgcacctgtaatcccagctacttgggaggctgaggcaagagaatcgcttgaacccaggaggtggatgttgcaatgagccaagatcgtgccattgccctccagcctaggcaacagagcaaaattccatctcaataaaagacaagacatgagagactttgcttctttcttctttgttctctgccatgtgaaaatactataagacagtgtattagtcagggtaccttagaggtacagaactaataggatatatatatatgtgtgtgtatatatatgtatatatatctttttatgtatatatatgcatgtatctatatatgtatctttcatatatatgtgtatatatacaagtttatacaagtatatatatatacacaaacacacacatatatatacacaagtatatatatgtgtgtgtttgtgtatatatagtatatatatatgtgggaatttattaaatattaacttacacaatcacaaggtcccacaacagactgtctgcaagcttgtggagcaaggagacccagtccgagtctcaaaactgaagaacgtggagtcagttgtttgagggcaggaagcatccagcatgggagaaagatgtaggctgggaggctaggccagtctcgacttttcatgtttttctgcctgctttatatttgctggcagttgattagatggtgctcaccagattaagggtgggtctgccttccccagcccactgacttaagtgttaatctcttttggcaacaccctcacagacacacccaggatcaatactttgcatccttcaatcccatcaagttgacactcagtactaaccatcacagatagtcatttgcaaagcaggaagtgtgcactcaccaaacattagatctgacggcaacttaatcttggatttcccagcctccagaactgtgagaaataaatgtttattattttagccacccagatcctaatatatttgttacagtagcccaaactgactaagatagcaaccgttttgcgaacaatacaccttctttttagccctttgtttctcttataatcactttcttgcaaatataaatgtagcattgttatatttttaccatattttatatgacagaattgatgcttcttcagttgagctaggtacttacatacttttcacatcatttctaggagaaaagttgacctgactttttgtcttaatttttatacgtagattgttggggaaatttttttgtgtgtgatggagtctttctctgtcacccaggctggagtgcagtggtaccatcttggctcactgcaacctctgcctcccgggttcaagcaattctcctgcatcagcctcctgagcagctggaactactggtgcatgccaccacacccatctaatttttctattttgaatagagacggggttttaccatattggccaggctggtcttgaactcctgacctcgagatctacctgcctcggcctcccagagtgctgggattacaggcgtgagccactgtgcccggcctgttggggaaatttttgcaaattgattgttagaatgatttaggctaactgtatttctctgctctgtatattttagattactcttagtactcttttatgtctctttattttgaattcgtttaaaactaagaataaattttaaaatggtagtttcagagtatccttcacccaaattttcccggtgataatattttacataaccattgcctattgtcaaaattaggaaatttgaaattggtacaatattattaactcaagctcagacctcattcatatttcaacagtttctacatgcagatttttggtatgtgtgtgtatagttctacaaaattttatcacatgtgtagattagagcaatcaatgcaaccaacaccataatcaggatacagatttgtccacaaccatttaaaaactctttcatgttaccccttaattaccatactctcccgcctactcttaactgttggcaaccactgatctgttctagatcactgtcattgtcaaatcaaaattattatattaatagaatcatatagtatgtgaccatctgaagtttgctttttttttcatttagcataatgcccttgagatttattcaactattgggtgtatcaatagttccttcctttttattgctgaataatagtctattgtatataaacatcatagtttatttattcactccttgaaggatatctggaatatttccagtttgggaatatcacagataaagctgtaatgagcatttacatataggttttgtttgaacataagtcttcatttctctaggatatgtgtccatgaatgcagttcctgggttgtatgttaaatatatgtttaacattattttaaaaagtgcaaattgtttttctagtctgtggtattttacacaatgattggcaataatgagaaatccagtttctctgcatccttatcagcatttattactatcagtatttcttatcttctctattctaacgtgtggtggtatctcataatggttttaattggtatttctaccatggctaataatgttagacatcttattatgtacatacttgccacctatatgtcttttttggtgaagtaactttaatttctggcctattttctggttgagttgtttgttttcttaactgttgagtttctgttgaaagtgccctgtgtattctggatatacatcgtttgtcctttaggtcaaggacattttttttggcttacaaatttctaatttttccaataccatatgatgaaaatttgtaagcaaaactaaaacaaataaagtacctaattttcgagaaaggcacagaaacaattcccttgaggaaagaaaaaatccatagtctatgtggatctgtttctggttctctgttctattctactgatctatgcacagtctttcacaaatatcatatagttttgattattataaccgtatagtaagtcttaaaatcagatagtgtgattccttcagcaatttttctttttctttcaaaattgttttgactgttctattttccttgtcttgccagtcttatttttcctcttatctaaaaattactttaacctgactttgctgatcatcaattgctgtattccttttctagttaatttctgcacttttttaaaatttttgactctcagtagtatctaatttattcctgttatttactcatgctaacttctcagaattagtttccctgtaggctcttctccagcaatccacctatagtttttccttcaaatttgagttggagactatcgtttcctaagaaatattcctgtctaacctcaaagtgtaatagctacactttcttttccccttattagggtcaaactgtgagtttttatgaccttaagcacacacacagataaacagacacgcaaatgcatttctgcatataattcaaaatttaaaaattaaaacaagcaataaaggaagtgtgtaacaaatcccatcaaaatttgacttctcctcatgaagaccccattgatgctactctatttgctcgtatttggaatacgaaattctttttaaaaattctctctctcactctctaattttttttgtttttatctttgcctttaaccacctccccaatttgatgcagatgctttgctggtggtttaggaatatgcattatctttttattgagtaatccaacactagcttttatgaataatttgttctatgtcattaagcattcacatttctgctctagctctctttatctttgctgtctctgccatgtgacaatcacctgatttgtctctctcttttaaattactccatggagcccctaatctgatgccatattattttattctctgcctcacattttaccttagaatttattcttaaatcttcatcccttttcaaaataaatgtattttacacatattcctgtatatatttctgttacattttttgccaaagattgcaaacagttaaattacttctctaatactcttctcttttttaaaaggtatatttccctcagtgcttgaacttaactaaatagtccctcagaacttcttttcataattaaattatttgatagggtctcttgggccttgtgtttgcacagccatactgaatgtgaactaaataattctgagtactttttgaaactttctttttacaaacagtaatgtattatttagaagacagagcaataggattgttcatattgaatgaaaataatgtctacagttatttatcattttaaggagcagagacactacttaattacaacagttttttttttttttttttttttttgaggtagagtctctgtcaccaggctggagtgcagtggtgtgatctcggctcactgtaagctccacctcccaggttcaagcgattctcgtgcctcagccgcctaagtatctgggactacaggtgtgccaccacgcccagctaatttttgtatttttagtagagatggcatttcaccattgttggccagatggtcttgatgtcttgacctcgtgatctacccgcctcggcctcccaaagtgctgggattacaggcatgagccaccgcgctcggcctacaatagttctttttaatgtgcgttttttactcatccaacatggctaatctctaatgaattaaaaacattttgccaaacagatcacaacccttcaccttcaaatgtacatttgttggtattgtgaggtctttggtactcaaccttggtcatcaaagcaaataagttttgactgaggactgacagaatattctcactgaatatttaactcctaaattatttaccatgcctacttaggccttcatttttattgcataatgaggcgtatgaaagcacattttagtctgacaaaataaaatccacacagaaactatgtacaaagatgcttgtgaacctacatgctggtaaggaattgtgaagcagaatattcaggttattttataaaattaacattaattgaaatgacttctttctgctcctttggcaaatctttcctgaataagtatacttcagtgagtacaattcttacacgtgtgaacaaaatgtagcctttgttcagatgacagaaaaatctataatgtaggatcagaagtaactgcagcttccttcactgcatatatctgtagttaggtgacatgaactgacacatatttcttattcatgagttctacagtgtgagaaggaggattcacctgaatattaaactgttataaactgttaatatattctagctagaattaattaagctggtcacattatttcaaagaaaaggttcgtgtagtgtctgcttcatacatatcaatgcttctcatttggattccagttcctgtggcccgcagcagtctttgcaaatgtatctttatttttctttattcttctaagaattaagaaaaacgagatttggaaaaaaaacctcaaactttcaagtgaccttttcttctgttcacatagttacagacattttgctgtaacatgtatgagctttttgaggggcacatatgcacagtctcacatctcatgtttaagccctttcctcttctttgattgtttcagttgaaataagaacacaggtcacaccgccctttaacagtggagtctgctgtttaaaaggtgtgtggggcattgtactaacatcagtagcttctaaattgcctttgtactttaagattattttacagatattatttagaacagccatagtttgtttgcttgcttccttccttccttgcttcctccctctctccttccctccctccctccctccctccttccttctctctcttttcttttttctttctttttttttttttttttttttccctcaagacggtcttgctctgtcgcccagactggagtgcagtggcatgatcacggctcactgcagcctcaaattcccaggctcaagtgatcctcccatattaaccttctgagtagctgggaccacaggcttgtgccaacatgccctgctaattttgggggaccttgaaggtagagacagtgtctctctatgttgcccaggctggccttgaattcctgtgcttaagtgatcttctgccttggcctcccaaagtgttgggattacaggtgtaagccaccacgcctagcctgacatagtttttttttttttaataatacatttagcataaattgattaatatttttcctctgaagcacttttagtttgataagcaagatatttaaaataccaccccaatatacaaaccttcaagccttaggagtcaagttctcctatttgaaattcaggatttcataatttaggaatgatgtaaatcctgattaagtaaggaaattgaggaaaattttaggaagtataaaatgtactttccttcatatttataaaagcttgtagcatttaaaatttggttgtcataatgatacaaaataaacattcaaatagaaatgtcaattataaactaaattttaaaattcatctaagaatagcaaaagtaatagaatatacatggattcagagtcataatagtaacatatctcttaaaggtagagaaacattcaagatcaagacaacaacatagcagagcctgccatgatttctcctgttctcaatttaaatagttatacaatatgcaaaagacaaaagcacataaaagagaaaatatgaataagaggcaaaagaatgactgagccagacttcattcccacttcatttgatttatttatattctcttctttcaagaaaagatttaaaccagtttacaaggataaacaaaatatgacaaaagagtataaattaaagttggaagaaataagaaaggataaacattgaggagataaatggagccaggaatatgccaaaatgcatgctataataactcactggctgacgttgagtcacacattcatatttaagctttcaaatagccaagcaaaagacatagttattttcatttgtataactgaggatgttttgagattcgctaaaaccaaatattaaaaacaaagacacacaactatattggtactaaggaaggattttaactgatggagcgcatcaaagaacataggcaggtgcattaaatgatgttataaagaatatccttgtaatggtaagtttcatagagtggctttcatgataaattaatatattctaagaatattacttatggacaatcactgagggatgatctaaaggattaccagttggaggtacaatgattctctacagaaaattgttttgaatcatctttagactatagataatttaaggaaacctaaatatgagaagaatacaaaaatgcatcgaaaacaaatgaagagtgtaactgatactgaagaaaattgaaatagtgatatggagaacacattttaaagggcatggtagaatgcagaaatacataaaaatgtaattaataaagaaaatagaggatagagcatcaagcttcagaaaacaaggagacgtttatagagatttttggtcataaaagacagttgtaaccattcatagaatgctatgccttccatattttctattaaaataaaaacatataaataaaagaataaaattagatcaacattgaaaaataagatgctgaaaatgtacatgctaaaaaataatggctatccaatttataaatcttcacatgcaaaattaaatttgtctgaagagaacatagaaaagagtcttcactgggccaacacacagacatactcaaatttgaaagagtcagaactaaattaaagataggctctggaatagtttttcttagatcagcccctaatgctaatttgggaaccatagaatgatagatcatggaacccattctaaccgtggatggagggctaagaaatgtaaggaatactgtccatcgtagatccccttaaggataatttggacttcaaagaaataaccaatagctgaaatatgggtgtcaagtctttaccagaatgagaaagctccctgtcaaaagacaaagttagctgtagcttcattctcatttcttatgtgtaagtagaattttaaaataacaagtttcaatcaccagatatcttaaaatctcctcagcccttttggaataaaactaacaaactggacaggtaaacacataattgtagaaaccttcccaaagaaaatgatatagaacacatataattgctttctactagtcatgaaaaaagtgagaaatattacatatatgatgaaaaggactagtagttcaaaagaaggacactatgaagaatcagcataaaggtctttctgtgaatattttttcaacaaagcaatgtttaaaactatatttttaatcccccaaaacttagaaaatatacttaatacttcaaatgggaacaatctgaaataaagattactttaaataaaaatcaaaatgtctgaatattcagagaaaacaagaaacaacatactgaaaacaagcagaacaaaaaatattttaacatccaaaggaaaattttaaagaataaataggttgggggccatttaggaaaaggagaaaaacttacagaagaaaaagtatataaaaaagtaatatgtcaaaagaaattcccagagctaaagaaacatttaggtcttggaacacaaatgtatcccagaatacttagaaaaattaaggtaaaaatctttatacacacagagacacatacacgtgacacatacatcatggtgaatttggaaatttttaaaaaatgaaattgagaaatcaatttaaggaaaaattaaaaagaaaaaaatttttaaattattagcattctgaaatgaattttttcataaagtttaccagatttttttactatgtaaagtattaacagaaacgttcaagtagaagtttaagaaggaagaaattataattcaagaattccatatccatacaaactgacccaaattatcaggataaaaaggcatcctttacataaaaaaatgaaaaagtactcaaagcaattcattaaatgaaccaaaagattgtatgcaatgatgaagaaaaggcgatgtaatgaaaatggtgaattgtggaaactgcaaaatagaataaatgtctaaatgaatgttgtcaggaaacacagcccatgcaatggatatagatagatataaatataatacacataccacaaaatttactcatttaaagtttacaattcagtatttttagtacattcagacaattgtgcaaccattgctataatccaatgttagaacaatcttatcacaccaaaaagaagctccactctcataaagagtcactcctattttttttttttttttgagacagagtctcactgttgccaggctgtagtgctgcggcacaatctttgctccttaaaaccactaatctactttccattttatagatttgcctattctgagcattttatataaatggaatcatataatatgcaacctttggtgactggtttcttttatattttgaaagttcatcaatgttgtagtatgtatcaatagcttatccatttttattgccaaatactgttgtgtcatatagatataccacatttgtctatctagtcatttgaaacatttctactttttggttattatgaattatgaaatatttatgtacaggtttttgtttggacatatgttttctcttttaatttttattttactttaagttctgggatacacgtatagaatgtgcaggtttgttacatagatatacatgtgtcatggtggtttgctgcacctatcaacccgtcatctaggttttaagccctgcatacattaggttggacatatgttttcattactgttgggtatataactaggagctgaattgctggatcccacagtgactgtaggttaatgtttaaaagagctaccaaactgttttccatagtgctatttttattcctaccagcagtctatgagaaattcccaattctccacattgttgctaacacttgttattatctagttttaaaaatattatgattattatagctgtcttagtagctgtgaagtcataaaacattgtgattttaatttgcattttcctgatagtaacgttgtgttttccattcacattttattcatgtgcatgtcttctttgaataaatgtctattcatattcattgcccattttaaattcatttatgtaagttttattcagttgtaagatttctttacatatttcttttatttctttttttattaggcaaataattttcaaattttttcctattttctggctcgtctgttcactttttatggtatattttgcagcacaaatgcctttaattttggttaaatgatttatcaattcttcaaagaataaatttataatttcttcattgcttgtactttgggtgttgcatctaagaagtcattaccaaacacaagataataagcatttactcttatttttcttatgttttcttccaggagttttatgattttgacctttaaatttaggtctatgatccattttgagttaattttggtctatgttataaagaaagttcaactgtattcttttacatgtggatgttcacttgttcaaactttagttgaaaagacatttgatgaaaacgctatttcatccttgacttgttggggtacgcttgttgaaaatcatttaactataaatatagtagtttattattagactcttaattctgtcagattgatctacatgtctatccttataatagtaccacactgtcttaattactgtagctttatagtaagttttgaagtcaggattttccaactttgttcttttttaagatcactttaatctggatctcttggatttctgtattattagctataagtctactcagatgttctatttcatgattaattatggtaggttttgtgtttctaggaatttgttcatttcatccacactatccaatacattggcatataattattcacactacttttttataatcattgttatttctgtacaatcaacagtaatatccctattttcatttctgattttagtaatttgagttttttctcttttttcttagttcatctagataaaagtttgtcaattttgttgaacttttcaaagaaccaatttttggtttttatttattatttatttatttatttatttattttttgagatggagtttcgctcttgtctcccaggcaacaatctcggctcactgcaatctccgcctcccaggttcaagcaattctcctgcctcagcttcctgagtagttgggattacgcattcaccaccatgcctggctaatttttgtattattagtagagatggggtttcaccattttggccagactggtcttgaactcctgacctcaggtgatctgcccgcctcggcctcccaaaaggctgtgattacaggcataagccaccatgccaggcctttattgattttttaaattgtttttctattctcttttttgtttatctctgctctcatctgtattatttctttccttctgttagatttaggcttagtttgttcttatagttccttagtttgttcttatagttccttaagttccttaagtaaaggcaggttgatgatttgagactttactccattttttttcctttttttttttttttttttgaggcagggtctcactctgtcacccaggctggagtgcagtggtgtaatctcggctcactgcaaccgccgcctcccagattcaagcgattctcctgcctcagcctcccgagtaactgggattacaggtgcatgccacgacgcctggctaatttttgtatttttagtagagatggggtttcaccatgttggccatgctggtgtcaaactcctgaccccaagtgatctgtcgtctaccttggcctcccaaattgctgggattacaggtgtgagccaccacgcctggacttacttgatttttaatgtatgcatgtatataatttttccccttagcatggctttcattgcattccataagttttggtatgttgcatttctgttttcattcatctctaagtatgtttaaattttccttgtaatttcttctttgatccattgattgttaattatgttgtttaatttccaatgatttctaaattttccagtttttctctgttattaatttctaacttcatctcgttgtactcagagaagatactttgtatcttttaaatctattgagatttaatttgtggcctaaaatatggtctatcctggaaaatgtaccatgtctacttaagaagaatgtgtatgtagctgctggtatgttgagtgctctgtgtttgttggatcaagttgctttattatgatgtttatgttctcttctcatacttatcttttctctggtggttctgtccattattgaaatgcaggacactgaagtctccaactattacagaactatttctccattcaattttgttagtttttgctggtcagaccattgatggtctgttattcattgtgtaaatgtttacaattattatatcttcttgcaatattgaaacttttactaatatatggggacctgctttggctctgattaacttttaaaattaatgtatattttgtctgctggtatagccatcgttgctttattatttgcatgaactttttttttttcactttcaatctacttgagattttggatctaaactgaatcggttgcaaacaggatatagttagatcatggtttttaatccattctgctaatctgtcttttcattggagagtttaatccatttaatttaaattaattactgatgaagaagcacttctgttttattgctatttcttttccatataccttataaatattcttttctttatttccagcattactgtcttcttttgtgtttagttgacttttttagtagtgaaatgtttcaattacttcctttgtgtgtattttatagctattttctttgtggttaccatagagattacatttaacatcctaaagttatagcactataatttgaatttataccagcttaacttctgttgtgattttctaattttttgtcttaaagtctctttctggtaagtggccataagccaagacagccactctctagaaaagccccgactgggaggagtattagattgagattgccagtaaggaaagacacagaggaggcagcacaacaaagcccattagataaccagaagcagttttattatttgcccaagaacagggaacagcatgtcttgctgagccaaccagaagaggaaagccatccaggacacatgctcacctagtgggaggggagcaaaagagagagcaaaatacctgtgagccaaagcccttattggggtccagagtgtgacccagtttggtttcctgcagggaattctaactgatgggtttagagcaagcaggcacaagttccgtggagtctgtgactgagaggtggttgccttggcatgtcttggcagtccatgtggtatatgggagtcagtgggtcaggtaggttatatctagctgtcccatgggcaggtggttgtcaggaggtagttgtataaactcctcccagttcctcaagctggatcaaccaccttgaggacttgggaggaggtagagaactggaaactatgcaaagtgtgactaagccccgcttctggtatgataaaattaaacctatattcaaaatggatgccaaagcaacataaaattatgagctcacaactttgaatagtatacaaaaactgcccctttacaggtcagttcccactgaccaactttttcagttgctgatgttccaaaattatatctttacatataatgtgccaaaaacataaactaacaattattttaaatggattagcctcttacattattcagaaaacataatgtggagttacaaactgaagttaaaataagactagctttttgacttttttttaatgtgttagtatcttaaattatgtagaaaacagtgaattataaactattgctactataacattagcttttgtaattgcccatatacttaccagtaatgaaatctttatttcttaatgtggctttgagtgactgtccagcatcttgtcattttacgctgcaggactttctcgtacatttctttcagggcagttctactggtaacaaaccaccttaatgtttgtatatctgggaatgtcatactttttcctcattttgaagggtatttttgggatatataagaaagttcgttgacggtttttgtttttccttttagctctttgaatattttgcatcactgccttctggcttccatagtttttgatgagaatctgatggtaatcttattgagcatcacttgcatgaaacaagttgcttatttcttagaattttcaaggttctgtctttggctttgaaaaatttgaatgtaatatgtctcagtgtggtctctttgatttcatcttacttgaaggtctttgtacttctcgggtgtttatattcctgtctttcactacatgtggtgtcataaatttgtgtaatatagtcaccacttaatatccaccttcaggcttgatgtaagttgtttgaaaccagttgtatccagtcacctttcacctagttaaaacttcctttccctgaatggttgtttagatatagcctgtttgttcctcatcccagtgacccaaaccctaacacacctcatagttggttactattataagacccaatggtgaacaacagagtcatctaaataagtttattcatttatatgtgttttctaagctagaaaatctacaaccttcacaggaaaccctaaggaataataccatggactttactgaaggcataattacacaggtactcttcctctctcctgctcctcaccctctggttgagctccctgatgcctttggaattccagtcagcctcccatcagtacctgtaacctctctgaaacctgtgagttatgaatttcttgtttcatgcactttggtttcacttcctctttgtctcacctgacacgcacacacacctaaacctaaccttcctcccattcaggtcttttctagaagagtggctgttttggtttatgagtgctctccaaaaaaagacaataccaaattaaaagaaactgtaataatggaaatctcatgtggaaagttttcagccattatttctttaaatatctctcttaccctttctctctctcttttccttacagtattcccacaatacttgtctgcttgttgacgttcagagatctcataggctctgtttaatattttcttcaatctttttctatttcaagttttataatttccaataccctatcttcaaatttgtttcctctgcctgctcaaatatgcctttgaatccctttagttaatttttcctttcagttgttatatgtttcagctccacatttcttttcggattttctctttttattgatatttccattgtgttcaacattgttttttgtttattctttttttgctttctccacttcttcttttagttatttgacagtctttaatacagttattttaaagtgcttgtctagtagatctgacagcaagtcttttttagggacaatttctgtttgtttgtttttttttctttgaatggaccatacttttctgtttctttctaggctttgtgattttttgttgttgagaactagatagttgaatctaataatgtggtaactctggcaatcagatttttctttcttccccagggtttgctgtggttttttaaaaattattttggtttattgtttttgttttcctattgttgtaggcagtctgtgtgccaggagttagcctgaggtgtaaatttaaggtctcttctggtctgttttgaccctgcacctttcaattgacatgtgtggtcactttctaattttcctcacatacgcagttgcttttgaatgttctaaatgtctttaatgtctgatgcccaagaggggaaaaagagaaaaatgaagtgataggaaaatgatactggccttttaaatgccctagaagttattgtggctggtgggggagcgcttgcaataatgcgggaggtacaaaaacaatagtcagccacttctttctctgcacttctgtgattggaagcagcaatcagtaatcagagcacaaatctctggtatttggggaatacgcttcttttttcccactctggctcccataagctacggacaagctgctccaggaacatgtgcacagccatctgcgatggggacaaggataggtagctactattatgttaagagccgaaattgaccaaaattaagtgcagtttattatccaagctctccagagttccaaaatagttatattggtcagattcttctagtgcgattacaattgttgtttaggtgggaagaaagattcctggtgcttcttattctgccatctctccaaaattttctctccaattgatatttgtatattgctcatgtatcctgtaaccttgctgaatttgtttattagtttttacagttttatgtatattcgagttttctacatacaagatcatggaatctgcaaatagagaattttacttcttccttttctatctggataccttttatttctttttcttgatcgttttccccagctaaaacatgtagtgcaatgttgaatagaagtgattagatcggccatctttgtcttgctccttattttaggatgaaaactttcatctttcattattaaatatgttgttagctattttttttttgtagctgcctgccttttatcagattaagaaagctgtcttctaaccctagtttttttttttttttgctggattttgataaatgttttttcagggtcaattaaaattattgtgtggtattattcttcattttcttaagtgttttattatattaatttttaattattaacacatccttgcatttctagtgaaaatctcactgttcattgtgtataatccattttacatgttgctggatttagtttgctaatattttgttgagaattttaaaatctctgatatttatcagcagttttgatctatggttttttttcttgttatgtatttgtctggttttgatataagtgtaatatcaacctcatagaatgagttgggaagtattccttcctcttgtattttttggaaagtttctgaagtattgatattaattcttctttgaatgtttggtagaattcaccagtgaaacattttgggcctgtccttttctttgtgtagggtttttaaattactaattgttatggactgaactgtatcccctcaaagttcatgtgttgaagccctaagccccaagtaattctatttggagataaggcatttaaagcggtaattatggttaaataagggtaaagccctaatccaatagaactggtatcctttttttatgttttttttttttttgagatggagtctcactctgttgcccaggctggagtgcagtggcgtgatctcggctcactgcaagctcgcctcctgggttcacgccattctcctgcctcagcctcctgagtagctgggactacaggcgcccgccaccaagcccggctaattttttcgcatttttagtagagatggggtttcaccgtgttaaccaggatggtctccatctcctgatctgcctgccttggcctcccgaagtgctgggattacaggcatgagccaccgcgcccagccagaactggtatccttttaaagagagaaagacggcaagggtatgtgtgtatacagagaaaaacctgtgtgaggacagcaagaatatggccatctgcaaataaaggagagaagtctcagcagagattaaacctgatattttgatctgggtcttccagcctccagaaatgtgagaaataaatttctgttgtttaagccacccagtctgtggagtttgttatggcaacattagctaactaattcaatcgctttactcattgtaagtttattaaaattttctgtttcttctagagtcagtttcagaggtcatgtcttcctagaaatgtatccatttaatctaagttgtctatcatagtactttgtcttttaaaaaaatttctgtaagattggcagtgaggtcctctctcttgtttctgattttggtaattttagtcttctctgttttttttcctctggtcagtgttactaaagatttgtcaattttgttcatcttttctatgaacctacttattattttattgattttttctattgtttttataatcactatttcattatttcctactgttattttgtttcctttcttttgctttctgaatgcttagtttgctctttttttttttttttaatgtctaaagatagaagctatggttattggttagagctcttcctttaaaaaataagcaccaacattcataaacttctatctgagcactactttagctgcatccagtaaatattggtatgtcgtgttttcattttcatttatctcagagtatgtgctaatattcctgtgatttcttacttgatacattattcaggagtatattgctaaattttctatattttttaaaatttctcaaatttcattaagtgattgatttataagttcatttccttgtggtcagagaacacgatttctacgatttctacgatttaatttctttaaactttactaaggattattttatggcccactatacgatttatcttggaaaatgatctgttgtactttgtactctgctactgcaaagtggagtcttctatagatatgttagttctagatagtttataatgttgctcaagtcttctatatccttcttgcgcttctgcctagttaatttatccattaggaaagtgtgatattgaaatttcagactgcttttgttgaattgtttatttcttccttcaaattatcagctcttgtttcaggtctttcaggtttattttatgtacctattattagtgttatattgtactgatgaatttacccttttaccattttaggacatccctgtttaacttccttttacatttttggtttataggtttattttgcctgatattagtatagttactccaactctcttatgcttactgttactgtttaatggtgtttcctttccctattcttttcaatctatttgtatctttgaatctaaagtgtgtattcgacagacaacatatagttggatcttgttaatttatcctttctgacaatctctgccttatgattgaattgtacaattcatttcaatttaaatggaagtacatataaaacaaggttatgcattgattggttgataaaaatattgtggccagagactcacaggaaccaaattctgtttttccactacatgaaatggctcagtatttgcctatttgaaattgttggtgactttataaaacataactacatatgaataataaaaattgatggtatatacatgtagtatatgcatactattttatatagttgctttctatgtcaggtaagagatgaaaggacaataaatatgcaattatactaccttttataatcatctctatttatatttatttgtattttatgtgtggatccaaatatttgcctgatgtcacttgttttcagcctgaagaacacctttagtattccttgaaaggcaggttagctagcaataaattctcttaatattgatttatttgggaatatttttatttcaccttttttgaaatatagtttttctggacacagttttcttggttaaaaattcttcttttttttctgtcagcactttgactatgccatatattgccttctgaactccattgtttcagataagaggtcagctgttaatcttttgggatcccctgtacatgataagtctgctcttttgctacttacaagattttctctcttaattaatctacacatccagaaagcccaaagaactcaaaatagaataaaaatgaagagatccacacctagatcaatcagagtcaaaatgttccaacccacttttaaaccctctgtttaatattttcactctaattattgtactttcaaccctggacttttcattaattcttcttctataacatctagctctttattgacattctctacttaataagacaatgccatcatacctttgtttaattatttaagtgtgactttgtttagtttttatttataatatctcctttgcagtctttggctgataagtacaatatttgggtcctttctcttgccattttctttgcctgtgtatggctgtgaattggacattttagaaaatacaatgcaatgttcagtattgattctccttcccctaccctggacttgtttgtttatttgtttagtggcttggctgactgttccaatgcagtctgttttctccacagtgtgtagcctctgaagtcactgagcagacaatggcagctttaggcatagagtgcagtccccctgacaatctctcccccaaatgacagtggtttcagcttggctgtcttttactgtggactcagagtccctggggttcaacttttgattttttgacttcacaatgggtttatcaggatgcaacctcatcgtaagtcgagaagcatctgtatttctcacatcttccttttaattttctggttggtctgtctctcttgctatcacactcagctattagactccattaatttgtagctgattgctctattattttagagaatacctcagggcataagttgctccacagtttgctccaattaacatctcagtccctttgcagatgtagtctttgaggacagttagtgagctttggtgtgaccagaggtgttctctttttagcagcctttttccttgattctctctgttaagcgtttcaatttttactatcgtatggctataaacctccacttaattgcttacgaccaaagtcaccattgttttctatagcactgttatgcttttttctccatactttgttctaaacatctccatgatttattctaaataaagtcagcctccttggggacagctacaaagctctctgttcttggtctgcctctgtccctgggcagaatgtctgcactacttctccgaagaacagcttccacttatcttggaataacatagctactctatgagtggagtgctgggttgggatgacagcctctggttctgtaggaatactttcattctataagtgagatggatcaaaatgatgggacccagaataataagctcactgcattcagagtataggttctgtcctacaattaaggttagatggagaaaggaagcctgagatctgttagcattagaatagagtttctgcaacatatacctagggcagaggaaaattgctagtttgggatcttcccttcctgagaagaaaccatagcactagactgggctctgggagaagatggagacacatcttcttggttgtacttggacagagtagagcttctcttccactgagcctgaggggtctgagaacaattgtaactcaattgtcatggtctcttactgttcttactgagatttaatatattttcttaaaaattgtttcttcatttggagtattccctttgtataattttctaactctactatataaaccaaaattttcagtgaattaaagagttaaaagtatatatctcataaaacgttaatgtaatttgtaataagaaatgcttctaatattagatgttagaagaggagaagcaaactttatatgctgtataatccctttaaaaatattaatacaaacattgctgatgacatgataaagtgaaagaaatttttaaaaaacatctgccaaggtgttgaaaataatatttctaagcaaggtgattaagggtgacttgtattttctttgacacatccttgcatattttccaaatcttctatggtatacatatatgtctataataattagagcaataatccttattaaaaatagtgatgccttttttagaccttacaccgtgtttaaacaaattttactaattgcttggtggctgctagcatgatcattttttccacagtcttctgactctacttttgctgactctgccctgatatttcatcttgattgatacagtatgtgatctactccagtcacctttgttcctccattcattaagggaagcatgaggggaagatgaaattcacacctaggcagttattttcttctgctttattctgactccaaactgctgcagctcttgcaggtcacatgcagctctgagagagattcagtcagctcaccttttaagcccagaggttctcagactgtatcaacttttgaataacttagttcaatctaattctatttttttcctgtaaattcaagtagtcatcatgatttctatgatttcttccatgagaaactgttatattcaatataccttatatagttattgttatttacattccactataggaacataaaaactgtagtaggtcctaccactatttcaccttaaattgtattctgtcggacaaaatcttccatcagcaccttctttatgttgaactcataaaatatggcagtctacaaatctatttatctcttcttaggtatccattagagaattggttttctatcactttgaattttgctcaataacacccctcaaattcaacaaagctaaatcttaaaggtaaatgaaagtaaagagagaccaaaagagagacatgtttaactcacaaatgaaatatctaaaaagattttcaaaaaaccagatactactatatacagctaattggagaaaaaaggaatagactctctttatttgtgagtctaaagtcaattttaaagagctcaatacagaaaaatttgtatatagatgtaaatatttaaatataaaattttgtcaaataactaagatgaaaattatgtcttaacccctgctatgattattaaatagcaaagtaaggtaattatagatgatgttgtcaccatgttttatgtttattaaaggtagcattttaattttaggttaaatatacaatgtaggagtatagtagtttatgggctttaatgcacattttatgaaatgttgagtctgtttgcatagtcactgtgtatgctacatttaggccaattttatgggacttgaagaaccatagcactattttaaatgataatgctggtttatagggattgtgcttccttttacgatatcagtgattgatatatttaatggctaatttttgatgtacttcaatgtgtaaaggtagaatacttatataatgtccaacatactgtgtggaattattcacacagctgccgcaatttgtttatttaactacaaattcaaaattactttcctttcctttcttctttccttcttttttcttttcttttcctccctccctctctctttctctctgtctctcttctcttctctcctcttctcttctcatctcttttcttttcttttcctttcctccagagtctcactccatcacccaggctggagtgtaacggcgagatctcatctcactgcaatctccgcctcccaagttcaagtatttctcctgcctcagcctcccaagcagctgggattacaggcacctgccaccacacccacacctgccaccacacctgccaccacacctgtatttttagtggagacagggtttgccatgttggccagcctggtcttgaactcctgacctcaagtgatctgcccaccttggcctcccaaagtgctgggattataggtgtgagccaccgtgcccggcctcaactacttcttttaagcctatagtatcaggcttctgctgatggaatgaagaattcattgggcttagattcaggagaactgaattaaaatcctgtatgtttgggcaatgattaactagacttttttatttcagttcttttctcttagtgagacaaagctgcaaatttgacgtaaaaagtccaagctgtaaattctggctctatcaggtgttaatgggtatttgacattggaatcatttcttgatttctatgaatatcagattcagtttgtaaaatgtgaatcataatatatatcaccttgataaaaacatgaagtaatgaatgtcaaagtgttttgtaaatggcagagcattattctaacttttgtacatagcacatatatatttagtgcttatttttatgctgagttcccattctcaagtgtgacatcttactggaggaggcaaatacaaataatatccatacaaagagtcagataacatacagatgtacaagtattatagacagcttgcagagctaagcaagcatagaagacttgagtaaacaaatggcatttgaggtgggatttaaaaagggaagaaaaatgggagcaagaactacaacagttgtgtagtggtgtgaaattaactttggctaaagtagataacagtaagatataggcaaagacatggtagaaaatgaggtttgcaaagcattttgaggcagacagagagctattaataggagtttggacctttttccttggtttagtggggagctgttagagctctttaataattctccatccagattatggctggttgatacctatgacttacatatttttgacttaatatcaaatggcaataggaggtgccgggtggttaatcctgatatggtttgaatgttggtgttccctccaaaattcctgaaattgatattgaaacgtagtcccaaatatcaacagtgttaagaagtgaggtatttgggaggtgattaagtcatggaggctcctctcgcagtgggatttaggcctttataaacgaagcttcacatagcatttggctttttcttccccttccttgccttctgctgtgtgaggacacagtgttcaagacaccatcttggaagcagatactaggacctcatcaaatactgaatttactggcaccttgatcttggatttcacaaactctgtaactatgagaaatacatttatctttttttataaatcatataatcccaggtattttgttacagtatcacaaacagactaagacaatttctaaaatctggcaccctgagctcaggtgtcagtttaataaaccgagtgtgtgtaaaatgtggaagaaaaaaaaacaccctttagccactatgcttataattatttaacagttaaaaaaaaggcacagtagttgtctcactccgtttgggctattataagaaaatgccttagactgagtaacttgtgaaaaacaaatttatttttcacatttttggagcctggaaagtctaagatcaagacaccagcagatttggtgtttggtgagggcttgctgcctgcttcaaatatggtatcttcttgctgtgacctcacatggcagaaggagcaaaaatgttccctcagactttgtttataagggtactaatctcattcagggttttgccctcatgacctaatcatctcctaaagatgccatatcttaatactcttgcattggagattaggtttcagcctgtaaattttgggggaacacaaacatttagaccgtagctgtagtgaaatattgtcagtcaagtaatgctaaaagttttgctttttttttttttgtttatttttaaaaacatttttatagatagcatcttattgtgttacccaggctggagtgcaatggcacaatcttgctgcaacgtctgcctcccaaactcaagtgatctgcccacctcagcctcctgtgtagctgggactacaggcgcccaccacaacacctggctaatttttgtatgtttttgtagagacaggtttcaccatgttgcccaggctggcctcgagctcctgaacacaagcaatctgcccaatttggcctcccaaagcactggtttacaggtgtgaaccaccacatctggcgaagtaatgctaaaagtttataacagcacactattggtgaacatgactgggcatatgttctgtaggcatacctttttagatgaaagtacatcctggcctcattggagtattttgtagatgtccttccaaggatatgcatgaacataaacaattcacataatatgtacatatatatgtttatcataaagagtgaatgcaaaataaaaatgtatggagtgaatatttggcagagtacatttacttatttagtttacataattatacctcttgctcataaccctgacagaacaggtctaattttcattaagcatgactacagttttcctacactaatcatattaatgttatacttgttttgataccaaataaagtaattaggttgtttttgatggtagtgaatataatatgtatattaacaaattggcatctgttttatttcatttttcatttcaatttaaatgtaatcaaccaataatgaccctagtaagctagttaataattaagataagcattcttccactaaagttatatagtttatttcaaaacttatgtttaatacatttcaaaagatattaatcagaaatgttcaagagaaatggatattctgagccaattgttgacattctaaatccaagtacattaacagcaccttttcaatcataactattgcatcattagtgcacagctacatagtgctaattactttatttacctctacattgaatgaatgctgttaaacctttttaaataattgataatttattaaatactaatatatgcaaaactgaactatacaagtttttccaaattatatctgccatcttttgattatataaatacaacatatactacctgaatgcaaaattaacatattatatttttattatgttaaaacatatgtaacacacagttttccattttaaccattttaaacgtagagttttcagtggcattaattatattcacaatattatgcaaccattaccagaatctatttcagaattttttatcaccccaaacagaaactatgttccttaaaaagttaagcatacaattaccatatgatccagcaactctgcttctaaaaatatactgcaaagacttgacagcagatactcaaacagatgctggtacacatacatatgtttaactttttgagaaacagtgtaagtgttttccacagtggctatatcattttatattcctgccagcaataaatgaggattccactttctccacatccatgacatgctaacatgtgctattttcttgttttttggtttttttttttagtacagtcatcctgttaagtgtcaagtgatatctaattgtgtgtgtgtgtgtgttttcaattttagtttttgtgggtgcatagccatatatatttatggggcatataagatattttgatacaggcatacaatgtataattatcacattagggtaaatgggctattcataacctccaggatttattctctgtgttacaaataatccacttatactctttcagttaccattgtgattttgaattgcattttcctaatgatgaaaaatgttgagctacttttcatatgcttattggccatttttaaatctcctttggagaaatgtctattcaagtctgtattcatcagagaaaaagaacccataggagatatatatttattatacaaattatacatataaatatatataatataaatctataaaaagagatttattgtgagggactaacttatacaattatggaggctgagcagtcccatgacttctgtctgcaagttataggcacagaaaagatgttggtgtagttggccagttcaaacctgaaggcctgagaacgaggtgcactgatacctgatgcaggagaaggtggatgtcccagctcaagcagagagcacattcagcctttctcatttttgctctatttgtgtcttcagtgagttgggtggtgcccacctgcaatggtgaggatgatcttctttattcagtctaccagttcaaacactactctcttgaggaaaccccctcacagatgcacccagaaataacgttttgtcagctatctgggtatctcataatgcagtcaagtttacacttaaaattaaccatcacagagtcttttatttacttttaatttgctttttgtcttcttgttgttggcttgcataagttctttatatattctggatatatattttaaatataaccatatactttttcccttatcaggtatatgatttataaatgttttcctccactctgtgggttgtgttttcactcttctgatggcatctattttgattcccttatttcctttagtttgtgttcagctagtgttttgatatagattttcttgaattccaagtgcttggaaacaaaacaaaacaaaacaaaaaaacacctctcagtgtttgacgattaattctgtgctgggtcactcttttaagatttagccagcccagttaaagctctggcccaacctttacttcctacttgtgctgagtgtggacatcagccaatgatgaaagcttaaggttttcttgggtcttttttgagcatgcatcctatcctagtcatgttcttggtttccaaattccccagtatatacaggcacttttgagtgttctcatttcccaaagaaattaccttcctggctttttctcccaagatttaggcagtcagttgtgtgtcttaatggtaatctctcttttacctcagttggctgcaggttcttcatttgccttccctttttgaatagcaccttctgtctcctctgctcttggtgggatccaagatatgaaacagaaacaagaacattatgtcagccctcaggtagcacccaaacaggttagaacaaagaaacaattatttttcaataaaccctgctctgctccttccagaaccagaggccagggttccatgctgagaacaccggttaacatcttcaggactgcagcaaagccatggagaggtgtggataagggcgagtaagaatgccacaatttttggctaccatttttaaattgcccccttttttttttttttgattcggcattcatttggttactgtatacttttgactgtttctggagttctgacaaagttggttttgacagttctgcttgttttaaatgatttttgtgaaggcacagatgtttggagctgcctaatctggtgttttgtggatattgctctcctttactgtaattttatattccaatttaagttaatggaattaataagtaaacctgtgaattataagacttgcattacacaaagtactgtaggacgtatgctggtggaagacggaccctcaagaatttgagaggtagatatgacctgcatatacatatctattacagcaggtagtttatgacctgtagtaaatcaggggagtcaggaaaagattaataaggataacttttaaggtggactttgtagcttaactaggatttttatagttagtgataatagggagaaaaagtttagctggaagaactgaatagaatcctgttttatgagtatgtaggctatttgtagagttttggtggaagatagagccagatgatcataattagttctgtctcttatttaaaagacaatgaaaataaaagcttttaagcaaagaaatgctacgatttaagctcctgcttcagaagattagtttggcagtgatgggtagaatgcattgagcctacaaaatgtatattacatacataaaattatatatacaataaatgtgattatattaagacttttgaaatctaggaactcttagtttaagtcaataaataaaagatttgcttattttaaaacccatctaaccattatgacacctaagatttttaaaatactaggcaaatgcagttaaaaaacaaattatgttaaatttagcttcagagtatgtttcaatgaaatatgataaatactaccagaaagttacttattaaaataccatttagaatccgcaatacaaataatcatgctacaagccaatgcttattggatgcttcctatatgccaggaaatatatgatgttaatttatatatgctttctataagtatatttttctaagtgctttatcagtggctgctcatgtaactctctgttacacgtctgccagcctgtcagttaagtaccatttttatcatatcattttatgaatgaggaatctgagacttctataaattagggaacttggcttgccacataaccagcaaatggtagagctgggatttgaatccattcactcaggctcacagattttgaccttaactgtcacatagcactttctccctttttaacagttatcaagaatctagtattgaagtaagatgtcgttaaaaaaaaaaaaaaaaacacaaaatgtgtaaaaagagacattaagaaaactaccatagtagtgagaaattacaatagtctttttgctaagtcctcaatagattagataaaataaataaaaatttatagactttaaatataattaatagtagcaagatattcatacaatagtagatatctatcataggtctgtaatagatgtagatgtatttgtatattaaacagattatatatttatagaatatatatcccaaactttctattcatatatttaaataaataatatagtttattttcaagtgcctatagaatatttacaacgtgaaaaagtgataatatcctagggtgaaatgttagtatcaaaattttaaaaataatattaatatgcataccacattctcaattttcactaacacaaaactagaaattaatagcaaaatgttaaccaaaatacttaataaaatgacaatttattaacatgttcctaaagtaggtctaagataattttaatatgtaattatatagtttttgattaaaggaaatggcaatattacattccaaactgcaaatgatgatgagaaaagagttctcaaataaataccctaaaggcttttataattaagtaaaatagaaaagaaataaatagagtcatatcaataataatgtagcggggaaaacagaaaattcacctgttaatacattagaaaaaaaatgatgaatctaagaataattatttgatagggagaggaaaaattctaccaaaataggtgagaaaaactctggaatgtctaagaaataaatacatggaaagagaaaaattgaaaacacactgtgtttatcaattgctttataactatttactccaagagttagcagcttgcaacaaccatgttttttttcacatggtttctgaaggttaggaatctggtggcagctcggctgggtggttctggttaacgggttcttgtgaagttgccatcagtgttgtttatggttgcacatccaaaagcttgactggagattgaagatctattttcaagcttacatggcttgcaaacttcttcagtatcatgtgggtctcctcttcatacagcttcatacagcttctcatgatatggcatctggctttcctaagagtgagtgatctaagacagtgagggagatatatatatatatatatatatatatacacacacacacacacacacgtatgtatatacatatatatacatgtatgtgcgtatgtgtatatatacacatacatatgtacgcatatacatatatacacgtgtgtatacatacgtgtatatacacacatatacatatgcgtacacatgtgtgcacatatgcatacacatgtgtgcgcatatgtgtacgcatgtgtgcacatatatatatatcagatgatatatatacagaaagtgagagagcagatacatataaatcttcaaaaccagtccttaactaacaggtctcctctcacacacaaatatatcctattggacctttcaagtatattaacttatgtagcaaaaaggacttgcagatataattaaggttaataatcagtgactataaaatagggatattaacctagattatataagagtattggtgggatgtagggtatgatcatgtgcatggagaaattttcttctgctggagtcaggagaggtatagcagaaaaagctagaaaaattccaatgtgagaaaaatttgtgtgccatttggggcccatatgaaaggcttgaagagaggactctaggagttcagggtggcctctggctgacagacaggaaggaaagagaaccttcattcttcagccacaagaaacagcattctgccaacaacttgaatgagtttggaagtggttttgtttgtttgtttgtttgtttgttttttcctaaaacctcactataaaaacccagctggctgacaccttcatttcagccttgacaaacccacagcaaggacacagttagctgagcctaacaggacttctgacttttagaactgtgatataataactgggtgttgttttaagtcgctaaatttgtgagaagtggttacagtagcaatggaaattgaataccatagcatatacttactctcaaagtgatatgccctctcttttgctatattatgttggtcagagaccaagcagggggatatgggagggaaccatacaaagatgtgaataaaactgaggtgagatcatcaaggactgtattggaggttactactatcctctgacctccacaatacaaattccctcacatatgaaaaatacacacactgccccccaggattccccaaaatctcatcccattttagcatcagcttgaggttcatatgctgttatctaggtccaggcatggatgagattcctggagtgtaggcacttaaatacagttccttggataaaattacttaaatacagctccttgaggatatttcctctctatctagagatagaggcaggttactgccccccccatacccaatatcctggcagacaacagaggataatagttgtagacattcctgttcataaaggcaaaaaataaaaggcacaaaggagacataggtccacagcaattttaacatccaactaggcaaatattggcagttcttaattgttgccaactctgattcctgcccccaaatgctctctgtatctttttgtttaagattctgggtttttggtttctccctttgagttaccctttcttttcatgaatggtagtgcatgttcacactgagtaatttttatagcctgccttcttatttatagatttaagggtccaaggacctctttttattttgtactgtcactgttcttttcaattaaaactggcgattctggtgacataatctgcatacaactttgtagatcttctgtggatcttgttaaggatcactccattgacaaaatttatgtccctgcatcttttctatataagcctcttctctaccctcttccactgagatggctgagatactatactctttaccttcttggaatctctctctacttttttttgttgagaggatttatgatgcgcacccttaaattctttatagggctttttttttttcaccacagagtactatgagacaccccttttaacttttctggagtcttaacaaaggcttttagagtcacgtcattggattctactaattctatccttgtttcccgtcttgggacactggaaatcttcaaaaccagtccttaactgataagtctcctctcacattttactctaaacagagtatattcaacatttttaatggaaatttcctcagctggatcaccccatttgttaggtacattttccatcttccacatcactgcaagtaacaggtttgttggacattttgccactaagtaacaagaatattctttcctcaaatttccaataaaattttcctttctttcccttaactgttcacaggcagcctcctcaacgtcaaaacttttgctaacagtctgttcgaggttttcctaaaactcttcttaaaacccttctacctacttcctattgcctggtttcaaaatgattccacatattaggtatttattgtggcaccacactacttccaatttctaaattttgtgttatttgtcaattgctgcataataaatcatccccaaattttgtggttttgaacagcaaacatttactgtctcacatagtttttgggtactaggaatctttgagtagctgagctaggtgctgctggctcagaatctcttgtgatgctataggcacattgttttctggtgctgcagtattctgaatgtgtgattggggcaggaagatctgttttcaagctcggtcctgtgactgttggcattaggcttttcactatgtggacttctccacagtgttgtttatgtgactctgaatagtcacaatgggggttagtgcttcaattcacaggacttcctataagaaaaaaacgatagggcatttatgctaggggagctggctttcctcgggaagtaataacagagagagagaaagagaaagggagggagagagagaaagagaggagaaataaggacggaaaataatatctcttataagctgtctcagaaatgaacataccatcacttctgatatgttctattggtgacatattctattggttacagtgaccaaatctggtacaatgtagacagggtgtacagaagggtagaaatagtaggaggtggggactcctaggagtctcttggaggctgactactacactacaacttctggcctccaattagtcatgtctctctttttaaattaaaaaaaaagaaatgttggggggtatggaattatactttataattcaggaatgtttgtctcagggaaattaagactcttatccaagacattaccaagacaattgaaacctaacccacctgtattgttccttttcctactgctataaagaactgcccgtgactgggtaatttataaaggaaagatgtttaattgactcacagttctgcattgctggggaggcctcaggaaactttcaatcatggcagaagtcaaaggagaagcaggaaccttcttctcagggcagcaggatggagtgagtgcaagcatgggaaatgccagacacttataaaaccatcagatcttgtgaaaactcactatcatgagaacagcatgggggaaaccgcctccctgatccaattgcctctacctggtccctcccttgacacgtggggataatggagattacaattcaagctgagatttgggtggagtcacagacctgaaccatatcgccacctaaacctcatgcctcacctaaaatcttatgccttttctcttgcaataaaataggataccctggagatctgctatgtatagtactgttttccatagtacataatattcctatactgcttgagcttttgaaattgtctatctttgccagtttttctttatctcagccttcaatttctatcttacctcactggaataagtgttccagatggataaattttctctccacccttccagattactatgtttttgtttgcaataaacatgtatggcattgcctatagcatcatgaaagaaccagacttactgaaatcgcatgaaaactaagtgtaggccaggtgtggtggcctgtaatcccagcactttgggaggctgaggtgggtagatcacgaggtcaagagattgagtctggccaacatggtgaaaccccgtctctactaaaaatacaaattttatatatatatatagaatatatgtgtgtatatatattctctatatatatagaatatatgtgtgtatatatattctctatatatatagaatatatgtgtgtatatatattctctatatatatagaatatatgtgtgtatatatattctctatatatatagaatatatgtgtgtatatatattctctatatatatagaatatatgtgtgtatatatattctatatatatatagaatatatgtgtgtatatatattctatatatatatagaatatatgtgtgtatatatataatatatatagaatatatgtgtatatataatatatatagaatatatgtgtatatataatatatatagaatatatgtgtatatatagagagtatatgtatatatagaatatatgtatatatggagtatatgtatatatatagaatatatgtgtgtatatatatagaatatatgtatatgtatatagaatatatgtgtgtatatatagaatatatgtgtgtgtgtgtgtgtatatatatatatagagagagagagagagagagagagagagagagagtaagctgggtgtgatggtgtgtgcctgtaatcccagctacttgggaggctgaggcaggagaattgcttgaacccgggaggcggaggttgcagtgagccgagatcacaccactgcactacagtctaggtgacagagcaagactctgtctcaaaaaaaaagaataagagtaaatacgttctgagtaaaaatctatgtgggtcttcctgtattagactgtttaggttgtcataacaaaatactacaaactgagtggcttcaacaacagaaatttgtttctcacagttctaaaggctgggaagttcgagatcaagatgccagctgactcacttcttgttgatagctctgttcctgttgtgtagatggctgccttctcactgtgtcctcacttggcaaagaaagtgagagagccttcgggtttgaatgctgctataagaatacaaatcctttcagatcagtgcttcacccttaagaactcatttaactctaatcaattccttattctaaatcatgcttgaatgtatgagtttgtgggggaatcaattcaattcataggacttcctataaggaaaaaatatagtgctttgactttgggatattatagtattcaaggagctctttttttccaatgggggttttgtttctttacattatttttctcagtatcaatccagacagtgagtttttcatatatttatgttcccaataattaagttactgattataatatggagtttcattattgctgctattttagaaatatgtatttcctgagtttcaggttcaaaacgtttttaaaggaaaacaaaatacactcattaaagagattaatagcaatggaagaaaatgaaaatagcgtacctataggtggacttgagtttgttttcattcacttaagtagcttcttattagagggtcagattggttttatattaatgtgaagagcgcaacaaacccattatatataatagatttatattatacaaagccactgatatattgtggtagattatatgaagctattctcatcattccccttctagacatacatacacacatgcttatatataataatcaaatgagttagttgacaaaaggttttaaagtccgaatttaattcatgaaggtatccattttcttggattaaaattctagtttctgatttttttacatttcaaaaacactatacctttttctaaattatgtatatttttctgtttgtaaggaaagtgtagagcttacaacagagacatagagaaaatattgactatactaaagttagcaactgatatatgttatagatgaactgtaacaaatatgtccttagtgaaatataaaatgatgttgttataataacgttagagttctagttagtactacattcaatttgtattcaatttgcgacaatttaaaagttattaacctatattctaaagttagtaaattattttacaacagtaatttcaacaatggaggctcccatgtgcccatgtatttggatacatttgtctgaaatcattttaatgagcaattaaaaaactcacaaaatagtctttctaatatttgctctcaaaacaactctgagaggtcaactgtttaatatgtttaatgtaatatctattatattctcaattttaccgttcttactaatgaattatgttatgattttattgcctttggaattgaaagcaagataaaatatgctttttgtgttttatacttacatacaacaaagttttgaagtattttttagctctgaaaaggaatgataacaatgactatttggaaataaaatatatcttctactatagaaaacataagcaaatacaacttgttaccaaggtatagtttctggtgtgtgtgtgtgtgtgtgtgtgtgtgtgtgtgtgtgtgaaagacagagtggtggtgtctatgacatactacggtatatttgagattataaactaacaaagcaactcaaacacttgacaacataagagtaaaagataactgaacatgagatgacaattggaaagttaaccttgaagtggtctggaaaattatattatttgctttgtttttgatttgtcaatggagaccaacataaattttccatgtaatggtaagtcattaaaaagtcataaaatatagtttaatagcattgcaattattattttaataaatgttacaattactataatttaaaatacttgcctgaaattaattctaatcatccaaaatacaacttctaatgaaattttcactcttgaatgtttactttaaatcacattgtcttccatatattcaatacttttgggagcaatgctgtggaatgtagaataaatatcagttgttgctattgaaaattgtgaactttaaaaaattttaataaagggataagattataactttttgcttatgatttgtaaaaaagaactgcagtaccctgttttacaaatatatgattgataacattatttggaaatgctatatataccaatcattttcaggtcatttgaaaatttcatgttttaccttaaaataagagaacaaatttaaagtgagccaactcaagtttattaagaaaaagtttgaggcagtttgtttttcagaataataataataatagtattatagtctcagattatgctttatgccaaactgtggtattgtcatctttggtttctggataagattttactgatgccttaggtattattttaataaatgtcataatttattataactgcttaatgcactcaaaattttgcaaagcttcttatactgtataattcagactaaaatttaacataattgtgatggtactttgaaaggcctacaatgttccatgaaagaagaatctgggggcaccaatcactgcattatctacaaacaatatgagtttttgtatcaataatttcacactttccccaaagaaagtcattttttcttgagtatcaacaaaattttatagtgttcatttagcttgcttgtcatttcaacattatgtattgtgtaccatcacaatagggggtgttgaagaagcccattacctactattcttgtcctccattgttcagagcataatgtagatagaaaatgataaaaacaataccttagattcctaagcatagggcatgatagtaatatcatagtagtgacattggaacccgcatgcaagtcattataaattcctgcccttatcatatacatcatacatgaaaatagaagagataatgagtgcaaataaagaagtggaactgagtggcattaatctcagtattgagagattttgtgagtagtacagcattcttttcatgtgctagctgaagttcccaatggcaaattgaatgctgcttatatcattatatgcatgaatgaatatgattgaaataatgcatatgttattatatcaaatccaatttcacgaatattatcaaccaactaaaaagtctaattgctgattagagaacttattatggaggttcttcttaatatgcttcaaattgacattgcatactggactatgtctcatttatgatttagggaacaaaatgtttgacagtgtgcacacacacagccatagtacacacatatgtctatatacatccataagtgcaaccaaatatatacaatatacaaaatgctatgcagtatatcagagccttctctgtgctcttcaaacttggaagaatggatagcaaagctcacataactctccaggaccacattttctcacttcctctaccttagtaaaacaattccacgcatggtccttgtctctgttgtacaatgttgtgtctccaaaacccagcacaaggcatgggacatgggaagcagtcagtggatcaccttagttcaagaatcctctgcttcagtcatgctttatggggccacaggtgttttgagaagatgctttagttatagctttaatgaagcaaagggtgcagcagagaaaagccaacatccttaccatgatcctaaggcagatgccctccctcacctacaactccttctccaaccatatatgccatcactgtccccatccctctctctagtgctgacgccactagcctctgcagctcttccaaataagcttatgcctcagtgacgttactgtacctggaaatcccttccacagatatctacatggcttattccctcacttcattcaaatctctctttatgaatcatcttattagagaaaacttccctgactacctacttaagtggtaccttccaatacctttttttatttattgaactttggtaagtttaagcatgtcttaaatatgtatttgcctattgtctgaaaaacacaagcacaataatgtaagctctaggagaggagtagtttgtcagaattgtactctgtcttactgcttagaattgagtgtagaaaatagaagttcctcaagaagtatctattaaaagaatgaataaattaagaagtgggtccctaacatccatgtcaagaaatttttggtgttgtttcattttgtttaacacaattgacttctaggtaaaatttcttttgtaataaattttctgtgtctaaaaatagtttgaatttttaaagtttgatttattaaaacctgtattacttggtagcacaaattctatgtatttttgatgatactgaggataattctatattaaataagcttacaaaagcaaaaggaaaatagtttgtaaaaccattctgacattcaaatactgacaaatctatttgcaaagataaatctaactttttgttgtagcagtagggtcttgataaaaatttatattattttgccagtaggctcatataaacctgaatctgatactttaaagcactttctccaaataaaattctacatagatctttgcacaaaagcatcaaagtcaagtggacagaatttagaagctgaaacaatgaaaacttctggctgaatgcaaactgggacgataatcagcactcttagggtgtgtgggcaaagagagagggaataaaaggatggagtacgcaaatggtaatcattctcctaatcaattctatcatatggagaaaaatagaaagacagacaaggaaatagcagaggctattgaagaccggccatatcttcatgaactcagagaaagagcagagttatgcaaggaatggccctccaacatgccatagcctgcacactagtgaatttgctatattctatgtcatggatactgataaatccaattgacaactcctctttctatatgaaggaatgagaaaaaggagttgttttttgcactgtgatgaatatgcactcgatatgtaaattaacccaatgattaatacaaagcagggagtagtagacgcttaaagaatagggaggcttagtattcctatgggaatacagacaaagagactttgacttttctagggttatatggaaagatttcaaagagaaagtgagatttgaggtagacagtgaaagttgggcacaatttgaattgcccagcgtccaggaaggcattttaagatgaggaaatattatgaactctagaggagaaatagtcaaagaacccatgagtatgtaagattggctggactatatttttcccaccgtttatttcagtttttttctatgtcatgtattgtatttagttataattaactattcaattctctcttatatatttgtcaatataaatatttgtttaacatacatttaaatataattattctaaggggctgtattttagattatgtttatgtttatacattagcttagaaaaatactgaaatccacaaaaaatagtatattttaagtaaaaggaaattaaaaccatataaaatgtcttattgttaaacttatgaaatactagaacagttacaaagaaacaattaaaatgatttgttagaaaacatcagtgacagaaataacatatgctgtctggtagaaactttacctccaaacagctattttcatatcgtactttcgtatttccttaggagacataataggttttaaactatgccttattactacgttgtgaagttgggaaaaaagaaaatagactgtgtatgtaactatagcactttaataaaacatagtgtaagtatttgtctaatttaataatgccaattaactgaaaacagtttctagtcaatttgtctgcctctggtatagcaaaaaaaaaaaaaaaaaaaaaaaaaaatctaagaaactatcatatgtgtttttaaaataaagtttatattttatgttaaaagagggaaaaaacaaaatgctacaaagcatttatttttattgatcttgagatctgagcaaatttatactttatgggaatcccagtagggaaaatagaaggacatctaaagttcatttcctcaaggtgggggaagtcttcttaatttgtcttgcattatatttattcacatactcatcagctatttattaattcatacatgtatttgttcattcattcagtttagtctaaactttgactccttttcacctggccctgtccttggtctaactcgggcatgacactttccaatttcttctgcaatacctactgcctgcctacctcattctgcctttctcattagatccgaattaggacctcagaagctcactaacctgcaggatatagacagtctgaattttggatctagcaatcgtgtaatttagatcttgtttaatggtccatgctacctatgctttcaatctcagactgattttctgataaatcaagttaaaattaaacaagtttgacaaattaagttagactgtatcttttatttccaaattcagctccctaaatactcattcataaactaatataccactattcatatttccatttttagctttctggcttctgcctgagcctagaatcctaaactcggacaattgtagctttgtccacttggccgatatttaatttctcaattaagtatatatttggcactgtgatgaagggactgtactgggatctgcacacattttcaaaaggtatgcatgcctttaattcctaagggcttaaattctaataaatggcataaaagcaatacataacagaaaaactatataattataaaatataaaatatatatatacatatttatattataaaaatataaaattttaatataaatataaaaataatagtgtaaatataaacatatttgtataaatgttatatatttataaaatagataaaatgtaattagagtgcgttataacaaactttgttgagtggaaggagataatgtattttaaatacatacatcttatacttgcaaaaactaaccagctgaagtgggagaaaaaagggattgaaaatctggggatctgaaatgattgtactgtaagatagataaataattagtgagataactgcctaaactgttccaagagagtgtttttaacccctttaaataaaccaagattattcatacaaatgcatgctatgagcacttgataaagctaacagacagaaagtcagtaaagatatagaacttgaacagcactatcagccaaatttccctaatggagatttatagtatactccacccaacaacagtagaatatactttcttcttaagtatacgtggagcatcatcgagatagactgtatcttgggccataaaacaagatcaataaaattaagatgatttaaatcttacagagtatgtttcctgaacaaaactgaattaaattagaaatcgataaagatatctggaaagtctccaggtgcttttaaattaaacaacacattttaaatagctcaaaggttaaagaggaattcacaggagaattagaaataatctgaccagaatgaaagcataacatatcaaaatttgtgggatagtgttcagcaaggttacagaattcaaagtcaacacacagaaatcagtcttgtttctatatactagccatgcacaattgtaccaacattttagatttttttaaattaaaaaaaaaaacattcaaaatagctcccaaaatataaatacacaggtataactctaacaagacatacaggatctgtatgttgaaaactacaaaacacttaagaaatctgagaagacctcaaaacatgaaagacatacagggtttgtggtttgcaagtcacaatatggttaaagatgaaaattctccccaaattaacaagtagattcaatgtaattcctatcaaaatttcagcagtatttttgtagagatggacaaatagttcagttgtgtagaatgtggagttctactattgcagctatggaagtaggcagtgcaaggctgtgcagctaacaggccggagtttcaaggctttgaactggatctaggtttgtgctgggtcaggttgtgggatagtgtcatatgatgaaactgttctgcaatagatttaatatcaacagggaaaatatgtattctacaatggattgagactgctaggacaataagaatgattctccaattagttactgcttgttttgtgggccctgactctgtagcttgggcctggacaacactaagaacacagtatccatctttctgccttttcatttatcaagagtgagttccctaatgtttacttgcctatgatcacccttcattctatatccccattgtctgccatacagaacataaaactaactcagtttgcggaatggaaaagcaagtgccagttgcattatatctacatttatgtctacgtttgcattatcacatggtgcgttatcatggggttttcctgcttttatttttcaatttctcttgcttctaaagctctaatttgatcaatccatttgagcatgcccttactaaaaatacctattccttatgacccaaccagtcctcatggcttcaggatagaccacagccaggaacagtcatatctgaaccactatatttacgtaagatatgacttctagtggaaacaatttctgatggaataatcaaaattctacttccttaataggcaaataaagagttaatactattaatatttagccagcattttgaaaattgtataatgttcaaatcgatgtcagacattttcattttatcttgattatacataaatatagggagtatatatgatttgcctgtagttatgtaaatgacagaaatggttaatgagcccagagtccaagcctagtattctttttatgaaaccttaggaagtacaatgttattaaatagtcatagcagtatatagtgttcatattgcaaaaaaataaaaattgccttgattttagaatagccactaattttatatcatatttgcattgatttcaataatttatatattattcctgagtgatttcagaaaggatctgacatggggtgatctttatgtctactagaaaggtgtccaatctaaactgagtaccttcccctttgacatttctacatctttatttgttgcttcaaaataagggtaattagaaatgtatgtggttacaaatggcagattatataaaaataatatccctagaaatgtgttttatatttacctttgaatattaacatatctaaatatgggtgctaaacttcccttagctaaaatactagagttgtattattgtggagaaagactgtattagagctaagaaattaatcacttttttgcaatacacgtgattcttaaacaatgcaatggttaggggaaccaactgcccacacagtcagaaatctgagtataacttttgacattcccaaaccttagctactaaatgcctactgttgactggaagctttactgataagataattgacacaaataactgataagttaattgacacaaatgtatattacatgtattatatactctgttcttataataaagtaagctagagaaaagaaaaatgttactaagaaaattataaggaagagacaatatatttactattcattaagtggaaggggatcatcctaaaggtcttcatccttgttatcttcacgttgagtaggctgaggaagacgaggaacaggaggagatggtcttgttgtcttaggggtggctgaggaggaggaaaatctatgtataagtggactcatgtagtttaaacccatgttgttaaggttccagtgtatgtttgctcaatatctctaagaagccactgaaaaaagtgccccatatggaatttgtaaaacagctgtggaattttgccgcttgaaccactttgtttcctcacatgaacttgactgatggaaacagcaacagcagtagcttacagggatggcagcaggtataggtctccccagtttcttccttctccaaatccacttatttttttttcttttttttattattatactttaagttctgaggtacatgtgcagaacgtgcaggtttgctacgtaggtatacacgtgccatggtggtttgctcacccatcaacccatcatctacattaggtatgtctcctaatgctatctctcccctagcccccactccccgtcaggccctggtgtgtgatgttcccctccctgtgtccatgtgttcccattgttcaactcccacttatgagtgagaacatgtggtgtttggttttctgttcctgtattactttgttaaaaatgatggtttccagcttcatccacatttctgcaaagggcatgaactcattcctttttatggctgcatagtactccatggtgtatatgtgccacattttctttattcagtctatcactgatgggcatttgggttggttctaagtctttgctattgtgaacagtgctgcaataaacatgtgtacatgtgtctttatagtaaaatataaatccactattttatggtttggcatcctcacattccatttattcatctgaatccatgttttccattccctggtgctcctggacccccgcacttgtcccacgctgcatttctaccttgtcctgatgctctgactgctagggatgaggcaatcatgagtcatgtacctacttagagccagtctgtattttagactgatttaaaaggagagcaataattaatgcaaaattgcctttcctgggacttttaatgggtggatttccaagtctttaccaagcaacacactgagctgtaagaagaaatggcaaagtcagtgtgataattaatctagtggttcaccactctcaaggggacattttgacaattgagagtttatttatttatttatttatttatttatttattcttgtttcagtgattcacgggcactgctgtcatgtagtgggtgcagccaggtaggccaagcatgttgctgcgagtagggcagtcctgcataatgaagacttgttttgtgtcacatcggacttcaaaatgccccatgcatactcataaagaaagaaaaagcctgttaatatattttacaatttttcttacattttattttcaaattttaatttttagcctaaaacccaagtccactttgaaaataaacacaaagccccgtttataaagttttactacatactgttttccaggaatgcaactactatttgaaccaaggtgatattttactgaattttaccagaaccttaccgagaattgtttagcgttgcagaaactcttctccgtgacagtaatgccacttgaatttgaatttcctagacagtacaccttaactgtttgcatttatggtcgtcacagctataatgaatgattccatatgtaggtatgagtcactgactccatcattatgtctcttggtgtagttgggcctgagcatatattttgaaaaacacattttttgatatatattactgactacattttttacattaaagttaggttaatatatccatttttaaaattattatctgttaatttcattttgatatagtagatgggactttaaacatatttgttttctaaaggaacattctttaaatttgatgatttttttaaatcatagaattaaggattactgtttgaagaaattaagcagactagtaccgaataataggtgcaaaaattgcataataagttatttagctgaacaaaatacatgctaattacaaaagcctgatgattggtttgtaataactgacacacttatatgcatcagtcgatatttctatcatgtgtaaattgtgctacatacagatgataaaacaaagtcatataaaagttggccttataatacagatgtctaataggcatataagtcatccttaccaactttcagcctgctgaccagtcgtgtaatgaaaatggatggcacctgaatgagaaaacaattatgtggctatctgaaggagggtggtcataccaaaaggatgaacaaaatacttcaagcaaaactaacagcaacataacgagctaagaagtgacaggcacaaacacaagtggatcatgttgacttgaagcaagcagagtttgagctgtttcactgtctcattgaaacagaagagtatgctcagcgtgaaactaagagacagcttacagagaatgacaccctgcaggtagcagctgctgctgacacccaacgggcagaatatagagaaggtatatttgtttatttatgcaatttgtgaggaattgattgcctgacataattcacccttttcagacccatgcttataactaggaagcatcaaggtcaatatcccagtcacacagtgcaaaatattttgccatatgtacaggattgaatgtaatggcagaagtcatttcaacaggactgctgtcaatatatcatttgcatatgtacaaataatttgttaactatggttgttcttaacatattcacaagtaaaccccctaaggcataattacaatagcactgcctattcaatccctatttttgttctggaaattatacctacattgagcctagttctaggttcaggccaaaaaacaagggatatgcaactttaaggggaagaaatactgactccataaatatccatatagctttttaagaaagatttgcttaataggaaaacggtgttttctcacgtaaaattcaggttttgtttaacaaacatattgaatccaaagataaagtatagtataaagtaataggatgtgcttctgtattgaaatactggtagttttaaattcttgacatgaataactggatatggcatatgtaaatctaccaagaaataaaacagaggtcttaaaatgtaaagacatgataggacatatttatcaccccataaaacaaactggcattttcatatcctaagctggccactttgttgtatttgtgtatgggtcctcactacaaagttctgtccctgatttgggaacatcacacatgagaggtaaaaagcacatggtagatgagggatacaaataccattctgtttatgattctaacagatcgatttgtgatacaaaaaccatgggtagaatttgagaataattagtgtgatacgatgttataaatacaaaggaagtatgtgtgtgatttttttttcaaacttggttttctatttcttacagacagtagttttctttgaaagtattaattagttcactgtttgtgtgattttatgggcaggaggagtgactatccattgtgatggcagtaaaaggtaacgtgccctaatgtagttcatagtaatgacgagggacacatgccaggtgacatattttaatgaaatgttaaatgaattaccaagaaaaaagggaacttaattttcaatatgaaaggaagaggccattgaataaataaagtggaggtgagataacagattctcaaaggattcttaaaaatctgccatgttatatcattctggtcaacagaatgattcatatttcattaactgattatagataaaatattagatcctgttacaagttatgtgtcttacagttcagttattattcacataggtatttcagagggagaaaatgattttccatcctttttttttttttttttacaacattaggggaaaataattactattaaaccttctgtttccattcactggatctgagatgaagtggatttccttacatattcatgactgctttggttaaataccatctattctgaattttattctccatattacagctataatataaaggaaataaatatgctttccttaaatgtatcaatggagcaaaaattgtttttataataaagaacaaatccaaagacaggcaattcagttaatcatataatttaaaggttattgcaaggtcttggataaccctgaatatttatttttccaccagctcactatcttatttgcatcttttcttatgtgttctaagatccctgcaactggaataatttctcttgataaaagaataaagaaaagatttaattatggtatttattattgtattttgaaggtaaatattaaaaatatgctttgatggaatgggctcaagagaaatgggaatgaggatgctagttgagaagacttctcatgcgtcctcctcatttcataagcatagattaattaaattaactagttgctcaccaaagcctgacataagaatgatgaggtgcagaagccactaagttttaatgtgtgttaaaaacagcagcaaaaactgttaggggcttagtgagtatcatggactatctgcaggtgggtttccatggaggaggagcccaggggagccccaaggaagtataaggcggggtggggctcaggaaaagcagatttaaagcttgagagcaccatgctgtgctgatattatagcagagaaaaaaactgattttacctttcctaactcctttctcttcttgccatgaatagcatatatggaattacttttaaatatgtgatgaatacatgtatatccgtgacacatgagtctctgcctgcaaatcagttatgtaagaaatatggcatttccttgtttactagaagtcaagctaatttagacatgactctctttcttatatgtctagctagaaattctaccttagtcattcttagggcatctcttccctatggtggtgccaagttcctggagccttattctacattagtcatcaggagcccttcctagttgttggtcatctgcccactgctgaaataaatgttcagtgtcccagcttcatggtaatgtgccttactttgttgttatacatggaccatctttggatgaagggtgaaacttaggactaggatccagcctctcagatgaatcctgtggtgtttccctctgagatctggctaccttttccaggcaatgcaatagaatgatactaaattctttccttctcacagagcctgacaagcatacatacccctttcctactccaagggaatctacctcactctttctccttgtccttgaaagcttccctaaagccttctcttctttcagagataactagcatgagcttagagtttcataaaagatgagaaacacttctgactccaggtagtttctggtctctgtccatccaatattccagaggcaaggaattacaaagcctgtttccctgcttcactggaaaaaatagggggaaatcaccaggagtataaatgcaaattagtatttcaataaattatactaccattgaggaagaatctcacacatttatgtcaccaggaatactgataatgaaggaattaattccaaaatacaattttaaagcagatacctaatggctaagttctgacaaagagtatagatctgatttgtgcattatgcatgtaactatttcagagacatggaaattaaatcatatttaagacatatttgatgtattatatttactgaaaataataaaattctgtaaaatcaggactgtcaggaaaagtcagaatgtagccactgtactcagttatagaataaaagcagatatatcttggccattgaatcacagtgccttaaaataagatagtaaagtaatgaggaagctctcctactaatgctattctttttttttttttttttttttgagatggagtctctccctgtcactcaggctggagtgcaatggcgcgatctctgctcactgcaacctctgcctctcaggttcaagcgattctcctgcctcagcctcccaagtagctgagattacaggcatgtgccactgggccaggctaattttttgtgtctttagtagagacggggtttcaccatgttggccaggctggtctcgaactcctgacctcgtgatctgcccacctcggcctcccaaagtgctgggattacaggtgtgagccgccgcacccggccctactaatgctattattctaaactaattgccctttctaggtttgcctgcctggattgtgttttttaaatattttttcttatatgttatattcttgttagatggctagaatgctctagggtctggaaagagggacaacatcctttgggtaaatggaaaagttgaactaattgagaaaaatattctgtgtttaaattatgtttgccatttttagtattttcatttttagggactacatatgctgacttaggaagttcaagctaggtttaattttcttcctttgatagcttcacataacccacactttccctccaaatattcctcatctttcacctttgcttatagttgttatagaatttattaaagagtaagaagaaaagaaaataatagacataccaggggctcaggaataatactatatagaaaattacatactgttggcctttagtttttgaacatgattaaatgtgaaatattgctataaaacttttattcagctcagaagggttcggcctacataacagaaagtgggagataatggggaactaattttccaaaaacaaatttcttattttatcattttgtataaagtcatttctgacatatcatggcagcaaaaacatgataaataaagtcaacagtaatgttgtgtacttgatctactgtggcaaaactgaaggtcccctgttagtcctaatatattttcccactttctttttaacagtgaattatatcctcattcaaacattaaaaaatactcttttgctgacattttaaagaagaggtgtccaatcttttggcttccccaggccacattgaaagaagaagaattgtcttgggccacacataaaatacactagtgatagctgatgaggttataaaaaaattgccagtctcataatgttttaaaaaactttagtaatttatgttggaccacattcagagtcattctgggctgcatgcagcccatgggccatgggttggacaagcttgttttgtaacaacacagtggaaaaatggaacccttacattgataccatcaagaatggtaagcaaggtatacacatttaatactcttaaggagcttacattcttgagaacaagagtgtgaattaaagtcagaaatttcagttaactaaattatactgttagatgagaaaataaaaactaaaatactggaagtttctatagtctttactgggcaatcaattattgtgccctttttgttgatcatgtgattaaggtaattaaaatccacgtaaatctcagcaagtatatttttaaacaatagattcaaaatttcaagatgaattccaaagggaaggatactgcattgagggttaaatactgggaagtgatatggtttggctttgtgtccccacccaaatctcatcttgaattgtactcccataattcccatgtgttctgggaggaccaggtgggagataatttgaatcatgggggtggtttcccccatactgttctcatggtagtgaataagtctcacgagatctgatggttttatcaagggttttccacttttacatcttcctcattttctcttgctgcctccataagaagtgcctttcacctcctgccatgattctgaggcctccccagccatgcagaactctaagtccaataaacctttttttcttcccattcttgggtatgtctttatcagcagcatggaaacagactagtagagtaaactggtaccagtagagtgggatgttgctgaaaagttacctgaaaatgtggcagcaactttggaactggttaacaggcagaggttggaacagattgaagacaggaaaatgtgggaaagtttggaactttctatagactagttgaatggctttgaccaaaagcttgatagtgatatggacactaaggtccaggctgaggtggtctcagatggagatgaggaacttgttggaaattggagaaaggtgactcttgttatgttttagcaaagagactggtggcattttgcccctgccctagggatttgtggaactttgaacttgagagagatgatttagggtatctggtgcaagaaatttctaagcagtaaaactcaagcgatgacttgggtgctgttaaaggcattcagttttataagggaagcagagcatgaaaaattcagaaaatttgcagcctgacaatgtgataaaaaagaaaaacccattttctgaggagaaattcaagccagctgcagaaatttgcataagtaacaacgaggggaatgttaatccccaagacaatggggaaaatgtctccagggcatgtcagaggtcttcacggcagcccctcccatcacaggctaggaggcttaggagaaaatggtttcatgtgcctggcccaggatccccatgttgtatgcagcctaaggactttttgccctgcatcccagatgctccagccatggctgaaagggtccaatgtagagcttgggctgtggcttcagagggtgcaagccccagtccttggcagcttccacgtggtgttgagcctacaagtaaacagaagtcaagaactggggcttgggaacctttgcctagatttgagaacatgtatggaaatgcctggatgtccaggcagaagtttgctgcaggggcagggtgctcatgaagaacctctgctagggcagtgtggaagagaaatgtgtggctggagcccccatacacagtccttactggggcactgcctagtggggctgtgagaagagggccaccgtcttccagaccctagaatggtagatccactggaagcttgcactgtttgcctggcaaagtcacagacactcgatgccagcccatgaaaggagctgagagagaggctgtaccctgcaaagccacatgggtgaagctgcccaagaccatgggaacctacctcttgcatcagcgtgacctggatgtgagacttggagtcaaaggacattattttggagctttaaaatttgactgcctcactggatttcagacttgcatgggccctgtaaccactttgtttgtgccaatttctcccatttggaagggctgtatttacccaatacctgtacccctattgtatctaggaagtaactagcttgcttttgattttacaggctcataggtggaagggatttgccttgtctcagatgagactttggactgtggacttttgagttaatgctgaaatgagttaagactttgggggactgttgggaaggcataattggttttcaaatgtgaggacatgagatttggaggggccaggggtagaatgatatggtttggctctgtgtccccacccacatctcatcttgaattgtactcccataatttctacttgttgtgggtgggacccagtgggagatcatttgaattatcagagcggtttcccccacactgttctcagggtactgaataagtctcacgagttctgacggttttatcaggggtttccgcttttgcatcatcctcattttctgttgctgcctttcactcctgggccattattttgagggctcccctaccatatggaactgtaagtccaatgaaacctctttttcttcacagtcttgagtatgtctttatcagcagcatgaaaacagactaatataggaagtaatggtgtctcttcagagaacacgaagatttgtcgtttcattaaaaataaatatttattgagtacccactctgggctagctatgtacaactgttaagtgatggattgtgacatataaggccagagtcctcatggagtgtttaactctacacagggctgacaagtgtaagagggaacaagaacataaataaataagctaaattcagctagtgattggtgctaaaaaggaaataaacaggataatgtgatagtgatgtgtgttgtgggtccattcgggtttctagctctttatggtcagaagatactgagctttgaaggcaagctctgcgcatgaggaaacaggtgggttaaatagattttttttttctctgacaatcaagcccctggataacctaagcgttttcgccttcatttcagccaggctttttctcctttattctatgcttgctgggccctttactctctaatagccaaactactagagctagagatcttgcctttgtcattaacttttcctgttcccaatatctgctttctaagatctctttcaggaggtagatatggaaaggaaaacagacataaaatttgaatgtatcattgtggctacatgtgaacatattgcattaaattaattgatagaaagaagtttgaataaaatattttagaagaggtttttgaatttagagtttatgaggttatacttctttatcaacttacagttaacaatgaagttattcccaagcatctttaaagctaatttatttccttttgtgtttaaagttttttgaaggaaatatatgcctcaaaacaattctgttgaccttttctatctatctatttatctataaaacaaaacattaaatggttccttgatggttttaagtcatggaatttttagaagctaaaagtgatttaactgcagaacattaaaaaacagcactgtatgattgaaactatgagctttcattctttcttacccaggtctggggttcaggcacatgaaggattgactttcatagttccacatcataaggcacagattgtaaagtatatgtaaccattttacttagtctattaactttcagaaacccaaaccaagagaatcactcagcaatgtgacatttcacttttagctcttactgtcctttataatattcaggtaaaataatattttaaactagtttagactgtggcacatgcagtacataccttgatggtacggatgacaggcatcaaacctaaactctgtaaaaaatctgtgtaaataactcttattttactttacactgaaagtaaagtaaaataaggactcaatggtaaactatttctttattaatacacacattcttattttacatttcagagtaaagtaagagtttgtgcgtattagtccgttttcatgctgatgataaagacatacttgagactgggcaatttataaagaaaaagaggtttaatggactcacagttccatgtgtctgaggaggcttcacaattgtggctgaatgtgaaaggcacagcttgcatggtggcagacaagagagaatgagagccgagcgaaaggggtttccccttataaaaccatcagatgtcttgagacttattcactaccaagagaacagtatgggggaaactatctccctgattcaatcatctcccactaggtccctccacgacatgtgggaattatgggaactccaattcaagatgagatttgggtggggacacagccaaaccatatatttgtgtattaataaagaaatagtttactattgcatccttaagaattgaggcacttacatatagctcacattcattcttactcttctgagtctcagtatcaaatgggctggattaaaaataaataaaaaacaaaacaataaataaggcaaggggaactcaagtgaacacatggataaaatgattagataataaatggaattattcgagaaatattttaaaaattagtgtaattataaaaggtaaataaattctagataaacactgtattaatcagggttctccagtgaaacagaaccaataggagaaagagagagagagagatagatgcaattatggaggcaggaagtcccacgatgtgctgtctgcaagctggaggcacaggaaagccagtggtacagttccagtccaaacctgaaggtctgtgaaccaaggcagtcagtgctctaagtcctggtccaagttcaaaggcctgagaaccaggagctctgatatccgacagcaggagaatatggatgtcccagattgagcaaagagcaaactcaccattttagttatatttatgccctcaatggattgaatggtgccctcttacattggcgagggacatctcctttactcagtctactgatccaaatgttaatctcttctagaaacaccttcacagacatacccagcagtaacattttaccatctggacatacttatcctggtcaagttgacacataaaattatcgcattgagaatattaggcatccaatagtggtgtgcttgcaagcccactctcagaataataaaggcctcgatatgtagcatttgacaacttccgtagtgtaaataccctcaccataacacatttcagaggatcaacctgaagttgctgaatgtgaagttgggaagcaatgtataccattttcccgtgtgaaccagtacgagtcaactgcagtgtaccactgtattagaccagttaatatatttaaaaatgtttctaatccacagaaatggacttatctgacactgtgggagatcggttaatataaattaattttctagatagtggccatttcacctgtaagcaaatagtgtctatttattaaagataatttctatacaatgtatatgttttctgcctatagagcataatttcatcaattcttgatgatctaagttcctcagttgatattaatcttatgtgaacaatcaggaaggtagtataatggttaaaagaacatagtcttaaaccaactgtttgggataaaatcctgcctctactattgtgtaatgttgagtgttactcaggttccttctacctcagtttccttctctgttaattggggaaattataagtgttgttagttcttgttattcaaggcagttatattctataaagtcaccacaaacactgaattagtaaatactggattattgttttgaggggaaatacaggggttaatttcctggaagctgattcatcaaccaatcaatacctgcattgttttgtgtatgttcctatttaaagataatttatttaatatatatagttgaatcattaacatggaccacatagacaacagcactatcacttgtgtgtgaacaaagcttactgacaaatgtacgttctctctaagacacatcacagcctttttgcatttaggatcactagacagcacatagcgctacagccaagggctgttttaaatagggaaatcaccaacaaaaaatcacagaagcatgaaaaacatggcaataaatagactgttaaagccaccctgtttatagtatgagagttgaaacacaaaggtagggctttgcctagtttcaacacaaatgggaacatgcacatcaggtgactcaaatttttcaagcttctgcccatgcctgtgtctacaaatgagcaaaaagggctgtgagtataatttgggagttactgtcaaagatcaacaaagctggacactagttaaagtggtaagatcaggtggtaatcagtaatatactgctgcagaagggaagagggtctggcgtgacctgaattcaacttagatttgtacaaggaggactgggcattttaaagagagaattgtagaatagggagaagggtgagcagggactcagtagagtcagggtagcaaaaaattacaaagtgttggtcactgtaaatgattcaatcctccagcagagacggggaggcaagctgttcctcctgatatttacattttaagagaatggctttcaggtcctttgagaaacatactccttaattgtaggagacacataggtatctcaaagggataaaggaaggatccacaattgtaagacctttgtagtaaatgctctaaaaaaggtgtcggggcttatcatcaggtgtgggctagagtagtcgattcttttggcagccctaaaaaaggtgtccgcggcttatcatcaggtgtgggctggagtagtcaattcttttggcagccatgagcttccccaggcaggatcttaaatggggctgggtcatcctagggatgcaggcttgatctagtgcttattcaagtcttttcataggagggtgggagaatttcatgttcgctgacagcctgtagattttataggccaagcatgagacctagtcagggagttccgaggagcctggctagcatttgagcaaagagagaatatttgtgattacaaatatattttattaaataggcaaattcgcaaatatgaaatcacaaataatgagggtcgaccgtattttcacattgttgttatttaattatgtaaattgcttagaacactaagcactcaataaatgtctgcttaaattataatgtaagatgtaggaagtgttgagttataaagctgtttgttttgatctttatcagcctgcctcaggttgctattttaatatttggtcttctttttgttttatattttcggttttccagtttactgccaagcttccactttttctcactgttagtttgtgctactctggccttttaaccccagccctcctgcacccatattctttgcgaaaatgtttcagttgactatttaacaaggctgagtgaggacttgaaggcactctgagttgctagctctactatgatcattttatttgttcaccttttgcttttagacccaagatcctgcccgtgttccaggtacttgaggttgttaggggtctgccttttatgtgaggtggatttttatgaccatttgggaacaatgttcaatttattagtatatttttatcatcgagggttttggccaagaacttcttttgtttaggagctgtggcctggccatgatccaacctggctgagatgctcagaccacgtgattttcatacagacacagactgtggtgaatcttatggtagagcttgcggcagactccatggtagattttatttagatctcacgtctccactgaataaccaactgaatttcatggctacaaagaaaggaactatcacatgatgaattattttatattatttttgacaatataaaacaaataaatgttttcattataaaagtattcttgacttttgaagtaaaatttgggtgtcactcgaggactttgcctggctaaggtgcaaaattcttgtgaattttaaaaatagcttatatataaacctttacagaaaactaggaggtgaggaaaatccctcatgaacttggatgttatgaattgcagtctagggatttaaataggtttcacttatgttcatgttggattgttagagtaggtatttcatgaataattttatctcagataaactcatgatagattttatcattttattttggttcaattatataaatgctatttaaaatccagctcttactaagggttaatatggtaatgaattctagtattccctttgaaaacacggatagatattttttaatctttttttcatgttcacttaaaaaatatcttgctactgtctttatatcaatgtttcataattctattagccacattttgttgacctgcatattcctacaagcctgaattttaagttacaactttgtattcaatattagtagtattaaaacaaacatatcaaaggaaataaaaaccctaaaatttaatgtttcacaaaggaactctgtgttaaaacagtgtccttttagagttaacatatgtatgggagatgcattttaaataaagatgtatctgacctggaagagtagacaaatctgctttacagcaagttgaaagtttagagaaatatttatcattcagttaccaaaataacaaattaaagcagcaaggaaagagaaaagagaggagatgaaaggaaataaaggaaaaccaagacgtaagttaagaaagagctattgcttgtgaacttcttcctaaaaaatgatagaaaaaaaagataagaaacagaaaattgcatgagacttcagtgtttatgttttgatggaaatgtacaaatcattttcattctttgcagtgctgtcatgctccatcactttagtccattttcaccttccaaagaaattctgaatgggccttccttctctggcagctaattaatctttcacaagcctactcttgcagcctgtctgccagggatgccccacaccttaagccagtgactcacgagcagatttcttaccctcttgagcagtactttcttcccttgagctatgtgaagacctagcttttctattttgtttcggaaactatgtgagctgtaatatatcattgaagaattgctccttcccccccaccaccataagtgaatataaagtgttcctgaatcatttaattgggtaataatgacaacaaagtctgaatataaattatgaatgtgtacagcattttaccaatagtgtatatcatatagatgtaaggacacatattactagattataaattctctgtgtatatacatttgttagattatcattgtaataacacaaatgtacttatatttataataatgttgcatttgcctaaaaatactaataaaactgcaaataaaaataatttttagtctaattaatggaagatttggtatatgaatttttttttaagttagagcataattctttacagattgaaatgcctcagttaaaacaaaacaatatggccagggatggtggctcgtgcctgcaatcccagcattttgggaggccaaagctggaagatttcttgaggccacaagtttgagaccagcctggacaatatagcaagactctatctctacaaaaaaaaaaaatgtgtgaaattaaaaagtttggtatacattctttttgtatgcaaatgtttccatctgttgtcatttcaatttaatctgaataacttcttttcagcctttctggtagaaaacatctgctgtcaatgactttatcaggttttatttatctaaaaaatgttttattctcgttattgaaggaattctgggctgaatattgaattttcagccctcaaaaaagtgatctgcctccattatttctgttaaaatgtcagttgctatttgtataattgctctgcacattatgtttatctgtggctgctttagagattttgttttatgttttgcttttgacagttgactattatatacttaggtgcattctttctgttgttaagcatgtttggattttgctgagctttttcaatcttgatatgaatattgataggaatgttgacatgaaaaatatcaatgttgatagttttcattaaattgcagaagattttagccatcatttctgcaaaaatatttctacctcatctccctccctccttctcttcacccctctctgataacacaattatacttatgttagaccttgtaatatttttctactgattattgagactgtaatccatggtttttcaatattttttctgttcttcaaatcagataatttctattaatctcttttcattctcactactattttttccttcagtacccaatctgatattttgctcacccagctaacattttaatttcacatttacttatccattcttacatagacctctttttttatggtttgcagttaccttctgagattctctatctgtgcacccattataactatatgtttctttaaatctttgaacataataataataaatcatttgtagtcttggtctttgatttccaatgtttgattcagagtctgttctgttctatgtatttttttatttttcttgtgtatggattacatttttacctttccacttatgtacatatgtagcatttaaaaaaaaaaattacatgctggggctgggtgtagtggctcacgcctgtaatcccagcactttgggaggccaaagtgggtggattacttgaggtcaggagttcgacaccagcctggccgacatggtgaaaccctgtctccactaaaaatacaaaaatcagcctggtgtgctggcacaggcctgtagccccagctactccagaggctgaggtaggagaatcgcttgaaccggggagacagaggttgcagtgagccaagatcgtgccactgcactccagcctgggcaacagagcaagactccatctcaaaaaaaaaaaaaaaatacatgctagatgttgttaatgactaatttggagaaatctatattaggttttctcctggaaaaggtattgagttctgttgtaaggagcagtttaattatgggaagatcatttttgccctttcaggcatagttttattcattggtagtagaactctacttttgttttgaatttagtttatgaaccttacccgtacccctatagtggagcctttcttgaatctccaagtgagagtctgagatatgcagtaaattatctccacttcacccaggattaaactccagagtattctttctagcagtagctaatctctggtatcattgttcagcaatcaaccatagagcaggaaatctctgctagaccttgtggaatcttactctatgaaaatgccatctagacgttcgcccaaaattcatggtgaatcctcacacaaactactgccattcccagctcagctcccttttgtcagctaccctacactccaaattttaagcaactcagaagcccagacttttctcgctgcttctcaactcagtgaaacttcagttctactgggctctatttccgtatttgatagtaaaaagtgcatccaagcagaaagtcatggaggttacagagctcattttgagtttttccttctcttaaggattatattcctgtgctatgtttagttcaatgccagtaaaaatttactttagataatgtgtgtaattttacagttgcttattataagagaagtacagaaactggttactttatcacagttggaagcataaatcctaacaagccatttttattgttagataaaagagataaagcagattgccatagatgaggcagaatgagggtcgtgagggaggcaggctcattgagagttaaaatagagcctgtgatgctacgggtattgcaacatactacatacatctgtacttgaaagtaaagcaaaaaaatggagaagagatacacgtcagggattgggtcaacagcacacgaggtgaaaagattttgtaggagacaacaaatctgaatagaagtcagtgcctttctctccttctgccaattaattttcccaccttttgccattaatctttagaaaacagctatcccccaatagctgtcctcgtaagtcataataaaaagaaaccaaccagattttataaagaattgcaaaaattgaagagtaaatgaataaaactccaaatttcagtgaagaacatgaagtgcataaaggaatcacctgagtaaagatatgaaatcaataattcacacaaaagtactctgtttccaaagaaattactgaaatgctatattttaaattgtttttatataataaaatgtcaaaagagttaaaatattttattatgatttgtaagatgatagatgcaaataaaaagcagactgaaaaagatcaggaaacaagtgaactagaaaacagaaataaaagcttttgattgctcttcccctacccaacacacaaatagaataaacataattgagagttataaagaacagatattaaaaatgaaaaaaataagaattgtagagaaaatattaaacgtaaaggcaaattagacaaaaaaggacatagtgtttctaaacaaaataaatggactaaattgaggagaaagagaaaaaaaagtcacaggggaagaaactttcctggaataataaaagtctaggcataataggtggacctttccattagggtatgctgtgctaaaatttctgaacttcagtatttgggaaagaaactgtaagggctcttgggtgtaaacagcaaacgaaccccaaagaaggttggatgggagattggagagactagactgacctcagactttgcagtactctaacagtgaattgtttctccacaaacatttgaggaggtcaggtgacccaagaaattataaccagcgaaactgctgttgaagtactgaataatcattaaactgtataaaagtatggatgcagaggattaatttaaacatatattaaacactaggaagatggggaaggagggacgctgagtttgagctttgtgattacagatcaaaatatgtgatgatttttgatattctaaatttaacaataagatttttttaaatttcagaggtgagtaaaaagaaagtgggaggaacataaatacgttattttccttttttcactatactttttataaatgaaatgttattaaaataatatactttaatatttttcttaatgttatcttttagatagtgatagatcttgtcttgtagtaagaaagtatctacgtgactttcagcaatgcctttagttatacttattttattgttaaatttcatataatttaataatttaccattttaatataataggaataaaattcttaatttttatctctctctttttctctcccacctcacctctctgtctctccatagagctataactacagtaattatactaatatttaaagatgattatttcaagatagtgggctttggaatagaaacttaaaaaatgttcatacttacatttttagattcattaaaaatagcaggtaaaatttgtacataaaacagtaattttttaaaagaaaataacttattctgtaagttttggcactctcctcaaaaaagattaaatgtcataagtaaaacccaagtatactcgtaaatattctaatatattggtatacttcttgggtcagcaaacttttcttcaaagggctatgaattaaatatttttgatttgtggaccatattatctctgttgtggctatgcaactctgttactgtaatgggaaagcagcaatagacaatatgtaaacagactggcatattccaataaaactttatttacaaaaataagcagtcagttctgggtcgtggtttgttgacccctggtatacacatcatcaactttagtgattaaaatattatcagcctatctgtgaaatactgaggtaaggaaactaatacaaaatattcctgatgtattgattttatattcttgctccaaatacttattactgtaatacttagctttgatgagaaagggaagtgttgctaaataatttacatacatattcatatacatgcaaattttcatatcttttgatgtctcaaaaatgctgacatttaagaaaggaagggcatattttgcttcttacagttcatatgtgctgtactcaagctgacttcttccttcccattttacatttctaactttgatctcagaatgtaggagctggacaggatcaccgagtgcatcaggtaaataatttcattcacacaagaagaaaatttacggccactaaagttaaacggttaccatgctagttcttgccaaagtcaggactggaattcagtctcctggctcccattgcagagttttgcccactacactatattattgtacatggcttggttcaagccacagaggaactaatcaaagattaactatctgatttatacatatgtatatatatacttacttatatatatatatttttatacttacatatatatatatatatatatatatatatatttttttttttttttttttttcctcgagagggcatctcgctctgtcacccagtctggagtgcagtggtgtgatctctgctcactgcaacctctgcctcccagattcaagcgattctcctgcttcagcctcccgagtagctgggattacaggcatatgccgccacgtcaggctaatttttgtatttttagtagagatggggtttcaccatgttggtcaggctggtctcgaacacctgacttcaggtggtctcctgcctcggcctcccaaagtggttggattactgacttgagccacaatgcctgggccaactgactgattattatattaggaatgcatttatattgactcctctgttctgagtacttactagttatcctgattctatttgttctctattttaaaagtaggtttataaataaagttatttaagagcaatcagtcattacacatgaggagtggtattgctctatgtatactccgtttcattgagaaacagccttttcgtaaaatggcaaaaaaaacacagctgcagttatccctttcttctgggtcatttctaatagtttagatcagtggttctcaaactttaacatgtatcagaatcacttgaagagcttgctaaaacacagattgctggggcctcctccagagtttctgattcaataggtttgggatgacgcctgagaatttgcatttcagacacgtttccaagtgacagtgatactgctagtctgggtaaaaaattttaaaaaccactgggtttaaattctcagccctaaaggcatattataattaccaggagaggcattaatccactaattaattcccaggctccatcatcaattggcatagaatgtctagggcttgagactgggtatgagtattttgtcttttttttttttttttggtttaagtaattaatcggtgcattaataattgtacatatggggtacaatttgatgtttcaatacatatctgtggtgtagagagatccaatcagggtagtgactgtatccatcacttcatgcatttaccacttctttgtggcgagaactttcaaaagcgtttcttctagctgttttgtaatatacaatattttaatgttaaccatagtcaccctactgtgcaacaggacaccaaaatttattcctcctatctaattgtaactttgtacccactgaccagtctctccctattctcccgtctcttttccctcccccagtctctggtagccactgaagtgcctcaggtgattctaatatataaccaagtcggagaagcaattaagaaaagtaatgactgaaaaagtttattttgtctgatgaattagtgcaaaattttttaaacatattcctctattatgtggggataatttttatactgtcatttcatggtaaagtataaatgagatagtataaagatgactttaccaagtgattccataaattgaaggtaatttgagtgtagttttatgctactaatcgtataaagtgctgagaatataaggtagctatagaattttacttttaaaatgttgttattgtaaaatttttgccattaataaaattatttcatgcctcagttccttaaattatttttattagcattgtatagacagcatagatactaactcctaaaattcttaatttctctctttatagtgaaagatgcagatgtactttgtatggacatacagattctgtgaacagcattgagttttttcctttctccaatactcttctcacaagctctgcagacaagaccctgtctatatgggatgcaagaacagtaagcaaatcattcactttttttcccagcttttgataagtctgattactctcggtcattctttgggtatggaatatgacttaaaaagtgattgtgcaagggcattcagggcaaaagaacagtaaaaagttcataattacaagatcctttctatgcacttgtatccattctgccttccaaatgtgatcaggtaaaaataatatgattatctcattaagcattatttcaacaattatttattgcgatagaagctctgctggttcatgggatacaaaagggaaatacacactgtgccccctccttaaggatcttttagctaggtaaaggaagagaaacgagagattattttgatgaaatgagacatgcgttaataaaatggaagactatctaaatacagggggaaagcaaggaggaggattcatatctgctggaagagtgtggatggctttcaaaggagcctaggcttgagctaagatctggagggtaagtaggatatataggtcatctggagaggggtagatttaggagagggcaatacatgctcaaagccatagagatgtgaggctgcaatggcatgttctgacagtaatgatataaatggaaagagcttaaggaaaaagaggcatgataggcaagaatgtacagagacaaaacaagatcatgacgtatttgattaaagtcttaaactatttccgagagaattaaagagcattaagcaaacagggtgacataatcggatttaccttgtcaactgaagagtgacaaggttcataaatttggaaaataaattcctcataaggggttacagtctgcagggtggccattcggacaagctggaaagcatagcctccagccagaagccagaaatagatacttcgagggaggagcaaagggaacaggaatttatgctgagttgggtatgtgaatatttcataagcttgaggaggagtcatgactatttatgaaaggtgaatcatgcacatgcacagtatacattcatgccccttcatgggtcccatgtaccaaaaatggcagttttagcatgatccaaggctggagttttcagccgcctaacatcggaaggtgaagtggaggacatgaaaacccttactgcacatgttccatggactggccagacccacttcatggtcagtggtctcttatcaggctaaaagaggaagggcagtatcaggtggctggttgatatcagtattgaggtcttttgaaagggctggtttcggctgggtgcagtggctcacgcctgtaatcccaccactttgggaggctaaggcaggtggatcactggaggtcaggagttccagaccagcctgtccaacatggtgaaaccccatctctactgaaaatacaaaattggctgggtgcggtggtgcatgcctgtaatcccagctacttgggaggctgaggcaggagaatcgcttgtatccaggaggcggaagttgcagtgagccgaaatcatgccattgcactctagcctgggcaacaagggcaaaactccatctcagaaaaaaaaaaaaatcaaagaaagaaagggctggtttctgtttagcacttagggaagcaaggctaatggtcattttggagggagggagtatgaggaggcttgtctgaacaccatcctgtcctggctgagagctcagttttcaaggttactctggggtcctgttggctaagagatgttccattcagttggctgggggagggccttagaattttgcttttatttgtcccctttttagaagatgattttgataaggaagtaagagagtcagtcatgtgaggaatctaatataacaggctatgagtggatgagaatttgagctaggaaacagcgtagatgaaaaggagagaatgcattaagcataggaagtttatccaaatttggagagtgattggaggtgaagattatgtggggaggaggaggagttcagggtgagaaacttttccaatttgtctaggaatgagggttttcctgagtcatgagattttcagagctaaaattggacagaactggattactggtaggttcaagagtgaatttgattttaataaaagtgttttagtctgttctcaccctgctgataaagacatacccaaggctgggtaatttataaaggaagaggtttaatgaactcacagttccttatacctgtggaggcctcacagcatggtgaaaagtgaatgaggaagcaaagtcacgtcatacatggcagcatgcaagagagcatgtgccggggaactcacctttataaaaccatcagagctcgtgagacttattcactatcacgagaacagcatgggaaaaactcacccctgattcagttacttcccaccaggtccctcccatgacatgtggggattattacaattcagggtgagatttgggtggggaacaaaaagccaagccatatcacaaagtaaacaacatgtagggactacactttcaaacagtttggctgtgaagatgaataggagaaaagattgtagctctaagatcaaataaaggatcctcctttgttcagataggagacagcatgtttatttgcttatgggtaagatcggggagatgaaatgaaaatgtaggaaagagaaaagataacagagtttattgtgcacagattttcataacttgaagaatgccaatatgtgtaaaacaaggcctccatattcttcttagtgatattttataaagatcacaagagaaacaatgactacagttgactctataagaaaagaataaatattcataatttctggttcctgggtcaataagaaagagaaatgtaatttctcccattttatttcccatatacaaaacatgattgatataaataaaggaatatggtaatggacatgcagatggtgttaggagggatgcaagttcagtatgtgaagccctgtttagacctctgaggccaatttatttaggatatatgaagaacaaaatatgctcagcaccacacattatagaaaaaactaaggtagagctacccatgtcttggtgaccaacttcacatgttgcagagatttaaacttctgaggaagcagaagtcaagggggcattgtggaaagagtgcatcaggcgtgacttaaaaataaaatcaggatgattttttgttaggtacaaaggtccgacaatctcctccttgctttaaaatagcttctcagacattgatgcagtggagtttgctcctgctaatggagcgtcaatggaaaagtaagattttcaatatattttgaactaaaaacttagatgtgaagtttgtataaaagtgattggtagaggaatatccatagagaaaatattaatttagcagtgacctaaattctattgacttcaaggtttttttctctctctctcaagtgctataactgagtgttctaggaaagtctatatcttatttactttctcttatgtgaaaaacagaagcactaatgcttagaagtaaaactgctctaattttaaaaagtttcctctcatatatatctgccttgaatgcatacagctgtttattgatggtgaccttcctccctccctgaggttctgagctctttctgtgctatccttattccctgaagtatcaggagaaaaagagggattcagcacagcacagtaccttcagcatagtgcaattgcatatgcattgaatgtaaaagcatagaagggtttgcaagtcccatttgcatgactttaatcaacataaatatttttaagttgacttaatggcaaattaaaatgtatatcactacaattattattgctattttgttactattatgcatgctagctttatattaattaatactagaaaaaaggctctaaaatattttggtttaaatgaaatatgattcctaaatgtatcataaatgcatcattaattagaaataaagttcatttaatgggtttattttctaaaaatattttcaaaccaagtagaaaaaaatttaaattgatagctatgtactgtaaaaaactggcatataatgcaaaggaaactcattcaacttattaattactagataatataaattgttaacgaaaatattgatataaaattctacaagtgaaatacgataatccaaaaattaaacagaatcattccactaacattgcattaggcaactgtggcgacttcatttcagatatagctaatttattaaaaaacaaaacaaaacaaaaaaactttaaatcacccaggttttaaaaaatttatactgttatatacattgtttttaaaagacaaagacacgtgttatatgttgtctgtataatatggaattgttagttgttttttatcccagtggttcataaacaagttaaaataaatttacatttttagttaaatagtaagagattttgaaaagggtaaccagattagctaaagtttttttctatgttgtaatgataagaacagtataacatattgatatggatgacattatttgatttgcaacatcaactgaatccatggtatactggcatgcttcttctttataatttttaaaatatgttaattccttgatacatgataaattgtcaggttatcctgaaggtctggacctaaaaggagattaatgactttcttctattagtgaagcagtaatggtacattttgtcacctcaatgtgatcagttactattgagacaccctctgaaatattttttgatgaaatgtgaaaatgaccagtggattatattcctataaattagttttaaacctccttctcccactctcaaacatatactcgttttaaatcattaatatgatctaacacctttattatcaaagataattaacgtggaggcctaagtcagtttccaagtcaactggacatatcagctctgaattttgtagaggatgaaaaaagggatataaatctctataattaccaaatggaggctacaaaataacttgcagtttggaaactcatgaaattgctcagttttacaggactgcatgtatttttcttcaaagttgaagactattttattaaaattgaaagataagattgctttattgtcagaaagtgatatatcacatagcaaactgaatgagaaattataaggcctacctaaaggcagtaagaaaaggctcaatgtacatacagtgatttggaagcctgtttaaaataaatgcaatgagattgttagtcatccacaaacccagtgaaaatattaaggctttttttttaaagaaaagaatgttttcaatatacagtaaaacacagaatgagaatgagatgagtaatacatctatgagttgtgtcagagctgggctggcaacagtcagagttgctgacattttgtctcttgccatgagtcagacacagagggttcatgacctggactgcctttagtggccattccttgctccttagactaactgcgggcacttgtccagcttacagcattctcctgacttagctttggccaaaagatccagtaacttgtcactgcgagtttctataaagtggataaacaaggaactcacaaaaagagttaacctgttggctcctgtttggtgccagacccatgtctgctctacagttcatcctgcaccctgcataggcctgttggttttcatagataggatctggtgaactctaagaggagcctaatattcagaatccagaatgtggaaacaaagggaagcttgtacctctctcttttatccctcagccatatttgatttagtaatgtttactggagatctatgtgctaggcaacatcctaggttctcgagaggtgactgtgacagaatccctgccctcaatgaacacacagactctcagggacaatgtataaagataaattatcttaaaataatgtagtaattgctatatattctatataactatagctttggtttttctgtgccaaagctcactgtctcaagagctgattgatggttaacacttattgaatatgtaatttgtgccatcattttacctataaaatctacatagcttactggaatctgattgggtgggtaccattattatctttatttcacaactgagaaagtggagcctgaggaagtaagttgcgcaagaacagcccagtggtcagtgacagggtgagaacgcaggctgcctctccaacctcggtcttccttcttccatgcccttggccatttccatgcctctattaatctacttagtcccttcgagtttctaccacagtagtctccaaactattttttataaaaatgttttaagcaattactactgtgctggtattttatgtatgtaatactttatatatacacctgaaataaaaataatgacagaaaggtacaattagcaatatttaaaattccatgtttcttttatagcctctaattttgtttgtttctgaccaaaaaataacaatgacacaaaaatgacagttcagtaagaaaagatgactcaatatgcttatattttcaaggaattctgatttaataattttaattaatgactgtaattcagtgattcacaagtatgatctatgattggatttagcagctatcagaactgcaaatgatcccttgacaaaaaatacaaaactcctaaaggaaaaaatgtatgatgatctgtacttaccaatgtgcaggctgaactttcaaattcatccactaattatgcaaaggaatttttgttaaaattttgttagggtttcctcttgttctgaggtcaatcagttggttttgcaaactaatcagaagttttcaaacattttaatactatgtggaaaattctttttctacatgtcttaaaggttcagatacaaggacttttaaaggttactgcccttatgtagatttggtagaggaaacactaaaaatatgtgttatcaaatgttctatatcataagtttctttcgaaaatggtgccttttttgtttattgttaaaatgtcacctttattttgataggatgattaatcatattattttcaaaattatctgcttacagttcactgttggcaaatgcctattatcacaaaaaaggtcaacaaattaggaatatttgtgttttggggagaaaaagcataacacatatttaaggtcaacttttcttttaaacactttgctaaaaaattgtgaaatttaaattttgtgggagtagaaaacatttttttggtcactctgactttttacaaaatattataaagatcctaatcatcaaaggactagtgtattaatctgttttcacgctgctgataaagacatacccaagactgggcaatgtatgaaagaatgaagtttattggactcacagtttcaggtggctgaggaggcctcacaatcatggcggaaggcaaaaagtacttcttacacagtggtggcaagaaagagacgcttgtgcagggaaactcccgtttttaaaaccatcagatctcatgagacccattcactgtcatgagagcagcacagaaaagacctgcccccataattcaatcacctcccattggttccctgccacaacacctgggaattatgggagctacaagatgagatttgggtggggacacagagccaaaccttatcaactagttaacctaaaattaaccaacttataaatatgcaaagtgcttgaaagtgcaataatacaatacaaaatttaaaataaacctcactgcattgattttatatactgtgttacaccttgctttgaacaccttggttcaaagaccttcatgttgcacaaatcctgtgtagagacttactgctttctcactaaataaacatctactaccatcagttattaaatacatgatgtcctaaccgtgtgaagttaacaaacatataacatgatctttcctctgaaaaagctttccctttactatttcatctgcctgacacaccttttcccctcatcacctaaagaatttgcatccatccttaaaggttcacttcaccttccctccaaagctccccatgcttgttcctctggattaggcatcccaagaggcaaccaagagaactttgtaccccgtagaattttgctaattatttctttgtaaagtgttttaaaatgttgaacttggcgaatgagacatttttttctccataaaaagacaagccttaccaattagctaacatttcgtgtaattactaatggcttcaggaatgggctacaagaagatatgcttgaaaaaaatcaatgtacgtaattgcatttttatagaactctggacttatatcctatattatcttgtatttacatcagaccatatagcacgataggaacatgcagccattctgcctggattcaaacccaaaatttgctgcttatttacagtgtgtccttgggcatattgtataaaatatttttcccacaatttcctcatttgtaaaatgtgcatagtagtactacttatcacataaggataaaatgggtattaaatgatcaatcatatgatgtgcctagaaaagtgacagatgagaactcagtatcttttagatattcttacagcagttgtcatgccatataattgtttagttatattttgctctcatgaaactcggagctttcttctctattttcacaatggttggataataggtgcttaacagatgttaaaggaagtgagggaacaatggagggtgaaaaagaagtgaaggagggaagggaggaaaaaaaagaatctgtcttaccatggtgtttcttctaactcaagaacttgtgtcatgttcttcagatataccctatttcacttttatttcttttcctttctttccatttatattaacaccaagccatagtacagaattgttactaaatatttaagaaatacataaattatgcaattttgtttctccaagttattgccaaattctatcctcttccttctttcctgataatgacatagccttccttctttgctactacaatttgatgacatgaatctcattagacatttcaagttatctttcaatcagtccctgacagtgcatctgacataatttaatattccccgttctcaattatcccattttattatgccttttatttcagataaaccttctcttttcccctcatgttttctctgggtatctctgtagcttgcagtaggtaatcacttatgttcaacaggcctttgttttccaagtaacttctctcacttcattaaaaatgtagtagaagctgtgttctgagaaaagtcacactgattaagatggatgttatggttttttcagagtaatattaacaacaaaagtaaaaaatactgattttccaccaaaatgactgactggtttggctttcacatctttccctagaggagtagtatttgagtggctatcaattgcttcctaaggcattcattaaaaaaaaaagaaaaaaatactttatgtgttttctaaaatgcataagattttcagaacttacagtcatatcatttacatttgtcattaacttaaggtataagtacataggttttaagttattacagactataaatcagatgttttgcttttaggtagaaaagcattttactcaaataatccaattgtttgaaaattaaaactaagtatttttaatacacagtaaaaacattgtatcttaaatagtagatcaatttaatatgctataaggctttcaaagattgttacttaactttgctaaaactattgtgtatctcatactttccatataaaacctttgcatacacatcacaaatatcattcctttcttcttttccttgcagttactataaatggtattacactggccagtagcgggaagactagatttttgtatatcggtatcagcctttgaaaaaatatcatattcaataatggcattaaataatttaattaattgaattaattataatgactatgtccattgaaaaataaatatagattagctttatgagattattttaattctgtaagaggtaaaaataatttctttatacttcatgcagtttatttagattccattcaataaagatggaatgtagagatatggtgttggatgagataaaagtaagtaaaattcccaatcaattatttagaataaaatattcttaatactcctgtcatagttgagacaccatgttgtactgtttttttatgctgaattttctgatttggaatgaattctaggattggaaggaacaagccaaaagaaaataccagatacaaaaattcatcttttgagtagaagtaatatgggctaaatcatctcaaaaacttttctccacgtgcttacccaactgatttttattcattactgaaatggcttctttgtaataattttagagtattttattaggacagagattatgatctagaagggtatgaaatttagatatagtaaatatagatgatttaattccttttgtattccttaataatatctgtagtgaacacaaaatagtttaaatgatatctaaaatgaaaattgagatcaattattttcttagggaagaataagataaatgaattgtaaaacataattacttaattcaatatttttgtaaaagttatataatacattctaaacttaaagatatttgtttattccttcttttgaataatatcagtgagtatttcttccttttattcagattgatgtgaaattatatgaatagaaggttgatagagagctaaaaccaaagattgatggaaagttgaaactaaaggaaaagcatgcatctaccttttcaggtgtggtagaatctagatctcttagaaaaactatgtttttttgacttatttgaattaaataaggaataggattgtcacatataaatattgaaggtaacttaatcatagaatatatttgaccaacaggaaaccccagtggattgcctccagtcttttctgccttgagcataataatgtagaaaaattacagattctgaagtcagatagattagagtcttgagtccaagattttttaaagttcttttacctcctggttgtgaattttgaggcacaatatttaatacctgtaaaattcagcattctcttttaaaatgggaataataataattaaatcacagtattagcactgggagtatttatttggaaatcaaaaagggtcagttacgtttttctatttttggtagctgagaatgctagagacaagtcttctcatgatttgtagttctgtctctttggttgatgggttaaatgatgcttaatgagattgaataattccattgcaaattgctttacccagtgttttgtgtgttgctgtcactttcaagaactaagtgactacaattcattgcatcagtttgtaattccacagtatgtatagtgtttatttgacctatcttacttgtagcctcttaattttacttcaacatatagaaattactaggaataagcttgtcactgttattcattcttttatacattcaacccattaaaacttcaatagtgatggcttggctgtacttcaagatagtcttaacttcaaattcactgtagtaccacatgttaattataatttttagataccgttgatgaaactagaaattaaatgcaacatttgtggcaagtgtttccggcattctgctgtggttgctattgtgatccgtgtaaggtaaaacaacacctcttgttatatagatttatagcaccagaaaattattagcaattcattaaattacatttaaattggataaccattgatgcaccatataatcatggtgactttttttcaaccatttagtatactcaggcatttcattcaataaagaaaatactgtaaaagaagacaagctgccttgcataccctactgttatgacacttgtgcattctatatataaggacaaaaaccttaaatttaatgatataacaaaattaaactgtaaacttctgtaaaagatttactaagatggtcatttgttgtttatttgactacccagcatccaagaaatattcttttgaagggaaattgacaatgtaagaaatgtggtaagaggcagggctgaagaaatatcagcaaatagaaaataataaagattaaagcataatttaacagtggaaaaaaagtagaatttgtttgtccaaaaacagtttctttagaaaagctaacagcaaaccatacttagcgttactttgccttactgttagcatcttcttataatttctacttttgcaataacatatatacatacatgcatatatatacatacacatattatattatatatacacacacacacagaaaccatgtgtatatttttattagtttagaactaataaaaatgtcataaagttagtctaggaaaattcaatggaaaaatcaatagcttcttctttgctgacaaaacaaaaacaaaagttaaaagtgcaaattaacaatatcaacaaaaatatcctatacacataaagatgtttgtgtaatgtgaaagaataaatctgcataataacagtgaagtgtgtaaataagtatggacacacgtataaggatatgccaggttctttcattgaaagagacacatttctttataaactaatatataggtttaatgaaattccaaggagatcctaataatgtttctgctttgagtgtatttggtaaataaagttattctaacctttatatctccttagataatagcaattgataaataaagctggagggaaaagattcatgagaaagactagcctaccggttattaatctataaatttactatacagtaaatattgtagaactgaagaaagattgataacccaatcaatgaaatagaagttagagcccttaaacagactcttaattatgtactatacaatataaaatcctttatttaaaaagggaactcttcttgagacttcttcagtaaatcaaagtcatcatttttttcccttcagcctttccccattttgacttgctgattctcaaatccctttctatctaaatcttgtatatcttttgactttgtatatctaaagtttcatctgtttcaaagaaactttattccactgtttgatgagattttatttttagatttttttcattatcacacaagtaaaacactattcagtgtaggaaagagtagactttaaaagtacttagaaacacacccttaaaataagtaatgataaaatattagtatgataacctttccaatttttgtatgctatagataagatgtacattcaaacccttctattcataataatagcatactataaatattatagaagttaattcttctttactgaacagcataacttgaaaattattttaaatattattgtataagcattctcattcttattatcaatgtattatacatatattatagttaatgatatagatgtatcactgtttgcttggacagtcttttcctatgaatatttggatggtttctaagtaattgatcttctaaacaagaatgcagaaacatccttgcaggtttattttttcacatttgtcagttcttttcattgagatacatttataggtggtaaaatttgcatttttaaaaagcatttaaatcatattgataaaggatctataagatgttgacaattcctagctatatactctttccagcaatccatctgtgtccactttcccccattcttaccacttaagttttagaagttagagaagataaaattatcctgtcactgttttagtatataagttttaggacagttaaaatgttttatgttatcattaagcataaggctaccattgacattaatttctatatctgtaattcatatttacattatttgacacaggattttggacagtctttttcaaattagtatggttatctggtttatttgttttgacattcaaactagttgaacattttttctgtttgtcttggaaaattgagtgcttcttggaatgtatcgtgattgtcttaaaggtataatatatgactaagtgtgttattttagctaactaattaaaatatatatttgtaaaatgagcctttattttccctaccatcttcttaactgttttctggaacttttggcatctaggatttgcaacacacatttttatgatgtgtgagattgtggggagctagcatactactgtgcctaaattactttacttgggtccccaattacactgaactagccatgccttttccgtattttctgtattccctggaatttgtgtatctgattataggaaaatggtggtgagtttgtgatgaaatgacatagaataacaaggagtagaactagtctattgtacttcttagataggctcatagagtttgaatcacactgctgtcaatgtcttagttcctaaaagccacagaactcaggatcacttggcagatagatgatggagccttttcacaattcttgactacttcatgaagcaaagctatggcttgactgaatagaattctcaactgaatagaattctcaactcagccaaattgggaatttgtttgtctgttggtattttttaatgtgtttgcatgctttagtctctggttgtatctttgtggatgatacatatatcctaatacttagttataatttcataacaaatgcctcaacccaagattttaattttacatgcatttgataaaattttaaaggatatttaagagtattattaaataagaatcttctgtatttctgatatattaacattgaaatcacttgatgtgaaatcttgaataattttactatttactatagtatctgtgaaaaaaatcatttttgttaaaaatgtatgtatgtgtgtatatatttgtgtgtgtgtgcacgcatgtgtatgtgttgaatgattttattgcattcaatactatatttggcccaaatctttactattgaatgtaatacaatcaatcattcaacacgtaagtactgaatgcctaacgtgtagcagggactattctatggatacaatttttttttaaagactaaagtctctgcctttggggagacttttagtagaaggagaaagataaaataagaaaaataatgagtatgttagatgacacatgttgtggagaagaaatcaggaatcagggaaataatgtaagaaatcttttgctggtggggaaaaatgatgttgtgattctaattaagatacagctagaaccaaggtctaaataaggtttggtggggagccttcccaatatctgggggaagagtgttccagagagagaaaactgcaagtacaaaaactcaggagtagtaatgtgcctggtatgtgtttgaggatcaagcaaggagcagcaggagtggatgagtgaggaaagaggggttggaaaatataaaatgaggccagagagtgttggtgggtaggaagagtgggacaaattctgtagtctggtagactatttggatgactggcatttactcagggtggtatgggaagatattggagggcttcgagcaaagaggtacattatctgcattaccttttatcacactagtgggcggggagaggggaaggcaatggtggaagcagaaaaatccactgtggctattctgatccatctatgcaaaagatgacaatggatgggaccagaatgatagcaaagaggaagatgtggttagagaaaattaaacacacaaaagaaaagaatgtggagaagagaagatgatcagggacttggaaaatgtggaattgccccaaaaacaaatcttactcaaacttaactctatgcctttccctactaattcagccttcaaagaagcgacaaattactcagtcactcacaaaacaaaaataaataaaacgtatgaaatttaatacattttgctcttaacagctgtatggaggtgtaattgatttggtttatttttggaattgcacttgtttaatgtatacaatttgatgaatttggacatatgcataaacctatgcataatatcaccacaatcaaggtaataaatatattcaccacctccaaaagtttccgtgtgtgtgtattttagtggtaagaacaatcaacatgagatctagtctctcaacctaattttaagtgcacaatactatgttgttaactttaggcactcttgtacagcagagctctagcccttattcatcttacataatggaaactttatattcattgactaactctctatttcccccttccgcaggtcctagcaaccactattttgttttcttcttttgtgactttgactattttagatacctcatctaagtggaatcacacagtatttgcctttctgaggttggattatttcacttagcacaatgtcttccaggttcacccatgttgtcccaaatagaatttccttctttttatggctaaaaactgttgcattgtatgtatataccatatgatccagcactcccatgttcattacagcattattcataacagccgagatgtagaaacaactcaaatgcccatcagcagataaatggataaacacacttttatttcttactttggcattgtatattgacattgtaaatagatcttgtcaattaatattttatgtatatggtataaagaggtcctggatttttagtgccatagttagaaatttgaggtccatctgaaatcaactaaaaatgcaaagatttctggtaataacatgtctttcaagttaatttaagtctatgagtctttacttaaatggctctgtgttcagagatgatgaacttacagcagatttgattccaaaataaacctaggagactgtaacagatgccattgatacctctccccctaacctcacgtttatctgcagctgtactgcaattcctgggtcccttatctacttcccacctcaagggttttcatctgcatctctctgtttctctgcctaaggcaatgccacagcttactaggctcaagtttgaggaagttaatgtccctggggacaggtagaagtcactggataaatagctcagcattgttgtccctcagtaggacagttgtgaagcatgttttatatgattcttcagggagtctttgtattagtttgttctcactttgctataaagaactacctgagtttccagtttttctgctctgttttttccccatctttgtggttttatctacttttggtctttgatgatggtgatgtacagatgggtttttggtgtggatgtcagttttccttctaacagacagaaccctcagctgcaggtctgttggagtttgctagaggtccaaccatgatagactggattaagaaaatgtggcacatatgcaccatggaatactatgcagccataaaaaatgatgagttcatgtcctttgtagggacatggatgaaattggaaatcatccttctcagtaaactatcgcaaggacaaaaaaccaaacaccgcatgttctcactcataggtgggaattgaacaatgagaacacatggacacaggaaggggaacatcacactctggggactgttgtggggtggggggaggggggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataaaataaaataaaataaaataaacatgaaaaaaaaaagaaaaaataaaaagagctacctgagactggaagacctttacgaagaaaacaggtttaattgactcacagttttacaggctctataggaagcacagctggggaggtctcaggaaactaacaatcatgacagaaggcaaagaggaagcaggcatatcttcacagtggtgcagcaggagagagagagaaccaaggggggaagtgctacacacttttaaacaaccagatctcatgagaactcattcactatcactagaaccaagggggaaatctgcccccatgatccagtcacctcccaccaggcccctcctccaacactgagaattacaattcaacatgagaactgggtgaggacacagagacaaatcatgtcagtcttcaataagtccaagttccagttgctcatagtgttcccatagcataccctttactggcttttgcccttctttatttcccttttcccctcccttgcatgcactttctggttcacctcccaaataaatgaacttcaaagtatttgtcttagggtacacttgggggtcccacatcaagccaggcagagacactttaatgaagttgctcatgtctggttgacaaaacaaaaggttcaagaatgttcctcaggaattaagcaaaggtgattgttagctccatctactttgttttacccctctttgatcttattggtctcactgtgaccagcattaaagaaacaaagggtcttgagctggtacagctcaaaatggtgaatctgttgctgtttccataattaatcatttttgtcaatagttataagtgaacagagccatgaaatgcagaatgcataataggaagctgaaaatttatgggcatattgaagacatgtaacaattgcctgtatgaataacaaaggagcaggaatacagcttctcggaggctaggatctgagtttctgacatctagaataaagttaggaagaacttaagtgctacaataacaaaagatgccactggatttacagtttggctgaattctagggaaatcacatgttgtaaggccttggtaaagatcagattcagaaattatttttaaaaagaagaatttggaaaagataaagtaaaaccccaaattctatattaatttttgatgtagatttactttggaggcataccaagtgtttctggcttggaaaagtttaggtgcaaagactatggatgagcaaatgttcagtggtccttttctttccctcttatggcataatctaagcctcaggaacagaaatatccataatccataaaatgctttttttatgttatacaaagaatcagaaagacacgacttgtttagaaattcaaaagactgttaacagagaacacacacatctcctctgacatgaaaattttcagataaatcaggcagcagagaaagacaaagtcagaaaatgtttatcgttttcctgcaattattggaaacatgaaatatttttggtcaaagcagagggaaccaaattaaggtaataatgtgtaataactaataaaccgataaagtaggtgacaactgcagcaaatgcatgatcacttatttttccccaagattactgtcattattcttatgggtatgtgggtgtgggcaaggggaaataaggcccatgtaaataaaatgtaattctttgcttgagatatttatagttttgtggttgaaaaacatatataaacatgttatttcagtacagtgtgaaaagggcactgggtttttggcagagttagatgcagagaagtggcatgatctgattatattttcgaagaattactgtggctttcttgctgagaagagactgagagggggctggaagacaataatccaggcagaagagtttggtggactagggacaagatggtagcagtgagctgatgagaacatgacacaaaaagattatattcaaccatttattcatgccttcatgcatccatccattcactcatttagacataggtccagtcttaccaaaaagttgtaagaataacacaacagacacttcacccagatttcccaagtgttaacattttactatttttttttatatttttctctctttgtctgagagagagaaatagacttatatttctccaaaatattgactaaattgtaggcatgataccccttcacctctaaatacacctccaaatataccagggtataatatctaaaaacaacaacattctctgaaacaatcttagaaaaattatccaattcagttttaacactgatacagctatctaatctacagaactttttcaaatttgttaacctgccccaatagtgcctttataacaaaagaaaatccataatcatgtattgcattcagttagttgtcttgtctctttagttccctttaatctggaatagttcatttctctttcattgtgtttcatgatattgacattttggaaaagtacaggccagctatttatagaatgtctcccgatttgtgtttgtctaatatttcttcttgtttacattcaccttatgcaggtttcatagaaatacctcagaagtgatgctcttttcacagaattttatatcaggaggcacatgctgttgatcagtgtcattaacggtgatgttaactttgatcacttggttatggtagactctgctgtctctctactgtaaagcagaatatttaactttgtaattaaaaaatatcttattattttcacactgtgttaaatatcccatgtgttctccagatttcacctattagtgttacaggatctttggggcattgctttgccagctggaaacctccatggccagtggtgtctttgcttgagttttgcttgggcctgctgggccaactcagcaggctgctgttagctcacacctctggcctggattgcatgcctgccaagggcaagtggagcagcaaggggtgtgtgagagagacagcatggggtctagccactgtgcatagccaggcacgctggctgcagcggggtgggcagctccaggcactgacacaggtgctggctccctgtgaggctgcagccagaccagacatcctgaaagcagcttccacagctggcaccagggaatgctgcagcacctggaagctttaagatgccaggaactgcaaagccccatagaggatgtcacggccctggcttaaggagctcctaggtctgggctcccctaagggctgcagatcttctctccttctttttgcctgcaacatggcaagcaagggccatgttttagccttgctcatgttacagctctttcatccctgccattcggcaggtcctgagttcttgaacctgtgcccaggaagaatgaggtatgtggacaagtggagctgaataattctatttttcaagtggatggtgagcaaggtgaaaaggagctttattgtgtgatgtaacagctcagaggagacacgcagtggatagctactctccacagctagggtgtcacaacaagtattcagctctctgcagagaggagaccgtggggtaggtagctcctctctgcagctggtcttatcatcatctcctcaagtctggctgagtctggggcttttatgggcctcagaggggaggaagtgcacactgattaatctatgagcagcctgaataaagcacaagttcccactcgcgtccatgggcccagcagcccggcccccaggcttcaggccctccccagctcacaggtgggacttcaccagggacctgccccttatgcccaggagcctgtctgctttctgctgccattcatggcgcccaggccattcatgccaagggaaacctgtaggccaatgccaagctgccctcagcagcccctcaacccccctcacatacttgttggtgcccaaagtccagagggggctgaggcaacaggggactggcatgtcagtgctgccttgagagtgtgcacacactggcaacctgcaacagtgcccaggctcagccccaatcttgctccaagattggagtgtgcgccaggagcagggagagggcagacagtaggagcagacacttctgagcccctgggggcgggggtccttcctgtgcccccaagagtgcagagctgccaggtctgcagccatggcttgggtggctgtaactgtgctcttgcctgcttccagcctccaaaagcacaaggaagcccacatccacagccatggctggatggtcagagctgtgcccagggagcacgaagttcctgccctgtcaactcagaaggggatggcacttctgcctgttcccagatcctgccagctccatggagtgcacagccctggcatgccttccccactgcagccggtgtcatgcagtggccgctgtagattaaccaccactgccatgactagttttaatatccattgatgattctcactttcattgattactaccaagatggttgttatgataatttttaaattccatcatttatttttattaatttattttctaccaaaaggaatagcttttccttcatcctaattttcatttatatcagtggattaatgtatttctattttgtacaataggttattcttattgtcattatttatttgaatgttcaaattgtcacattcttggccaatggaaattttttcaagtaggccacagttgcccttttgacatggaccataattctttgagcactctcccaactttcagcacagaatgttgcagggtcctcttgtactttccttggcttagcactggagtcagccatttcttcaagaaactctggttcctttcagtacagaatggtattagagatcaagattagggttctatctgtaaccatcaccacaggggagtcgttgcttctaggcattgttaatattaataaacaaagccagaaatagaaagataactgtgtattacactcactcacctgtctctatttagctaactagctatattaaaaacagttgatacacactggtttctctgcttccattccaacatagcaggataattgtattttctccctttttatacttataactgtcctctctactagtgacaaacagctcccattatttataatatattcacttacatgtttaatcttacaatgtacagaaagtagggtcagtgttactaacctagacatctaagaaagaggcctactcagtagcattcagtatttatttagggttctttttgtctttagctggaaaacatatagtccaactatggttagatcttctcccattacttcttagtgttatttattcaaaatattatttatttaaagtatactgggtcatttgtttctgtttctgttcaattttagaatttttcaccttcctttttgttttattattttcttttttgtgtctgtgaaatactaatattctaaaagtgagatctatattaaatttcacttttaactaaattatttcctttcttgtgttgtcgtttagttgatttctttatatattcatgtatttttaagcagataatttaattcatttaggcatattcatttttattgatgaaatgtttgaggttatagggtttccttttatcactattttatgtgccacagattctcatataaatagagatagatagtatgtatactttaatatacacatatatgtgtatgtttttattattccttgtttagaaattctttaaatttgttttgtattttcatattcacccaacttgtttaataaaagttatttttgattatttattccaatcgtatgaccttttaccttttttattttaaaataatctgttttttgttattagagattaaattgtaatatttataattatgaaatgtacttatgtaacttagtatatgattacattttaagaatgcccaatgaatgtttgagaagaagatgtattcactattacttgagtgtaaagttctgtgtgtataatatctaccttactgattaggttttgcaggacttctatatcctgttctgtgtgcacttgattgatcttatatcaattctgatatattaacatctcctaggcttgtatgtttctatctgtgtctttttgattctccttaattttttgctttataaaagtgtctactatgttattttggtgcatagatattgatagttgtcatgcctattttgtgaattcaggcttttaacattgaaaagaataatttttcccatatttaatgcttcttagcaaagtttaatattaactttgtttgataccaatattgcctttgctctgttattattcccagaagcctggtgtgtgtgtgtgtgtgtgtgtgtgtgtgtgtgtgtgtgtgtgtgtgtgtatccaagtctttctatttagcctttctgaattattttgcatatgttttggatgcagaacatattgggttttactttgtgagtcaaattgaaaataatttccttctaatggttgtgttaatcttatccattcacattaattgacgtgctaaatgtctaatgtcagctctgttattttatgtaataattatcatgtgtactgtgttatatttgctgtgtttctctatacaaagtagagtattgacctcttttattctattttgtaatttcttttggtgtttaggaaagactgtacttttgttctagcagtcaatttttaattctttttacattttcttattcttttgcttttgttttaacatgtttctgtgttgtttgcattttgaatgacatattttaacacaaactattacctacacagcaacttccctattttctctcttctgtcaatttcagttctgttatttctactttgtcagaacatataacacacactatgtagcatataacataaaatattattactccactctcaactttatctttgttttagtcttagatttacaattacatatactaaaagcttaccatttgtaatactgctgaaatttctcaattcatttctttttttttagattttttttaatactttaagttttagggtacatgtgcacaatgtgcaggttagttacatatatatacatgtgccatgttggtgtgctgcacccagtaactggtcatttaacattaggtatatctccaaatgctatccctcccccctccccctaccccacaacaagccctggtgtgtgatgttccccttcctgtgtccatgtgttctcattgttcaattcccacctatgagtgagaacacgcagtgtttggttttttgtccttgtgatagtttgctgagaatgatggtttccagcttcatccatgtgcctacaaaggacatgaaatcattattttttatggctgcatagtattccatggtgtatatgggccacattttcttaatccagtctatcattgacggacatttgggttggttccaagtctttgctattgtgaatagtgccgcaataaacatacgtgtgcatgtgtctttatagcagcatgatttataatcctttgggtatatacctagtaatgggattgctgggtcaaatggtatttctagttctagatccctgaggaatcgccacactgacttccacaatggttgaactagtttacagtcccaccaacagtgtaaaagtgttcctatttctccacatcctctccagcacctgttgtttcttgactttttaatgatcgccattctaactggtgtgagatggtatctcactgtggttttgatttgcatttctctgatggccagtgatgatgagcattttttcatgtgtcttttggctgcataaatgtcttcttttgagaagtgtctgttcacatccttcgcccactttttaatggggttgtttggacttcatgtctaaaacaccaaaagcaatggcaacaaaagccaagattgacaaatgggatctaattaaactaaagagcttctgcacagcaaaagaaactaccatcagagtgaacaggcaacctacagaatgggagaaaatttttgcaatctactcatctgacaaagggctaatatccagaatctgcaatgaactccaacaaatttacaagaaattcatttctttgttggattctgtggcacttaaaactgtttttccatagcattgatccttgactgaccacttaactggctataaaatttttcattcataccatcttcccttgaattatttgaaaatgctactcctctctaccttattttgctttgtttttgtatttggcaataaagataaagtttaatacacatgaagctggccataccacagtgagatagagttattactcaaacaacctctctgagactttaggggctagggtttttcaaagatagtttgggtgagcggtgggggtggttaggcttgcagcctagggttgcttgcagctgattggctaggggtacagtcatagggttgtagaaaattgtccttctgcacactcagtcatttctggtggggccacaggagtggttagtgggcccaggtggagccaatggtcgtcagacatggaaaaaacctgaaaagatatcttaaagggccaagcttagcttctgcaatagtgatgttatctgcaggagtaataggggaagttgcatagcctgggacctccagaataatggctggcaattgcttatgtctacaccttagcagaattcaggcccctctatcctcctagcctggtggtctctcatttgctttagaagtgtagttgaatttgggggaaggactgatatctctttcttccattcttttaaacttttattttaagttcaggggtgtaagtgcaggtttgttacataggtatacttgtgtcataggggtttgtttcatcacccagttattaagcctagtattcattagttgtttttcctgatcctctctccactcccaccctttaccctcccaaaatccccggtgtgtattgttcccctctatgtgtccatgtgttctcatcatttagctcccacttataagtgagaacatgtggtatttggttttctgttcctgtgttagtttactaactaaggataatggcctccagctccatccatgtccctgcagaggacatgatctcattcttttttgtggctgcatagtattccatggggtatatggagtaccttattttgtatgtagcgttttggaagtctgatgccaactatttttcttgtcattgtttttatttctttatttattggctaaagtctgcatatttttcttcttcatctgtaaaaatttggtatttttactttaacatcattttgaactgattattactaatcaattttctctgctactcattgagccctttcagcatttagattcaggacttcttttatttctgaaaggctatttgaattgtcctttaaaaattaattcttttccattattttacttatattccttggagactccagttatagtaaattggatcttctttgcctatcttccattttaagcactttctttctgagcctttttgtttattttatttttattttctttgttgtttttctattttttaaatgaacattgttatacttttatttgaatatattctttcttgggtatctcgtaatttactttttctgatatgattttgtctttttaaatccttttttttctctttttagtgtttgaatttatggtttaagttttttgttctgttttgctttgtttttgctccatacctcaaagtgtttgttcattaatttagtttggagtattgtgttaaagttttcttctttttcactgttactttttgggggttgcagaaggaggattgtatcagctgaattgtttatattctcattctctgatttctttttgtagtttttaataaacaaagactctttgcacttctacattttaatggtctaggttggtgatttgtagtagtttcttttttttttttaaatcatggctaaaaaatgtcctatgtagtcagtgtgaaaaaagcatagtttcattacaaagtgcatttttttttaggggaagattttataagggactaagttattagtcttccaattgtattgtattgtctcttatcttgctcaatctaaatttctctctcgcttctttttcacttcaccatataatttccaaagggcacttatttcttgcttttgattctcttcttgaagactgatgccaacctcttgaagactgattccttgcatactgtatgcatattctttccctgtgatcactgctctgatctacattgttgcagtattttcacacacacagggaagatgttttctgaaatatttttaaacaaaacaataacaccttgtgggaggtgttatttaatccaatttaaatatgtacatatttatatatagtctgtgtatatattatatatatcttttgtgtatatatttatatatatatagtttgtgtatatatttgtgtgtctgtgtgtgtatatatatatatatatatatatatatatacacacacacacaaatatatacacaaacatgtaataagtgtaccaaaacctatcagctggaagttttctttttctttttctttttcttttttttttgagacagagtctctctctgttgcccagactgaagtgcagtggcacgatcttgaattactgcaacctctatctcctgggttcgtgggtccaagtgattctcctgcttcagcctcccaagtagctgggattacagacgtgcatcaccatgcccagctaatttcagctggaagttttctaaaccttggataccaaattaaacttgacccggatatatattagtttggtgcaaaagttattgtggtttttgcattaaaagtaatgggaaaaactgcagttacttttgccccaaccccaaaattttatcccatgaagaagtaaaaacaaaaacaaaacaacaacaacaacaacaacaacaacaacaaaaactccttacctctattttatacatgtttgaggcttcatattcttttctgtgcccaaacaaaatttctttatttgttttccccctatctcatcataggaaaaatattatcctttggaagagattctacaagaaataaagatagttcaatgtttcctaagattgaaactttggcgaagatttgaacatactaagtgaatgatgtcttcacactttcttttccttatttctgtgcttctcattcctgatttgtgttacagagtctaaaaatcttctcattctagtacagagagcaatgcaactctcctaagagtctcctgcaaatttatctacccaagctaaagtgctcagcagtaaaaaaattccacctttgttagagggaagttttgatgaaatatagcacatttttactttgttagtatagtgggttaaaaaaggttttatggtctatatattggttgttaacagaagaatctcttgaggacagtgagctaacataaaagaatgaattttcaaatcagacttataagaatctgagatcttacctaatattcaagctttactaaataatgtcaaaaaaactcatgcaaagtagagtgaggactctggtacaccaaaggtcacatatcagatcctgtattttcaccttagtcatgcagttctgcccaaggatactagatcagatctctatatgacaaccttgagatcacctcatgcagtgggaatatttaaattatgaaacaccctcatttaataaatctaacactagtatagcctatttcacattttccagggagaagagcctgatatatcctggtttctatagtttacccttagttaggacatcttgtgaagtgcatttcagagattaagtctcttctttctagcaaatatctatagtccatttaaccaaatatctcattagcaaggaggtagaatggggtcagctgccaacatttttccccaggagcactcaaccccccaaaaggaaattaatcaatttcaggcaagctgctttaatttctttctttcattgatttgctgtgattttctcttttgtatttttttctaaaaccgtgggtattaaatacataattgtcagaaaaattgatgtaatggaaatggggaaaaaactcagtcatatattgtgatgttagaacaattcatttacctggttgcagctctggtctatctgtatataaatagcagacttcatgccttacgattcagtcacctgaagaacagtgtagtggccgaattgcttagataattgatattatatttatggtatctgagacagaatgaagattttttattaaatccctttgaagattagaaaataatgtcaatagtttgtatatttaatactatatatgtttatatattcatataacatatacacacttatatgttcatgtaatacacacaagcatatgtatacatataccatataagtcccttattattattgtagtaaatcaaagttctatatctatatactgcttaactacacataacttcctattattcttccctgttctttagtctctaattttatatagagtaagaattatatattattgtcttattttctgagcagaggtgtggtggattattccccaaaggtcttgttttctctgtttcttttatatttcatgtcaacattttcttgttgttttccaatttcttccataaaaatgtaatacaaagaatatcataatagcaatctttacatatgcattatttttaatttataaaggactaagaactgtttctgtgttctaaatactctaagtaatacattttctaagtaataaaataattttgagaaatgctataaatgtcatgttcatctttccattcataaaatactattctttctgctaccgtgctgtggtttctcccaatcaacagagttgcttatagacactctctgaagtcacgtccacccctggacaacttgatagatggcttttaagaaagaaatgaaacattatttgggggagggtggaacaatatggaagaatataaagcttcatccatcatcccacccacaagaacacaaaattaacaagtatctacaccaaaattgccttcatcagaaccaaaaatcaggtgagcattcagagtacctgcttttaacttcatactgaaagaggcactgaaaaggatagaaaagacagtcttgaattgccattgccacccctccttcatcccctggcagaggccacatgggatggagagaaaatttttgcacttaagagagggagagttcaacaattgtgaggcattgcattgaactcagtgctgccctgtcacagcacaaagcaaaactggactgaactcagctgatatctgcccttggaggaagtgtttaaaccagccctagccagagaggaattgcccatcccagtggttggaatttgagttctagcaagccttaacactgtgggcggaagtgctctggggccctaaataaacttgaaaggtaggctagaaaaccaggactgcagcacctaggcaattcctagtgctgagctgggctcagagccactgcactttggtggcacattgacctactgagacaccagtcagggtggtaagcgagtgcttatgcagcccctcccccagccccaggctgcacagcttgtgccccaaaagagaccccttccatctacttgaggagagcagagggaataataaagagaactttgtcttgcatcttaaataccagctctgccagagtaggatagggcaccgtaagagttgtgagacctcctttccaggccctagctcctggatgacgtttctagatataccctgggccagaagggaacctgttgccctgaagggaaagacccagtcctggcaggatccatcacctgttgattaaaaagctcttgggccctgaataatcagcagcaatatccaggttgtatgccattggccttggatgacaccctgagactttctggcttcagctgagactcagcacattccaagatgtggtaactatggggagagactcttgcttgagaaagcagagggaaacgtaaaggggactttgtctttcaccttagatatcacctcatccctgggggttagagcaccaagcaggctgtcctgaatattcttgggaatgatcaatgagttaatgaagtgattaagaagaaaatttaaaattttcttgaaacaaatgttaatgaaaacacatcatactaaaatgtgtgggatacagccaaagcagtactaagaggcaagtttatagctttaagtgcctacatcaaaaaaagaagaaaaacttcaaacaaataacctaacctagttcttaaagaattagaaaagcaagagcaaaccaaatgcaaaattagcagaaaagaaataataaaaatcagagcagaaataaatgaatttgaaatgaagaaaggaatacaaaagatcaatggaacaaaaagacagttttttgaaaagttaaaattgacatactttgagccagactaagtaaaaaagagagaagatgcaaataaataaaatctgaaatgaaaaagaagacactataactgataccatagaaattgaaaggattattagcagccactacaagcaattataagccaataaatttgaaaacctagaaaaaaatggataaatggctagacacatacaacctaccaagattgaaccatgaagaaatccaaaacctaaacagaccaataacaagtattgagatcatagttgtaataaaaactctcccagcaaagaaagtccaggactcaatgccttcactgataaattctacaaaactttaaaaaaaagaaataatccaaatcttactcaaactatttccaaaaatatgtgaagatggaatacttccaaactcattctgtgagaccagtattaccctgataccaaaaccagacaaagatacatcaaaaaaggaaagtacaagtcaatgtcactgatgaatattgatacaaaaatcctcaaccaaatattagcaaattgaattaaacaataccttaaaaagattattcctcatgaacaagtaggatttgttccaggaatgcaaggatggtctaacatacacaaatcaatcaatgtgatacatatcaacagaatgatactgaatggaggaaaactgaaagcttttcctctaagatgaggaacatgacaaggatgcctactttcaccgttattcaacatagtgctggaagtcctagttagagcaatcagacaagagaacgaaataaaaaatatccaaattggaaaggaagaagttaaattatcctggttcacagatgatatgatcttatatttggaaatacctaaagacttcacaagaaaactgttaaaacttataaacaaattcagtaatgttccaggataaaaaattaatatacaaaaattggtaccatttctatatgtcaaaagtaaacaatctgaaaaaaaaaaacaatttagcaatcccatttacattaggtacaaataaaataatataactaggaattaactaaaaaagtgaaagatctcttaaatgaaaactataaaaaattgatacaagaatttgaagagaatgccaaaaatggaaagatattccatgttcatggattgaaagaatcagtattgttaaaatgtccatactacccaaaacaatctacagattcaatgcaatctttataaaaataccaatgatattcttcacagaaatagaaaaaacagtcctaatattcatatggaaccacaaaagacctagaatatccaaagctatcctaagcaaaaaagaacaaaactggaggaatcacattacctgacttcaaattatgctccagagctttgattaatcataaccaaagcagcatgatactggcataaaagcaggtacatagaccaatggaacagaatagagaacccagaaacaaatccacacacctacagtgaactcacttttgacaaaagtgccgagaacacacacctgggggaaaaatatcttttcaataaatgttgctggaaaagcaggatatccatatgcagaagaatgaaactagaccctgtctcttgccatacacagaaatcaaatcaaaatggattaaagacttaaatataagacttcgaacaatgaaactactacaagaaaacattggtgaaaatccccaggacattggtctgggcaaagatttcttgagcaataccctacaagcaaaggcaagcgaagcaaacatggataaacaggaacacatcatgttaaaaagcttctacccagcaaaggaaataatcaaagtaaacagacaagtcacagaatgggagaaaatacttgcaaactacacatctgataaggtattagtaactagaatatataaggagctcaaacaactctataaaaaattctaatactctgatttaaaaaatgggcaaaatacctgaatagacatttctcaaaaggagacatacagatggcaaacaggtatatgaaaaggtgctcagcatcattgatcttcacagaagtgcaaatcaatgctacaatgagatatcatgtcaccccagttaaaatggcttttatccaaaagtcaggtaataacaaacactggtaaggatgtggagaaaaggaaccctcctcatacactgttggtggtaatgtaaattaatacaaccgctatagagaacagtttggaggttcctcaaaaaactaaaaatagagctatcataagatctagcaatcccatgcctaggtatatactccaaagaaaggaaatcagtgtatagaggagatacctgcacttccatgtttattgcagcactattcatgatagccaagatttggaagcaacctaagtgcccatcgacacttaggttatcaacagatgactggacaaagaaaatgtggtacatttacagaatggaatattattcagctattaaaaaaatgtcatcttctcacttgcaacaacatggatgaaactggaggtcattatgttaagtgaagtatgccaggcacacaaagacaaactgcatgttctcacttacttgtggaagctaaaaattaaaacaattgaacctatggagatagagagtaggatgattaccagagactaggaagggggtagtagacgggtggcggggggaagtaggaatgattaatagacacaaaatatagaaagaatgaataagacctagtatttgctaacacaacagggtgactataataaaaattatttaattgtacactgtaaaataactgaaggagtataattggattgtttataacacaaagaataaatgcttgatgtgatggataccctaatgtgattattacacattgcatgcctgtattaaaatatctcatgtaacccataaatatatacacctatgtacctacacaaattaaaaaagaaacaaaaaaatcttattattccatattggtgaaatataaggagaatttagtagtttagactccctccctccctcccttctttcctttcttccttctctccttcccaacagggtctctctgttgcccaggctggagtgaaattgtacaagcatagctgactgcagccttgaactcctgggctcaagcaatcctcctgcctcagcctcccaagtagctaggactacaggcatgcaccatcatgcctagctaaattttaaacattttctagagatgaggtctactatgttgcccaggctgatctcaaagagtttagacattttcaaaggagaaaatgtgcttatagcaatctgaaaaagcttatctcaattgactgaaaaggaacagttaagaaattaaatggagctttgttgtattaaaggaagtcttgatcttgatcacatgaaccgaagcacctctccttttccgtcaatatttgacttttaaaatctggattacccagactataaacatgaaagttgcttttttaaaactcctgtcatgctctctgacttgcaataatctcttgagctttctttcagaagtgacagtgctagtttggagaaaattttattttctggtaaagtgaattaatttttctagttacatatatttcattgtaaatatatttctagtgctagttgatggcaggagtttctgttgatataaattgtgaacttcaaaatacatgtttttaaataaatgttttccatcataccatatagtattatttttctaatgtgtctcaaaatcacatttgtggttgtgcattcagtgggctccatggcagagctggggaccagcggggctgccccacagccattgtaagtttattgtgagaaagttggacgcagccctggggactcctgtgagcagtatctcaggatggcagcactaggccaacctgaaattaatttttgaagggaagttatatttacgtcacaaattaaaaggttaaacttttttaaaaaaataccttcttatacattttatagaaacgtcatttgaaaaataaaaaagagatataacatatgttctgaaacagagtttctggaaatagtttctggaaaagaagaatgtgtaacagattttattggtatatttcattcctttcagtgagagcttttatttgaaaggtgtcttgatttctacacctttggagacaatcaacacggctggtgtggtcccattagaggtcatattaagaatacccatgagtgagctcctcttagtgggaagaggcgagaagtgaagccatatggaaaaaactacctctcttagggacacggtggtaatctcaatcatgaagatcaagaagtgaaggcaagtctagcccaactattctttagctgaagaatcagctaatgaagttatgtttaaatccacagtcctgggccccagctaaaaaaaaaaaaaaaaattcagtttatcttgcggatcccaggactgcatattttaacaagcatcctgagtcaattaagctgattctctgaacacactttgagaaacattcatctggccctttctgtatcagcatcaatatctgagtggtctgatctgagcaactgaggcagaacacagcagaagagcttcaagtcgctatattcttgtccaagaacttaacgtaattcatattacttaagtaattaatgttattaatgacatagaacagaattgggactctttttaagtctcatagaaaattagaaagcaatgtatgtactccatatatgtgtatatatacatataaaagtattatgtattttaaaaagcccatatgtttgcctcattatcattgcaacaaatcaaaattccagatctatatacagtcagccctttgtgtccataggttccccatcctcccatcttctttttctccctctctgtcaccagactatttcttctcctgagttatcagactaaattattttcctaccaaaatcatttcagcttttgtaaaaaaagatcaacctgcaaaagagattatagggtgtgagccaaaccatgacagtccctggtagaacactcttgcacatgttttactctccaacattatcgttgagtagactcagaatgcagaaggatgagctctgccaggaacgtggggttgcttgtttccctgaagactagttatgactgtcttttttgaaccatgcaatcatagcagtgtcttgacctttaatattgatgacataatggtttgttatgttttaattaagctctaagaatatttctggcaatttagtattacctctcctgtggcctacacccagaagttaccctttcaaggacgacgtaaaatatgattctgctaatgctagtgttttacatgccagtcttttattcagctcatggtgttttcttttctcctaaaaatactttatagcaaaggaatcacatctcaaaaagaaaaggcatttattaaactaagggtagaaataagaagaccaaaaggaattgccaagaaaagcttttactaatgcttcacattaggaatctgcagaagcctgtgaatgaggaaatggccagatttagggaacttgaataattgcctttggagagcaaagttgtattaatctcattggctttttgatttgctattttcctccccatcttattcacttcaatttttgtattttcttttttcttagagtgctaactttcatgttgcttttctaaattatgcactacccctgctgtctgtcccattctaattaggccttttctatttatacttacaatagtgtaaaatctcaagacacaacttttcttgctcctagagtaggtgagccacaaatgagaagttcagatagatgcagtttaacagagtcagcaagaatactgacatacccatgagaaatctgccttccaggtctgacaggtgacacctttgcaatgatcagccttaatggttgatctgcattactaacatttccttggtaatctgatgtcacattgcaagcagctcaatattatagggtttttatcctacatcattagacgtacttcataaattttgcccaagaggcagacttggcttttacatatttctgtttatttaatgaaaaatagatttcccttttttcttcctatgtgatttgtaatactgcatattaatagatattgaatagaaaatacttgtatcatattctcaaacatttgaatgtgctatataagctctattcatgtcaagtaggacaatgattttatttactttttcaattattatgacatcatttttattggtaggactatttttgcatggagtagaaaagggcagccaatttaaaaagcttcttacgatagaagcattgtcattgttctccacctagtacctattgcagtttttcctaaagtaaattgaattaactggacaaggagcttggtgacccaaattttacttcagctatcaggcgaccttctttgtagcaaaagtgaatcccttagaagtcttttgacctttgttcacagttacacagctttcaacgttttctggtttaactcagagcgcagcacagagttacaaacgaaagagacaccttgcccctggggcacaaccaattcatttccagataattcatacctgcaaaactctgacttgcctgcaccagccacagactccactgttgattgcagtgttgcagctaaattatctggaatcaaggtccagtctatatatcccagatatagttttggagaaatcttttctctttatatcgtatattataagaataataatataaactcaatcaagaaaagctatttttaaaatactaaactgaaaaatttatctgccaattttaattgcactttggttccccctgtatatgctgatacccaatctcaatgtgagactgatttttcttctcatacttcccctctgtttgctccttacagcaaagttccatcaaaaaaatgaatattaactaaaaagagacgaaaaaagggaaacttcataacttactgactttctataaaacatcctttatttcctagcaatgtggttgaggtgcgttagaggaagacaagaaggcaaaaactgaaaacgtcttctctagaaatgacagagttttttctgcctacattcaacttgaataggccttaatgtttttgatctgtttgagaccactactcaaatattctgtagagttcacatgggaccaaaaattgatttaagacatgaaaattagacctgttgacaaaagctaagggaagtgaggttatttcacctggaggagaaagacaaggaaggcatgcaattcgagcatggaaagggtattgcataaaatacggatgacagctattccatttgaacctgagtttcacatttaattccatttgagcaaaaatgcagttcagttttaatttataagaggagaaatttggaatctatattaaatcttcttaactagaacaaaaaaaaatgaaaattaaacattcttcagttataattagaaccaagattgtctttgcttaataaggcctgaaagcaaagacgttttttagatgagaatgggtatgactgtgtgcttagtacttaccatatctcagaccctttgaagcaggagtaggcctctagaaaattatgaggacttctgtgtagtctcactgctttttatgtatggcagagaagtacaaagcaaaagaaacctttccccagaaaaacccctggaatacaaccaattcactcaacaggtaattcatacctagaaaaatggtttggtagcaccaaagactccaatgctaatttcaacgttgtacacaaattatcaggagtcaaggtccaggctaacacagcttcgccaatgtaatgatcacaacagtacaagtgatgaaacagaggcagaaagaagtagcttgaccagactcacacagccagtaagtgacaaggttagctgagaatcagtctattcatgccaaagcttatattctttccattattttacaatatatacctaagtgaagtttaaaagtcctttgcaaactctggattctaccaatacatgtcattaatgatagataagaatattttagttttgttttatgtgctaagtagaattcaaggttaataataggacaatgaaataactttctcactcacccccactccctttttttttaaaaacggagtctccctcttgttgccctgtacggagcctcccttttgttggagggcagtggcacaatctcggctcactgaaacctccgcctcccgggttcaagcaattctcctgcctcagcctctgaagtagctgggattacaggtgcccgcccccatacccggctaatttttgtatctttagtatagacggggttttgccgtattggccaggctggtctcgaactcctgacctcaggtgatccgcctgccttggcctcccaaagtgctgggattacaggtgtgagccactgtgcccagccctcacttccccgttttaaaattctaaaaccctatatctccttatggctaaatataaagtaacaattaaaatctcagagagcgttcataattcaagcttttatttatccaattgttcttatcagaagttcttaaactgttttttatagagcagtaaagagtataaaagagaatatgtgagaataaaatacttcctttgcaaaattcaatatatttctgaggcctaacagaccccaatgaagaaaatatccaccaaattattaacttcaatgagaatgagagttgaggcatatagtataatatttctataattttttttgctgaacatagcatggtttaatgaacaataacctttgacttcttacagagaatccatatctctaaatcaaaatgtatttgtgttcctctctgcttatatagttacatatatcatctcagcccaaagatatattttttgttgcaaatttaaggtgattaaatggtttttaatggtagcaatgttgcagttttaattacagtgtttattatcatgaagaatttaatgtaaatatatgacaattagcagtattctattggggaaagctgaaaataatttgtcccaatctggagatttgctgagacccataatatgcatacactaattcctttgccctaacaccaccactgtataaaatatctctagggattttaaaaggtaaaagtgatattcacagcaggagtgacacagcatataagggaaacttaaatttggcaggcttttagcaggattttcccccattaaatcacagtagcataaaataagatatgtaaaatcacctcattacatttattttttaactaggatttgtttgtttttaaagatccaggaaaaactcaccaaattcctcttctcataccctactctacttgaaatcctgtaagaattaccaactacatattgatgatttccatttttgatagataatttgagtatgtaactttaaaaacatgaatcctataaactaatgagcaagatttcattatcgaatagcccattttgcattactaaatggactacttttcttaactaacttggcacttttaagtatataaagaagcaaacaataatgatttttaaaaatatttccactttccaagcctttattccatttcctgaattttaacctgtcaaaaatgaaacgcatgcctatggaaaaggtaattacttttctccttctttaacttcttcttaattaacttttaatctatgctgttacagagggagcatgtcttaatactaaatgtgtctaaaatgtaggagacagagatttaaatcatttagataaacatctgcctagcacagaggcataaaaattacaaaattaggatatgggtggctgagtgccaacagtagctgccagcaaaagcaagatattgccttcatttaaaaaaaatcttttgcttacaaacaaaccaacttaataaatgacttctaaccatacactcttatattggagcacatttcttgttttatactacataaaattctaaaaacatgtgaatgagaaattgaagggaaataaccatgcaatcatttatgaaaggcatgttttaatagagaaaaaatcaataaattggaaaatttttaccatgaagtgaagcactattgctttgtttagttggagtggattctgtcaacagtaatttaaagtaatcagttcaatgatatgatccctggttggtgttcagataattactatacttatgtctagtaattttcagctattaaatggaatatagagtggcaagtaaagacaggaagctttgacccttaataccccctttactatatgtgtgtaatttgtcttctaataactgaaataacgtgacagtaaagtccatacacacaaaatggaaataatcctgcatcctttattcaagcctggttaatcaaaatgtcttgaatttttttttgcacaagatgtagtagaaatacacacacacacacacacacacacacacacacacgcatagagagagagagagagggagagaagtcatttataagcataccttggagatactgcagtttctgttccagactaccacaataaagcaagtcacacaatttttttttgtttctctgtccatataaaagttatgatactgtagtctattaagtgtgcaatgaaattatttttttaaaaaatgagcattccttaatttaaaaatacttattggtaaaaaaaaaaaattctcacaatcaactgagccttcagcaagttgtaatgttttcactggtagacagtcttgccttgatgttgatgactgctgactgatcaggttggtgactgtggaaggctggggtggctgtggcaatttttaaaaataagacaataaagtttgccacatagactgactctttgataaatgatttctctgtagcatgtgatgctgtttgataacattttacccacagtagaaattctttaaaaattggagtcaatcctctcaaacccttctactgctttatcagttaagtttatggaatgttctaaatcctttgttgtaatttcagcaatgttcacagcatcttccccaggagtagattccatctccagagaccactttctttgctcatccataagaagcaacttctcatccattaaaattttatcatgagcttatagcaatttagtcacatcctcaggcttcacttctggttctcctattttcaccacatttgcagttaattcctccactggagttttgaacttctcaaagacatccatgaaagttggaataaattccttccaaactcctgttaatctttatatttcgatcccctcccatgaatcttgaatgttcctttccagaaggttttcagtttacttttttttttttttttttaccttttcaagatccatcagaggaattattagctatggcagctataccttataaaggtatttctcatataataagacttaaaagtcaaaattgcttcttgatccatgggctgcaggatggatgttgtgttatcaggcatcaaaacaacactaatctccaatatctttatcagagctcctgggtgacctggttcattgtcaatgaacagtaatattattaatcttttttttggagcagtaggtcttaacggtgggcttagaatatttagtaaaccatgctgttaagagatgtgccatcatctaggctttattgttccattcattaagcatagatggactatatttagcataattttcaaaggccctaggattttttgaatggttaatgagcattggcttcaacttaaagtcaccaactgcatttgccactaacaagagtcagcctgtcctctgaagctttgaagccagacatcgacttctcctctctagctaagaaagtcctagatggcatcttcttccaatagaaggctttttcatctgtactgaaaatctgttttttagtgtggccaacttcatcaattatcttagctagctagatcttctagataacttgctgcaacttctacatcagcactggcgcttcaccttgcactttatgttatggagatggcttctttccttaaacttcatgaaccaacttctgctagtttccaacttttcttctgaaggtttttttttttcctctctcagccttcatagaactgaagagagttaaggccttgccctggattaagctttggcttaaaaaaaatgttgtggctggtttgatcttctatccagaccaccaaaactgtctccataacagcaataaggctgtgtcactatcatttgtgtgttcacaggagcagcactgttaatttccttcaggaacttttccattgcattcataacttggctgtttagcataagacacctagctttcaccctgtgtaagtgtacatgccttcctcctccagcttaatcatttctagctttttatttgaagtgaaagatgtgtgactcttccttttaacttgaacacttcgaggccattgtagtgttattaaatggcctaatttcaatgccgttgtctctcagtgaatagaaagtcccaaggagagggaagagagatgggggagtggctgttccatggagcaagcagaacacatacagcatttattaattatgtttgctgtcttatatgtattcagatcatggtgcttcaaaacaattgcaatggtaacatcaaaggtcactaatcatagaccatcataacagatataataataatgaaaaagtttgagatactgtgagaattaccaaaatgtgacacagagacaaaaagtgagcacatgcagacggcaaaatattgctgacagacactgtctacacagggctgccacaaacctccaatttgtaaaaagcacaatatctgtgaagctcaataaagcaaagtacaataaaatgagatatgcatgtatctcctctccctctccatatccaaatgtagtaaaggaaggaaaacaaacaatatatttattaaaatactgtattgagaaagggaggtagaggcattacaaaccagaaatttccattagcttctgagattcaaaaggtggatgaagggtattaaatgtataacacaagttaagggaaccccaggaaactgctacagtggtgctgaaaggttaatgaattcttgacttgttgcaggacatggggatcacagtccttttctctaaatagtttgtgttccactgtcttcttgcttccagtagcaaatgtaaaatctgaccagtcagtacaatggttttacctttcaaaatatcttgctcgggaggctgaggcaagagaatctcttgaacccaggaggcagaggttgcagtgagccaagatcatgccactgcactccagcctgggtaacagagcaagactctgtctctctctctgtctatatatatatatatatatatatatatatgtatgtgtatatatatatatatatatgtatgtatatatatgtatgtatatatatatatataatcaagaatttttgtaaaaaatttcatcctcagacttctgaatggttgtcttttttttcagttagtggattattatttgtttgttatttcaactccatttgttacccttttcttcttctgaaatactgttggcatgttagatctctgggatctgtttcttatgattatcatattcttgtggggtttttggtctttgttctaagttatttcttccatgtgatcttattacaaatacaagtctgagccatacctggccttttctaatttaaattccagtgttttattttataatttatgaatcacaatcattatagattttctgactatatccgtttgatggtcctcattcattttatgttactgttttctttgagttcttcatcagttctagtaataatttattgggaactatcacttaaagaattttggatcactcaccattcctcaggttacttataccctttaaggttatttttttttttgccatattttcattatatgtgcccccagccttcacacatggggatattatgggttctgagctaaggcagactttcagtggaggatggtgaaataaaatggaaggcacagtcatttttgctcccgtggtcaggttatgttatctgtcaaatgtgttattctctcttgaagcatctgggtactgcatccccagtcccctctttttttcaccctgagtataagtaagagccctgtatcactcacaggacctgcgggcaatgcagcccagtaatgcaggtgagtgcaaggtgactgatttcctccaagcctaagagagtaactgggatcaagcaacctttgaaagactacacaaagccagtgtgccctctcatcagggagatttgtagatttcagttgattctccttaggaaaaaaatttttccctataccatctgcagaatattagattcatcctccggctctacccagatgcctccagcttgcatgcaccatattctaaatgactccaaagagagttgggaggaagaaggagccagggatgaaaaccttagttcccaaacattccttattttgaaaaggagacaaaaatattgtttattttgaataatgtgactatatatctctaaaacctaaaggataaaatgaaatgctttttaaacataagataattcagtaagattatgggttactataatgaatgtccaaaaataaaacagaaaacatagcaaaataaaaatcgaaagaaaaaggataatgtataataacaatacaaccataaatctcttggaatggaattaataagcaatgtgtaatacttataatgataaaactataacactctcttagaaaacaaaatgacatgtaaagagagaggttttctttgttcttgattggaatatttagcactgtaaagagggtagatatcttaaaaatgtcttcatgaaatcagaacaaatattcagaattccaataggattgcttttctcgggcatgggagtgggacagagagttggaatgctacaacacaaataaatctcaagtacctgatacattacatatgagaggattcagaaaattccttcccaaaataaaatatattataaaactagaattaaaatatgatgtaaatgaagaaatacattacagaagcaatgattttcaagacatcagacatcaggctatgaagaactatgctacttgagtgatgggaacaatttagggaagtcccataaggagtcttcagctaaaaccttgagatagcttttgggaaatggcatatggcagactctctaagaggagaagttgaaaagtgactcaagtttgtgagacagagtactaagagaggtaagtccttcatagagaaactcgaatatcttcaaacggatctcctgaagcatttagcagagtactaatcaacacatatttatgaggaaagtacataaagcttggaaagaacatgtgaaaggattagaggaagggaagcagtgccaaaagctgagatatggtgctgggaattatgcgtgttataaccagacagattggaaaaactcataatccacagggcactaggttagtactcaggaaagtctcataatttcatttggtgtattagtatgagttttccagagatatagaaccaatggaatgtatgcatgcgtgtgtatacatatactttaagaattgattgtggaggctggctagtccaaaatctccagggcagaccagtaggctggagactcacagaagggttgatattgcagttcaagtctgaaggcagtcttgatgcagaattttctcttacatgggggtcctcagtttttttctcttaatgctttcaactaattggatgtgacccacctgcattatggaaggtaatctgctttacttacagctactgattgcatctaaaatataccttcatagaaacatctaggcctatgtttgaccaaaaactggatactatagtttaacaaagttgacacataaaattaatcaccatactcagtattttacagtactcagaagttgcttcagtagtgaggagtaagcagccctaggttgagcactgctctggacccatttaacaagttagaaggcaagactcaaaaggatggagctataggaggaattttaaaaataatttaacacccaacaagataaagttcccagtgtttgttatccaataaaaaagcaggaaaatagcatacataatgaataaaagcatgcacacacacacacacacacacacacacacacacacacacgcagtgtgtagtattcagaagaaagactgctacagtgatatgttaaaatgtattatcagcatttctattgtgatctttaatagacatcttaaagttacatcaaaaaccaacctcctgggccaggcagagtggctcatgcctgtaatcccagcactttgggaggccgaagtgggcagatcccttgaggtcaggagttcgagaccagcctggacaacatgatgaaaccacatctctattaaaaatacaaaaattagttaggtgtggtggcacatgccttaatcccagctactcaggaggctgaggcaggagaatctcttgaacccagtaggcagaggttgcagtgagctgagatcgtgccactgcactccagcctgggcggcagagcacgactctgactcaaaaaaaaaaaaaaaaaaaaaaaaaagaaaccaaaaccaaccgcctgacctcactacaacattaccacatccccaaacatgcatttcccactacacaacccatttcaattgatggcaacacaatcttttcagatggtgagaacaaaaaccttgaagttattattttactcctctctttctctccagttccacatctaattcatcacaatatcttgttggcaccaccgcacctgttgtaatagcctcctcttttttttttttttttttttagtctctgctctcttatagtttaatctcgacatggtaaaacagagtgattcttgcaacatgtgactctgatcagtcactcctatggccagtctcaagaaaggattttcattttattcaaatagaagctaatgtccttccagtgacctacatgatctgctcctccgcttttcttctgacaacatctcctatgattctcctagctcagcactgtctaatgatgaaatgtaatgtgagtcacatatgcaattttaaagtttttagtagcacattaaaatgttgaaaataagtgaaattaatttaataacattatatttaacccaacatttcaaaaacatcatttcaacaacatgaaaccagtataaaaattcaacaagtaatcaatataaaaatgatttttggtatttttttcatgcacagccttaaaaatcagaaatgtatgttatactaatagcacatcttaaattggtttagctcaatagccatgtgtgataaatgggtactatatcaaacagcacagtgccagctcttgcctctccaggcacattggtttcctttatattcctggaacatgccacccatacttttgcttcacaacctctcttatctaatgtgctgaaatgccataataccacatactgggtaatttataaacaatgaaaatttatttttcatggttctggaggctggaaagtccaagatcaaggtgctggtgaaggcttccctgtctgcttccaagatggcgcccttttggtgcatcctatggagaggaggagcactgtgtcttcacatggcaggagaaacaggtcaacaatggggcaattactagttccctccagcttttttatcaggtcactaattccattcatgaaggctccacccttatgacttaatcacttcctaaagccccacctctaatactatcacatgagcaattaggtttcaacatatgaattttggggacattcagacagtaacacagcctttgcatcagttgtttcctcttccaggaactgcttcctccatatataaacatggattgttttcttacctccttccagtctttttcaaatgtcaccatttccatgaggccatgccagattactttatttaatgtatcatttattatgttttaataatacataaattacttatttataatgtttattatctatctctcctctcactgtaaactctcctatgagggcaggaattttcgactgttttgttaatttatatactcccaacttctcataatctctattccatagaagttcaataaatacctgctgaatgaatgagaagaattaatgcagtcggatattatgctctcattccaacaacctagagtcatgtactgattttgagagatattcaggatattttggcaaagaacaaaatagacatattgaataattgtggaaacatatatccttttattatttcaaaacgtgtctttggatatgagtatagctgtgattgagatgacatatcatgtttataaagaaagcataatatctagttgctataattaattgcgtctgtctagagagtagaaatctgtggagagaggacactttcatagtttttaattatacttatatatatttagctttttaaataataagtatgctccttgtgataatttaaaaatacttataggtttaaaaactggtaatgtcataaaatattgggagcaattattctcttgttctaaaaattaactcatttagggtgctaaaatctatttcttggaggtcccctttgtaaaaccctgtaggtatttttccagaaatattcggagacctctacattgtatgtgtattattctgacctccttttgtatagggctatctgcgtttcatcattttaattccaaggagtgattttataaactgttcctcagttcatagtctttgcaattaaattgtaagttgacccactaactgaattacagaaatcagatataaacaaatgaacagatttcagctgttcatttgatatattggtttgaattagttttaatgggccacatggcagttttctagcctgtaattgctattaaacagaattctgtaaattcactgaagatgtttaaatactctgtgtggtaatacaactgatttgtgttttgtacaagttaataactatagattgaattaaaaagaaaatatgaccaaaaaagagggtctatttaatgcagtttttgttttattactttggaagattcatatgtcttaatttcaatttttcttttatttcattttttcaaaataaaattataagaatataagaataaataataataacagtaacttgtatttctactgtgctaagagctttaaatattttttctcatgtgattcttacaataaacctataaagttgatataaatattatctcagtttttacagatgagaaagttgaggtttaagaaggcagaataacttatctatgtccacagagctaacaaggttagaatcaacacttatatattattgttagtttcattctaaaactgtgtttttaagcattatgtcactaatatatttatcctagtgaaaataattcttctgatcatctttaaaaataaataggcctaaaattgcaaagggattttgacctcaaatcgattataaatccattatatgaaactgttatatatggtatcgcatcacaatacttagaacaccgactggaacatagtaggtatacaataaataattttgaattaatgaaattatgaaagttctcatctaatattctaaatctttacagtgaagggaaaaataccttttaaagtgggaagaacaaaagcaaatggcacagggtgttagtatttgagaatggaatagtcaaataaaagggattcaaattcacttgactggatcatttagaaaaactacaaataaagctggaaagtgtcaggctattccatagtatgcctactttacagattaccaaatacatatagtttatgtgagtttgtatacttaacaggggaatatttatttcctctgttaattttatgcatgttgaaatatgtgagggcctggttaaaataagaagccctctctgtagcccagataaaatgagcctctcattcttctccattaaattaggagacattggttggcctttaaatatcattctggactagttaagcaaactcataatgtttgacttctgtttgaccagctcctctctccaaactttgtcaaccacaaaatatcgtatgacacattatatatacctgatgatactcaaatactcttcatctttttattctctaccactttactagtgcagattatcatctgttctagaactaatgatgaaatcaccttcaaattattccccttgtgttagaagtccagcttgttgaccacttcttcccactatcaccatatttatcttcctagaacatgtgtctgttcttaaatcttgctaattccctgtcaccttttgctaattccaggaggaagtgtaaagcttcctcatgaaattaaagaagtctgccacagccacctttcctggctcaccttcccacaatcctccagcaaacctgaattgcaatcataaagaccaactctggctgccccagataaccaagcaccatctgaggctgaatcttgtttctaaaatgctgtagctcttcctttgttatcagtcaaaacccttctcaaacatcaaggctcagaaaaaatgccatctgtttcatgatgtttttcctagtctcccctattttactcctaccttaaaattaagcatttccataaaactttacttatacctacatttattgcatatctccttcccatatttattatagttgtcattattctttccttattggtttcaaactctttatggacaggtaaagtggctcatgtaagtgtttctcttccagtgcctagaacaggacaatatttgcagcaacaaaatattcaatataataaaaatatgttgtttactgaaaaaacactcaataaactcaaaaactacaataaaatattttgtacagaataaagatagcaaagaaaaaaacataattctccatataatggaaaaggaacatgttaaaacttgtattgataactagatgaatatagatggatgttttactggaaaagggaaatagaagagcagaaaggaaaacacatcaaaattattctttgatttcaactttccaaggaaaaattattttcaggtactaagtttgtctgcattgcaaaggagtgattttgtaatttccagaactgtcatcctttgttccactgttgtccttcacccagtatgctctctggggggttttaggagattgcacaccaggagcgctgggcacaatggcactgaagtcttgcagtgcaggaagcctcagcaatcaattcccacgctttccaggtggtgctgtttggttccattcacattaacttttcagctttctatgtgaagaaagcctccagatagtgaagagggagggagagcaataagaccagtgattacaaatccatcactttcattgttccagagccagtagcagaacacagctgatagacaaagcactggttttgttcaataattaggttgtttcttagaggagaatatgaagccttttcaatattttactctttttagaaaatatgtatattgtatcaaacattgtgtagcacacaatagaaatggaggttttaatagtagtccttattgtgaacatcaaatattaaaggcagttttgattagatttggggaagaatcagctctactgcatgcataaagccaaaatatgtgggacactggtccacctgagaagcaaggtagatatttcccaaattaagggtaattcaggagaggtattactattgcgtacacttataaaatatactcaaaatttgggcaaagataagaaaaggatttttaggcatatgggtatgtgtatgtctttctgaaaaaaaaaaaactaaaattttaagaatgctatcataatgatatacaagtaaaatagtctggatgtgaatacatccgggtcttttcaagatggtccttgccaggattttgttgaaatattattttcatgctatcaaacgtcctaagtaaatgtcattgtggtttctttatttactttttgggcccctactttctcaccgtatttccaccaagtctgacaccatgttagctgtaagtggggcaaagagatattataaaacattcttcagtgattagagacataaaaactataaaaaataatgtgttactttgtaaatagaattcaaattagaatttaaccttcaaaatatttttttttggaaagtgatgagaaaacactgcatctatatggaagccgtgcagtataacagaaaatgtcctgttgtataaggatggaacacagaatttatttccacaactatcactggctcctaagacattaaagctagtcacttaatttctggtgtctatcaatcagttcttaaaaatggaaacaatgatgcaaattcataacaagagatcatacaaatattgggatgataaataatatgtgactgtattttagttgcccagtatgccattttgtgattatttttcagaaaggattcattcctgaaagggaattacagaaaataagcactattggtgtgtactgtattattagatatttttacacaaaccattatgttgaactcagaataaaaggcatattttaactggacatagagccttgatttgttctaataaaaccctaatttgcccaagttttatcagtaaccatggttcccacatagtactcatggaggtggccatggtttttattttctaataagactcactgtggtacaaggtctgactcagagcttttcctaggaatataaaaaggataaataaaaatgtaaaagaaaaattatcaaactgtcccttgataactaaatggttgatcataaattggagtgtctatgcaaatgaagtaaataattaaaatctccaagaacagcattgactaggtggttgatgactggcaattataaaagctgaatttttaatatgcatacatccaaggagccagtaaaaattagctcccagactaatggacttgcctttcttccgaagcagaattttaatgagagcattatttataacggagagcccaagaaccagggtattcttgcttagtctcatttttttttccctgacaccttatccattaaactatgaacttctttacagaagaataatactttattccctaagaagtaaaggtcaaaatgacctcagaaattcgttgcattatatatactctaaagacatgccacttaggacaaaagaaatcataaagcctgtgtttctaaatacccaagttgtatatgcttttaaaatatatttcataagatcaaattacattccatatagttttgcccttccacaaattttctgtgtgattatttcctacataagataaaatgcaaaatctttgaaggacacttaaatctttttgcatatatttttataaggcttgagaatggttttaatcattccgatacgtgtatattgttaagctgctaatttctttgaggccattgaaagggtttaatttttccctagaaacaccattttgttattggcagtctgtgttataaacatcacagagtttaggttgccactttcctttttgatatttcaaccggagcgatgtctggttttgctttcatgactctttcccccacagttgtaactaagcaaggactgtttggcagatagcatctaaggagattttattgtctgggtgacagctcccttaaactatgagtcaggcaaaagcctggtccaaggatgagtcagagagtggtttactcagagctgccttaaacagaaagtcactagttcccatccaattctatcccttcaccctcattccagtgccaacctaaaatcatatgaccaagggagatgggtggtaaaagcattatcaggaggaacatgataaatgaggtctcattagtctaagcttgttcccttctgtcacctttttttttgttgtttttaagccctcagtattttagaaacttctatatctactcatatatactgaagaacctaaattttctaaaaaaaatcatagattttattaaaaatctcagaatgtaggtacctttctaatgtccaatatcagatagacaacagacaaatgcttaggataattaggttctttatatcaaccaaggcaaggccaggagcttctcactgagactctttgttcaataaactggagattgtaactttggttaataacattgaattgtgagtatagttaagtttatttttatatgtgttttggcaattttgtgtttcttctcttttttaattgcctatttttatcctttgcacattttcctcttggggaatttttttttttttctgattggtttgaaatacctctttgtgcattaagaccatgagttttttccttgcaacaagtatttttcaagtttgttatttgccttttaatttttatacttgtaatgcataagtatgtttatgcttctgtgtgatcaaatatacctatactttccctaatgttttatttcttatttttatatttagaaaagatgcccctactctgataccagatgaatatttacttatctttttctgtaattcttgtttgtttacaacaaatgtaattcattttggcatatggtatggagtagatctttattgttttccaaatactaagccagttgtccaaaggctacttatcaaatgtcattctttctccactgctttgaattatgtgatttataacatagatcttcgtagctttaatatatacaaaagcaattttttttctagtcggttccagccatttatttgttttactccagtattaggaatattttactatttctagaaaactggaatatttcctcacctagtaagtattgttttttgtctttttagcatcaaatgagctgatcatatagattccctcttttgatatatcaatatactgatgtaattaagtctatattatatcagtagagtttctaacatataaccacccttgctttcttagaataaatcctacttggttatggttttattatattaacacattactaatatttttcagatttctgcatatatatagtataactgagaatgttatgcagttttctttttgatctgtcattgcccagggctttataattttttcttcttaattcataatataaattggaaaatatagtagagaaagttataaaaatatggctgagtcaactaagaaattcaatgattcaccttcatctgccctacccggaaactgtacaaataaccaaagcattataaaaatcgagaaaatctaaaggtctgcaccagtactggaaactaggaaaggagtctatccacacaaagaatattgagtagtttctgctgtatgtggtgcatataacaaatgaagacttttgtgatagataactcacaattccacatcccaagaaaatagtggagtatctcaggaatatagttatacagctaggaagatcttcaatagcatctcctgatttgaataggcaagggctcaaagcaagggcaggtctgtagatagataagatgcaaaacttctgcccaaatagtctatgctcagcacattaaatacaagtatagtcatattagctcaaaagccttcaggcagtcggacttctccctggtatggcattaaaagctataaataataaagtaattcagtaaacagtataaggcatgtagaggataagcttgagatgatcatacagaatataggagaaaaagaaaaaataatgaaaacaaccaaaggaaaaccatttgcatagatgaccgaccttgaaaaactaaggtactgatttttctatattaacccaacatgaactccaacataaaattgggagttactggtggatgtctccatgtttactgcaccaattatacagaagaggcagctgtcagtcagcctttcctatcctccttcaatttggtgttgtagattgctgaaatacactacaatgtttttgtgagtatcatctttccttcatcatcagttcccatttgttatatatatttctttggtcattgtaatcaggatctaggatgaagaacacaatttttgccttattcttttatgtctttatttacttaaggcaataacactgtaatttagttagaaacttagttcattaactcaaaagagaaattataactaattttaaactctctgagtttaggttttaaaaattagtgaaatttctcattggtttcaaaataaattaatcataaatatgtacaagctattttttaagaaacaatatcttaatcataaaagtcacaaattgaacttttttaaaagcattatttacaggaaggtgctttttttcttgctgcacttttctaaagataaatacatgacccttaacatttccagtttccagttgtcacacatctttacaaaggcaagcacaaaatttgcacctgttatatgagagaagtaaatgtcctttgagatactttgacagatacattataacaaagtaaagcaaaatttttagtctttatataaaaataaagtagaaatatctaattaaggatatgaagaaagctggtactatttctgatctttctaatgcccaaatgaatgttgtattgtttcaaagtttcaaattctattaaaaaattgctggcagatatgttcttattaaacatataacatcataccactcctacaccccgaacaatcccacccaccttgagtacaaatcattttcaaaatattgtttgtcaggaatttttcttcagctatataccatttaagaatgacactaaagggaaatactagactagggaatctgtttagggaaatctgctattgaataaaattggcatagatttaataatatgagtttgaagatagaaatgtaggtgtttgataaaaatttaggtaacagaaatgaaagcatttgaaaatagacatttaagatatttaaaaatagaatccaagatgatgtcattaaaaactgtattatcagaaaaagtagaagacaatatattttaattaggaggggtaggactttttaaaaaatgtttaaaaataaaaatgtaatgtattttaacaataggacaggacaaacatcagttttttaattaaaacccaacttggatttagtttctatagtactttagatacttgtatttccaaaataatatacagacagctactcagcatatgtgtgaatatgaacacatacaaatatattaggccatttcaatttttcatcacaaagttaaaatttctagtgacaattagtggttcattattccttttagaaaagtggctgaatataagatcaacatgaaaagataccttgcagtcctatatacttgtaacaaacaactagaaaattaaatataaagtaagataacacttaaagtagcaataaaaaatcaactacctaccaaaattggtcaacaatatggaatttctctatgctaaaaactaaaaaatattattggtggaaattttttctttttttttttttctttttttttgagacagagtcttgctctatcaccaggctggagtgcagtggcgcaatcttggctcactgcaacctccaactcccctggttcaagcgactctcctgcctcagcctcctgagtagctgggattacaggcgcccaccaccatgccagctaatttttgtatttttagtagagacggggtttcaccatgttggccaggatggtctcgatctcctgagctcatgattcacctgccccggccttccaaagtgctgggattacaggcatgagccaccacgcccggccggatattttaaaagacctaaatatatgcaggaatatttcatgtctgtgcattggaagaactcaatagcataaagatgtcaattcttctcaaattgatctataaatttagtgaaataccaaataaaacattccagcagtttcttttatagaaagacaagtgattctaaaattcttatggcaatacaaagggtcagggatagtacagacaagctttaaaaagaacagagttggaaaacttacactaccagatatcaagacctactataagtcttactttaataatgacatggtgatattggctcaaaaatagacaagtagagtaatggaacaaaatagaaggcctaaaactgagacccatataaatgttgccaccacttcaacagaagttacactgtaattgcaatggattgaatgtttgtgtcccttctaaaattgatatgttgaaatcctaatgcccaatgtgacattattaggagtgaggctattgggaggtaattaggtcatcagggtgcacctacatccacgcaaatcatattagtgcccttaaaatggaacacaagggagttctctcactctctgctatgtgagaataaaatgagaaaacagctatgtgtgatccagaagagggccctcaccagaacccaaccatgctagcactctgatcttagactgccagcctccagaactgtgagaaataaatttctatgttcatgaaccactaagtctatggtattctgtcacggaaatctcaactaagacataaatacaatggaagagaggttgtttttatgaatgatataggatcaatttcatattcatatgacaagtaataaactattgctccaaacttatacaatacacaggaattaatcctagataaactatataccttaaagtgaagtgcaaagcaataatttttaaagaagataatggaagggaatagtctaatcatctttgacttttgggtatgtgaggatttattaaatgggccacaacatgtattattactgaaagagaagatagaaacactttcaattatcaaaatcaagaaattccattcattaacgccattatgaactgaaaagacaaccagagtgggagaaaatacctgaaaaaaagctagggtacagaaatatgaagcactcctgtaagtcataataaaaagacagttttcaattaaaaaacaggcaagagatttgaacagtacatatacaaaaaatattcaaaggactaataaatatattaaaaggcattaaacatcattagtcatcaaggaaatgtcctttgaaaacacaatgagataccactataaacgcaataaaatgccccaaagtaaaacagcagataacgcaaactgttagcaaggatgcagagtgggaaaagaatattaataatagcattattttcaatagtcaaaacctacaacaactttaaatttccatcaacagtagagtcagtaaataaatggcatagcttcatacgttgaaataccatatacaatgaaaaataatgaaatactgccacacaaaacaattgaattttataatcttttaaacattataatcttttaaacataggagtgcttcatatttctgtaccctagcttttttttttcaggtattttctcccactctggttgtctttccagttcataatggcgttagtgaatggaatttcttgattttgataattgaaagtgtttctatcttctctttcagtaataatacattttgtggcccatttaataaatcctcacatacccaaaagtcaaagatgattagactattcccttccattattgtacattaattatgtacaatagtacataattaataccatttatgtaaaattaaaaactttattgataaaaatcaaaatagtgtttactttatggggagatagttattgagaaagggcatgaaggaggcttctggacgccgtaatgatctacaagtcaacttaggtattttcacttgacataaactcaccaacttaaacgcttgtgatttcagcactttgctgtaagtatgttatatactccaacaaaaatgttttcttacaaaataaaacagaaatatgcagaagaaaaacttcatatcctcaggggaataatgaaccatacgtccttaacacagaggcgaaattccacagcagccccactcctgaagtccaaggcagggaaatacacacatgatgataattaagtgaaactgatttatttttatctcagtatacatttttgtagcgctatatgacttcatgtgttgtgcttaaggaaatgcattcttatatctaaagtaaggatgaacagattgtaaattcaagaactgtgctggagtttaagacttttttatagtaattgttaattttcttaagtaaagatttctgccttgattacaactaattagcaaataaattttctttctgtcatatccccttatatggaatcaaaaacttattaagcatatgtctatatttgaatgcatttttacatgtgaacatctcttttatatatttaaatgtatatttgacatagtagagtatatatttaaatgcagacacacacaaatacatatgcatttaagttttaaatgaatagtaaacagtgatatggataacccaaaaatcgtttctatttgaatttggaatgtcttgcatgatttttgaggtatatttatcttcttgattacagcttgtttagactgatattaaaattagtctgcactacttgaagacacaacacctgatcttgaagaattatatctaaaacatattagttaacagaaagaaggtatctagggattaagtgttttacactaatattcatccagaaagatcagcaacatactgataaatggaaattaactgtaaattaaattcaatcattaaaataaggacatgcctgaaacaaaattaagaaattggcctaaagtgaaaattagggtatctcaatttattttaattcttcttattttattctgtgtgtgtgtgtgtgtgtgtgtgtgtgtctgtgtgtgtgtgtgtgtgtgtgtttgtgttgagagagtgtatgctacaataaaaagagcacagcccttagattctggcaaacagatgtttgactactgagtctattagttttaaaatatggtagcaagttacttgacctcttgtagttcttattatagaatgtgccttgggctgtgatcgtgagaatttaaccacaatggcatatgagttcatagtttgcttttggttgggcaaagttaataagtaagcaagggacagatcatgaggtagagagatctaggctgaaagatgataaattcactttgggatatattcagtggaaaccatcaacttgtaccctgatcaatagcaagttggatttagtgatatgagctggagacatagttcagagtcatcttatatatgatggactttggaaatggaagctttggaaatgaacccaggccgcctggaggagtgtgcagcatgagaatagaggagagcctggaatctagaagcctaagaataacaacatttaagggaggccaagaagagatttattttgcatcttataatctgatgatacagatgtcattagtttgattacatgtacaaataaacagagcaagtagagaaaaaatatttattaataataacaggcaaccacaacctccgggtacctaggggcaagaatataactgtaccttgtgagggactggagccaggaatgagaagccttcaagggatcccgagaggatgtccctcactcttgtttctgtttcaacctgaatatcttctttattcttctacaggcaggcttcatttgttcttctaaacacatgtttaaaaaagttaacactgaagattcccagttttatgtctcatctatgcaagaggccaactcaaaacaaaagtagagttaaaggccttattctcagtttttgggaaagggcattatttcagatacatatcttaaggcttttcactgattttcccagcactgctgtctccaaagtcatctagtcacttgtcctgagagtgctgagttctcccctccccttggctgcccctgtgcaggcacgttggccagccatgtgccaataattctgcctcaatgaccactttcagacttcaattaaacaccatgaaggcgggtatggaatcaggcacattgtgcagctgccaaaatatccagatgatgtaccctagaaatataggggagtttgatttccaagaagcaaacttgaactgaatcccattccttcttccctcccaggattagtcagagtcatagttttccctgcattctgcccaccaaaatcctgtatggcaaaggatataactctgtagcaacttgctgttccttttgtgtagtagccaatgcaggaatgccttattccctgtctgtccctgcctcacttctctttctctcattgcagctgctctgggcttgcatctcttaagtaaagcgtttgcacattaatccttactttagcctctcttttctggggaactcaggtgatgagaggcagcttattgcttagatgtgttcctgtgtcccctctgattctttctgcaagggagaggaaggcaaagtattcccaagaaaaagacccttccacatgcctctgtgtcttagaaggcacaggggagcttgtttccagaaaagaaggaagcattgccgttaggagagagaccccaaaaatatctgacaaagattaaaagtatagtcatcaagaattattctaggccaggtgtggtgtctcacacctgtaatcccagcactttggtaggttgaggcaggaggattgcttgagtccaggagtttgagaccagcttggacaacatagtgaaaccccatatctacaaataataaaataaaaattggctgggcatggtggcgcactcctagagtcccagctattctggagggtgaggtggaaggatttcttgagcctaggaggtcgacgctgaagtgagccgagatcacaccactgtaagagcctgtctcaaaaaaaaaaaaaaaaaaaaatctgttatttattgctccttttctgtgtgtctcttaattgcaattatcaatgcttttattttacttttctctttaaacagttcaatgaatttgattagatgagttattactataaatatagtatatttctgtgaaaaaataaccctttgaggaaatttattataattgatcacttctgaagagtgaggaaatgacatgataaatatctttaggggttgttgttttcagagtatttctctatgaaattaagaaacaaaaccttcaaatgtaattctacgcccttatcaaaatgatttccttacaaggaatattttggatttccagaaaccatacaatcactaattcagtttaattcactaaggtaaagtagggaagatactgcactattgcccttcctgcagtagaaaaaggcagcaacaaccaacgagaagctgggttagcgcttggtaacagtcttggtgtgatctgtggaatacacgtttaggtctttcatggcacctcagaatctctgcccttccattgcttgttctaagcctaaggtacatctaagatagtcaagagaaaagatcatcatagcaagatagaaagacatgacatacttcaaaattagctctcccaaccactgagaaaaaaagaaaaatcactaacttttctctacttcccacctcaccatcagaaggcagtgtttagctttctacctttcctttttatgcattcagcaagttgtataaagcttatgatatgtagggcaccatttaagaactataaatatgaactaaattatatatcaatgccctcgagaatagtaattttcacaatctggtaaagaaaagaaatctctttgtttgaataatttgttgtgttctgaattcatgatatttaaaaagctaaattttgctacagttaaaatgttttcttatttatagcaattcttaaataagccatgttagaaagtttggattccagagaaggcattaatgcaaaaacttaatcatcatgttaaaattcccaacaaatttcaagcaatacctagaacctggcaattcctattgaaatggcagtgcttagggcaaattggaaagccagctaagaagttttctaccggcaagatgaaagataatgtgggaccaataatataaatcattggcttggaccacctattttattaattgccttattttagaagtcagatttttgtctcagaagaatctgggaatgggagacaagagaaaagacactgactttttaagtgtcttcccaaccccaggtttttgtccttgtttagaagagaaaagagaatttcaaaaacaaaactaatttttattattttaagcagctatttaggtctctaaatagaagccaaatagggtagatgaaggaatgtggactctgcagtcagtcaaattggatttgatatctactttttatcattcttcactgaataaatgtggacaatttacttaacctctgttaagacaaacctaacagaaatatctcagtttgtccatccttaaaagggtcatgataaatatttatgttaatttgtaagaattcaattatatcacttaataaatgacacatacagggcagctggcatacagtaaacaaaagtgaggctgagaattcattggcagcagaattatctgaagacttgagacattaaaaccatcaacaaactcagtaagagactctagtcccagaaatttctcaaataacaagttctataaaacaagatccatttgaaaaattctaaccacattaaggccaggcacggtggctcacgcctgtaatcccagcactttgggaggccgaggcaggcggatcacaaggtcaggagatcaagaccatcctggctaacgcggtgaaaccccatctctactaaaaatacaaaaaaaaaaaaaaaattagccgggcgtggtggtgggcgcctgtagtcccagctactcgggaggctgaggtaggagaatggcgtgaacctgggaggcagagcttgcagtgagctgagatcacgcctctgcactccagcctgggcgacagagcgagactctgtctcaaaaaaaaaaaaaaattaaaataaaataaaaagaaaaaagaaaaattctaaccacattaaagctattttaaatattttatgaataacttagggtaacaatattttaattgtctaatttattagccgaaatcttcaagacacaagcttttcagactaaagtacccaatcaaaacaaacataacctttacttaacacctgtttttgtaattgcaagtttctttaaccagaatcacatggttctcaaatcagactgaacaggaaggcttataaaaatacagatatacagatggagagtcagccccagagttttcaattgaataggtgtgggatgtaagtttttcaagttctcaggtgatgttgatatgcctgatccagaaaccacactttgagaaccactgaataagaaaatagtatctcagatgctttcacatacagggctatatattaatgtaaaataaacatggacatatattatgtacataaaaatataatattagaatttaaatataatatatattacatttaacatatatatatgctatccaattatctcttttgcttcactgaaaaccataattcaactgagatatctaagtaacatacttccagaagtaggatcataccaagactccaagccgcattagccaaattttacctaacaacaaaatctctgttgttggttgaattgtgttcccccaaaagatatgttcaaatcctaacccccaattacttatctctgttttcagtggtacagaattgggaataatgacactctattgggtgtttgcagatgtaattacttaagattagatcatactgaagtagggggagccctaattcaatatgactgatgctctcataaaaagaagaagggacagggacagagagagagaatgccatataaagacagaggccgagattgtaatgctgcatctacaagccaacaaccgtcaaggactgccagccgtcaccagaaactaacagagagacataacattctccctcagagacctcacaacatagcacacaccttgatctcagacttgtagtctccactactgggagaaaattcatttctgttgttttatgccacccagtttgtgatgttttgttatgacagccctaggaaactaataatgcccttcttcccccagtacctgatgattctgtctgcctctaaaatttgcctcacattgcaacattttttagtgctctctcctactcattgtatttttttttttcatccttaggagggtttctttaaagaaggagaggattcagggaaagagggtggggcaaattgtgaccatctctgcctaaatcattagaactcaagagagctggggccaccatggagacacttctggccacttccttctgattccacatcaagttcctcaggctctgggccctgttttaattgtcggcctgtggctttgatatcctcttcttatgtctttttggcactaaaccttgcctttcttcctggctcttcttgcccctcgcttttggcttggatacctctgccatgtcctgcagctggatcgaggaaaacgttccacttgcccttcatttctggctcctactgctctaatttacccagttcttctctgactatccctgagtccactcttaacaatataacaatctcctcacccaagaggtccactcaactctgtttttccataaataaatttctcctcatcaatcttctttcattaaataaaatgtgtctgaaacccaaagacacaagatcttttaccttctcctccacttcttactgtctcatgacttttgggaacctgatacgttgactcttaatactactttagttatactgccatttttaggatatgattgccctgcttctgctcagtaatctccactatttttgatgtctacttctgccctcttctcttccttgtcctatccatctttctgtcttcaggacagcatgacccattcatcactgtcacactgttcgtcttttcatcattgccagatacagtggttctcaactctggctgcacattagaattacctggaaagctttaaaaaactagttctccgatggctttaccttcagatattctaatttaatgggagaaggccttaacatcacatttcttaaaaatcatttatttgcctggtaataatcactggcctaccattatgctcaacagattcaacctttatgatatttttcttacttcctagcctcatagttcttcactttcaatgttaagcattgccactttgtttctcccaccccatcactcagacttgccttacaactcttgataacttgaaataactctaccatttaccaacataatcacaaactctgacactgaaataattgcagtcttctcctcacctttctcacttccagtaaataagctctaaattttttattttgaccctattttgttctttgacttttaaaaaattaccttacatgatgaatttactttcaggtctaccgaaccagacatgtggtcaaccttgtcaataatactaccatctattaggaaggagggtttattctgaatttgtcagatttccatagaggggacggaatgtgtgatttctaggatgaaagttttagaagaatacttgagacctcttgtccagggcctctcatagacacatccccaaaggagtgtgtgattggtaatcatctgactggtaagctaagggaaagaacctgtgggtatatggatcagtctttattcctctcctgagttaaggaggcagttttttttttcttatttaccaggccataagatcatttttcaactctgccaatggctatgtgggtaagccattcattcatggagaaaatacttagatttgggtttccaatctacattttctaattcagctatatccataacaagtctcgtgttctgatttctgtgtgattccagtgattttcttaccattgtttcccaacttatgagaggaagaacctcaagaacagactcaactaattaacttccattcattctgcttttgttgcatatctgacctggggatctggggatctgtcccccaacaactctttttttaaaaaataaattcaagttttattctagatttgggggtacatgtgcagatttgttacatgggtatgttgcatgaggctgacgtttggtatatgaaacttgtcactcaggtagtgagccataatacccaataggtagttgctgtatcttattagagaaatgcacaaagtcctgcttcttggatccactgtaattcttttaaactaagctagactcttattattgcatcctttttaaaattcctagtgtatgcttactattgatgtccttcctcatagcaattcctaccttttctattctactaaagctcttatactaaatccacatcaccgagactttcagtgaataacttcagctcatacagttttgagaaaaccatataacatttatactctttattttcccttcactttaaaatttattttcatccatcttctcttcctttacatgcctcccttaagaataaccattctttttccctcagtacctcttcacaagggaaagattgagattctcagtctctcccctctctaagacttcatttcatcaagtcctctcatttgtttacatctgtaacttctccttctttacaaaataatttctctgcctaagggcatggtcataacaaacaaagccaggaactaaaaacaaaatcctcaattctgttactctttgaaatgacttttttgttttcctcccttcagcacgtaatctttgaaaaaaaaatcatctagattttatgacttttttctcacaccttacaacatgaactccccctaaaccaatggaaatacctcatttataattcatcaatagaatcataaagagcctatcaacaggttttgcttttctcacattcagtctctctcctttctttcctttatccaacccaccagtgttttaggcttcagatccttgtatagatgataatatatggttgttgtcactgccccaactttatatgtacatttacaattactgacctaggctctaactcagcaggtctctcccccaatttatcagcttactctgaattccctacttcaataagtgacacacttatttcctaatgactcaggctcaaaatgtcaatgccatttcatacattcagttactaatttcttcatcattcattatgtacctgcttcttgccaaggaatattttatgtcctggggattacaaagcagaataaaacaatatctcttttcaatgagcttatattatattgaagaagaagactgacaagtaaacaaagtatgtggtaagtgctgttttagaggtagcactgaaagactgttagaagacaaagcagagagcaattcatgttgtgtgagggagttggaagaaatgcttcacagaaagcaggtgctttacttcagtctttaataagaactaggcagttaaaaatagagaaggtaagtccaagaggctggtagggcagaacttataaagtcaaagttgcgtaaagccatgagaaatttggtttgactggaatataaaagcaaaagaaagtaggacgaacaagagtgagtcaaaagacttataattagccaggcatggtggtgccttcctgtagtcccagctgctcgagaggctgaggcgggagaatcacttgaacccaggagacggaggctgcggtgatccaagatctgacatcaagccaatgcactccagcctggttgacagagggagattccacctcaaaaaaaaaaaaaaagaaagaaagaaagaaagaaaaagaagaaaagagagttatcatgaaagtctccatatgttggtatggagttagtgatcaaaattgcttttagggcaatggtcctagcaacaacatggagtgagaaaaatacaaaactttgattatacttcctcaaattcccaaatataaaatcatctgttacatcttgcaaatgtgtcctttacactgcctttaaaaatttttcccctactgtttatattccactcctcccattctggtttagtagctcattacctttcctttgaacatccagactacaaagagaacaattccaatcatgccattcacatagtcataagctgtccaggacacttcactgtctaccacactgaaggtcagttattcatcatgatgttgaaggcttttcacagtgacatagctatctaattatctgctaatatgaagtggacatggtcagtgtcacaaacagcacttttgcgtgatatttatacgtggcagaagcttttcctcccctacatctttgatttgtgtttctttaataccttgaacaccatcttcgccctctgccttttgaaagcctgtccatccttaaaaattgattttaaaatacatctccttttgagattaaaattttaaattactccgaacatatgtgattgtttctttatgctttcatgaaacattgtactttttatatgtgacttaaaaatttatctgatgcagccatcacaccacttattctcatacagcgtaaacttctgacagtgacactgcatgactctggctttcattttctttcatttcatttcaaaatattgccttgcacaaaactgtattaattaaggttgttaccaattccagaggttactacttgtctttttcttcgaaacttcatagttcaagataactatatgtttagtcatgataatttattatgtaccaagcaagaagtaagcaccttaaaaactatcctcagttgctgatatggtctggctctgtgtccccatgcaaatctcatcatgaattgtaatccgaattgtaatccccatgtgttgggggagggaccttatggaggtgatgagatcatggaggcagtccccctgtgctgttctggtgatagtgagtgagttctcatgagatctgatggttttataagaggcatttcctcccttattccctctcttgctgccttgtgaagagatgccttccaccgtgattatgtttcctgaggcctccccagccatgtggaactatgaacaattaaacctctttcctttataaattacccagtctccagaagttctttatagaagcatgagaacagactaatacagttgcctatattttcgatgtctcctccctactctactgcccctagaaagcattaaaaacaagcaaattggatcaatcacatttcaaacttcatgctcagaaagtgtcttcaggcactattgtactgtatgagaaaaaataaagttactttcagtgaaagaattggcatttttaactttgcaatgcccaatgaacaacatgattttgttctattttttactgctcaactcattgatgtcaagtagttactaccagattcaaagagagacactttacctcaaactgcagtgtttacactttcttgtgatttttcattcttagattctattatgtggtttcttcactcctttactcagttctgtcttgatatatcagagcctcaggcactgtactaatatatatcctaaatatttttcttgattccattatataaaggctcccattcttgcaacaaaatgataatggtgagaaataaagagttaaatgcagatttttttgctatcttaactttaaggacgctatataataatgtagaaaaaatgtacagacacacatatagtgaccaaataaaagtaaggtgttattatgtaaaaaagtgatggataccattcaattcttcattttttacccctacttaacatgacaataaactattagcaaacatggaaaattgattatgatatggattatgttaattcagtcattcagcaaatatttattaagtattcattatgtcccaggaaactgtgcaagttcttaaaggtatatagataagaatatatagacatttttctaaaagatgtcacatgataataaatgtaaatcagcaaaggaaagagtggaggtgggaagaaattgagaagtaatgtatgttgggaattataggtgattattcttaagtaccaaaaagagacagaaagccagaggagatgagaacctaattcctattcaacagcaggaattaaccagggaattaaaagaaacttccagttataagcttgaaaatgggagtcaaaaattacagcataagtaaaatttagtgtgccaaccagacactgggtgctatagacaaaaaaatatctagacaaatcttgcccttttttggaagctgaataaaaataaaacacatatggaggcaatgaacaggaagaacatctagaagatctagaagaaaaatactaaaaatagtattctgcacaaattagaaaaataaattaaaaaataaatgatgccatcaagaatatccaaaggacatttactttaaaagacctgatatgtaaacagaaaagtatgaaaaaatgcagtgtgaaaaggaagaggaatacaattaaaaataaattgaaaggttattaactatgtaatagcagatctgatacaacagcaaaggaatcgctatgtggaagattattttacagaccttttccagggagtggaggaagaggatggaagcactcacattgtgcaaaggaacaaaaatattggaaaaaaaaattagataaaagatggctgttatggaagtctgtaaacaaagagccatcaccgagatgaatggtattctgaagaaagtgcaaccatacctattcccaatcttacttaacatctgcatatgcagtttgaaagagctcatcagatacaggtgaaaaaaaccacactgaagcctgttccacaaagttgggcacctgctcccagcactcacagaactatgtttattctaatagatacattctagaaggacattttaattgaaagaataaagaaaaatgtacaagcttacaggaaaaaaactacattagccatactaaacaataaacaattcacttccaaaatatgaaaggccagggcacaacaaagacagatgcctgacaaaatatcactcaatattttttgaaagaataatattctagaaaattataaattaataaaattgaaaaatcagaaaacaagtagaaaacttgaatagaaccataccctggggaaaaaaattgaaacagctgaaaagatctaacctctaaaacagatgctgggaccagatggctttatgaatgagtcctctcacccgttaagtgacccaataatgccaatactgtttaaactattccaggatctgaaaaatagaaagatagcctgctcactgtataaagctagtataacaatgatactaaaatatgggaaagaaaatgaaagaagtaaaaatggcacaccaatttcactttggtatatagatgtaaaaataatataatatttgcaaacttaaatcctgcagtatattgaaataacatcagaatcaagcatattaaagaataagtaatagattcaaaatagagaatatattaatatgctctgtatctattccattcccaccttctcaaacacttcgactgtagagtcctttatggcagagtgggacagaggttgtttttttgggcactgctgggtcttctgtgcctatcccagtatcttgccagagtaatcaataaatctctctcagtatgtggaaaattgaatggagaggttgttggaggctgaggggaggcatttgtaatagatacaagtaaagtttagcaaattaaaaattgataaatttcctcaacagggtatttttacattatgtaccaaaagccttagaaattcacaatttctgagctagtaacccatcttctgagaatttattctcaagaaatggtaaagatcatgtacaaacactttcatcattctccttgtttattatacaagattttcccctgactttcctttaaatgatgcaggttttcacaatacatgcttcggacctttctctacagtgtttctaagcctctttatcctggctcatagtttaaattaccatctctcaccgatgatctacaaattttgcctctcattctaacctatattccaagtccagaacactatatgtaacaacatttttagcatcctcccgcccccttggttgtttcaaagacatcttagcacagtatttacaatattgaatttatgatcttctctcccaaagtttgccattctctgaggttctctaagaaattccatccagttcttcaaatttagaagtcatcactaaaatttcaatccatgaccctccctaaatccatccataaatccctttaccatattttattgatataatattctaaatatttactaaatatcaacttctctttaagacctctactacttctatccaatgtcaagttaatgagtgtctgctccctgggcaactaactagactctgtacacatatgcctgccattctaatacactgtttacactgctatcctagagattcaattttttaatgaggaatatattcattgataacatatctatacacaggaataagcttgtacaaataataaaatactcatctatatacaaatcaataaaagcttttgcaaaagagatatatggagatatgaagtgtgatgatggtgataaaggagaatgaacaaagagaaagaagtggaagaggaagataaagatgaagacgaagaaaaaaagaagaatgataataagaacaagtataagaaagacttttaaaataaaataattatctacaaataattttaaacactaaaaaagatgaaagaacagcaatattcaatttcttcgcaaactctgagaagctcaacaagtctttcaaaagcaaccactaccggaaaatagactgtgacgatcagatgtagtgcctcagagagaggcaccttcactgtatgtcattaatacgtctcaatcacagtgtcaagggtcaaagaaagaaagagtaaaatatgaactggtccaagcagaagatagaaccaataaaccaaccaaataaaataatgggctattgtgacatggatttagcaccagcagttgcttgtatataaaatattcccctcaaccccaattttctttgcatactttattccttcttcttcagatctcagctcaaatataattttcttactaaagctttgcatgagttccaaaccccatgtaacattgtttcgaatatcctgattttactttcttagtgtttatcacagtgattatttgcagacattttattaaagtctgtttcttcctcattagtctttgcgtcctttgagagtaaaaatatatactcatataaacacagggcctatagagtgccttaaaggcattctataaatatctgttgatgagattaataaacaaaaaatgagaacaaataaatgaacaatccaaaatctcgccatactggattattacttttagtttagtttctgagtttaagtctgtcttgaggtcataaaatgttggctacaattaaatgtttcatgtgtgataaaaatagaaaaaggaaatctgtgatacataaaaacaaaatccaagtttctccctctattccctacttcaatcccactgagctaaccagtgctaattaacaacatgtgtataaattcttccattcctttttccttgttcataataataataatagctgatatttatggagtacttattatatcccaagatttgttctaagcattttacattattatttcatttatttctcaaaaatctgtaataaaactactaatactactccattttgcagatggaaacactgaagtatgaagatatttagcaacttaccaagctgggaaagtcacacagctggtcagaaacagagccagtattcaaataaatactcagatgatttggcaccagagtcctctgtgactttatgctgggtctttctcaatgtacacactaacttgctgtatatacctgcataacaatgtactgagaagcattcaatcagtaatgtgtttacaaagctgttagaaccacgcctggcatatagtaaacacttattcagtgtatgcaattattgctataatgtttatttgttttaatgagatataatcttgctatacattagtctataacttgcttgtattacttagcataagtattggatattctctcttgttttctagtttacttatgcatttaaatatgtctgtacacacatagaaatcattttacataaataggttcctgtatgcttagaatctcctgtttcctacaattcctatcttcttccctttatccactctaatgaacatattaacaacctgatcataatgtgttttatgaaatattattattaatccaactgtacctccaaattcaacagaaaagaaaaaacatttccaagaacaacagcaaaaatcccacaaacacacttccagacaaggtcctttggtcattgtacaatacaatacctacttctgtgcattttgctttacttgttcaaatgtatctgatagaaataactcaaaatcaatcaataggattctattttattattttattgactatatagtaggcaaaggagtaagagtttatgtcaaaattattttcttgatgagcagtcacttcatttccaggtttttgccaccataaatggtgctgcaaaaacatactcagatataaatttacacatgctgcttttattgcaaggttaaggagcacatcattttaaatgttaatagatgttaccaaattgcttttccaaaaggctgtaacgattcacatttctaccatgagtaaatgaaagtactctcttccccacatgactgccaacagcaggtgaattggtagttgtcactttattttgcatttcactgactagtgagtttgaaaatcttttcatacatttattgtccatttatatttccttttatgtgaatggcctattcatatcctttgtctgtgttactatgaatatatatataaatatatatatatatatggccctttatctgtttatctgtcatctgcattgcaaaatttttaacaaatcaaattttttcctgttaccttatttattgtatcttttgccatggaaaagctttatttaaaattttgataattaacttattcatattttatacttctgccaattattaacttattgcctgtcagcttcatacccaaccttctaaactcagctctgtgatcctggagctgaaattgcaatttccatttctgtttaccagtagggtccgtgttgagctctggccacagtgggagctaagggagatggcaaggctggaggaggaagccaggacctggccttttctatgtactccttgtctacttcctgtgtgcctccagaggactcttgtgccttgattcttcatcccagcagctctttttatggcagcagctaaatcaatttcaatttttgccaaactcatagaaccattctcattgcaccctcttcagagacactaacagcacctgaggagcacctcattttagaggtttgagtttaagcccttcatctaagtcttttaagatttaataactcaaacttttatttggcccctcttccctaggtattgtagttgcttggtacagttaccacctctctgatcctttagttctctcttttaacactttcagctacctagttagtaattttatatatataatagttgtatcttaaattatatgttttggaataaatgatgtggtttctcttcaacagtgatataataattcataaattaagttgggttatttgtattttcttaggaagtaatctatttgctctggattttcaactttattgccatagtaatgcttgtattttcttattttatatgctattccttctatacattttatttaatctcttctatcattctaatgtatatatatatatttcacttgattaaaataactggattatctatattattggttttgtgggtgcatatgtgtatatatgtgtgtgtatgtatatgtgtatgttgtgtgtccatgtatgtgtatgtatctttgtgtgtatgtgattgtgtactcatgcacgcgtgtctatgggttgatgtttgtgtatgtatatgtgtggggttttttaacagccatatagcacagcataatgataaaaacattttgtagttgttaagagagtatagctattaacttaatgctctagtgcagaattcaccaaactttttctataaaaggctagttttgcaggcctatagtctttgtctcaacaaattaactctgcgattgtaataccaaagcatccataaacaatatataaatggcatgctctggggtcactctctatttgaatctttgccctctatcccatgactttgcccaactaacttaccttttagtgtctatatctcatcttaaatatcaccttcactaggagcattccatgtttctctactggatccttattatttaaggtgtggtctgtgcacaaggaacgaccatatcacctgggagcttatgagaaattcagaatcttgggctccatgcagtagtgtgtcagagttggttcacactgatttgtgaaagcagaatacgcacaactcttcccaaatcagagttcagtgacattgagttggtagcttgaaattgtccacggagggaatatttataccatggcagtttgcaaatgctacaaatgagagtgttttatttaagaaaacaaaaaaaccttgtttcttgcagagcattggcttaccccagacctactgaattggaatctgcattttaataagatctccagggcatttatattaatattaacattaaaatttgagaagcactgcagtagatcattttttcccaaagtacatgttagaatcacatggcatgctaattaaaatacaaagtcctgaaactcatgtgtacatagattcagaacctctttaagtggagcctcagaaatcctttttctgtaaaaatatgcgttataaacaagctttctgcttggttcttaggcaccctaaaatttgacaattattgttctacaatatctgtgcccagggcatgctttgttttctaatttataatagagcagaactgtagaatcataaagaattattcccaggccttgagacctactcacagaacttacacaatttgtatggctgaattttggaattattatggactaatgacccttttatgccttcattttcctccttttagaacaggaatgtatacagttgttattctgtgcctgcccaacaatgtatatttggtaatatggggtagatgatttgtctattttagtttcacaggtctacagatagagaggaatggaatttaaggagctacacttaaactacgtcccaggtgcatcatccacacctggatctagttaggtagccggtttctggacgtcagatcgttgccaattggatgaaacttttgagaggacttggggaggggctgcatgtgggaggactgcttaaggactttctaagttccctcatttgcttaatgatggtttcagaatcatcagggttggagtgtggggaggatgatgaggtggaaggaactcaaaagttcttagcacattggaaatctagctcagcactttgtaaaataaccatatttttaaagccaacccccttcatagcgtttatcaaagtccctacattgctggggatctcacatgtgtaattcacctcttgagaattgtgtgtttctctggccggttgttttttatcttttttccctagctcatcacatataacagagaaagcagacacacacagaaacccccccagaaaccttttctccagttcaactactaaccctttcatatgctccacatggaaaaagagcttcaaattaatcacacgtgtctatcatacacggtgactggtgttcactttggagtgtggactctgttgttgtcaggcttagctcaaactttggatttaaatatgctattaactctagtagtgtatttgacacttagttaattttaaggaaatatttgttgagcgaaggaaagccacctattataaaactgagaatattttatatttcagggtttttcctttctgaatatgtgttttcatcctattttaccaatgatcttaaaaattcatgtattatagaaaaaaatgaaaacttgtattggcttcataatttgggaagtaaatactatcatataaaatatagatccttaatgtgcataaagtttcagttatgcaagatgaaaaagttttggagatctgttgtacaacattgtattatggtaaacaatatacagtagagttaaacatttgttaagatagtacatctcttgtgctttttaaccacaataaaatatttacaacccctcagaaaccttggaaaaatgactgtttctatgggggaaaataaaaccctattaaaaataataatagtatatatatcctaaagcaggcagtaaagtcaataataatgtaaaacaattttctgaatttgggaaaattgaattatagaatgtaatggtgagaataattaattgaatatataatagaaaaagaagtatttaaattttgactctatttgctctgagatttcattcttattccctttggcttatcaggggcaagtgagattgactctgaactttaatatttatttgtattggtatattagtgtttccctctgccattatactatatttcctttgcattatttccagtgaattttatgatgctggtagttttacatagagaggttggtttttttaatgcaaaaaaaaaatgtagaatttttttcaaggaaaatgtaattctgccaagtactttggttcatttgatgctgcctgtttaactctgttcggctcaatcactgtgttggacatattgtgacaaaggctcattttcatcaaaaggaatccccagagggtttgctgcttcaatgaaagggaattcattaaatatagtctaatgtaaggtgattggaatatatatattccgatacacatatgtatataattgcattttagtcagttcttatgctactgggagcgtttttttaaacactcacttctaaatgaagaatgctgcatgaaagctttttctctttctgaaaaacagctggtttcttcagcaattcaacctagaacaaagaaataaaaaatactacatgctaaagcagatccgcagtaaaaattttgtagaggcaaggcaaagtaacattaataaatgaagctaattaggcttgatttgcatatttaactcatcttaattacacaaggattcagcaaacattttaaaagctgcaatcaatctttcacagatatggttagttatttacatgaaataacaaaaactaggagctttgttaatgattactctgtttctaatttatatgccagtgagatcatttcagtattaataatggaatatattttttaacaacctgtaaacccataaggttaaaattccaaagaattttttcacaaatatgtttttgagaatttccagaatatatgaaatgttatataaattgctctattgtattaaaatgttttaccttgttcaaataaaaaaagatctttataaaattcttttgacattaatttttaaacttggaaactaaggtagtagccataatagagacaagcagaatatagtaggtgataagtaggagaattttttcttgcagctggcataaactttaattctgctcacccttggatacaatttgctttctcatctttaatagtacttttgactggtcacagaatttgaaattaaatagggggcataatgacacaatatgattctttttaatttcagtgttttatttagataaattattttgtaaaaatatacgcaggaatgctgtctctgtgttgtgatgtgaggggctggcaggtgcacttgaagtggctaagtacagaaggttctgtggacaagaacgcaacagtgcacaaaactttatgctgtgcagctgtcagatggttgtgacattccattattagggctccatttcttagatttttctctccatgagtgtccttttataacatcaaaaatcttgacccttttgcttaaattaccttgaaagggtggaggtcatgtggttaggaaaggacagctggtgaagggtgcatttaccaaacttgcaatgtgtgtgtgtgtgcgtgtgtgtgcattagtttaaaaatatgtattaaatgcttcccacgtgctaattcatcgttgtggttataattatgaagtgataaagacggtacactaaatgtcatctctgctatcatagagcttgcaatctgcatattatgactatgtaattgttaacatttattgagtacttgctttgtcacgggcagcaatcaaagcactttacaccaattcacttgttaaatccccaaaatggcactatcatgtagatactatattatttctattttacagatgagaaaactgaggcttagagtgttccaagggcacagtaagcagcaaagcccaaattcagacccaagtagtttcgctccagacactgtgcttttaatcattacattatatgcttgtatgatatccaagtctgtttagatatgtattcaaatatgtaaaatatacaacttttcattttgagactgcatataagcccaaaatatattcatgcaatataggtacaatacaataaatagtataaaataatgtcacagtttaccttttgcaaccagttaatgttctaatggctattgtattcctaagacattttatgagtagtagaataaagatatctgtagctctttgcaaggggttgaattgtgtccccttaaatccatatgttgatgtcttaatcctcagtatcttggaaggtgactgtatttggagataaggtctataaagagataattaaaattaaatgaagtcatcaggttgggcccaaatgcaatatgactagtgtcctcataaagagattaggacacagatagacacagatgaaaggccatatgaacatatagggggatgacagccatctacaagccaagtggaaggactcataatgaagccaaccctgcctacactttgagcttggatttctagcctctacaactgtgaagaaataaatctctttcgtttaagccacccagtctgtgccactttgttatggtagctttagcaaactagtataaacttaattgtgtctaaggatgagaacaccactcaatatctgaaaccaaaaagctgaatgtataatacacttaagtgtggaagaattatactggtcagagttacccattgagcaaatccaattgctgattttatatccagtttttgtgaagagtttactttggattgtgctggttacagaggcaggagttggttgaagtcagttttagaaaagtagcttgtattggtcaatgagactttttttttgccagttacagaagtagaaaaaagttgataatagcattagaaacatgttcactgtagtgaatcctgaaccagttggctgactttcaagtcgtgtctgttgttatttgacttttacaggagtgctcactgaagttacttgtcattgattaattagataggtttaaaacccactctgattgtttacttgtaagcagggctgtagaactgttgctaattgattagatgagtttataactagttctggtgcttgtgagcatggatagagaacactgagtcttttcctgggagagtggtgacttttaaaattctcagcagccaacaaaaattaataggtataacaaggaatagagaaaaagctacaaattaatctataaataacaatatcccttacttgtgtaggcattatgttaattgctttacataaatttctcccactgtaaatggagatttaaaatattactaatttcctatggtagagatgaaaagaattgctatacacaaagtacttagtaaagtgtttatacgaataagagatagtatcaataattttccaataagctgagttttaaactctgcaacttcactcaaatatcacattcttaaccaccacaataataataaaatgcatatatattatggtttcatttatatgaactaaggtagatacatgagacagtgaggaaaggggattgtatatgtatgaactagtccatgaaatatacaacaaacatgatttatggtagttgcctctggaggtggcctaaaatgggagactaacttttcattggagagtgttttgtaatatttgactttacaaccatatttttatatttcctttctcaataaaatatagttaataaaaattgtagggatgtttttactaagaagggcatgagagaatgttttggaatgctggaaacatttcatatcgcaatctgaataacaattacacagatatatacacagataaaaatgtattgaggtaagcccctaagatttatgcattttagtgtatgtaaattatatgtcactgatatggtttggctctgagtctccacccaaatctcatctcaaattacaatcctcataatccccatgtgtcgaggggagacctggtggaaggtgattggatcgtgggggcagtgtcccccatgctgttctcatgatagtgagtgagttaacatgagatctgatggttttataagcatctggccttttccctgcttgcacttctctcttgcctgctgccatgtaagacatgcctgcttccccttctgccatgattgtaagtttcctgaggcttccccaggaaaattaaaccttttttctctataaattacccagtctcaggtattgctttatagcagtgtgaaaatggactaatacaatcactaatataaaaattgatttaacatatcaaaaaggcattttttttgttttctctgacatttaatttatttcatttgtttaacttttaggttcaggggtacatgtgcaggtttattatataggtaaattgcatgtcacagggatttggtgtacagattatttcatcacccatgtaatacgcatagtacctgataagtagtttttcaatactcgtctttctcccaccttccaccctcatgtgggccctgatgtcttttgttcccttctttgggtctatgtgtactcaatgtttacctcccacttaaataccaaaacatgtggtatttcgttttctgttccttgttgctatgttagttcacttaagataatgacctccagctctatccatggtcctgcaaaggacatgatctcattcttttttacgcctgaatagtattcatggtgtatatgtagcactttttttcttcatccagtctaccattgatgggaatttagattgatttcatgtcattgctattattaatagtgctgcagtgaacatatgggtgcatgtgtctttatggtagaaaggcattttaaaatctagccttggaggaaaaaaaatgagtgaagtggactcacttcatatttttgtcttaaaattttttcaaaagaatatggaattcattgattaagtaagtcattataatgagaaaggaaattcataagcattagcactttaatgattttagtgataatatgcttggctacttattttatgatttaattttggcctaatttttaagagttttaaaggtttttttgtctgaaatatgacttttgatgagtattacttaatttttttttcaaattttcacatgacactattgacactaaaaagacttttactattttgagggaacaagcttaatctttatacatagggttcacggtcagtcaggctaggctagcttgtgttatggtaaaaaacaacctccaattctcacaacatgtgtgtcctgcttcagttctatgtccttcatgggttggaagatgggtgtggggcattcctgctggtcttcccagggatccaggtggatctctcagccatgaccttgaatgttgtttgtttctgccagagggaaaagggactcctggagggcatttgcacctatcattaactgctgaaaatgcgaagttgggaagagcctgagaggagtattctatgtcatttccattcaccactcttaagccagaactcattacatggtctctcataagcccatggagggttaggaggtgcgtatctacccagaaaggaggaatattggaaagatttggcaaacagcctcactcactccatcttcttgcacataaagggctaggggactttggaatcaggcaaaactggaaaagtgtcatgactctgccactttttatttgtgggttagatgccactgttttcatctctagaatgtgaattacaatagtacctatctcctagcattgctgtgaggattaaatatgataacaactgtaaaacatttagcataatgctttaggtatgtaataaacacttgatgaatgtaaagctgcatcctccacctggaatcaccatttccctatagttgtttaaaatgttaataggcaatggaaaagtcaatgggtgaatatgctcccgggttagaactacactgaagcaaaggtgttggggaataagaaagtgcacgcatttcatgtcatgactgatcagaatgaaaataaatattgagaagactaagctatttgtccaataataaagcatatctggtgagggtggttttttgtttttttttttttgcaatttcatttataatctccatgtaagtgtgcttactttttcattcaataactgtatcgtatcttaccagagatgtcttaggccttggggatgagaagacggaggagtggatgagtttgtcttgtggagcgtaattttagaggcaggagactacaataaataaggagaaaaattcatgaagtaattttgttaatgaggagtgatatgaaggaaacaaaatggggtgacctatttgtcaagtattggcatctgtgaatataattgaaccctgaaatatcagggatgtgacacagtggaagctcagttctcattcatggactacccaattgtaaggtcccgaatggcagcttttctctctgtggtggttgagaaacccaggttccttccagtttatgctgcctcatcatctagaggccttctgcgtatagcctgcaaagaacggaaaatcaggagtttggcagattatggtggatattttctaagggccaggcctatgttggacttacttcacaactgtctgtgttagcagtggaagagatcagagttaccctgatttaccgacggcaaatccataggtgtctggagcaaattcagcctttgcctgctcagaagaaagaattcgactgaggggcataaagcagaaaaagagaccgagaccggggcaagttccagaacaggaagaggagtttattttaaaaggctttagaataggaaagaaaggaaaattcgtttggaagagacctaagcgggctcatgaaggatcaagggagaaaagggagcaaaaaaagggaggcctttaaccttgttgctaggacttcatgggcttgcctctttcccatgattcttcgcgtagggtgggcttcccgcatgcgcagtgttttccttaccctttggaattgagcacaggcatgcagtgtgtttagggaggtatatgcatgcccatctgaggttttttcctttctccagtggcatgtgccccccagaatgtcatacttcaccgttttgtctcttaacacacatgcccaagaagctgcttctccctggggcctgcattcaattaacactttaatgttcacaagcgtggaccatcaggagattgtctctctctggctaatagattaaatatcatttttagagaggcaatattgtggaaccatcacccaacatttcagtgggtgatgggagaggcttctcctgcccagctcttgcctaactacctgtagcacctgcatttcactgagcagaactcagtcacatggccacgcctgacctctagtctggctgtgtgcccaggaggaaaaataaaagtgtttcatgaaacagtttctgctactctaatgactggttgtaagagagacgtcaggaaattagatctcagacagcatgaaaaaggttgtgtttgagttgaaagcagcatgggaaggataaggacatgtgtatatctagatgagaacatctgcaataaaggaaacagaaagcacaaaggcgggagcattccaggcagttagaaaacaggaaggccagtgtgacagctgtatgttcttgtatctaactgtacttagagttattatcctgacagtacaaaggagttgtctggatcagatatcaaaccatttactcagagagaagactgtttattttctattcctcaattccttatgtagggggcagggagggctgggtgagaaccgggtgtaccttgtgggtacagaaggaaaggggttatgtaccacgagaaaggaaaccccaaaccatgaaactcaattttctttcttccctctggggagtgggggttggagggagagagggaaacagagagagagagagagacagtgagagagggagggagagagagagaacattaaagaaacctttgctctgaaatctaaacaaatcttcccaaaaagaaggaaagcatcggtttgcaatccttggatgtgaaagaatgcctcagggtgagatgtccctgtatctccccaggggtctctatctttagggttgctattcagtcattctttaactcaggtgccagaactctgcttagaaagccctgaccatgaagaaatatgaaaatattcgaggaacacagtgaaaaggaagagtggtaaaggatgaggtcagatacagagacaagagccgaacaatacagggccttaagacacaggcagagagtttggagttcttttagtgcaatgataattttttggttggctgtatgcaggagcgtgacatggtctgattcagcttttgttggttgctctagtggcggtgaaggggatgactgggagtggggtggagtgggagaaggaggctcctgccatagtcagggtctgtaggatgatggcctgcccccagagtggtgatagtggcaagggatgaagctgggcagagtagggctgtattttgaagaaagacttgtagtagataagggttggggctggagtgggggaagaaaaagaggtattcttattcccaggtttttggttgccttggtttgtttgtttgagcagctggtgatgccatttatatgtataaagatttcgtgaagatcaaaatagacagttgggaagtagtaaatcaacaagtcttcttttgcttattatgtctgacgtgctgcatcagacaggtcaccagcaggaaagaggggactcacggagtaagctcaagtttaatgtttacagaggtatgggcggcattaagggagctagcacagcagccagggactcgcaacaatgggaaatcatcactgcccactaccactgtgtctgaaaggggaggggaaggaaagcattactggatgcagtgtgcaagtggccatgagaaaggatacaggagctgtggaatttggtagagaataaggccaccgacataatcacagctgaacgggaggtagcagaagtggcaatttatccattctctctttgtgcttatccatatcctacaggcgcttccctctggctgaatccaaccagagcccagaagtcctaagaacataggcaatgtagttagtagagagcctggcatagggcggggcagagccatgcggagaatgaatctgagggcaacagaacaaacagcacccatgtccacaagagctctttaagaaggcaaatagacattcaaagttggaactcagggagaagtaagggtggatatgtcaactggaaaatattcagcatttcaatagtatatgacaaatattaagagccaatatttgtcaggcccttactctgtgctaggcaacataccaacatttcctgtgcattattatctcaattaattctcctaacaaagctataggttaaatgccattatctcattgtacatatcaggcaactgaagcacagtaaagcaaagcaatttgtttaaggtcacacagctattaggtggcagatccaaaaattaaatgtggccatttctacccccagggtcagtgatagagatcattattacacacagcttctctgtctgaatcaaatgctggagcaatgcatattgggtcacattattattattttttttgtaaactcttctttcttttttattttttctccttttgaaagacaactattctgacaagaattcatcaaagaagagattccaaattttaatgtcccagtttgagtattgcttttgattaaggctgtttgcagactagaatgttagtaaccctcacattccctataccacaaaaagaggagattcacttttatcttgggaacaaagctgtgtagaaaagctttttaaacttattttaattcatgaaacatttatcttcgagtcaggttttgttatagcagcacaaatgtggtccgtcagcatttcctttataaccccatatttccagggtttttcaagagtgccatagagattctactttgaattaaaacttggcattcagaatttgaaaaaaaaagctactacacttttcattaccaattaatcaaatagtttagcgattctcaagttagaaaaggaccaaatgcaaaactttcattaatacaaaaatattttaagacaatttgctaatttatatctttgtaaaaatattaccactcagtatacaagtattaatattacatcactgtatattagttctcaaaattaaccaaaaaatttctaagataatataaaaaactatgacatcttatgctttgcctttttggctttgtaagtaatttatttctattttgagaattgggatgatttgaagttcttagcataattggtttaaagttataacagtgtcaagatactgagccataataacaaggatggttgagattctgagagagtatcaaagtgtttcaatttatttttgtgaaatttaaatttatgtggggaaattttgcactctgtgaacaaagatttgtagcatgaattgattctttaaattgatatttggaagttaacttgctgagtacaatgacgataatgaggaccaagtagagattagtttagttataaagcctttccaactttgcttggttcagagatactccatgaatggccaataacagtgaggggcatcatgatgatctacctttggtagctcattttgcaatctcttctgtaatctctcccagccttcaaagatttaaggttaaataaatacaaggtagtgaatgagagtagatgaagacttttgagtgaatctactcttctgactgacttctttccagccacactggcttccttgttgttccagaaatgtgtgaggcaaacatctacttggagacatttgctctagtttttcttcctacctggaacacttttcctccagaaaaactcccttcctatactttggctatactcccttactatactttcattggctaactcccttactatactttcattcttggctaactcccttactatactttcattcttggctaactcccttactatactttcattctttattcaaactttatcttctgggtgaagccaaactggataactctacttgataatgtgatttcccttagttcccaaatcccaaaattcctactattactaaccctgcctgacaatttcttctcttcagacttattatcttctagtacattttatgcctttatcacaaaatgcccatctcctccactagaatataaggtccgtgagaataaggttctttgtctatttgttgacatatcctaagcacctagaattgtgccgacaaatattaattactcaaaaatatttgtcgaatgaacaaatggttgaatgaaatctgaatttccaagcacatagcaagactctccaagcaatagtccacatatgactttcccttgttctacagaatttgggttatttccctacaagagtcaagaatgcccgttgaacactggtgttcaaaatgaaaggccccacatttagatatttagatccctattataatgtgttataggtccatctttcccggaaacatttaaactgaagctgggatgtttttgtagttaattttaattttagctattatttggataagttaaattgaatgaatagatgtgaagtttggttctcacaaaacaaatgcttattctgtatttaaaaatgccactgtatatattttataaatttttatacaggtaataatgttaatgctgaactgtgaaaattcaggagctaaaatgtgattctatcatttaaaaagaaaaagagagaccccactgcctacccccagcagcagtagatatgctgtgctgaaaataacagctttctaataagggagttcttaatagtctttggcctcagggcttgaaagctatgctaattgagaaatgcagccacttagtgagagtttactaccagctcagtggtgtaaaagcaacaacagtagaatttcagtgtagataccagtactatggtatgctccccgctctaggtctgtactattctgaatagtagttgatagcaaaagctagaattttctatggtgagaatgtattaattctgggaggaggggctaaaaattactttaaaacttaaaagcatctttgaattcctttttacgttccaaaagaaatttatttgactctgtttctgctttgtcttcctagggtatatgtgagcagtcactttatggtcacatgcattctatcaatgatgccatttttgatcccagggtaagttcagttctcccagtaaactgtttttaatgcttcatatatacaaattcatttttataaaacaaatttccaagctaaaatggtaagttaatgaggtgagaagaacaactttaggaattagttgtaaacaataggaaaagtctataggtatatagggttgcagaattttaaaattcacacacacacacacacacacacacacacacacacacacacccccacacacaccccaagtcgtagcaggagtgacaaggaattctactgtagtcaactttacttaaacacatttttaagagccttttgtccaatttgggcttcaaaaaaataggtgggctatagactgcataaaattttaatgaaaaatcattaaaataactataattgctctgtaatttttctgtaagaaaacctggagaagaaaaagcagttaaagaaaaaagttttctccaatttagaacagaacagctttgatttgacagctttttaattactcatggaaaagtttcaaatatgtccttcttcataaaaactgatgacaaaacaaaaatattttatctgccacttgaggtattcattcaggtgtaaggatgatttcacaaacaatgaaaattgttggagagtcctttgagttttctgtggtttgaatgtatccctccaagtttatgtgtcgcaaacttaatccccaatgcaagagtgtttggaggtggagccttataggagatgtttaggtcatgacactggcgccctccctcctgaatgggttaatgtctttgaaggaagttgaagctgcaagttcagtctttttgctctcttgctctttttcctccctccttctgttatgggatgacacagcacaaaggccttcatgaaatgatggtgccatgctctgggacttcccagcctccagaactgtgagaaataaatttattttctttaaagttatccagtttgtggttttctgtaatagcaacagaaaatggattaagacagttgccacgtgaattaaggatgtctttaaaagggttcagatagtaatcaaagaaggatgatttaagtctgttctcagatgaaagagatttgactacatagatgacctctcaggttcatttaaactctatgatttaattatatctaacattttggttgtctcaaagttcccagtagagtgagaatcttaattccaaattccacttcttttccaattagctataaaagaaatctgatggattacttacatctaacatcacaatgatagcatagtcaaaattctgttaccatcctgctagtatcattcttttagaaagaggaaaaatgctcactaaaaattatatctactaagggaatgttgattgctccaattgaaattgtgcttgtgtcattgtcaggcctgggaattttaatgatgggctcaaccaaaattacattttaatagattggtctttgtaagaaatattctatctaattttctgtagtgagccaattagttggaaagtattatagattagttctagataccaaggaatattttatttccagcagggtatggaaaaatttaagcactatggacccattatgaaatagaatatagttttatgctgaaagtccattaagtggcgtatagcttcacatgccctacaaaaattaaatgggagctgaaatgaataatattttgtaaatcaggcattttattttggcaagcaatataataactgcaaaagacagcattttacattctaaatattaaacttaataaatatggaaataagcaaattagatttattgaattagcaatcaagagagacatacattaatttcccatatttcaaagggcaagataacagatatgaggtttaggtgtccaatatcaaagtagctaattttttttattattatactttaaggtctagggtacatgtgcacaacatgcaggtttgttacataggtatacatgtgccatgttggtttcctgcatccatcaactcatcatttacattaggtacttctcctaatgctatccctcccccagcccccacccctgacaggccccagtgtgtgatgttccccaccctatgtccaagtgttctcattgttcaatcccacctatgagtgagaacatgcggtgtttggttttctgtccatgtgatagtttgctgagaatgatggtttccagcttcacccatgtccctgcaaaggacatgagctcatccttttttatggctgcatagtattccatgttgtatatgtgccacattttcttaatccagtctatgattgatggacatttgcgttggttccaagtttttgctattgtgaatagtgctgcaataaacatatgtgtgcatgcatctttagagtagcatgatttataatcctttaggtatatacccagtaatgggatggctgggtcaaatgttatttctagttctagatccttgaggaatcgccacattgtcttccaaaatggttgaactaatttacactctgaccaacagtgtaaaagcattcctatttctccacatcctctccagcatctgttgtttcctgtttaatgattgccattctaactggtgtgagatggtatctcattgtggttttgatttgcatttctctgatggccagtgatgatgagtattttttcatgtgtctgttggctgcataagtatcttcttttgagaagtgtctgttcatgtcctttgcccactttttgatgggattttttttttcctagtaaatttgtttgagttctttatagattctggatattagccctttgtcagatgggtagattgcaaaaattttctcccatcctgtaggttgcctgttcactctgatggtagtttcttttgctgtgcagaagctctttagtttaattagatcccatttgtctattctggcttttgttgccgttgcttttagtgttttagtcgtgaagttcttgcccatacctatgtcctgaatggtattccctaggttttcctctagggtttttatggttttaggtctaacattgaagtctttattccatcttgaattaatttttgtataaggtgtgaggaaaggatccagtttcagctttctacatatggctagccagttttcccagcaccacttattaaatagggactcctttccccatttcttgtttttgtcagatttgtcaaagatcagatagttgtagatgtgtgttgttatttctgagggctctgttctgttccattggtctatatctctgttttgatactagtaccatgctctgttggttactgtagccttgtagtatagtttgaagtcaggtagcgtgatgcctccagctttgttctttttgcttagcactgtcttggcaatgcaggctcttttttggttcctgaactttaaagtagtttttttccaattctttgaagaaagtcattggtagcttgatggggacggcattgaatccataaattaccttgggcagtatggtcattttcacaatattcttcctatccgtgaccatggaatattcttccatttgtttgtgtcctcttttattttgttgagcagtggtttgtagttctctttgaagaggtccttcatatcccttgtgagttggattcctaggtattttatctttttataactattgtgaatgggagctcattcatgatttggtttcctgtttgtctgttattggtgtataggaatgtttgtgatttttgcacattgattttgtatcctgagactttgctgaagttgcttatcagcttaaggagattttgggctgaggcgatggggttttctaaatatacaatcatgtcatctgcaaacagggacaattcaggagcaggttgttcagtttccatgtagttgtgtggttttgagtgagtttcttaatcctgagttctagtttgattgcactgtggtctgagagacagtttgttgtgatttctgttcttttacatttgctgaggagtgctttacttccaattatgtggtccattttagaataagtgcgatgtggtgctgagaggaatgtatattctgttgatttggggtggagagttctgtagatgcctattaggtctgcttggtgcagagctgagttcaagtcctggatatccttgttaaccttctgtctcattgatctgtctaatattgacagtggggtgttaaagtctcccattattattgtgtgggagtctaagtctttttgtgggtctcaaaggacttgctttatgaatttgggtgctcctgtaatgggtgcatatatatttaggatagttagctcttcttgtttaattgatccctttaccgttatgtaatggcttctttgtctcttttgatctttgttggtttaaagtctgttttatcaagagactaggattgcaacccctgctttttttttttttttttggctttccattttcttggtagatcttcctccatccctttattttgagcctatgtgtgtctctgcaggtgagatgggtctcctgaatacagcacactgatggctcttgattctttatcgaacttgccagtctgtctcttttaattggggcatatggcccatttacatttaaggttaatattgctatgtgtgaatttgatcctgtctttatgatgttagctggttattttgcccattaattgatgcagtttcttcatatcatcgatggtctttacaatttggcatgtttttacagtggctggtactggttgttcctttctatgtttagtgcttctttctggagctcttgtaaggcaggcccgggtggtgacaaaatctctcagcatttgcttgtctgtaaaggattttatttctccttcatttatgaagctttgtttggctggatatgaaattctggtttgcaaattcttaaaggatgttgaatattgtcccccactctcttctggcttgtaaggtttctattgagagatcctctgttagtctgatgggcttccctttgtgggttacctgacctttctctctggctgcccttaacattttttccttcatttcaaccttgatgaatctgacaattatgtgtcttggggttgctcttctcgaggagtgtctttgtggtgttctctgtatttactgaatttgaatgttgttgaatgccttgctaggttggggaagttctcctggataatgtcctgaagaaagttttccaacttggttccattttccccgtcactttcagatacaccaatcaaatgtagatttggtcttttcacatagtcccatattgtttggagactttgttcgtttctttttaactcttttttctctaaacttctcttcttgctttatttcactaattttatcttcaatcactgataccctttcttccacttgatcaaattgtctactgaagcttgtgcatgcatcatgtagttcttgtgccatggttttcagctccatcaagtcatttaaggtattctctacactgtttattctagttagccattcatctaatcttttttcaaggtttttagcttccttgtgatgggtttgaacatcctcctttagctcggagaagtttgttattaccgaccttctgaagcctacttctgccaacttgtcaaagtctttctgcatccagctttgttccattgctggtgaggagctgtgatcctttggaggagaagaggtgctctggtttatagaattttcagcttttctgctctgttttctccccatctttgtggttttatctacctttggactttgatgtcggtgacctgcagatggggttttggtgtagatgtcctttttcttgatgttgatgctattcctttctgtttgttatttttccttctgacagtcaggtccctcagctgtaggtctgttggagtttgctggaggtccactccagaccctgtttgcctgtgtatcaccagcagaggctgcagaacagcaaatattgctgcctgatccttcctctggaagctttgtcctagaggggcacccgcctgtatgaggtgtctgtcagcccctaccgggaggtgtctcccagttaggctacacaggggtcagggacccacttgaggaggcaggctgtccattctcagagctcaaatgctgtgctgggacaacgcactgctctcttcagagctgtcagacagggacgtttaagtctgcagaagttgtctgctgccttttgttcagctatgccttgcccacagaggttgagtctatagaggcagtaggccttgctttttgggcactttgtttacctactcaagcctcagcaatggtggatgcccctccccctgccaggctgaagcctcacagttggatctcagactgctgtactagcagtgagcaaggctccatgagcgtgggaccccctgccccgagccaggcacaggagagaatctccttgtctgccggttgctaagaccttcggaaaagcatagtatttgggcgggagtgtcccgtttttccaggtacagtctgtcacggcttcccttggctaggaaagggaaatcccccaaacccttgtgcttcccgggtgaggcaacacctctacctgcttcgggtggccctctgtgggctgcacccactgtccaaccagtcccagtgagatgaaccaggtacctcagttggaaatgcagaaatcacccgtcttctgcattgatcatgctgggagttgcagactggtgctgttcctatttggccatcttggaacagaactcgctaatatgtttttatttgcacactttgttcataccaaaaggactattacaatatagctccaaatcagtatcccacagcctcattaaaattttccattaattgatcttttctttgctgcaaatatttattaactactaatatttttaaaaaataatgtcttgttatgatgactgacattttttaaggaaatttttggtcacttatattaattgttttaacaattatgttttatgtcacatacctgctaagcaatgtcaggaggttgagaagcagctgtgactgcagagtgcagggactcccacaggtctcttgaggacatggcattgagacacagttcatattcaaacaaactattaaagttgtatttaaaaaatccatatgtggtacatatatagaaggcaaaaattttagttatttggtattagccttgctcattacttggtgcctttagggatagacattcatgttgcgttaccatttaaagttgcatttagctatttacataaacatagtttggggaaaattctacaatttcagatttgtaagtaggaatcacacatgtaaaactcaatgttatcaagctagcaatctagattcacagaaacaagggtaatgtcagtaagatggtggaataaaaagtaaccctcaactgggcacagtggctcatgcctgtaatcccaaaactttgggagactgaggcaggcagatcatgaggtcaggagatcgagaccatcctggccaatatggtgaaaccctgtctctactaaaatacaaaaaaattagccaggtgtggtcttgtgtgccggtagtcccagctactcaggaggctgaggcaggggaattgctcaaacccgggagacagagattgcagcgagctgagattgcacaactgcactccagcctggcgacagagtgagactccatctcaaaaaaaaaaaaaaaaaaaaagtaaccctcctatctccgcccacaagaatcctgcacccatccacagacaaaagtctatcagcaggagtttcaggattcaggtaggaggctgcagagccccagtggagcccaagacttaggaggattattttgagagtacagaccagcacccacgtagctgatctgctgattatgctcccaggttcaagcctaggaataacctcatttcccaaagggcttggctagatccttgtttggccttaaacctgtgccaaaaccatttgcccaggcatccaagaggaaccacacagactactgcctcagtgaagagacttgtctgctcaatgacagtggtcttcacactgaaactgaaagttgttctttggcttggcactagcctccctcagctgaggttccacatgaggactgcttgtacaaggatacagaaggagacttgcccatattctctcaacctgggagtctaagcctccataatgagttcactaacctccatttcacagcagattttgaggtgcaccagactcagttccagctccccttactacttttggggaactatgctgtctatgcaaagacctgctgggaattgcacactcacgtgggccagtgagacaggttcgtcagctgctgtcacacagcagatcctgagagggcccagaccacttgtgcaggacctgccgggaagcacacctgtatggacacagttccactgcgcagagacctgctgggaagcacacctgtgtgggccactggaaaatatttcagtcttaggttcctgctcagctttcatcaacagcctagggaccctccttaagtcttccccaggtccatctaggacagagagccatgtcatccttggaacctttgtgagattcacagcaaacctgggctgagaggttcctctagtgctaagacaacttcagtgatcacaggctcagggaacacaattagtatttttagatctctggaagacgctctgaaaaatgataggcacagtaaagccagactgtgaagactggaacaaatacccagtctttcaaaatgcagacattgtcacatgtccactattatcagtaatattcagggaaatgttaccttaccaaagagagaaaataaggcaccagacactgattttaaagtgacagggatgtgtcatctctcagacaaagaattcaaaaatagctgttttaaggatgctcctcaaacttcaaaaaatatagagaaacaattgagaaatttatcagggaaattttatagagagattgaaattttaaaaaatcaaacagaaatcctggagctgaaaaatataatgaatgaaataaaagacacagtggagagcattaacagcagaattgatcaaacagaagaaagaattagtaagcttggtgacaggctatttgaaaatacagtcagaagggaaaaagagaaaagaataaaaataaagaagttacaggatcctacaacagttgcctgtcaaagaaaagctcagaagtaggcttcactgctgaattctaccaaacatgtaaaaaaagagctaataccaatgtttctcaaactattccaaaaacttgaagaggatagagttcttactaactcatcctatgagaacagcactaccctgataccaaaaccagacaaggacccaacaacaacaacaaccaacactattggccaccattcctgatgaacatagatgcaaaaactctcaagaaaacactagcaaaccaaatccaacagcacatcgaaaagatcattcagcatcatcaaatgagatttatcccagggatgcaaggatgattcaacataggcaattcaataaatgttatatatcacattaacagaatgaaagacaaaaattatatgatcatctcattagccatgggaaaagcattcaataaaattcacaatccctttataataaaaaccctgaacaattaggtatagaagcaacataccacaacacaataaaggccatatatgagaaacctacaaacatcatactaaatagggaaaagctgaaagtttttcctctaaaatctggactaagacaaatatgcctatctttactatttctgttcaacatagcactagaagtcctagccagagcaattaggcagcaaaaagaaataacgcgcatccaaattggaaaggaggaagacaaattgtctctttttacagatgatatgatcttatatagagaaaactctacagaccccactgaaaaactgttagaactaataaattcagtaaagatggagtacacaaaatcaataaaaaatagtaacatttctatatgcaatagcaaactctccaaaaaagatatgacaaagaagcccatttacaataactacaaaaaatctagaaataagtttaaacaaaaacatgaaatgtctctgcaatgaaatctacaaaataatgatgacaggaaatagaagaggacactaataaatggaaagataccctgtgatcatggactggaagaattaatattgttaaaatatctggatcagtctcttctcacactgctataaaggactgcctgagactgaataatttataaaggaaagaggtttaattgactcacagttccacatcgttggggaggcctcaggaaacttaaaatcatggcagaaggggaatcaaacacatccttcttcacatggtggcggcagaagtgctgagcaaaagggggaaaagccccttgtaaaaccttcagatctcttgagaactcacacactatcacaagaatagcatgagggtaaccgcccccatgattaaattacttcccacccatccctcctagacatatggcgattatgggaactacaattcaagaggaaattgagaggggatacagccaaaccatatcaatgtccatactgcccaaagtgatctacaaattcagtgcaatctctatcaaaatactaatgacattctctataaaaattgaagtaaaatttcaaatctttttggaaccaaaaggctgcaaatagccaaagcaatcctgagaataaagaaaaaaactggaggtatcatactacctgacattaaaatatactacaatgctaagaaattcaaatattcttaccataaagaaatgacaagtgtttgaggtgatagatatgataattatcctgatttgagcattactcaatgtacccatgtatcaaaatatcacattgtatccataaatatgtagttacatgtcaatgaaaaacaaaatacatctttaaaaaagattcacagaaacagataggcaataaacaatatttatatatggccctgaaaaactattgaattgaattttatttgttaaattgaattttaattctcttatggtattagagctcggatgtcttaatttctccttgatttctccattggaagtagatatttattttaaacctccttttaaagtaatctgtcatgagacattttaaggaactataaaagctacttattaagtcatttttataaagcaaagccaaaaccaaaaaaggaagatgacagtaatttccagaaaattattaatagccacagaaaattcaatctaaaggaaaaaataaaaacaaaaactgtaaataatacgtggcaggaaaatgagcagggagcctcacctgacttcaaatttccaggaagttgacctaagtcttactaggatggacattccatagggccttctagaagctcttgctggacttttccatttttccttatttttattttgcattctagtctcatcttgaaattagtcatgtaaatctttgatatttatgagatataccaatatgttttattatttctttgcctataactaatttctttcttttctctccttcctgcagggtttcattttatcttgctaacgatagtctctcatagttctttcagggaaagtgtgtgggtagtaaactttttttggtctttgtatatctggaaatgtcattattttattttcattctgttatttcctctgtcactattgttgctgatgagaatcaactataaatctaatagttgatcctttgtagataaggttggatctttctcatacattttaatatcttgcatatttagcttttaatttttctatgctgtgtctacatgtagatttgcttcttttttgtttttctctggacttgatgtgtcttctcaatatgagcacttttgtctttctacaatgctggaaatttttcagccattatgttattaaatattgtgttttgtcaattctctctagtatctcttttaggaattccttttatatctctgttgaatcttctcattcacttcatgtttctttttatatttcctgtgctttactactttgtgtggcatcccaattaatttcttcccaactgtcttataaatcaatctttctttagctgaatcctgtttaattttattctttctactgagtttttctatttcaattactacatttcttatagaaatgtagtattttagattcttttcaactttgtccatccttgtttcattatgtctagtttgattttaggcatatattaatttctttttttactttttgatctataatttctataaattttgagtggcaggaatatttcttcattatcttatatttccttgtttcctagaaacctgcactagcattttcacctcaactattccaatatgaattccaaatcaaaaagttcactgaaactcttcttgagctctgtattgttgtacccaatgagtaattttcattgtcacttaaaatgttctcctctcttgagccctgagaaataaaatatccacaggcaccgcttctcaatctactgtgctggatcctactttattacttgactgctaaatattatagtgtatcaaggctcaatcttaaatcctgttatctagcagattctctttataattcatattatttaaacttgtaacttttaattttatttatatgatgatgattttcaagtaaatcccactctgacccccaaagttaccattagtcattttgcaactcagcctaaacatctgatatctcattaaaatatgttaaaaatgaaacttgctttcccataatccacactgattcctttctccattatgtcatcttaataaatattattctattcatctagatgcagaagtagaactctccgtcatagctagcaattgtcttggggatttttgtctgtttacttttttcaaaaatctctctacaccagaattcagggaaaagaaataagaaaaggatatttccaatttcattttacccaatatctccactatgtagcatagtttgttttacatatttaatattcataaaaggagatgaataaataaatgaatgctgaattcggaacaaatataagcacaaggctttcattatagcattgtatcattagatcttatttatttcaacttgattaggcttccaaattctgcggatgcttagctgcaaactaaagttatttaattatcaggacagattcgctgttccttagaaagctactgtggcatcatagtttaccatgcctttggagtctctgtacaattgtccaatttcagttatatttttctcctattggtacttttcggattctggctttgctattcataagacatatgatcttgagcaaattatttagctcatctttaaaatgagtgacaaaagaacagagaatattagataatacatacaatgtgttttaaatagtgcttagtaactagaagatggtactactgctactactgctattattattactaaagtctgaacatctctaatccaaaaatctaaactccaaaatgttccaaaatccaaaacatgacaccgtaaggtgaaaattcaacacctgacacctttgctttttgctaatttagtgtacacaaactttgtttcatgtataaaattatttaaaatgctgtataaaattaccttcagtctgtatgtataaggtatatatgaaacataaattaatgttttgtttagacttgggtcctatccccatgatattacattatgtatatgcaaatattctaaaatttttaaaaagtcagaaatctcaaacatttctattcctaagaattttgtataaggcatactcaacctgtactattgttaatggagataatgttcctttctagccatttgttttcaaataagtagaagtaaataaaaaataatcacacacaaatatgtataatataaattccttatagtctataatttaattttctataacataatagtagtgtaaacataaacttgccatacatattttgcacttaagcaaagttcaagaacataaaatgttaaaattatcctaaaaaagaatgtgtaactgtatgaaacctgagctaaatcctactaaaaaaataggtataaacttcagagggagtattttgtttcttttatatctggatatgttatacaataattaggcagttaaatgttttaaatttgatctaagataggttaattgcttttcctaagttgccggtaagtagacataaatgcatcaattcacattacctttttaaaaaaccagtgataaacaaaaaactgcaattgcctacctaaaaaagtgatcctgtctccactttagcaaaggaagttgaatttctgatttctcaattttgtttgttacctaagttcaaacagcaagcactcaatatcaatctctggccattttatataaagaaatgcaaacaacaattaggtcatacagtgattgatcccctgaaggacaaatgatgtcaggcagtatttatgcaccaaaattatttcaattttgcttacttttccagcaatccaccttgatgtcaactaccatttagctgggccaataatattgatatttgatgtcagttcttattcattactgcaccaagatgatgcataagtcaaaacttttagatgtgtggtgaaaaacactaaagcaggttctgtctatccaaggaaattggaaacaacaatagaatataaaattaaggcatatgtaatctccatttttattttagaaaatatttaaattatgtcaatattcctacatattcaaaaaataattttatatctcaagcccatcctatactatgtgattttttaaactaaatattttatgaaattaactttttgccttaatactttttgtactttggaaagaaaataatttctagtaaaaagtgaaacgctttaaaaaagtaaagcaaaagaaaagcatttgtataagcagccattaaaaaaattaattagaatataaggtaactataataaattaatagaagtattctatctttatttctactttgttttggtgttagaaatctaatactgtaaatgactacagataaaaatgatacatttaagattctattgcaccacccccaaattttaacctccaatcactcctatagtcaaatggagttcatttcatacatttgtcattttgttgatgggtctatgaaaattgaaagcaacataattatgtcatatttcttgacatttcctctttgaccaaaaaaaatcaatcgtttgttttctatatatgtatctttggataactttaaaaccttttggcatatatgaaaacagttcagtagtgaaatttctacttagcaaccctttacatcaactgtgtcctggcactaatctaaatagtgagagttcagcaatgaaaaataccaagtcctgtcctcaggaaccttatattctcttaataatcagagacaataaaccagtaaataagtgaataatctcaggaatatgaagtgctacctatcaagaatcaatcaggtagaaaacagcaataaggtgagagttggggcttaaaatgcaatgatcagagagagattctctgagagaataaagaaatcctaaaagttctgaaggaagataactcaagcataggcaataagagaggccaagttcctgaagtggtgacaacatggtcccgtggaggaatagcaaaatcgggacacatagagtgaactaggaatagattaaacaggtggaatatcttgaatcatatagataactgattggtaatgtcacctatacaaagataacccagctatgagaagtttgtaatggatttttttatgtgactaataccttaagtttttttaaccctagaattcttagcataattctcagtatagaagcactaatcaataaatattcattgactaggaagtgtcagaaagtcactgtaggtcagaactgaagggatatttaagaggacataggaccatgtttgctgtgacacaacaaaatttattttctatcattgattttaaattttattttgaaatttaatatactttgcagactccccatgattgttttgagcatatgactgccaaaactagttcaaaatattttatttttttataagaaataatgtcactgatcaggatatttgaccactcagacaactggtcttccaatacagtaaaatctcatttaaacaggtttcacagtacgaaattgttctaagtaacgtgaaaatatcaacataaaatgatacactcctctctaattaggatttattatagccagtcttaatttgcatgtgatttaaaaagtataaaaaactacatgtatgataaacagcatgaatttttaagattgttttacataacagggataatgtctaatgcatgaaacattgtttttgaagcacataattagagcaaaaataattgtcacaccaatttactcataagcacaattacaagaaaacttgattatcccctttaatgtaattttccccacttaattgtatgttggtggatgaatgtgaccctgtgagtccatacttgaagaagtgactgttagttaacatgcaaaaccacgggcagaacaagagagtctgccctttctctggaagagatttaatttgtataccaagtggctctgcagggaaactgttttaaaaggtacatcttccagcaggatgggctggaatttcctggagcacctttcaccttgcccttgggctgtcatgtgcatcatcaccttgctctgccatttactcaatagctagacctaaacactcaacagttttctaactaaaggaatttaatctgctacctagattgcattcagaaacctaaattcattgaatttttttctgaaaccattcaagtttttatatatgttttctttttttttaagatttagcaaatattccctgacttgttatttgggtggttgtgaagtgaaagaaccttttgtttctaactttaatacctggttgcatttagatcccttattccacctgagctggagaaagttaggaccacagagaatcttaagtatacactctgtttctttttcatgaggcttgatactggaattggctgcagtcatttaaaatgttctctttttagtctgagggatagaatttttttctaaggaatagctggttttcaatttttacagactgaaatacaaagttatgaaataaatcaagtcattacattatgaattgcttttctatcatgttatgttttgtatacctaaaatggtaaaaacagacttttttggatgtgtgaggttgtaacttcgccctctccagggtattatggatacaattccatatcttcaaagaaatatgattgttttactagtgaaaaaaaatgtagaatttctaagaaaaaataaggctagcaaacagaaggacagtctgttagaaataattcttaaaaaggctctacattttagttaaatatatatagctccaccctgtaatctgtttttataaatcaaattatagattttggatattttatcaagtcacttcaatatgaagtacaggaagaaagatatggcacctttcctcacccatcttaaggatcatagccaaaagtcctgtaacaaaagacaggtttacaagggaaaagtataacaaatgtatttaatcagggttttacttgacatgggagccttcaggaatgaaaacttaaaagacccggggaaaattgtctattttgatgcttagatttaatgaagaatggacaatcacgtagaaatgtgattgggcaaaagaatataatctaatggtaatagaccgagggaagaaatccagtaaggcctgactttcttttccttccttctttccttccttccttccttccttccttccttccttccttccttccttccttccttccttcctttttttttttttttttttttttggcgtttctgtatagcatttctttcacctggcaatggggcaggtcccacctcgaatcacgtcttcaaaatagaagagatggagtgagcttgctaggctttacggagaagggagaagggagaagggatggattgagcttcctaggttttatggctttctttgggggagagaagtttccgtttctatgactcgccttagggaagaggagttctggtttctatgactcattcatgggagaaggagggtcggaagacaggaaggtggagaaggtcagaggcccttccaatttccttcatttcaaagtattcagcacaccaaggagccatacttcagggtgtcgtgttctgagctccaacagtggcaacagccaggcctggtttatggtcatcaacatgaatcttggtattgtaaacattatgatgacacaaccctattcatatattatcaactttatgtatataatggaacttctctgaatttatgtgactgtacttatgcacatattaagagaaaataaatccattgcaggttatcccagcaatgttattgcagtgagcactatattaatcaataataattagctactttaaaagactcttgccaaattgaggaacaccttaggttactatcacaataaataaacagatcttacagattgtgtatctacatcatgtaatatcttctgcaatgatcaaacagcaaaagtacattgttgttaacaatagtaattaacacattgctctcatctttgctagatgatttgttttatttctctatggtgtataaaacatacatatatatttttaaaaggattatccccaagtacttaagaaatgattattttgaaattactagaaatctgaagttgtaaattttttgtagtaagttctctgtaagtgtttgtgaaactgaattcagtagataaaaatattttttcccacaagggaaaagaaatagatttgatggaattttgcagtttgccactatgtcagctgctaatatggacattcaggattccaaatccctctttgacctctaatcactgctgcagaaatctagtgcttctctaattgtcaatccctgccctctgcctttcatatcttggagaatataaaaggactgacttcctccctggataaaggacaacagattaatgaaattaagtgtctgcctcattaaaattgtcatccctggtttactatttcaagtgcagtatcaactgtggctagcttttactcttcagggggtccagtgatgttcagtttcttatgtaaatttatgcaaaaactactccaacaatatcacatgctgttcctttcaaaccccaaaaggaatgctgtgtttctttatctggtagatggaaagagcagagtgggagtgagctgagttacaggttaacaaacagaatactggtctatccaaggaggaggagagtttggaaggaaaacacaatatttattttcaattgtgttaaatcaaagattcacctgtatgtatttcatttttatctgtaaatatttccaaaatgtaaatttacatggcaatgcattttattttgtttaggaggattacaaattagccaggatgattccatagctcatgaagatctagaatcatgtcttacccttttccctactgcatcagtcctgtcctcttcctcaccacacaccctcacccggcactaggccattctggcagggaaagcttgtctgggtgatacttaatgaatgactaatcatgttttcaaaactctttataaaagaagtttcatcatcttaaagtatgtacaaatttctttggtcagtttgttataacaaaataaaaagtagaccagtggtgagatagaaacagactgttctagaaaaaagggtgggttagagcagcttgattaaatgtattaaaaagtggtagaatttagtatttggcaaattgatattttaaagcacttaaatgtcctttaattctcaagttgaatcacccatcatcatgggttgttttaggaagtaaaattatcagtgtaggcttcattcaaatgtaaataactatggcataagtgcctcatttaaaaatagttgttcagaagaaaataagctgacgggcagggggaaaacctctcaagttataatcatttcaggaaagtacatcctgtgtatatgtctatctgtgtgtatgtgaattgcccagttgggtggccacattaattgtgcatatgtgtcatattatgattgctttaagattggttgggagagttattggcatgttttagttaaatcttatatttctcagtttaattgagaaagcaacaagagagattttaaaactctaagctctactcaaggcttttcattgtctggttatgctcactagtgagccacaaccttctccactgtcccctaacccttcttatatttaccctcaactttggccagttccaagattgctgtgccaaaatcaattaatatgcatccaaattgaatgaaaacactccaaagaaatatctttaatctgatttacatatgaatttattcctgtcttcttatctaacggatttcaattcaaccagatttagtttcagatcccaactatcacttaccagttgtgtgaattagaagtagcctaaattttctcatatgtaatatggtgatattacctagtgcctcataaattcatcaagtttaccttgttggatgctagatattttgtatttttacaaatagtcttgaactttgttctggaatgctgtcaagttacttagaaactggttagtacttccagatttgttaggtgggaaagaagcagtgctcaaactagggctaattacttccccgctactaaagcggggaagtaccccttctttgtcttctaatctacccagtgacctcaaatcttgaaatttttcattctgtctgttagggcagtcctcactttcccagtgtaatctgaacatcttttcgtgttccctctaatcatttcaggtagttcttcctaggcccctaagtaatttcctcacagtcatatgccaatcattactgagctaaatactagaggaggtttctctgcagatctccagggttttctctgtgcaactctcacctcacctcttctgtacactctgcctcgcaaattctacctgccttggcatccctggaccctcagcttcgtttctttaattagggagtctgctgtgctttgtttcagttccctgtccttgtgttatgggatagaaatcgtcaaggtagtatgtcaacgtagtcttctctggctgacttcattcgttttcatctcttgatgattattgccctttgttacctaatatgcagtgtcttgtaaaccattgttttctatattttgtccaggtttttggttgtttcaggcaggaggatatacctgatccctttgactccattgtgactggaagtcttttttagcatctgtttttaagtgtcaacagatttcaccagaagatatgcaattgtaataataatagcattatttttaacatttatagttagcccttcctcctatacaaaataaaagttggcagtatgtttgaagaagaccttaattatagttctgcttggaccatgaatttcatgcgaaggcttagacaaatcccttaatttctcaagactttacttttctattccatggaatactttgatctggacaacttttatattatctttcagaaatatattgataatcactaacattttccttttgaaattgagaaaaactatagactatgaatgcatgacttataaggctttttagagaagcaaggatttattttcaacacctggtttttctgaactctgaaagattctttgtgactcaatacttaccggtattaacaaaaaaccatgagatctgtagaggagaaaagaagagctttattttcttaacaataatctcaaattggggaggcatagcctacaatacaagtgagcgtgccttccaatgaacaaagtgggggtctggcttcaatagagaaaattctcaccccagttctcaaccaaatccatttatgcaaatgaagcattcaaacttattcagttctgattggttgaaatagataagccctgattggcaagcttccaagccccaaactggaagtctctagcagccggtgtgagagtttgagggtcgtggccacagtttatcttgacaacaacagaaactggtttggattaatcacagaaagggaggttttgtgacacttttacaacacctttctgagaacatggagtactttctgagaacacagctccctcacttggctgtggccacctggttctgtattaactttgagaacctcagtcagccatgaagacttcattttgtctgttggccagaggcatgctttaacactagcaaacaccacagcaaacctgagatctttcttctgacatacagagtgatgccaaactgtaaaaatttaacaccactcgctcttcagatgtggagtagtaagcttcaatttttacttcatatctctttggttttatttcttcatattccagaaaccctactgccctgctttgacattacagtatgttactatgtaaatatatcaaaagatattgctgcaatgtgacaagtcacatcggcagaaaacaccaagggcctataagacaaagatctcatacatgaatatctgaaataatgccaataatgacactgaaaatgaagtaaactcacatgagagtcagaacatttttttagtgcttttagaagaggctcactgccagagggagaatgcatcaatttcatatgccatgtaaggaacttccatttctccttgaataaaacgttagtttcaaaaattgtctttagagtagaaagactctctgtgatttattaaaccttcttctccccttcaccttcagaaatccactaattttgcatcgtatttggcagccaggaagttgggccagtctatattcaattccttcaggactgtgctttcaatttggcatctgcaaaataagcattatgctaggtgtcgtgggagattcaaacaagtaaagatctagtcctttttcttgataaactaggctaggtgtggtagctcaaacttctgagagtttgacaacagtctgagaaacacagcgagaccccatctctaccaaaaaaaagtagctgggcatattggcatgcacctgtggtcctagttgcttcgggaagttgaagtgggaggatggcttgagagcaggagtttgagattacagtgagctgtgatcatgccactgtactccaacctgggtgacagagcaagaccctaactcaaaattaaaaaaaaaaaaaaaatcaaactctatccacaaagtaggtaactatttgtttgtataaggtaacatgttataagtgccaaaagtggctaactaaaagtcagtggagaaaacttatatttacacaaaaacctccacatagagtagctttattcataactgtgaaaacttggaagcaaccaaaatgtcctccagtaggtgaattgatagagaaagtatggtacatccagacaatggaatgttactcgggacttaaaaaaaaaatgaactattaagccatgaaaagagatggcataaacttaaatgcacattactaagtgaaatagccactctaaaatggctacatactgtatgactccaactatgtgacattctggaaaaggcaaaactgtagaaacagtaaaaagatcagtggttgccaggggctggagggagggagggatgaatagacagggcatagacaatttttagggtggtgaaaatactcttataatgatggttacacttgtctaaacccatagaacgtacaccaccaagagtgaaccctaatgtaaactgtgagctttggatgatgaagatgtgctaatgtaggttcaccaattgtaacaagtgtaccactctggtggcagatattgctagtgtgagatgctatgcatgtgtaggggagacaggacatatgagaaatcttcatactttcctcttaattttgctcagaacctaaacctgctctaaaaaaaataaagactttaaaaataatcagtgggtatatcgggtataattcttgaaagagttctattgcaaatatgagaagttttgctttgactttccaggtatggaaataatgattcattcattcatttgttcaaatatttactaagtatataatataaacccaaaactgaatgtgtaaatgatctggaacagtactgtccaatagaactttctgtaataaaaagatgatttttaatctaaaatgtccaatgtgataggtgctagctacatgaggagatttttaactaattaaaaataagtaaaactgaaacttcagttcctcagttgctgtagttacatttaaagtactcagtagccacatgtattaaacaatggtctagaatgaaaagacgggcatgtatataagagattgcagttttgtaacatgaatttatggaagcaacagaaggaatacattgtgtcacttagaggactttagaagaagttgtgttggagccaagttttaagaatggttgatatttaccagaaaaataaataaggaatgagtatcccagtcagtggaaactaagaagaaaagcatgaggacttggtgcatttgaggaatagccaatagagtaacatatggggaaatttaaggaagatgataggcaggaaggaggcaggtcaaatttacatttgagagtctcaaatttgcatttaaaaatgactgtcatggctgggcctatgccttgtaatcctagcactttgggaggcctaggcgggcggatcacctgaggtcgcgagttcgagaccagcctgaccaacatggagaaaccccgtctctactaaaaatacaaaattagccaggcgtggtggcagacgcctgtaatcccagctactggggaggctgaggcaggagaatcacttgaacctgggaggcggatgttgcagtgaactgagatcgtgccactgcactccagcctgggcaacaagagtgaaactccatctcaaataaaataaaataaaaaaaataaataaataataataaaaaaaaaacctaccattagcatagagcaaggtttggcaatactgattttatggactggtaattccctgttggaggtgggggctatttcgtgcattataagacttttatcagcatccctggcctccatcaactgaattccaggggcactttctagttgcgaaatcaaagatgtctctggacattgccagaagtcctctgggaagaaaaaatcacctctatttgagaaactttgctgtaaaaatggccttccaaggctgggtgtggtggcttacgcctgtgcactttgggaggtcgaggaaggcagatcacttaaggtcaggagttcgagaccagcctggccaacgtgacgaaaattctctactaaaaaatacaaaaattatccaggcgtgatgatgcatgcctgtaatcccagctactccggagcctgaggcaggagaatcacttgaatctggtaggtggaggttgcagtgagctgagatcacaccactgcactccagtctgggttacagagcgagactccatctcaaaaataataataaaataaaataaataataaaatggcctgcaaagatagagggttgaagtgaggaagttcactgcatgtgtcccagtgtgagttgatgacaggctaaaataagggatttttggaggcaaatttcaactgaatagaattggaaaggaaagagatggagaatgggataaaaagctctggtgattgcctggagtttggatccttttgttgaaatggaaagtgcagcagaaggctcaagttgaggaaaagattaatttggctttgaacaggatgacattgaggtacgtggggaacttccaagtgagaaatgctatcagtagttggaaataaagacctggaatttaagagagagttgtgaattggagatgtagattcaagagtcataaacatcttaatattagttgaaatcatgggaatactcctttgtgcttccagcagtctggacttaatgacgactcatagtttctgactgatctccaaatccacgctttttgaatcaattcaacacatagcacctgttctttcctgatttcatatatgaaaagactttgaagtctacactggcctatttactgttagcgcttctgcctcagggcccttgatcttgctcttccctcttcctgaatcactcttcattctcacagcacaacttggccccacaaatccattaggtcttaattcaaaggtcacacattcctagtcttgacaggctatttgtatttcaacaccctgtctgccaaacattccttgtctacatttttaaaaattctccatagcttttaacatttaacataccacatattttactgatttatttaatttattgtatgtttctttacagaagcatgcccgttccgtgaggcttgtccaccacctaaaatcggcacaggctccataaatatttgtttgatgaatgaagagataggttttctatagaatgaggcaaatttgcccgaattcagtcaacctcttacttataacaaacttgagtaccacaagaaagcaatcttcacttgtttttcaggatctcagagacacagtcttgcactagataataccttcttaacttactgagactagtggccttcaacattccctttaacgtatcgatatttatgtacaaaacacataagaactttttttacatcatatgtaaaatttacattcctcagtgtgagctccagaaactttggaatttttacacattgttaacctcatcattaattcaccacattccccatggagtagtatgttaatttctgctttgtgctctgacattgtgccgttttcgataaaaatgacaccttcctgccttctcttccctattatttgtccataatcttcatctatctaaaacattacatttccagaaagctgtattcacctgatgaatttatcctagtgttccgctcctagaagatactttcttagattctacagtcttgaattaggtgatcaatttgtattctaaacaatacctacttctagcatttaactcttctattgtaattgcctagttactcctctctctgacaatcaaccagaagcttgttgaggtcatatattaattgtttttcttcctcttggtccaagccagggtcacagtagagttcagtaaatattagttgctttatatacattgtctttatttctagttactcttctgccttgtcaatttaaacacctgcttgcttgatttgttctttgttaatacatgtggtacttgttgacatgctcctaaagctctgttagctgttttggtgtgttttaccccaataacaaagtatgcatgtttatgcatctaagtggtttcatgggtcccggagttcggatgtctgacccctccaaatctcatgttgaaatttaatttccagtgtaatggtgttggaaggtgggacctagtaagaggtgtttgggtcatgggagcaaatctctcatgaatagattaatgccttccctgagggaggggatgagtgagtttctactcttatttcccacaagagctggttgttaaaaataacctggaacttcctctatctctctctctctctgtctctctgtctctctctctctctctctctctctcactcttgcttttctctcttgccatgtgatctctgcacacactggctccccttgccttctgccatgaaaagaagcagcctgaagccctcaccagaagcagatactggcgccatgcttctatagtctgccgactgcaggaatatcggaggctgggcaatttataaagaaaagagctttgggtggctcacagttctgcatgttatacaagaagtatggtgctgtcatctgcttttggttagggtttcagggagcctccactcatggcagaagaggaaggggagctgacaggtagagaaggggagtgtagctgtcacatggtgagagagaggaagagagagggggtagtgccaggctggttttaacaagcagctctcacagaaactagtagagtgagaactcactcactacaagaatgataacaaaccattcatgagtgagccacacctatgactcaaaaatctctcaccatgccctactctaacactggggatcatatttcaacatgagacttagtggggccacactaaccatatccaaaccatagcatcaggttttcaattccgagcctgtgttttgctaaccaaatgactctgggcaagtttaataacttaaaccttggttgtctcatttgtaatattgagcagtaccagtacctaaccataaagatgtagaattaaatgagatagtacatataaatcactttgtacaagttattgtaatgatgtagtgctgtgttgtgtactttagctgctcggtaattatttttgagatttccagctcatatccatggagcatgattggtgatatggtagttgttaatgcctaacagactgatgatggcataggaaagaagtatacacccaaaattacaaacttatccacatctttccagtgctctatatttcctccttctttatacttgaactttctaagcattcccaaatcttaccttctctttccgttctaattccataatttatttgctttatttgtgccattagagtattgaggaaatggtgtaatgagctattgcttaatgctgcataggcctgtcctaagagacatgctaatgtatcagtactaaaaatgtttgaaatactaattttcctcctaatgagcctaaacattttattatagttataccttaataccaagttgcaggtcattaccttcacatattgaaggcagctgatgtttcccggacttaatgtctctgccatttgcttgatgacccctcttacttgcccattttgcatagcagaattttagaaaataaaaattagatcacttgacaggtactgtgtgtgatgttttgatttcattatttctttattcaaaaatatttttctgatgataaaaattaatgtatgataatttcatgaaatctaactttttaaattgaaaagaacaaataaaattaatgtgcattggcttactacctgaagataaccatttctgatttattttcaatatatgctttgtgtatacatacaacatagacaattttgcatgctgctattttcattgaactacatattttttcgtcattaataatcttcggcaatgccattataatagtttagttatatatttatatatgttatctaatgacatatatatttggaaatgccaaaatatagtttagctatataattatacatgttatagttttatatatttgtgtatatatgtatgtgttatctattgatgattttttaggtttctacagttttagcttgtaaataatagtgtgaggaacatctatgtgacaaatttgtatcttattgactatttaatgtatcctgatggggaaatattttctatatttttaaacttttgtgatatactctagtagttttgagaaaataaaatgtaatacagtggataaaatcttggactctgcagttaaccatacatgggcttgaatccacactccaaatcattctaactaggtaattttagggaagtgactttatctctttaagcattattttcctcatttgtaaaatacaattgttgcacataaaaaataatcctataaatattgagcatatgtcatggcaaaaactgttaattttagttgtcaattactacatccaccagtaatacaaatctgattgtattgcagttttatcaacatcaatgctgtcattaaaaatctattctaatttgatagaaaaaaaggacatgttaattaaaaaaccccaaatcaaactaatttaagcaaaattagggtgttcattggctctatagaggagggaaagatcactcccactgcctttttattcttttctgggctctttggctggtccaggaactgaactgatataacagatgaacaggagaaaagcacacaagttttattaattttacatttacatgaggattttcatcagagagcaaagtccaaaggaatggccaaaggaaaatgcttttatattttttagacaaaaaatataaatttgtaaagaaattacacaacaaggggacctggctagggtagtaagttctaggggagatactgggagatacatgagaggtggaaagctagtggaagataagggttatttgggggagattatttattcaggcctatttcaaggctaagtcccagtatctggtgataagaattcttctcacgccctggtactgggaaagcaccccttgcaaaagaatatttaaagcctgctgcatgcaagaaaagacaattcagccattctttttctgaaactataatttctccaatgtttttatctcaaaatagtcaatataccaatttggcatatttgaggaccatacatcctttacttcttcagctcacaaacctagacttcagactgagcagttggcaactggcatttagatttagcaggaaccaaaactcaaataccacctgacttcctgaatggtcttactcttattagtttctttattgtactagacctgagcatcagaaggaagattacacatgtatatgcatattacacattttctgaaaccttttattcagagaggaaatagcttatctctctcacattagtttggaaaatacagggaggtaatcttattgctcctacctgagccagattcctaccccttaaataatgactccatccagggagatgaatttctatgaggacaccagctacagtgtaggaaatgagaggcagttcttcaaaaaaagtgagatagcaaacctatgactgctagagtgatcttgggctgggtaaccaagctaagtggatctactccaaataaaacactgtttgaatttatttcactcaactatagtcctagggtcagtgaaaaggttttcaggtgtttaatcattctttcttctgtctaggtctcatttcaagagcaatatttgtattgtcttagtggttttcctctttatttcttgtatttctttttgttatatttaagacaattttttcaaagtttattgccagttgacttttaaatttattttgttctggaaatgccattttgctgaagaattaacagtgaacattaagtccttcagagcatttggtgtggtttctttaatctctaccatatttttaattatccccttttccctgttgttgcttaattatgacttttttctttgtgattatttttgtctgtttttgacaaacctttcaatttgtctgtctacacttttcaaagagcggcttttgattttgttgatgttatctcttattattttaataactttaattttgcttctcattcatcatatattaattatttctaccttttctattctgtagaaaagagcgtcttcaatttaattctaatatatttattttaaatttcgctttaaaaaatgcatctgaaattacaaatttttattaataatggcttcagcttccttcaacaaatataatatgaattccttcatttggattaattctgagcactgaactctgagcttttcttcctgctcaaattcctttctaatggcctgggtaaagtcaagcctacacgccttaacatcttgttaaatagggcttttttgaggcctgtttgaagcccagtatactgtggcttactttccaacctgactctagcatagcgtcacatgacagataacagaccctttatcttaacctaagcatttgtttttactgagtccaactatttagacaaagcttaactctttcaaccaattgctaactaaaaaatcccaaaacccacctatgacttataaggctctacttgaagatgtcctgccatcttgggccaaaccaatatgtatctcccatgtactggtttattatattacctgaaattcctgtctccctgaaatgtataaaaccaaactgtaacctgatcgcctcaggcacacttttacaagatttctgagactgtatttccccagcatgtggttactctcatgggctcagaataaatctctttaaatattttggcagagtttcctttttctctctcttttttttttgttttgtttgtcaccagttccaaacttgtaatttattttgtgtttttttcttttagcttccaaacttttttttaaacctttggtgtaatttttagtttctaatttaattgcatcatcgtcataaaatgtggcctttataacacttctttgtcatttcttgaaacttattttgtggcttatcacatacttcacatatatttgatgatactatatatttggcaaatactgttttccattttagatcaagctttattttttgaaggggtggtaaaatgttgtatatctttccttttttgcattatctatcattctgatggacttgtattacaatcttccccattatttgggaaaataatttatttttatactcatgataacttttaaaatattttaaaacgtcatttgtctttacatataaatttattagttataccttgtggctagagtattccctttattattctttagtaatagactctagtaatttcttttctgtaattatttttttctgacactgatactattctacaagcttcttaggaattagcatttaatgattttattcctttattttcactcttgaatattttgggaattttgttattgtttctgcttgtttttaatgtttctcttgtaaattgcacatagttgtattctttattatttaaactattttagttgtttcttacttttaattgttaagtatatcccattggtgggggggggggggtggggggtggggggatgtgacagagagagagatatatatttctgtattggtattgccataacaataacttgtattttctgctaatcttgttttatttgcttctttttaacttatttcctgaattttgcttaagataagatttagattaggttagggttagaattagagttagggtttggattcagcattttgtctttgattttaactaaatcaactttgattaaaaattactgaatttttgcctgggcacggtggctcatgcccgtaatcccagcactttgggaggccaaggtaggtggatcacaaggccaggagatcaagaccatccttgccaacatggtgaaactccgtctctactaaaaatacaaaaattagccaggcacggtggcatgtgcctgtaatcccagctactcaggaggctgaggcaggagaatcacctgaacccaggaggcagaggttgcaatgagcccagatcaggccactgcactccagcccgggtgacagagtgagactcggcctcaaaaaaaaaaaaaccaaaaaaattactgattttttaaatatttgtgctcaccattatatattttgaccaatgctatacttaggattttactttttcatggtgaaatacaaacattaatacttctttccataagatatttaaacatttgtattcattaaatgaaaatgcattcaatccaaagtgatatttaactaaagcatagaattttaggttgaggttttttcccccggtacaatgaggacattatcccactggttctaatatctacttaaaaaattaattgaaatgtctttaaaatattttaaataggtaatctgtcatttttcacttgtaggtaaatatctcttcgtccataatatcccacatttttcattacactctgtttaggtgcagttttatttttatgcattatactcaatatttggagcgcaattttagtcttgatattatatttttcttcaattctggcaaagtttcagccattacacctttggatactgctgttctgactgtctttacattatcttcttttggaatgcttataaaacatatattggaatatgtaactccacccccaccctcaagtctcttaatggtttacatgcttttatctttcaatctctgtgtctacaatctagctaaattttccagattgtgatattccaatccactcactttcttttcaactttgtctagaatagagtacatcctatctatagagccctatttcttcaatgactaacattttaattctcttggatttctcaagtcattttagattgtgtttgtttcatttcttttttatttaatgagtaatagctctttattcaaatctttgagactcacactttcaaatctttgagactcacactttaaaatctttttcagtctttcataattttaatctatacagatcacttttatcttccaattattgactatattagctttagatctccttgcatgttatggaaaatttttggtagcttcttttgagtaagtaaaaggtctgatcatctcttttaactccctttatttcttttcctctttctttgtgcttacccttccataactttcagtattgtaactatctcctttgccccaggtctcccaggcccctagttccagggtgacctaggataggctttacgtttaatgtagatgaaatctgccctctggttttgaaaccacagatccagtcactgagtgtgctacttggtaaaggtccaggtggcaagactgtgtgttaactccagagtccttaaatgtatagattaacaaaaattgtagcttcaaacaacattagccggcaacttttgtcagcttcattttgtcaggaaatcttaccccagccatggttttagcagtaagttgatgtttatcttccatctgacacaaagctcttttagtctctttattattccacacaagctgaatgaccagtctgcttccaaacccaaaacccagagcctatgttttcatccctattctctattttgtgtttctgttctgtttttacttagtgcatagtatgcctgtcatcctgtcctcaaactcttcaaggcctcatacttttaaaaatcgttttttagcctcactctgtctttgagacatggtacagcttagtgactctaaagccacatggccttaaatcctggccatttcttttttaactgtgtgaactgtaggcaacttaattaagctttctgtggctcaatttcctcattcataaaatggaggtgatcacctattccatcatagttttgggtttttttttttttttttttttggtttcctgatatatgtatatatctgtatacaaatgcttggaaccctgagtgacacatagtaattacccaattagtgttagctattactagtttttaattgtctcatttcataggtattttttaagaccatcttgaccagggtccttccataaattatttaattcttctagaatatatttagttttatattatgaggtagaatcacagtttgactcatcatatagttgtgagagtcagctgtgacattatttacaggtatgttataagtgataaagaattatgcaaatgtacgattttgtgtcttatgatcacaaaaacatttttttctgagttttagctcatttaaatttctatatttgtgaaaaaattcttttaaattacatacaatcaacattgattactttctactttctttatatttattcattcaattagtgatttaaaatcaaatacctaacatgtagcaggaactgtgctgggtgctagagattcagtgttacagaaagagctccagacctaaatggaaacttctttgagagctttccatgcaaacacatttagtaccttcccattctcagtttcagtacttgtaccagtgacatattttaaagtctcatgagactgggcacagtagctcatgcttataatcccagcacttcggcaggtcaaggtgggaggatcacatgaggccacaggtttgagaccagcctgagcaacatagcaagaccctgtctataaaaaaaatttaaaaattagctgggggtgttgacaaacacctgtagtttcaactacttgggaggctgacgtggaaggatcacctgagcccaggagtttgagattacaatattgaactgcagtccaccctgggcaacagaacaagatcctatctcaaaaataagatttaaaagtaaagtaaaataaaatgaattaaaagctcatgaaataaatagtaatatgtttggcaatgatatttgaataatatataactgttatctttgaggagtttaattatttgtagttattcacatttaaagtattaaaggattataaaaatacacaaaagctttaataaatgacgtaactccccatttaatcattgtacatgtgtattatatactttaatgtaaccacagtttggcataaatttttccatgttttacattggttctataattgttgttttaatggctttataattatttatctaagatattcatatagtcattctacaattatctattgaacatgaactatattttattctaggtcactagaatgtactgctaaacaaacaaaacaaagttccttcacttagtgtttacaacattctcatgtatacatagttgatgtaaaatcattcatttaatttttctagtatgcagtataactctttgacaacagaatattatatatattctattgttcagccttcaggaatcactgaagaaaggaaacaatgtcctgggcctaaaatgcttttattgttcagtaaattgactttccaaaagaaaaaggtatttatatatataacatacgtgtatatgaaacccagcaagttgaaccaagaaactacttagctgactcatcaggttgaaggttcaaactacaatcaaattggacctgagtcttccaaaataggttaatatcctatttcttttagagatgcaatataaagacatagggactttcatagaaaaaattatgttactatataatatttcttaacctgagcactagccccgtaatcctaaaagttaggataatgcccaagtttgaaatatttgttttaaaaaattatacaatgccataagatatgtttatattaaggaatactattggtttataaaatagtattttaattatttatttaaattattaatgacctcattaacattccagttttctccttttctttcttagttttaccatatataaatacatttggaacctctgtgcagagagatagtagttcagtctgcttgtctctctgcatctgttgataacaagtttacataacagttgcctcaagcagttttctgaacccaccacagcccaaggtttacttcttccatattagattattattgcaaatttcacttgtttccattttgtatttataaataatgctacattggttttttcataatacatttttctttaatttataataaagttcagaagtaatagtaaaagtttcagaagtttggacatttttgtgatacttgatacctattgctaaatttttctcttataaattctcagcagcctagatgaagctagattgatcttatgttattctactctctaatttattattaacttcatgtctatatggttttctcattataggatctttaatttggtggtgggaggcttaacagaggcaatcaggagtggtgactattcattttcatctcagctgtaccctttgtccacttggctaaattctactggcataattaaattcatttgagtcttatgaccacaaagcatttttttgggcttcggctcagttaatatttctatatttttgaaacaaattattttaaatcacatagagtcaacgttgattactcttcattccctttgtattcattcattcattcaattgtttattcaaagaccaaatgtctaacacgtagtaagaactatactggatgctggagatgcagtgttacaaaaacaatcatagctctcaatctgagctttctgcacatccaccttcagtagcttcccatcctcaggatcagtactactaccaatgataaccagaattgcattttagagatttccaaacctcttgagtcttgactttcattaagattgtcatgaaatctcacctatctttaaaaacattttctttgaaatatttcttaatttacgttaaatgccttaaactatagcttgactgtcataaattgtaggtaaaatgacttttccctaggttgtcaactaatctccttcccacatctctccatctccacatccctcaaaactcaaactacacagtttggattaacaacattctagtttattctgtctcgaggaaggagattggcagatggccctccaattttcctgaaatgggagaaagaagaaggatacagggcattagaatattctaagtattgattctggattctctgcctcttccattgctttctgtcttgtaagtgattcagacctatcagggttggaattaatattcacctgcaaaactgctttggaaggacttggaccaaaataaaacttttaggtaacctttgtggaagcattactcatctatcagcttaacaaatacttggttgagctctgctatgctccaaacactgtaatagacactgcatctgcctcactagctaactggatatatagttaagctgttcttccgttaccaagtatctttcagttctcaaatctaaatgcaaacttatttctattacttaaaatattaccatatttggctgggcgcagtggctcatacctgtaatcccagcactttgggaggccaaggtgggcagatcatgaggtcaggagatcaagaccatcctggctaacacagtgaaaccccgtctctactaaaaatacaaaaaattagccgggtgtggtggcaggcatctgtgtagtcccagctactcacgaggctgaggcaggagaatggcgttaacccgggagacggacattgcagtgagccaagattgtgccattgcactccagcttgggtgacagagcgagactccatctcaaaaaaaaaaaaaaaattttcatattcattttaccataatgcatactttgtcatggcttttaagtttctaaggcaatggaaaaagtctagctaaaggatgttagttattcaaaattgcttgaagttgctatgtactagtttattaatgaagcatttagcacagtacctggctcattaaaagcatttcataaatattgactcactttcatattatcaaactattgcacttgatcatttgacagcaatagaagtttcaagtattaaatgtaaaaatattaaaactatttacctactcattttcacacaataacaatgatgaaactattttttattttaagtatacttcctcaaattttaatattcaatgggataaagtatacttcaagattttctttaatccatagactccagacaatgaaagaacatcaagtccatccacctgcctgtggcaagaggtgcatccagattaaattccgataaaaacttacctactctgttcccaaaattgaaaaaaatttccattctgtgacttctctcagatcattgaaagcccttatatttggaaagaattctttctaatttctaacattaatattccttgccgatactgagaactgttctttccttttctgaaatgaaattcactgattcctcacaattcttataatacatgtttacatatttgagggcattccaagttctccatgttccttttaagtcataaaaaagattaagcatctcatttattagattggggacaaggctgttgtattactgtgccagtgacaacagttatagaattttaaaactaattgcattcattgcattactggtgtgtttagagaaaaacaatgagtccacttgaactgtaatacaggatgtactatttttacagaaagaatagaaatcaaggagtaagtgagaaaatatgtgagctagttcaaaatgataaggaaaattataggataattaaggtattaacattaacattttaaataacgtagggagaaaatgagaggatagtttttaagttgacattaaaaaatttgaactgcagctgaaagggaaactgtacatcaaatgggaaacagtatattgatgttttataaacataattgatgattttaatgtggccaatactcattcaatttgtgagtggacaaagaaattaaatgaccagaatgatgagaatgagtgaagactatgagttgctggggagcagaaacccctcttattcaccagcatatctccaatttctgtcacaaagtagatgctcaataaacatttcctgagagaccagcaggaggcgtgtagacagaccctgggctccaaactgaactgatgagcctgggccactgctactatgctgcaaaactatctctccccaccttccattgccatgtcacttgaatccattcacccttccttctgttttccttcccctttatccaattaccttcttccttgttccactacatgttaccaaagcaagcccaactatgttttctgagaattttgactaacagactacaataggcaccatttcattgccatcaacttcacctggtccctgtcattctacctgctatgcgatattcttctctcactgtgtccattttacttcctacctctttttgttttttctctatttgaggtataaattatcaatgctaactaactgtgagcataaaagctgagatatgcatgtggtataattttcccacattcacagtttttatgtgtcacatatatcatatgcattatatgatatatgtatatatatgcaaattatgagtgtacatgtttttgttttgttacatcttctaatgtagttaaaatgaaaatgcttgtctgaaacgttaactccaaaaatttagtgtaggattttatatattaagaatatcattttaataattttatgtccaaaataaagttattaacaactatttcttagtttagaggaatgtaatcttatggctgtaataaaactgtaacacttaccttttgtctataggttactatatgtatttgtatatatgtagtgtgtgtgtgtatatatatatgtgtgtgtgtgtgtatatatatatatatatatacatacatacacattttatttttgtttatcttatattttgaagggtcacatgatagcatcctgtgatgcctgtggggttacaaagctgtgggactttcggaagctgttaccaattgtgtccatcgatataggtccaagtcctggcaatgaggtgaattttgattcatcaggtaggatcatttttgtctaatgtttctgactaagccaataacattaatatttgttctgaaactattttgtttctccttaaatgtatgtatttctacgtaaatgtctgttcttaatattacattatattacattacattaagatatattttatcattacgtatagcatgtcatatgaaagaattatattcatatatttaaagtcagaaataatataggtgataatgtgtactaatctagatagcataggtttgttagcagtgccatgcaaaatattcaaacctccattcctcagaatcatcatccaaggtaagcaaattcgattttctaaaggcaaaatagctaacagtagagaagaacaaaagtttagcaaaaatgaacctgaaatatttttagtgtaataatttaatgttaaaaatttaatgaattaccccatattgtgtagagtttacaactaatttgagataaacatttatcttattgttgcaattatgtgctgtgcattctataatgttattatatttagtttttattccacaatgatataagtattatcaattagataaaatattttatccttgttgatgaggaatagtgtagcagctgattttatgaaccacacaataattccagttgtccatttataaggttaaaaatacagttgcatctgcatctttaatgatagagtttactaaataatgtatatatgttattgaataatatattttttctttgctattgtgatacatgttttaaactattttaagttttgagaatattttgaatctttgagcattatttgtggtaaatcaaagttgtggcgatagcaaaaacttgattttaggtgaagaagtaaagaacaaataagaagaaaatattttattgttttaagatagtccacgtttattctttagtccagaaagtatgaatataccaggagtaattctagagccagaagataattgtgtgtttcttgggactggtttcataatattgccatcacatatctgaaatttagaaaatggtaagtttgtcttcttaacaaactttaagttatgttcccattacagattggcatatgaaccacactagtaacaatggcttctttaaaaatgttttagtaatattcttgttaagacatttatggtctgccagaattaaaaaaagaaaacactcttcaaaatagaagtctcaactatgggaatttcatcttatattgcaaaagcctattaaagggtcaatttatagtttttggcatatataatctacattgacaccatagctctaaaggaactcttacagctttcacttgattttcataaacatttcacatccttaaatccctttttattatcttgagctagcattcaagtattcatgtctttgaattttgaactccgaaatttcaaaattttgtctgtacttcctaatagtagaagttaaaaggtgctttgaaatatcattacaattaataatagccatgtattttattgtcattaaatatgttgccacttgctctttgccatccttgtcatccagcccaaaagttatttgcatacttagataaacatgattttaaataaattacagtacctatcttctgtcatacaggtcagtgtgattttaaggcccttggtacatcaaacctatttttttctctccatgactgatatatacttggtgatacactaatattaagaaaagcataagaatcagcagtagaacagcaagaaacatcaaagacaacacgtatgaacgagggactctaatgaaaacactttatcagtctgaaggaatatgatttcaacctgaccttcccatccctttgaccatttctttaaggaacataccataataaattttagttccatgtgtgtgagaaattactgtcataaggattttctcattgaataatgagaaatctgtgcttctgtacaagacaagtcctcaatgactcttcatttaaaaggttgaattatatcaaaaattgaagaaactggggaaaacaaacataaaatctaatgagagaatgaagaaagaggtgaaagtcacaaagttaagtgctagaaattatgttcatctcaagagagtaaagaagagtgcaaattaagagccaaacaaaattgaaataaggatggggcacataggtctcttctagttgcatttattcaggaaaaaaaatgatttaaagagaagtgtaacaaaattgtatcatgaaaatatgagaataaaataaaatctaatttagtaatctcaaaatacacattcatttgaatatacctttatttattcccagtggcaagccaatacaagcctatatgatgtaatctttttcaaaaaaagcaagaatataattgaccctattggcaataatgaacatgtattgagggctcacattagttatgtctaaccattttttctagtcaaaactctgtgacagaactaaattgtgcagttatatacacctagcgtgttatttgtcacaacttatataatgtgaggccaggcaatggtctgctgtctccgctgtgctcttggactattgaaaacacacatgtaatgtcatcataatgttatgtaacacatgtggaattataaatagcatcctgtctgagatatttcatataaggaatgtgggtggttattagatactttaagtggccattacataaaagttgctaataatatttaatgtctctagatcagtttaatttaagggtgtctcaaggttgtgaggtgtactgtttaaaaagagttattttcttatgaaatgacagatctttataaataagggatttcttatcactgcaaatccaacacagtataggaataaattgaaagtagaggtcattaaaaggctgaaactgttatctataatcttaaatttcaaattttgatgtataacaaaattttctctatttattaacctcataagtaaatattgcttttgtggatttataaaagtatatatgtactaataaatagtaccttatctgtcttaaaatagagattattcacagagtatcatttttaaaatgtagctttggcaaaaatgttggaaaaccaaaggtgaagaaaaagaatatagactatatatttcagacccttaggtttaatcacatgttcagcaccttttagactttaggcacattacctatttctcctcatggaaataatggaagagacaattgccttgcagtgttctaacgtggactcaaagggataatgatattctctaataaggaactcagcatcttcatctactgtagggaccaaccccacaaggtcggtgggtctctccctgtgtgcggcgacgagagagtgtagaaataaagacacaagacaaggagataaaagaaaagacagctgggccccagggaccactaccaccaatgcgcggagaccagtagtggccccgaatgtctggctgtgctgttatttattggatacaaagcaaaaggggcagggtaaagagtgtgagtcatctccaatgataggtaaggtcacgtgggtcacgtgtccactggacagggggcccttccctgcctggcagccaaggcagagagggagaggagacagagagaaagacagcttatgccattatttctgcatatcagagacttttagtactttcactaattgactactgctatctagaaggcagagccaggtatacaggatggaacatgaaggcggactaggagcttgaccactgaagcacagcatcacagggagatggttaggcctccggataactgcgggcaagcctgactagtgtcaggccctccacaagaggtggaggagcagtcttctctaaactgccccggggaaagggagcctccctttcccggtctgctaagtagtgggtgttgttccttgacacatttcgctaccgctagaccacggtccgcctggcaatgggtgtcttcccagacgctggcatcactactagaccaaggagtcctctggtggccctgtccaggcataacagaaggctcgcactcttgtcttctggtcacttctcactgtgtcccctcagctcctatctctgtatggcctggtttttcctaggtcatgattatagagtgaggattattataatattggaataaagaataattgctacaaactaatgattattgatattcatatataatcatatctaagatctatatctggtataactattcttgttttatattttattattctggaacagctcgtgtccttggtctcttgcctcggcgcctgggtggcttgccacccacagtctaccatgttttatcctagtgctgaaggggtctgagaggtcaactcattccttttagggatgagagaaattaaacatattggtgcacaagaaagatgcttgaggctgggtgccactgtagaagttttctagggaaagcataagtattaataaacaaataataaaagaaacaaggatcaaaacctcacttttatgtaatattaaaaattgcttaatcagtaaagttatatgtaatgcgatatatacatatatattttaagtcaagatataaacatataggaatcaccccctagagtttagcttttcctgttgctgtaaaaaatcagcctctcatacatttaaaaagttgtatgtggcacagcattatttacataatgttttattatcaaatacattgcttgtgacaaacacagatacatgtgtatagtagtatatatttatatcccaagtatttgtgaagggataagtgctcctttctcattaaacagaaagcctcctggtaatataatgctacacatttttgtgaacattcactacctaaataatgtctctcacctggcctactcaaaatgccatatgtttgatcattcaaaaatttattgctatttcagaaaatgttaaatggaattgcgtagtgaaagtaataaaaatgaaccatgagaatttatatacatacttttccacgtctctcatttcaccatgtttatgtagtttagcaatatttttctctcctttgtaaaactaattccaggaaatttgcaaagaagtcacatcctaagtcctaagaaaatgcagaagctgaagtttgagccagatgggcactttccagtagaaagcttatcagtatcagatcattaaaatgagcaaagtttcccaacattatgttctccacaatcggaaccacaatagaaatcccaaaatgggacgaaaatatgactccattcaaaatgcaaaaagtatcagaccccccccccccattttttcataacctaacaagataactctaaaacccttggttcatatttgattcatcagtttcttctagaaaaatctacagttcatcattttttatttaataggaaatttgcagttaattccctctgatagaagcagtatagtgtaagggagagaacatttatttagaagttagaagcccaagttttgaattttctctccactagttactagcaaaatgatcctgacaaaatttccaaatatttctgagcctcagattttttttgtatttaaaatgataaaaatctgtagggacttctactaccagacaagatgttgtaacaaagaccaaccagatttattcctaacctaaaacgattgaaagaaacaaaaatgtatgtacatatatgaaacaagggctttcagacatgtaatatttggcaataaaaaactgtaatacctgagagagagaaagtaaacaaggtgagccctatgactgctccagaatatagcctggagaaagtttctaggtttcaactcagggatgaagggacttttggctaattcccagagttgaagagccagtgggtagtccaggaaggccaaggcagcttgagtttgcagggcagggtacaggagagttatgagccacacacagagaactggagatctgcagagtcccctccagtcttcagctggctaagagtgaatacatgaaagcctgaggccagaaaaaaatctatcttaagcattagaaggaaaatcccaggagctcacacaggcctggaaataatttgtgttcgcaccaacaagaatgggaaaaccttacaattcaaaaagacagcaggttggcaaactactgcccatgggccagcttggcctcttttcatatatggagctttattggaacacaacctcgcttatttatttacatattctctaaggctgttttcaaactacaacagcaaggttgagcatttgcagcagagatatatggcctgcaaagtctaaaagatttacttttttttttttaaagacggggtcctatgatgttgcccagtctggtctggaactcctgggtgcaagcaatcttcctgcctcagcctcctgagaagctaggaagacagacacgtgacaccatgcctgagggtagcctaaaatatttactatcttgctctttacataaaaataaaattgctgagttagagtgctcagaagaatatcgcctccatagtgaagcaacattaactcacacctctggatcttgtcctacactaaagtcttttgaaccaccgtgttggctcatgtattcacctatttaattctcaccccaactcaatgagattgttactcttgcccctgttttatagttgagaaaactgagagacaaagcattaacaggcccactgtcacctagctgattaaatgtggagttgaaattcaaatccagagtctaaatccagagactaaaatctgtaagtttatgttattctgactcttattctaataattgtatttggctttatattgatacatggcatctgttaggagaaatgattcatttgctatgaatattgaaatagtcccattaatgacacttagtgatagttgactcaaagctaagacatggaatcctgttattgacattagttttcaattagttgcctctggaagaaaacactaaaagagaatctccctagtattatcttccaggtttctgataggtcttatgtgcaagaggcattctcattacatctgttttcctcctgggagctagaactccaaccttacactgcagtgtaaattcctattcaaggaattagggctgaatttagttgtcaccacaactcaaaatgagattgttattcttgcttctgttttatagttgagaaaactgagagacaaagacagccagcacctccagagcacttttttgtcttttatttaaggcctggtctgcttaaaaataattattaaaaactgaaataggaaaagaagaaagtggactgggccaggcatggtggctcacacctgtaatccgagtactttgggaggttgaggagagaggatctcttggccaggagtttaagactagcctggacaacatagcaagatttgatttctacagaacattttaaaaataggcagatatggtaggacaacagtagtcccagctactcaggaggctgaggtgggaggatccctgagcccaggttgcagcaagaggatggctgagcccaggttgcagtcaactatagtcctgcccctgtactctaacctggatgagtgaatgagaccttgtctctaaaaaacaaacaaacagacaaaaaataatttaaaaagaagaagaaagcaggccaacttgttttatctctaaagcataaggcagatccaaactaagatgttcttccgaagaacaagcccattctaccacatctggacacagagctgtaagaggagaggataaaatacaagagagaaaaggtgaccaggtggtccttctgaattattttacaatcccattatttcattacctgttgagtgaccctattgtatatgcaaatccattttgttcttaagtagaatttgggcctcactgattctggagaaaggaactggagaaactgaaggatgtcagactatgtggctctttggatgcacaagtctatgactaatacctggaatgaggtatgctatgctccaggaatcatgcttcctttttcaatcaccgcagcacatgagttgggtttccttcctcccattttaaagttttaagagatttaattacatgtgtatattaataaatacacatgttcttacagttctgtaaaagtcagaattgcatttcattaaaatgtaattttaatgtaatgtaaattaggaactgtacagtaaaaaaaactgttatgctttatctggaaatttaactatttttctctttgattttgtcttcttatcccctaggctagaagcaattttatttatctgccagcaagtatggaaaataacatattaataataatggggacaccttgaaaactttaactaaaaacaaccaaaaatatattaatttagggataatagtcatagttgtgcagttttataaccataaacctgttctgatttgtataatgtccattctgattggttggtgatcatgtcatatcagttattaaatatttagactatcctaatgatgactcataaattatgataactaaaatgcatttcaattgcatgatttatgatagattaatataaattaaagttattgacttctacaaaatataatttattcaggaaacgaagtcttgttcctttctgatatcaggcttgaaagattgtatacttaatctaatgataacatcattgcacaaattatgaatcctcccttttgtaattgtcttcacaactttaagcacaatgttttaaggttccccaatacccacaaatcttttctctgagtctagactgaattttcagaaacatcgagaaattattcatgtctccatcagaaaaggacatttgaatcaggaacaaacgagggtctaaacagtaaaattgttgttcatctgtgatttgtaatatgaaattgagtaggacacttaacctctcttgacctcaactttatcatgaataaaatacaggttttgattaggtgacgttatcaattaggttcacagcctaagttttaaacaattgcattttttcctatgtttagaataattagaacatgatatcctgagtcaaacataatattctaaaataaaatttaaatgctcctctatgctattttaaacttgaaaataaaacatcaaaatgtaagtaaaacattccacttttcctcgatccaaaacagaaataaaatttgatataaaaatattatttaaaaattgagccccaaacataaatggcagctgtattgctcagcaagactaaattgttattctcgcatacctcacaacacggtctctgtagcaacaggaattttgaacaaaaaaaatgcataaattccaacattttaataaattaaattaatgactggatcaaagtcttcttacaggactatataagaacctgactcattctgattaaatcagagccgaaaaataactttacaaattgcagcattatgcaggtgcagtcaaaggagtgtcattggttaattccttaatttggggtagtatttttaaaataggtatatttataatttttgtttagcgctctgatacagttacataaaagtataattgtaataatataattggaacgctataggtatagacaatcaaaaggtgcttggaaatattttcctacttaaatacctccttggaaattgtttacaaagcaactatataacgatgcacacagttatataaaaacaattttaatctagcacatgcccaaataatgatgaattctaaattagtgtaatcatatttagtgaagatatatgtatataaacaatgtgctaatgccaaattatttttcaacacatttaagaaattcaaaagatttgtatctatgtggcaagtatgagaaattagttgcgtaactatacacatcttagtatcatctaggcaagaaactactccagtgcatataattagctatgctggtatgtttgcagatataataaaaattacatgtataggctggcataggtcattttgaaacatgaaaagatgacattcttcatacatactttaatcaatagaaataaatttatacaaagaaagaagagataattagaccttttacttttttcctaaggagcagttattacatttaagaggaatgtgttatttagatctaatagcatatactagtcattagattgaaaatcaagagttaaaatttgcagtgcacacatactgcatgacccaaagtcaagtagctcaagaatttgtcatctttttaatagactgtgtatacaaaattgaatagataatcatctttagtctgccaagctgatactttttaataggataatcctttaagggaagctgtagttcaacagatgtgcaaatcaacccagaacaaatagcacactactcttggagatagagcctgcacagttggcacttgtgataacttgtagttatatttatctaaaattgaatttcaaactatattcaaatatgatttactcaaatctgattgaactcagaagtatattttctcacttgttctataagagaagtgtaaataaaaattgtttaaagtcatcttcatgtaacatctcctaccatgcactctatcaccaatagaaaaaataattgaaaggaataaatagcatattgttattatgaaaatcaatactctgtaaatattttgaaataatgataagcatctttgaataatagacatacatttcagaccatgtcttctatccaaaaatgttatcattccctctcttatatatctgttggtctaacagtgagaattatgttaattcggttgacaaatatttaatgtaagcctactatatgccaggcactgttctaaattctaggattcagtgttaaagagatagaaaatactctatttacaaagcaaattgaaacaatagacatgaatttgcaggtaatgactaggagtattgcaaacaaactgttccacatgttatatgctacatgtgtcatctgagtgctgtttgtaaagaatagcatgtatttgaaggtggagaaaaaagatgggcattcctataatattagctatataaccacctaattctcttctaatggactcaattaaattaatggactcagtaattagtgtaagttttgattattactgcttttttgttttatcctttatgcctttcataatatttgatttttttcttgtatttatactactttaggtaccatttttccttatccaaatttggttgtaacagtggatccttctgctacttgtgcttattttccttctacttcttttgctgttcttactcccccttagctcctttctctgtaatcatttttatcatccttttttttctttttcatcaggtacaaataactgaattaatcatacttctcagtatgtgataaacttattaatctccttttatgtgccgttcctactttcattctttcccattctccatggaagtttttaaatgtctttaatatgttctcttagatctgcagatatccttgaagaacgtatatatagagaaaattattctgtgtatgtacgtatgtaagtttctaaaaactatgttttgctatgcattccattcaatttcttgctttttcattttacagcatgttcttacattttacccacattaatatatgcctatcaatttaatcaattctgtctacttgatagtatttcatattattcatcttactattttatttatccattgctgtaatgatggatgcataattttcctataagccccttgctacctaaaggcattctgcactaaacatttttctcaaacagaagtttactgatttcatctagaatgtcttttattaaattgaaatatttagattatattgagtcaattgttcagctcccacttataagtgagaacatgaagtgtttggttttctgttcctgcattagtttgctgaagataatggcttccagctccatccatgtttctgcaaataacatgatcttgttcctttctatggctgcatagtattccatggtggagatgtacaacattttctttatccagtctattattgatgggcaattagattgatttcatgtttttgctattgtgaatagtgctgcaatgcatatatgtatatatgtatctttgtaatagaatgatttatattcctttggatatatacccagtaatgggattgctgaatcaaatggtatttcaggttctggatctctgagaaacttccacatcatcttccacaatggttgaacttatttacattcccaccaacagtgtaaaagcattcttatttctacacaacctcaccagcatctgttgtttcttgacattttaataattgccattctaactggcatgagatggtatgtcattgtggttttgatttgcctttctctaatgatcagtgatgttgagctttttctcacatgtttgttggtggcatgactgtcttttttgggaagtgtctgttggacagtgagagcacatggacacagggaggggaataacacacactggggcctgtagaggggtggggttgatgggtagagagagcattaggaaaaatagctaacccacgctgggcttaatacctaggtgatgggttgataggtacagcaaaccaccatggcacacttttacctgtgtaacaaacctgcacattatgcacatgtactccagaacttaaaataaaaataactttaaaaataaatttaaaaaatttttaaaaaattaaagagtcaaaactattttgtttgtctttgtatttttttggaggagggattgctgaagaatatcaaccctgctgttaggtcacaaaaatattcttctcttctagcatctttctcttttagctttacgttggtagcttttacattttaggtctttaatccgaggtgcaagggagtgttatcagtccatttttcctgcaacaacaaagaaacccaggatcttcctgacttatagaagcatttgtttctcgttcccttatcagaaagcttcaggacagttcaaggctgacttgctttcctgggctcagcctaatgccatgtgtctgatttcagatcccaggaccttttggtgggacatgtcctcatagaatgagcaggtcaaatgaaaaaccaaacttgtgcaatcacatttaaatcttttttgagatgtcacaaattttaagtctgtttaacattccattgaccataagaaggtcatagcaagttataaaccaagtacaaaaccactgagatggggacatatatcctattactacagatatcaaagacaagtttcatggtaataggtggagatttttaaccctattacagggaagaagtaagtactgggaacaataatgactatagagggagattcaactttatttctctttctaataagtcagttttcttaacaccaccaactctactattgaaacttgtctcgttgatttgtgatgccacttttattagagatcaacttcaaaccaatagacacatcattttctgaattttcctttctaatatgctggtaacattgcctgtttctgatctagcacaatactgtttttgttgccgtgatgttctagtattgtctgcttaatatctaaatgaagccacactctttgtacttctttttaaaaagtatccattgagttttctatttcttgagacttttggagttatcccttttaaaatttcaaactgtatttcaatctgttagagaacatgatctgcattaagttcatcttctatgcaaatatagacaatttgttcactgccccttgtttaggcaaaaaatgcatttctgtgcagcaattggttgattcaaaaaatttatagaactttcaatttagcttattaactagttattcaaataatttatacaatttattttttgactgcttgagatctcagtttctgacatgcatatattaaaatccttaaccacaaatggtaactaatttatccatataaatctgtcagttttcactgtatgtattttgaggctatgtttccagatacatatatatgaataatcattatacattcttgatcttttttccctttgtcaaatataacatctctttcatgtgattttgccttaagttctattttatctcacattaaagttggcaaacctttttatgtcatattttccaagtaatcttttccatacctttactttccatacctttttatggcaatttgtttttatttatttttgtttttctccccaatctgatatttatatttttgagatggttaatttactcataatagttgcattgtttcctacatcagtatgcttgcttagaaaaatttttgtattggtcagtattctccagataaacagaaccaatatgtgtgtgtatatataagaatgtatgtgtatgtatatatgtgtgtgtgtgtgtgtgtctgtgtatatgtgtgtgtgtatatatatatacacacacatatatacatatatatatacacacatatatacatatatatatagagagagagagagaaagagagagagaggaaaagatttattttaaggaattagcttatgtgattgcgggggctggcaattgtgaattcacaggttaggcaaacagtctagaggctcagaaaaacttgatattgcagctcgagtccacaggtagtatagaagcagaattccttctttcttgagggccttagtctttctttattaacgctttcaactgattggatgaaatcattggattggatgaggcccactcacattatggagggtaatctgctttacccaaagtctgtgagttcaagtactaatcacgtctttaaaaaaaatacctgtacagcattatctacactagtgtttgaccaaataccgggtaccatatgtacaatggcctatccaaattgacatataaaattaaccctcacaatgctacattgtgattgtcttgaccttgtctttcccttgatgatcttatttctttcaggaaatatttactatgccctattctagacagtaaaaatagagcaatgaaaaaatatatctgctctcatagaacttacattctacttgagaaagaaggttcagtgaatgggaggtggatgataaatagctaccgaaattaatgccaacatatttgccaagtggtgataagtcttatgaaaaattaagacaagttaagagaacaaagagtgatgaagtggaatattactttagaaaggatgttctgagattacttctctatgaagtgatacacatgagcagacacctggatgaattgagggaatcagtcaaatggttatcagcaggaagagcattccagaaaaaaaacagcagtgcaaaagatttaaatctaaattatgctttttgtgagtgagattggataaggaaaactatgagagatggatcaaagtgttagccaagggcagattatggatggtcttgactgtggcaccaacgctggtctttattctaaaaagaagaaataattataagttagctcaattttttaaatgcatgtacatttgatggggtataggtaaattaaaatcttgccaagagaccaacacatgcaacttaaaagagagctaatatatttgatctcaaataaaagaacaaccaatgaatttgtctgctattaattatggatgatcaatccacagcaaatcattcctatttatgtctaaagacatggtgggacttaaatcagagacttaacagtataaaatggtgtagaaatttaaatgctccggacactgctaagagacagcaattaataatatcatgtaatgaaaaattttgtaaactactcttatattcttgtataagggctattagatgttctgctgaggaggagatagttcatgagtttgctactttctagttccacatcaatggataatttctccctctttactgtatggaaatttataatatgtagacattttgatgttgataacatttagaagtgtttaatttttagtattatcagcctgacagacataagttttattaaattagtttgagaatctctttgaagatatttgcatctgcataagtttgcatgaaaaaaaagtttgcattttagggggaaaactattatatcagtgagaattttggagtattttgcttattctttctggaactttgaagtaatgtgaaatagtgtttagaaacctcatctcaacgtagggggcttcttagtaataatacactgtatctgcatacccgtttataggttttaatccaattcattccaccaacatatcttctaatgcttagtcctgttgtcttctcatgatcaaaaatgaccccttttaaaaatgctttgcatcaccatcctttttttttttttttttttttttttttttttttttttgccaaaattgacatccagtttgttttaagacagtttcattaggtcatatgtctagatttgttacctccattcttcctctgcctgggcctaaactattctataatttttctctgtccccactgccccccacccccttgaaatcatagtcaacaattaaactttgctacttataagaaagacttgacctggctttgggacagccaactgagcataaagtggtgaatatgctgttgagagtagtgcttataaccccatcatatgtcagtcaaccagattagcatactgctccactattttcattaatgaaggcagaatttgtgttaagaaagccatatttgctacaattcaaagtcaattagctttctcgtgaaaaaatgagtttctcatttaggtgcttaatgttaaaataaagagggcattgttcatattaattataaaataattcaaaaagacatctctagacaccaatcaggaaaagataatcactgaagattatctgaaaataaattaaatgtctaagcataagtcttgttcaaatataatatctcaaatccatgcaatggaataccatgtgactattaaaatgtcataaatgtgcatataatgaaatataaagatagattttcatagtacatagtgaaaacaaaggcagtggaaaaatgggatataggatgtaacttcacaataatcatctagatagagaggtatatagacaggatgctgtgctgctcattctccattggccccattcctccactcatccattctatgttcttctctgccttcctctattccctgggaggctgacttgcctattgacttgtgtttggaattgacgaatgggaggcacttacaggagagtgaagggcaggaagagagggagattggagcatctactccctccacgcccccgggctcgggtgcacttgcacagtggctgcattactctccagctacagctcccatcaggccgacttactcctgagactggttctcagccaggctcctgttaggccattttctctcctcaagcctagtgtcagtaacaactcttcactgcttctaatttacatatgtatttccttaatttattcctctatctttaccccttggtaaatatttagtcccttcattaataagtctctttaaaacttccctctgagagtgggctctttgtttcctggcggggccctgaccgacacagttgctcataaaaggcctggcatgctaaccactacaatgtgcgtaggcattctctgagaagtgttttgccttttgttctaaattttctaaagtgaatatataacgagttttcaatattaagaaaatcaagtaaaaatgtttctgtacatgaaagagaaaaaatgaaaataaataatgctagtatgaaaccaagaagagctggtatctttttaacttgttttaattggccatattggtcttaaggacctcccacatctaacactaagtcttacccatctcctcccaaatgagttagaaagagaggaggagaagggcagatgaagaagactcagctgaagccaagtgaaagttagcatttatacctaatggaagttaataaagcttaactccttggacttcacatatgtctggaaggaagagattttccactctactgtcagggttaaaacacttacatagcataattctaactccggctctgtccctccttcctctctccctctatgaaagtggtatctatcttggtaactggtgtcattgaatagcctctacttgtgccgctctccttggaaaaacttgtcatctagtcacacaggttcttccatctattactgccagcagacagcaccagcagtggaggcctgagttaccacaatgctgccaataattaggtgggcatggttcattcactgtggggagtgttaggatgcccatgagccaacaaatttgtgttatgtgttcagcttggccttatcacattttagctgcattctgttctccctataaatcctgtgccttttcctgggggtggttccaaactggagaaggaaaggaaaggatactttactgatgttctcaaaacacagtaacatttagatcccttctatatgcccacaggaggcaatatttttttaaatgtgtatttttgttattctaaatgtcttataattactgcagtcatttttgaaaagaatatgaaacacatgtaaaagaaaaatcatgaaatcataaaagagttaattgtatactttttatgaaactataaaatcactatataatatatatttgataatataatgttttcagtctaattatatactttttttttttcattttagttatgtacagggacagtagaacagttaggaaccaaggtctccagagtgacactgactggttttgaatctagattctaccacttattcattctctaaccttgggcaaattccttaatttttcttttctttttctttttttctgttttcttttcttttttctttttctcttttttttttttttgagatagagtcttgctctgtcacccaggctaaagtgcagtggtgccatctgagctcactgcaactccgtctcccgaggtcaaaggattctcccacctcagccttctgaatagctgggattacaggcatgcaccaccacacccagctaatttttgtattttttttgtagagatggaaattcaccatattggccaggctgatctcaaactcctgacctcaagtgatctgcctgcctcagcctcccaaagtactggaattacaggtgtgagccactgcgcctagacagttccttaatttttctatgcttaagttttcgcctctgtaaaatgagaataacaaaatagtgcatgttgttttttgtgagccttaatgaaatattcatataaacatggtgaataaggcataagtctctgcccttattgtttacacagagaagcagaaaattaactacctctttctttctgtctctgtctcacacatgacacgcacgcacacacatgcacacacacacacattcataaatggtataagcaaaataaagccatgttaagtatacacagtgaaagagtggatagtcatattttagataagatgtgcaggaaaggcctctgagaaaaagcaactttcctaactgaggaagcaagtcatgcacaggtcttggcaagaacatttcaggctgaaagttccaggaggcagaccattagttaaaaaaatgttgcagaggtccacgtgattagagtggaatgaataaggaaattaagataacgctgaatcgattacctgagagcaaaggggaacaaaccccccgggtaggttccagactcagtatctgagaacttccaaaggatgtggtactattttacttaatggtgggaaactgtgacaaggtagcctgagcaagtgttgttacttcaaatgcagctatctcaccagcaggattttgtgtatggaatactacaattaaacattgaattaaatattttatgttgtttccaaaactaagtcattatgattgtgtatgatatatcccaatgttttctattaatggtttccagaaacaccatctttcttttgtaggttagaacattatcatatgaaataagatgccaagaaaagaacttgttatatcacgtaactcataatttgataatccttgagtattcataattaaattgaaaaagtcattatttcttggactataatagtatctgagatgtaaattaatgtatttatttgttactaaccaatataatttaattttataccactttaactccccattttgtgttaaaaaagaacacaatcataatttgactcctttattcaaaggaagtaaattgaaattcaaagtgttgcgcttaaaagtgagttggttagtgtttaactttcttttgagcacttctgtccccaaagccggtcagtactttgcattttggtcatttttcttttgctgagataatgagggtggggactctttacaactgcaggcaattgctttgagctccgagcactttgaagagattagccccattgatattctctccaatatttttggagagaaatgctgccttcccttgagtgtaagacgaacggctgttgaatagaaacttcttttgtctagcagagagtatggtaatacatattctcttcttagagacatatatacaacattagaaagttatctaagatgattgggagcctcactacactgacttgttaattttgtttaaactttcagttaaatgtggtctcatttacctggaaagtatccttaaagcgtttgagcctggattgtattgctattaagccagtgaacttggtgatgaacaagttaattatcctggggataaaaagggaaaacggcataatttctgccagcaatacagtgaaaaatatatgagtgaactatttggaggcctgcccactcagtaggacttagctggccagtaacctgatctctctggtttgagttcatcaaagacatttctttgatctaaaaatgttacagaatgctaaaattcagatgaagccatataaataatataaattttataccacttgactccacatgcattatgtttttgtttcagagaggttcagttagcaaaaatatcaattcaaatgacttttctgtcattaaaaaaatgccttttgtgggagagggatacacatacacttaggtgtgtatacatatacacacacacttaggtgtgtatacgtatacacacacacttaggtgtgtatacatatacacacacacttaggtgtgcgtacatatacatacacatataagatataaattaaaataaaattaattaaatatatatttaatttcattgctgcaattctacctagtgtctcacataaatacaagatcatcatctactgattagcttgctcctgcagacaatcggatagatactaaaacctcctgaaggtcatcataacctcattttctgaaagcatcccttgaagttcaatagcttagaaagtttctgttgcatttgtgtcccttgctgggttgtatatacataaaaagggatattactttcattcagagaagataataaaaccttgtgatttaggaaacagggttatcatcaaataagccttttatttatgctattcagactgcctatcttcaggatatcgcaagtactgatcaatttcaggtcaattggatgtgtgaaatagaagtgttgtggtataagctcatgattatgtcctgtagcttgaaacagtgaatttgattacatgacatgttgctgtaccctctttggtcttattgtctgcacacttcaaataatctacctgtgccaactctaacagcccatttcattctctaggaaataaccttgatataactctaaccatttcttcatggtgttagaaattataaactcataccaccttcatccttagaactttttaactctagtcccaatatcattatccaggattctgggcaggctgccatatagcactgtgatggataaatacaaatgggtgtgggatttgctgaagggtgtctaggctcagaaaattgccattgtgcctttacatccaagagcgcctcacaagattacaatattttgtgactccttaaccttggaaactagagtccatgagacttttctaagatcataacaactttcaggaaaggagataattttctgtacctcagaaaattctgaggtacaggtctggccacttttacttcaggccaccaccttagttacactggaccttaattatcatggcaaaaatgtgaagcatcaatttttgactcctttacattgaaatagatagtttatgggtgcttagactgtcaaagctctcctttatcagtgttcttttctctaatttacaaaatatattttgttgttttgttgcactttgctgagttatttatattccccttgtacagatgctagcatatcaataaatagtttatatattttataacatcacagaaaacatttattgagggcctttgactctagtcattatcattacttttcacaaacttgcaagatgatttctaagaaattctcattaaactcttttaaagtttaaattcgaacatattttctcagcaacttttctttgcttttaaagaactttggctccttgcactaacagaataccatcaaatcagttctactcctatgtagtaagacaaattttatctttttccatagaattgaataatttcatgatactagtttaagaataaggcttgaagatgctgatttgcaactgatactggtgcatcaagtatcataaaattccttaagaacaataaataagtaaacatatattttaagtgaaaagttattaatgtttttttctttttaaaatacattttattgtgtatatttgagatttacaacatgatgtatggggtacatatagataaatggttactatagtgaagcagatcaacatattcatcactttacgtaattacttttctgagacaagatcagctaaaatctacttatttaacaaaaatatctaacatagaattgcatctcatgttacacattagatctctgatttatcctgcatactttgttttttttttaaattttattattattatacttaaagttttaggttacatgtgcacaatgtgcaggttagttacatatgtatacatgtgccatgctggtgtgctgcacccattaactcgtcatttagcattaggtatatctcctaatgctatccctccccacttcccctaccccacaacagtccccagagtgtgatgttccccttcctgtgtccatgtgttctcattgttcaattcccacctatgagtgagaacatgcggtgtttggttttttgtccttgtgatagtttactgagaatgatgatttccaatttcatccatgtccctacaaaggacatgaactcatcacgttttatggctgcactgcatagtattccatggtgtatatgtgccacattttcttaatacagtctatcattgacggacatttgggttggttccaagtctttgctgttgtgaatagtgccgcaataaacatacgtgtgcatgtgtccttatagcagcatgatttatagtcctttgggtatatacccagtagtgggatggctgggtcaaatggtatttctagttctagatccctgaggaatcgccacactgacttccacaagggttgaactagtttacagtcccaccaacagtgtaaaagtgttcctatttctccacatcctctccagcacctgttgtttcctgactttttaatgatcaccattctaactggtgtgagatggtatctcattgtggttttgatttgcatttctctgatggccagtgatggtgaacattttttcatgtgttttttggctgcataaatgtcttcttttgagaagtgtctgttcatgtcccttgcccactgttggatggggttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaatgagatcccatttgtcaattttggcttttgttgccgttgcttttggtgttttagacatgaagtccttgcccatgcctatgtcctgaatggtaatgcgtaggttttcttctagggtttttatggttttaggtctaacatttaagtctttaatccatcttgaattaatttttgtataaggtgtgaggaagggatccagtttcagctttctacatatggctagccagttttcccagcaccatttattaaatagggaatcctttccccgttgcttgtttttgtcaggtttgtcaaagatcagataattgtagatatgcggcgttatttctgagggctctgttctgttccattgatctatatctctgttttggtaccagtaccatgctgttttggttactgtagccttgtagtatagtatgaagtcaggaagaagttgaatctctgaatagaccaataacaggctctgaaattgtggcaataatcaatagcttaccaaccaaaaagagtccaggaccagatggattcacagacgaattctaccagagctacaaggaggaactggtaccattccttctgaaactattccaatcaatagaaaaagagggaatcctccctaactcattttatgaggccagcatcatcctgataccaaagccaggcagagacacaaccaaaaaagagaattttagaccaatatccttgatgaacattgatgcaaaaatctgcagtaaaatactggcaagccgaatccagcagcacatcaaaaagcttatccaccatgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaatccttcatgctaaaaactctcaataaatacggtattgatgggacgtatctcaaaataataagagctatctatctatgacaaacccacagccaatatcatactgaatgggcaaaaactggaagcattccctttgaaaactggcacaagacagggatgccctctctcactactcctattcaacatagtgttggaagttctggccagggcaattagacaggagaaggaaataaagggtattcaattaggaaaagaggaagtcaaattgtccctgtttgcagatgacatgattgtatatctagaaaaccccattgtctcagcccaaaatctccttaagctgataagcaacttcaacaaagtctcaggatacaaaatcaatgtacaaaaatcacaagcattcttatacaccagtaacagacaaacagaaagccaaatcatgagtgaactcccattcacaattgcttcaaagagaataaaatacctaggaatccaacttacaagggacgtgaagagaagttattaatgttgaaacagttcagttaatgttgcctgcaggtattagtttaatgttaagtgctgaaagaaattaatgcaaaaattaatggcttaacatcatcaatatttacttctcactcacatcaatccaatgtgagaaggattctgtgccatacatacagtatttcagtagcccaggatggcaaaggctgttccattttcagtatttagcttcaaaggtcactctgggcataaacatctagccagtggacaggaaaagatagggaaagctttcttcatcacttttgcacgaatctaaaataaatattttccactactagggccagaggccctcaataaataaccacttcattcagttagcaagtactagttccataccctgcctagataaaaaggagactgagaactgtattccttggcatagtagccattttcgagccacaactctaccctgcagaagccagtctgaatcttcagtggagagtcaacctgtgtctacctgaacctgtaaattgttactttatcagctataattcttgggttgcagtcaacagaaattgattctgctatctctcctaagaaagaaatagattagaaggatatgatgcagtttgcagaattcgaaagaaggttaaattgaggaaccaggaataaagaaatatatatatatataaagaaatgtgtgtatatatatatataaagaaatgtatatatatatataaagaaatgtatatatataaagaaatgtgtatatatataaagaaatatatatataaagaaatatatatataaagaaatatatatatatgaatcagagaaattctgtgaataaaaggaattggattgatgaatgtggtcttctgagtactgtcaacatgagtacgtctcatctcaagatgagatggctctagccactttctgtccaggtgttattccattcaagatttgaattaaagaaaagaacatctgattagcagagcacttcctcttggctagtggagatcggggtatcttgattgacagtcctctaagattttacccaatgagacatgggaagacacctcaaagccaaaacaaaaaagagcaatgtcaaaagaaggggtgatagaggttaggttgatcaaacaatatatatgcttttaaaaaatcagttatttcagactacttttagtttaatacattaaaaagcaagaaaacagttcctggtcagaacagcaaggagaaaaaactgataaatcattataatcagtataaaattcttcttcctttttgttgtaatttgatggccttgaataaaattttgaatccttcagtagttaagtttctttatgtataaaggtgcagatgagagtactttgtcatatgaggcagtggtgtttggttgtggggaatgggagggaaacagcaatgagaattaatgtgttagccattttatatgttgtgatttacttggaatatcccataataaaaacatttttactgcttataaataaaattatactttgccaaggagctattataatatactaatttgtattccactgataaattcatcttttaatgtatggataccttcagattaaatacaggtttattaaaggcttttgttgatgacaatgtcctcaaatatagcatttaccaccatttcctgacaaataactatgtggtgaaatggatccaaatgaacaatatctaagtagataaatgttaagatactgtaaaggaaagaaacttctttttttaaaaaaaaaacaatattattgctagctagaggtgctatagatagtcatccataaaaataaatgccaggtttgaaaactacaggatatacctgtagaatatcataaaacttacaatgaaaaaaaatcctccaaacagatcttaatatgcccctcttatctgttcactctatcctgtagctgtagttttccaagtaggctactaagcggtctttcaaagatttattttaacaaatggctgctctgtctatgcacaaagaaaatgaaataaccctataattttgtgaatttttaaaggtaagctaacaaaaagattcctttcctgttcctttgattccaaagaatgtatagttgtatattattttcccttgggagctcggtaagacaatcttcccctgagtctttattcaagtatttcatataacaatagaagtacagtgatggtcaatttcttttaaaattttccatgtatgcttactctagagcaaattccactagtgcccttaagagtctctagtggaatttattgaatgtgtgtgtgtgtgtgttttatatatgtatctaaaaatagttctttggcaaaaaaatatgtgctatcaattttttaaaattacactggcttttctagactttattaacgtatctccggagccagaattttatgctaagctttttttaaaaaaatttctatttgtggtatatctatattcagttataattggggaaaaaccctcacttctggagtgctgatgaatatagaattatttaagaattaagattatttcaagaattatgtttggaataaatctcttaaacacaattctcagtatgtgagcttatgatatttatatgaaaactaaaaccatttttcttgccaatggatatgaaattattgtcctattagacacctagaccctatttcctgcagaaaggagcatcattcataccattgcctaagctcaaagtccctgaattttccttaacttctttttcttaacatatggaccattaccaaatgtatctattttgcttgcagaataggttcaaaatctaaccctttagatgaattgtctttaaaaagattgacttaatggtgacagttccattttttaaaattcttaatgggacctatggttctaccagcaattctctagtattccaggaattctcaggattttacatctttgctgtgactttcctgcttctgcctggcaaaccctgattcattctttaatattctattcaaatagtactttttctaatatcactccctcactttttctcccaactctattttttaggcgaaataaattcttttgtcatctttgtaagaattatgacagaaggtaggttttttgtgaaacaaaaatgcttcttatggaagttatatttgctttccgttgtacattgatgtgttacagaatggcttagtacttagcactgtagtttgctgagtatttatagtacctctgctagtatcaaattaacctaacaaacaatgaagttttataataattaataaaaaccataagtttgttcctataagtaaatattttatatgtcttaattatggagaaaagttcaaggtaaattttaagttaaaaaagcagaatatatatatacatatatatatatatacatatatatatatatatatggccagaattgttatatctaacttcacaaagtgtatgtatatatatatatatatatatatatatatatatatatatattcatactttatttgtacatataaactcaagtagatatatttgtgtttatatatattttcaaatacatttacacagaagaaactgagaggaaatataggtacttacttttattaacccaaattagcttatttttaaaatgtcattaaatctaaatatacctaactagggtattttgagaataaaacgttcttatttgactgaattatctttcttcagacaggagatatcagagttttgcaaacactgtgctatatttttataataaaccaatctaggaaattggaatgtaggagtttaatggttgctatattatgtagtttgtgaaataatgaaagtgagggtaatcaatgtgaaaaactgcatatataaaattagaaacagatgctaataaacaggtggttgaacaaaaaatactatggtactggttcagcacgcttgtgctgaggaaacatctggatgtgggtgttttactccaaagctagaacttgctaacaagaaataaaaacaagaaatttcttgagtgaatagagtgaatcaaaaagtgattttcaagatgatctttaagtctatattgcttttgaatgtctatagagtaatgaggctgattcacatgcaggaaaatatgtcgataacaaatatcataaatagagcacacgtgcacatacaactaagtttgttttgtagcacacccagtgttttgaaaaatattaaagtaatatttctaatttctattacccagtattcgaagctgaatttccttacaaaaacattttgatgatttttatcagaaagaaacatattttgaaaatgtatccttctgaaaatcttcctagaagtgtttattatatatagtatgcatgcaaataatatatagtttattatatatagcgtgtaaataaaagcccagttgttaccgtcatttagtagaaagcttatacaattttcttttgacgtatgaacatttcttttgcaaactaagatgacccactctacaatctacaatcactataaaactacaatacctgagtaatgaaaatattgccaaactctaatcacttctctacttttagaaatatttagtaacacaaaatttaagtgtataaaaccaaaacaaaatcatctagcctgtaggaatttgttgcaatagtatttgtttttcaccatttgccaaattagaaaagctggacctgtgatctaaaagatccaattctctggtcaatttttttatagcctgcattgtttccattgagttttatgctatcagttggtataattttttttttctgtttggccataatattgtaagcatacgaaatgggcaatatgtcaggaataattaggcactgtggtgctgaaaccccagcgtatatactgcttcttttatagaagaaaccagttacctgtagtcttgtcagtttaacttagcaaagaccatctgtttgcagccacctcttttctcagaggagcattccctcttccacaaagaattgctccatgacgtcaaaaacacttttctctacaaaatggtctctcctgtcttcatttctttctgttttctaaactgggttgctttttagagaatcagcaaatgtggcactagataacttaagaggtgaaataaaatgaatccgatagacagtgctctcaatagaatagatatgaatgtgcttagataaatgtatggctacaggaggctttcttgtggacaataactatccaaaaatatttacatgtatttgggagtctaggtttatttgcaacagtaagccaactggtatttgtcaattacatttaaatttaaatttaatttcaaatcatactgaacattatgagtggaaaataaatggttttatgtgcttagaatttaacagtttatatgtaatattatgttttggaaaaacatgtaaatggtgttagaatagttcagctattactaagccattctgggttagcagttattcaggaaaagactgtcaattttatataaaacctcttagataaatagtatgggtatatgcgaaattacacagataaataatattctgcatctttcatccctccttcccatttcatgacaaactactgttttactaaatatgacaatgtatattttaaaaccaccagaaattataatacctatatttcctgcaactggggagtaattcagagggaaactgggaacttacccagtggtgtatgcttgagtttatatgttttatacatatgttgagggaagaatgcggcaagcctgacatttctgcatatttcatggtatttagggaatttgtccagagcagagtggaaattttttgttctagccctctttgttcatatgttgccacagtgatctatgagttaacaattaatggctgtgatatttcagtgcaaaaggacagttgatcatcaaaataactcagatatatagtcctgttataatcattagaatagtatttagtatccaagtatttccaaaataaattcaataagctataaatagataataatttccatcttatttaattaccaacaaactttttctttgtagtcagtattcatccttcctttaaatgacaagttagtgccataaaaacaaggtagcattcaggaaagcaatatgcactgcactgatacagaataatcaccaaagtaagaaaaaggatgtatacttggagttaagacacctagacacatatttttataattaagtgcaaattgtaaattatttctttgcagtatgggctctgatagtggttccaggattagatttttcttatacctaaagaatattttcggaataattaacaactcatattgaatctgaaagttctcacattgggctagatgcaacgtgacctttaatctttacctagtttaaactcatgccaaaccaacctgggatcattttgggccttgagtggattttattacaaacttctgttgtctctcagttaaagttgcccccgattggtttagttttcagttttattaaagatagttattatgtaccatccaaaagtaaacaagacttctgggtaattttacttagcatagtttgttttccaaataaatttagaaataattttataaaaatgacataaatattgcttgaaaggcattaaattagcaatagtcagaacatagcttaacagagaacatctgagaagaaagagaagcaataaatgtgagtagatgtaacaaaggaatatctaacatgagaaatgtgatttttatattttcaatttgtgtccctctctgcctagtactaacagacagaaataagaactgaacatgatgtaatgaacagagaaaagggaagtcatacttcttggctaaaggaatggtacaaaatagaggcctctaacttgacatgacagaaagtatgatgggattttcaaggcatcccaaggcatcccaggggagctttagacgtagcttcctatcttataagcagtcctttttctcactgcctgcctctgctggccaccaattctatatatgaacaccatgaagaaacataatgagggcacatgtaaaatctgctccactcacagatattctctatccagggtgcaagctttgctagaggccgtctctctctaaatcctttttcttcttttcttcctccactcttactgcattctttacacatctaagtttaaattccataaagcaaagagtcttgcaattctctgccattgtcacttccataagatgtaaaattgtatattttagcccagcaagtacccagtagtcaagtagatgtgtttaatttttacattaaagtgtaaacaataggaaaaagacgatttgacctagtcaaagttgtggttgaaaggctctctatctaccatgcctcttgcatcacagtgacttaaagtgcttttctagatggcctctaggcatcacaactgcatgctgttaaattcagccaccaccagcacacacatactcttcatacacgtacaaactcattgagaacagaaaatgcaacagtgatttaaagccctatgttatctaaaaagcttcatggtctttaatcttttaaatgttttctacttgatcatggaataaaatgaactgacagtttatctctttcttctctctaccttttgctggagatttaaatatatatacatatatatattgtacatgtatatatataacaaaagaagggaaagtaataaaatcaaagatcctagaaatattccataccagataacaagctctgttgttatcagtttgtttattttattattcttataagtttgagactctgggtaatcagttttcttgattttaaaactaaatataccaatgcctccagtagtacactggatattcttaaataccgtctatgccttttcaaagtatatagtctaaaattgatgtgaataatgaacagatggactaatatgtgcgttacacaactaagattaaaaagtaacagccagtctcacaattgtttcttctgtccaatataaatgctacaagattatagacatgtaccttaggtaaatgtattttataatagggatgaaaaggactgcaaatctttaagtcaaagttagttgctttttgtttctttgtttacctttaatcctttcatggctgttacctgatgagtaagccaggaagctagagatatacaagatatataaatattaatgttataaattgggataaagaccaaaataattgctccagtagattctgtggtttttatacttgctctgtattttagcaattgtaagaaacgatctccttacaaggtgccagaatcatgtcactttattgtacataaatatcagatcacattgctcagattttttccaaacttcagaaaaattttgaaaaaaataatatgacatacactttaaattttattttattactgtggccatcaattatgtgcttcttatatcccaattataaggaactctagaagaggtcatagcgatgaagtgcctggcatatagtaaatacacaaatacttgttagaggaatcaatgactctaaccattggttattttcctaatacagtaaattagtgataatctccagtttcattattcttcctcttttaaaaatattcctttgtatacctaaatgtaccatccctatttgaattactgcccgcttccctcactttgaaaatccatacatctactacatatttttctatttgtggttatctgaactcagacttaacctgaagcagatccatttctgtccccatatcatgcctaaatttacttcttgagattactatgccctattatagacagactttcactcagggacaaagaggagaattactggtgaagagaagctttaaaaataggggctatttttcttagataacaaggattctggagacaagagctactattattggtgtgaaggctcaatgacatcagggtgtacacctctgcaagtctctcggcccttttactctcagctaaaatgtggctactatggctctcagcttgttcaagtcaggaaaaggagtgaagtggctcatttttcttcaataaagaaagcagaagctcttccagaaaaaccataacacacttttgtttatacctaattggcttgaactttgttacatggcaaaccatgatgaaagggaagcagggacaagggtgctggagataggtcagccctatcactcctgtctcattttagctcagcttagaaacctgtcctggctgataatattttcgtcatctgtgtagtccaaacttgcagtgagagcctgcttgtcttttcctcaaatgtgcttttatgaagaccaatgaaaggcttcaccgaagcctccgtgtatagattaccccatctgagattataaagaagcaatcacaagtggttgaggcaaatttaagctccatacaggataagtacatatcttaaaacatttgggggttttgacataaatcttgactcattatctcaataccatttaggtccatgctattctaactgtggtctttactatacatgtatttatagtacacattctaaatgtttattttcaatttatatacttatcatggaccattaacaaagagttggcaaaccagagccagtttgccaaccatatatcatatgaaataaatatgcttatagtctgatatttttgttcttcactgacatgtggtaaacatctctctgcatttcttgtttcttttgtttgtcattttgatgataaaatgcataattcttggtataccatttaaataaaattttattataattattggatattaaaactcaccaaggattatttttgtcatataaatgtaaagttagttgaaagcttttcaagctttattagtaatactaacagccactcatcccaactatagtgtctctataattgccaatttttactagtttacttttaatgtaattgggttagctaggctcactcataaaatattaatgtttacactgatttgttttgctttaaatgacagcaaaaaaaagacatttcttttgtcaccccacaacattctcagggagaactgtggtacgttatgaggctaactattgcttgaatattacctgtgcattacttaagggggaatctgcaaacagtttcagggccaaaaacaaaaggtcataatttgataaaaatcttattgcctgatagctcgcagacatctgtcagcagttttggtttcttttaaagggcagcacatggctgactgatctcatagtaggatttataagtataattattgccatataattcaacaaatcacttttatcactgaaaacttaaagctttccaatttttgctttttagccatttaaattttagggaaatagtcttctgtccaataaattttaatttcaaaataaagtcttcactaaaatttaagtagtttaatgacaaaatagaaatgaaaattttgtctttaaaaattttttttttgcttttgcatttagaatattctatggatataaaaatatagcagctgggccttttaggattacattgattattaatctcaataatcagttgtccttattaacattcataattaacatgcatagcttattgacaaaggtaatttgcttgcatgaaaaaaataggcttatttgcagaggctgaaaaatgctttgaaaagtgctcgttctagaggctcactgctttctaagcacactccactgtaatctaacatagacaattcaagaaaataacctttctgagcttgggtctacctatctcataaggttattatatgcataaaatgagacattttatgtaaatcagtgaacacaattcctaccacataatatgcacctgataatttatggttattgtacagaagcttatttcttagttactgggtagaagcagtttgtgtttggaaatgagaatactaatttggaccaaaataagaaacagaataaaataaattcgcataaatagatatacctgtcttaaatgtccctgaaagaattcctatgtgataaaaaaaaaagtctacagaatgatgatgagataaactgcacatcaagaaaactagagaaattacaaagaggtatttttttaaacattaaacagttacataaatgtattttttaaatttcgaagaatggacaactgtacataaactggagtgatgtgagaaggtgtcacagagcaagcaaaacttgcaggccagacagagacagaattattggagacctgtccaagtgtgcctgcgtagtctgtgacaaaggggcaaaggctaaatggaacagatgtatggtcatgtggagaccagagagcagagggacctgaccactatatccaaagcagccccacaatacacacccaacaagatatgcccttttagcctttcatcctgtttgtttcctttatatcatgtttcacaatccatactcatcttgtttttctattcctttaactgttagcaacctatctcccccactataatgtaagttctgttagggcagagtccttgtttgtcttctacagcactctgttcataaatacccagcactgtaccaggcataaaataatgttcaaaaaataaaagttgaattgataacaaagaatatgagctgaaaattaaatgattctttcaacaagcattactggataaactggggaattatattgtcaagtattaaaagaattccctgacaccttcaccctaccacattgtcttccaccacagaactgtgttgaataagctccccactgccacaggaggagtctcatagctcacagtgaagctggagtataaagcataagattgtcacctctgaagttaaaatgcatggtccaggtatatgaaggaaagatttatgagaatctaattactctgagtttttccttcttctaagcaaataaagactccatgggcaggggcaggagagaggggaagatgaaagtcattggggcttgagaagaatgaggagtgaagatgatgaaattatttagtaaaatgtaggaaaaattgtacgtccagagaattagaagagttacagatgaatctgtagaatctggatgaataaccatggctgagaaccatacagcttccccctccttccactgaaataacatgacataagtgttctggagcatacatgtcactccaaagagaaggaatagatggaggtaatgaatactaacctgactaagtacactacaaattgtcaaaattcctctcctatgggataaaaaagagctcaatacagaaacatgcaatatgcaagtagttgtttttttgtttttttgttttttttttgaaatggagtctcactctgtcacccaggctggagtgcaatggcacgatctcagctcactgcaacctctgccccctgtgttcaagcaattgtcctgcctcagcctcccaagtagctgggactacaggcctgtgccaccatgcgaggctaatttctgtattttgttttagtagagacagggttttgccattttggccaggctggtcttgaaatccttaccttaggtgatccacccaccttggcctcccaaagtgctgggattacaggcatgagccactgcacctggctgcaagtagtttcaacaggagggataaatagaagctttcaaagtttacacttgaggaaccactatggtaggacactatatgggcgtactctcatttgcaaaaatagttatacgttaagtgtaagtacatacaccaatatatatccccacacacacacacacacaaagttccggtatattcctgttttaatccatagtaatctcttgtttcaaatacttctcaattattctttcacttttgtctaggtgcttcataggtgagaggtactatgctatgtgttacctagcaatattttatatgggcaagttgatgtaaatcaattcaaaaagggaaagtaaaatcttggcaaacaaatgttttccttagctatgattattaaatctaagtactcattcatctacccattaattcattcaaaaagaattgtcccttttatcagaaagcaagagtttttctacattttattagcaattaaactaacatcttactggcccatatgaacaatatcatctcccctagcttgaacggaagctgagaaacaggctttttcatccactgtagcagaagacagcaaggaagaaaaagtctgggaattagtcatgtaaacaataatgtctgccataacaaacctcaggttaagacaaatccgcctaaccaaatcttggctatctaagctgtccagtttttcaggttactcttataactccatatcgcttaacctttttttttttctggtcggaggaaaggatgaaatgaggaagaaaaaaaaatgtaaacaaaatgaaataggctccaaactttcggacaaagtagtactttgagctattctctctagccatacctcttctcctttaatatcaaaatgcactactatttaagcgatttttgtattggatggaccttgagaacatatgactttaaatgctgacggtttattgcagcagttccatccagaaccataagaagcccaagttatgagaaactgggatagataggtcagagtgtctgcccctcctctgcccatatcatccctttctttgcatatccacttctccctggatacccacatctcatgtagctcaatctctcacttgaccatgtgagattcatttgccaaggctagaatgaaagtctacaaaggaaattcaaaaggcattgccaataaaggactagttaggccattaagtatatttgaaagtgtaatgaggatctaaagggaaattttgtcttattgcatacagtctctcaaagatgttgtatatacattccacacatttataaagcaagtaccatttgccaagcactgtattacaaagtatgtgtcacctgcacttaatctttgtttatgcacaatcatagtgcagtgtctgaaaattacatttagatctgattcttcaaaccataaattaaaataattgaaattccatagtttagaataaaagggacttattaaactaaatatctggatctatttctctgtatttcaaaaccaaacattctttggtacctaatccacatagagtatttcttcatatccataaaaatgcaaactctttgcaaatgcaattgctcagtcttcagaggtgagatatctttacttctaagtctcttcctatccttatatttacctgctgtggttctgaatactaattttaggaattcttttgatattacactgaactgctatttttcaaatttgaaaatctctgttactgcaattacttccacacttcttaagcaacacatctattttttaactcatcctttactcatagcagtcatcaactaatttgatgataatcacttactgattcaagtgtggggtcctgcatccctttctgtgcttcatttatagcaaggtgtgtcagtctgggtgtgatttaggaggaaacaggtaacattttatacatagcaacatctcttgtccaggaaagacctcaactctttacaaaggaatcgtggtctttttaccttttagttgggtgaatgttcactttcagaactaacaaatccatttgtataagtatgttgtattgcatagatttgtgcagtacttctcaaaatgattgtgagactcctgtaagcttttggcgaatgacagactcacaacatctgatgttaaattaacatcataaagcagaatttgcatctggccaccaggcctttagtcatcaaactagcaaatggaactaatgtggaataataatgagagagctggcttttgagaacagaagactaaaggggaattttaggaaacatgcagttcacattaaaaaaaaaatcaccaaagctattaaacactgaatgcatcttatttttcatgtcagctaggtttatcattgtctctgccaggacattcatgatttttctgctgcaagtaatgttgagaagtttttgataaccattttaaatgccagtcaggtaaacagtcttcttttctctggacaaagctctatgtacctgtgcattttgcatattttaaaataagggcttgaattgggagaatttttcaagactacagtgaaatgtgatcctaggagactatcaccaaagcagcaaatgctaaacatgatttttttttgtattgaatgcataaacacctttttttttgcatttttctccatgatattttgatagaactattgaaaatactctagggaagagaaaagtttttaagaggtgcttttaaaaaatcaacttaattatatagttaagtcctttatttgtaaattaatttatgtaattcaagtagatatatgtgcttctttaccaaaaactgagctcctatagattatattttgcatcatcaaaattatcaacaatcccctttaacaactagtaaatgccacctgaaattttccgaaattgggatcatacagttggaaaaaaattgaatgaataaaaattttaattgactgaaccagtctccagaatgaacatcctactctgaaattatcttccagtttcctgttttgcactatcaaactctgtcttatctctttcctttttctctttttaccttgatgcatgcatatagacatatgtagccacacacctgtcactctctacacagtcatactacaatgttactagaatatgctccacgtctttcgtctgtgtctgcctcaatactggtaatctctcccctcctcctggcattactcttggagtgaaaggtagttgactaagattaaaagggaatatgagtgggacctttacaagcttcctctcctccctacttgccagattgtgttgtttgctttggaatttatataggagaaataatttgaaaatttttgagcagtgcacttcaattttcttcttcatatatgcccccaaattttgaaaacgaatatataccctcatataaaattgatagctcaaattatttttataaatttaaatggctacaaagactattatatacccttgtatacaattgatagctcaaattatttttacaaatttaaatgactacaaaggctattatctccagcctgttgtatatgatatatcatcacagatcaaatctttatgtctgcctcaaattcatatgttgatgtcctacccccaaatgtgatggttttcagatgtgcggccttaggtttagatgccattatgagagtgggggccccatgatggcatcaatgtccttataagaagagaaagagcctggagctccctcttcaccttgagaggacacagaaagaaggtggccttctgcaaaccaggaaggcgccctcaccagatctcatgatagcaccctgttcttggacttccagcctccagaactgtgagaaataaactgttgttgtttatcagctaattggcgtatggtactttgttacagcagcctgagctaagatagaaaagtgctgtaaatacatatttgtcaaaagcttgtagcgacaggtttagattattcaatttatagtaaatggtaaaaagccagtcctcattatcaaaccagtctgccaaatcaggcttactatgggtcagaaaagcctacctcaattatccattcttcttctgaattctagatagaatcacagaatgacagaattgtagaagaggagaatgatcaatcaatagatggacagataggacagagaccacctagcagaagcaggggtccttcactgagatatttttgatttagtgagaaaaaaggcacagccactttcaataatgcttatcagaactctctttggttcccttgctagactcttccagtgggagctatgcattttcaaattgccccttcgttggtataccaactaatgttataccttgagcagtaatttgctcctctttagtaaggtaggaaaagtgtgatgatgaaaacagaagttagaaaggaaaaaccagggccgggcatggtggctcactcctgtaatcccagcactttgggagaccaaggtgggcagattacttgaggtcaggagttccagaccagcttgaccaatgtagggaaagcccatctccactaaaaatacaaaaaattagccaggtgtggtagtgcatgcccctaatcacagctaggtgggaggctgagagaggagaattgattgaacttgggaggcgaaggttgcagtgatccaagatcatgccattgcactctagcctgggcaacagagtgagactctgtctcaaaaaaaaaaaaagaaaaaaaaaaaaaaaggaaaaaccaggatgctgtgaaccaatcataaaaaagagttcacatagaatttgaggttctagaaaacgatttccgtatagttatgtgtccatgtacttataagaatttatttgtgatcccaagggaacacgtacaatttgaagatccttgcttaaaatggttttaatatgcaaattcctgagcttcatttccattagtttcttattcaagcagtctgaatgaatcattggacattactttgggaaaaaaaaaacaggactaggacaaaagaatggattagtaaggaagtaaataaatattgctctaagagaagctaaagagtttaccacaaaggttgaaaactctgtgaagacatgcaagtttatgattcctttctaggtagaagtttatgacaatttgaacaaaaattagagggcttcaagaaacgaagcattctacctttccagtgatggtgttcatattagtgacaagttcagaatatattaaggaaggcacgcaaatgattgatatagaacagtgtagtcattttctccttcactgctcatctttccttaatgtttcttttttcctgatgccttaagaaaatagtgcctgtgtgaaataattaatgaataatgttaaatttgttaccgagtaactttacaatcctggtgaaactctttattttctatttcttagaaaaaaatggagatttgtttcttctatgaaagattggttctgctgtctcaggagcaaaattgaggagaaaataatattttgttcacagagtttatttagctgtgtttagctatgcttttgtaatgtattctttcaaaagctgttttcttttctctttgtcatatactatagtttgttctgtttattgcacttagtagtattgtatattcctttattttttttgtacttttccaaagagacagttctaatattttatggcatttgggatggttttgtttttcttaagtgtctttcatacactgtatcttctggttaacagagacccatgggtaagcaaaatactctgtttacaaaattgtgcccatatatgattattactctcttgctgtaatgcattgtaaaaaataagtaatgagactgcaataagcttctgtcttacatcaagttcccctagaacagcttgagattttgcaatggggatttgtatgcaagagagagcttttaagagaaacccaaatggaatgagagaagcagatcagggaagggacagaagccaagtgacgatgaagttttagctcaagtctgttgtcagcctggtcctacaaggacctctgctacatgatcagtactatagagttgtcccatctagaggcaaagcgaccaagctttgtatccccatatcagtcggctactggctgttaaggccactggtatagagggtgaggcataatttctcagacatttccaagcaaaatggattttatcaaaaggtaattttaaaaaatacatctatgagcaattagcagccaacacttccagtagctggtggatgggtgctgtcctgaccagagaaagggaactgggaggagctctggtcgcctctactagaactgctgcaccaagatactcatccaattaaaattttaagagcttttgctaaaattcattaacatctaattcaaagagatcttttatgtgtgtgtgtgtgtgtgtgtgtgtgtgtatgagagagagagagagagagagagagagagagagagaagggggtagagctcaaagctatgtctgccaagattttaggcagaatggttcagttaaataaaaggtcctggcagtaataaatctgtgtgatttatttgctgtgtaaccttgagtagttacttaacttttctgaatccagttcatcatctctgcaacgtctgtcatgggtagctacctgaggattattgtgaaaaaaatgtgtgtcaagttgctgacaaaagggagatactcactaaatgatggttcctattttatattcagtacaggttattgtcctccatttcatgacctcagacacttgctttgaaaacaaaacaaagaataaaaccaagtgagaaaatgtggctatattggtgcaaatgttctctctactgcaaaaacaaaacaaaacattcaacactaagtatcatctctgtgtaaaaaagtagatcatttagtttaatttctttaatgataaaattctcagacactaccaacgttaaagcaatgcaccattcagatgcacctttgcaccagaaaaaattggttggcattctttagagatgtttaaagagaattactctttatataatactcaactattatagtcagaaaatgctaaacatgacttggacaagcaagacattatttaagactgtaactgactcattctaaagcaatgcattatatgaccagtaggctcaaatagttggcgagttgtcatggggcttttgctttttctagcaatacatgaaatggcaatacatgaaaattcacttcagtcttgattaaagacaaaatatgccctggatctccaaaatctactataggcaaacctgtctacctagatcataatagtcatgaagtatatgcactaatacacatatgtgtactcatagactgtatcctcttcctcatacttgctcagaaacactatacttttactttacaaactattctagtttgtatgtttggtatctgaaattacaggaaaactggaagcaggaaaatgagatagaagaatggtacacacagtaaaacttcacattgtcaaattgacatctaacagcccagagcaataattcttcaaatttgtgtctgttttactagcataagacatatttgtgcacattattgcattagatctttataacacaatagaggtttgctagtcaaataaatattctcattttacatgtgaagaatgactcaggatgtttctgacactttcaaagtcacaacattaataaaatggcaaaaagggatgtcagatgcatatagtagatcacaaaatttgcatccttatcatattgttagattttaagaaaggaggatttttcctgataactcagaaagccctgtttctgaaaccatttggtaaagggaaaaattctgcacatttactactacgactggaatatgtaaccatatcttttagttaatacacatttattacacagcatccatatgtggtagccattgtgttaaactctggggatttggggatgaataagtaaaacatagcgtggccctcataaaacttatagtgtaatgcaataggcagataacagtagatacaaaaataattataatacattttgaattacatgaatgaaagaaaataaccagcagaagctacagggatggcctcttgagaaagtgctatttaatatgaaacctaaaataaaaggaatagtctgccaggaaaacaaataacacttccaggcacaaggaatgatgtgtataaaagccctaagggtggaaaattctttgcaagttctaggaagagttaaaaatgtaggaaaaggcagagtgaccaggggaagatactgagttcaaacacacacagatagatgagagatgatagatagatagatagatagatagatagatatttgagagatatatagacttgacatatttcaagcacagaatgttattattcaattcacattttacaaagattactctaacaactctaggaaaagaattacagggggttagcattagatatgaggagaccactgatggggctgtaatagaagtgcaagattgaactagaaacagtggtggaggtggagataagtgatatattagaacaaactttgcgcataaaactgaaagggcatggtgatggattagagatgggagtgcagaggtgagtaaggcaagtgacttgacccccttggctttctggcttgatccagtgactaaatagtgtctgaggtcattactgagatgaagaagactgggcaaaagtagaaaacagaatcaggagggaaatcagcagttcatgttgacacttggcaagtctgagattcctatgagaatcagatgaaattcaagtaaaaaaaactagctatggaagtctagattctgacggggaatttcaagctggagttatgaatttgaagtcaccaacattatgattttatttaaagtcaaataaacaactgctatcttccaggatcacagagagagtgatattagtaaaaatgcccaggactgagccagaggaacaccagtacctagtggtctttctactatatcacagtacttccttagaaaaatgttcaaaataagtgtaaaaagttaccagaaccagaatcgcccatatttaataataatgaaaatttcaggcccttaaagaaatattttcactatgttttcttaatcccgtgttgaatgtcataaccatcagtattgtatgcctcgggaaggtggagatataggacagaaggaagaaaccatgccagagagacagaaatcaacatgccatttcaatctttcccctttgttctttgaacttctctaccgttttctccctgtggagccttggcatcttaagatcttgattatcagaacttaagcatgaaagaatttcttgtcttgatgccttatctcttctgcatccagaggaacttcatgatgtttagataccacttaacaaatacgaaaacagaaaaactaccctaagatagtagacacagaggccatccgtattgactgtttaatagttcagggattgcacaataaaggcaactatcattgctaaattcagaatggaagaatggtaaatatcacttagtcccagaatattctcctaattccaactgaaatatacactacaaaccaagaaaaatgcagaaggtgctcagaaactgcaaagaaaataattggaaaagaaagagtgaaacacaaagagtgaaaccagtctatatgcctgttacattatttgtggttgaattttaaaacatgcatcatatacaaactaggaaaatttcttaatttaattggatttaacatttaagtatcaaaagcagaatactaatttagctgagctaagaataatgtagggaaaacctgaaggatagtataatgcactgaatcatatagcacaatataatccatcaaaaccacagagcctacaattttctcgctttatattcggttgaaaaatgacttcagagtatgtgcttataagaataactgatgagaaatctaagtggagggaagaccacttgatgccagcttcttatgataatgtataaatctaacagccataattaataatagttaaaggcttaaatggccctgggatattcagttaacagaagacaggtacacctgccaatatgaagctttgaaacttgcttagagaaagttagggcaattaacctgactatattccactcagttttgagtaaaaatgaatgttatgaaaataatgtaggtcagatattgacttgcaatattatttagagttctgatacaatatatcttaaacactgttcagtcattttgaaatctgtgaataaatctcaacatgtaatttatacagacaaaataaataagaaaaatgcttactgagtttatattcccattttggcgttaatatcatttttaaaggctgttagctttatttggaagtcagagaatttctgaattaataaagttcacattaaaataaaacatcattgttttggacatagtctacaatatgaatggactatgtataatggactatgtataatggactatgaatggaccatacatactgtatggactacagtatgaatggactataaataaatctccatagtgaaaattctcaaatctcctacacatttactgaaaaattaaaatatcattgtcattgcaaataaaatattattggcattattaataaaactgttttgggtactctatacaacttcttttagaggtattttctcagatttttgtttcatcagagttctacttctgttatttacattttggtacttttcattgtaatgtatgtgatagctatgtgtggtaacatcagtttacattataatcacctgtgttttttatatgtgtttttccactgaattaacctattaataaagtgaatattaaacacccagatttctaaaatatatatatattatgaaataaatattatcatatcgattctcactctttttatcagtaaaaggtaatatttaggcccaatttgctattgactttttacctggccattgggtgaaaatggcccaaggtttttgtaatcaatgactccacaaataaatcgtgtataatcttatagataacttgttttcactttatttcaaacatggtagcagaattgacctcttttattgtgtaatttttatttttatttcaatagtttttggggtatagctggtatttggttacatggataagttcttcctagtgatgatttctgagattttggtgcaccgtcacctgagcagtgtaccctggaccctatatgtagtcttttatccctcacctctctcctacccttcccccacccactgagtcctcaaagtacattatatcattcttaggcctttgcatactcatagtttagctttcacttacaagtgagattatacaaaatttggtttttccattcctgagttagttacttcacttagaataatggcctccagctccatccaagtttctgcaaaaagatattatttcattctttttttggttgagtagtattcttggtgtaaatataccacatttgttcattaatttgttggttggtagacacttaggttggttccatatctgaaattgtgaactgtgctgctataaacatgtgtgtccacgtatctttttcatataatgacttcttttcctttgggtagataccgagtagtgcaattgctggatcgaatggtagttatacttttagttctttaaggaggctctatactgttttccataatggttaactagtttacattcccaccagcaacactgctggtggcagtgttccatttttaccatattcatgccaacatctattttttttattcttaattatggccattcttgcaggagtaatgtggtgccttattatggttttaatttgcatttccctgataattagggatattgagcattttttcatatgtttgttggccatttgtatatcttcttttgagaactctctattcatgtctttgtccactttttgatgggattacttgtttttgtcttgctgatttgttgagttccttgtagattctggatagtggccctttgtcagatgtgtagtttgtgaatattttcttccactctctcagctgcctgtttattctgatgattgtttcttttgctgtgcggaggctttttcatttaattaggttccatttatttatttttgtttttgttgcatttgcttttgtggtctgaagtcatgaattatttgcctaagccaatgtctagaagagtttttccgatgttaacttctagaagttttatggtttcaggttttagatttaagtctttgatccttcttgagttgatttttgtataaggtgagagatgaggatccagtttcattcttccacatgtgtttgtcagttttcccagcaccatttattgaacagggtgtcctttccccaatttgtgtttttgtttgctttgtcgaagatcagttggctataagtatttggcttatttctgggttctctattctgttccctgggtctacatgcctatttttataccagtatcatgctatttgataattattgccttgtagtataatttgaagtcgggtaatgtgatgcctctagatttgttctttttgcttagtattgttttggctatgtgggctacttttggctccatatgaattttaggattgtttattctagttctgtgaagaatgatgatggtgttttaatgagaattacattgaatctgtagattgctttaggcagtatggtcattttcacaatattgtatcttcccatccatgaacatggaatgtgtttctatttgtttgtatcatctatgatttctttgagtagcgttttgtaattttccttgtacagatctttcacctccttggttaagtatattccaaagtatttgaattgttttgcagctgttgtaaaagggattaagttcttgatttgggtcgcagcttggtcatttttggtgtacagcagtgctactgatttgtgtacactgattttgtatcctgagactttacagaattcgctgatcagatctaggaactttttggatgagtttttagggtttgctaggtaaacgatcatatcattagcaaacagcaacagtttgtcttcctctcttccaatttggatgccctttatttctctcttctcttgtctgattgcctagccaggacctccagtactatgttaaatagaagtggtgtcttgttccagttcttgggggaaatgtttttaacttttccccattcagtgtgatgttggctatgggtttgtcatagatggcttttattactcgaaggtaagtctgttctatgccaatgtcgttgagggttttgatcataaagggatgctagattcaatcaactacttttttacatctattgaaatgatcatatgatttttgtttttaattctgttcatgtgatgtatcacatttattgatttgcatatgttaaaccacccctgcatccctgatatgagacccacttgatcataatggattatctttttgatatgctgttggatttggttagctagtattttgttgaggacttttgcatctatgttcatcagggatattggtctgtagtttccttttttcataacgttacaaagagggggaggtgagaggattgcttgagcccaggaggcagaggttgcagtgtgctgagattgcaccacttcactcctgcctgggagatagagcaagatccccatctcaaacaaacaaacaagatctcataaaatataagtttataaaaattgtaatctgataaaaattcaaagtttataaattcgaggtttttgagaaaacaattaattttaatgtttgtgaaacaaatatagaacatggatacacagacaatattacttaacaccaaaggcctgtctcctttttccccagcccattagcttttgattcaagaaaataaatcaagtttaacatatttgataaataataattaccacacatgggaagacattgtctgagacacagagtaattgtaaagagagttgcttcttccggccaattaacaggtgatccactggatcagctcagcttttgtgtttgcccagatactaggaaaaacttctggaaaagtggtgtcaatatcaaagggacacagactggtattgttttgtggatcaattagcaaaaataactgtaaatgtctctttttctaaagacggagccaaatttgtctacagggccacaattaagtagcataaattcttacttcagagttggtgcttcaccatcaaggtatcaataaaatccaaaatagagattcctgactaaacactttcgattagtttcttaaaatctagctgctaagtgaaaatatttaaataataaacattttaatttacttgtaataggggaaattaagatatatcccatttcagctagctagttttcctgcccttgaatacatgagagatacctgcaaactctaagctttcatatgaatgaattcaggcctcattaatgcacagtacatgacaagatagacctacatgtggtttgcatttgtatttatgaagatagccattggaaagaataagtagccatataaggaggatgttaaaagttcctacaaagaacaaacatttcatatatttaaatgcatcaattttcatacatttaactggtgtgctactgaggtcatatgctagttaggtcacttcagcatgtcctctacaatgcctgatatgggatagactacattttattggcataacaccaaccaaaattctggaatagattatatgatattctctggaaataatcttttggatcaaattaattaatgagtatgctattgcctgagctgcaatgtcaaaaatcacatttctttcttttcttttcttttcttttcctttccttttatttatttatttttattttttagacagggtcttgctctgttgctcaggccaaagtgcagtggcacaatcacaactcactgcagcctcaacttcccaggctcaagtgatcctcccacctcagcctccagagtagctgggactacaggcatacaccaccatgcctggctaatatttgtaattttgtgtagaaatggggttttgccacattgcccaggctggtcacaaacttctgggcttgagtaatctccctgctgggcctgccaaagtgctgggattacaggtttaagctaccatgctcagccaaaaatcacatttcttataacacgtttatttactttggatgtgggagacgttacaccaacaaagtcagtcatttagaaagaaagagtttaacttgaaaatttttttacaacctaaatacattaaattgatggctgccttatgatatgtctgtatttaaattgatgacaaaagtatttacagaaagaaaagagggataaggaaagatatttgagcaacatgggagggttgctgatggactttgaaggacataaatgactaatatttaatctcagtctgtctgtgttcctagaatatgaaaaccttcagtaaggtaaggtatattaatactaggaaaggccttggatgagtatttaatgaaaattatagagaagggataaattctgactatggtcaccatcggggcagaggtaaattatcctcaagaaagaaagattgaagccccaaaatccatagaggtagggagtaggagtcagaagtgatcacgaagccacatgcactggcaggagtttgaagcagttttaagaaggaagttgcacttcccataaaatatgaaagttgggtttgagctaatctgatctacatctttaagggccaagagacagagaattgaatctaagatacacaaataaatggccaaagcatcagtctccaaacaaacgtattcaaatagaaaaacaaaggaaataaatactctattttgaattttctattagtgccaccagagaaagcatcacagatgttttccggctatctcctaagctgttaaagaatatgattctgtgaaacagacctgagagaattgccttctcttttggtacaaaaaaaatctaaagtttcattttctgaaatctctcacgaggtgaagtcagtgtagaataccaaaacaggttttaaattctggaaacctaaattattctcttttatgttgtcagcaaaggtgctttattcacactaaatgaaaaatacagtcttcatttttctatatctgtgagagatttataattgaaaataaagataattatatcatgataaatataattggatgatgtccaatttaaacataaacttccatattactttcaataatgtgttttattttattttctggttctggtatatttctaagttctttaaagcatttaagttgaaggggggaaatggcagataggaggcaggactaactttcagctcccactccagtggatagagcagcatgtggagactcaaatcgtgaattttggctccaagaactaccacaggaacataccagaaagccgagagaatccacagaccctttgaaggaagcagagctgctgcaggccctgggagacagccaaaaaactgtgactgtccaaagtatgaaagggggatcatcggcctgaacacacatcctcacatcctcactggggaacctcaagttccagatcaggggataaggatttgaccttacctggagctgagacaaatttagagagctgagtaaaatatgggaatagaagaagcagtgggaagagccctgtggacactcgcggtccccagggaagccatttctgactttgtctcccaggggtccttggggagggctaccagaggaactggaaaaagaccacaggaagaaggaaatttccagctgaacttcgtaacaatttcaaccaaagtttcctggacggaacctggagaagggggcgaatcaggggtgcagacaagcacagaagctgtggcaggtggggaagctcaaaacctgaaagccctgcttactttcacagccgggaggctggttgttggagcaagttctcagctctgcctacccactgcctggaaacaaactcagtaccgttgtgggggcacagtgggagtgagaccagccttttgggctgcataggagctgatgaggcctgtaactgccagctttcccccacttccctggtgacttgcatgatgcatcagaggcagccataatccctctgggaacatgactgctttggcctgaaaaccacacccccacccccacagcagctgcagaaagccctgcccaaggagagcctgagctcagacatgcctaaccctgccctcacctgatggtctttctgtacctgccctggtagccaaagtcaaaggacataatcttttgggagctctatggccctgcccaccacctgatcctccctatactactgcagctgatgctgtcttgaaagcaccaccttctggctgaaagccaaccaacacaaaactagcacaataaacacaactacaaccaaggaccctcagagtccacttcattcccctgccacctctactagagcaggtgctggtatccatggctgggagacctgaagacagttcacatcacaggactctgtgcagacactaccctgtatgagcccagagactggtagttccactggatggctagatccagaagataaataacaatcactgcagtttggctctcagaaagccccatccctaggaaagggagaaagcaccacatcaagggagcaccctcttggacaaaagaatctgaacagtagccttcagatccagatcttccctctgacataatctacccaaatgagaatgaaccagaaaaacaattctggtaatatgacaaaacaaggttctttaatgcccccctccccaaaagatcacaccagctcaccagtaatggatcgaaaccaagaagaaatctctgaattaccagaaaaagatttcagaaaatcgattattaagctaatccaaaaggcactagaggaaggtgaagtccaaattaatgaaatcaaaaaataaaaaataaatcagctgggcacagtggctcatgcctgcaatcccagcactttgggaggctgaggcaggtggatcacttgagaccaggagtttgagaccagcatggccaacatggtgaaaccccgtctctactaaaaatacaaaaattagctgagcatgttggcaggcatctataatcccagctactcaagaggctgggagaattgcttgaacctgggaggtggaggttgcagtgagccaagatcacgccactgcactccagcctgggcaacagagcgagactctgccaaaaaaaaagaaagaagaagaagctatatcaaaaaaatgatacaacatatgaagggaaaaatcttcagtgaaatagcataaataaaaaacaatcacaactcctggaaatgagggacacacttagagaaatgcaaaacatttaagttgataatgtattttacttttgatgccttgttgtttttattactgtaggagttaaaaatcataagatcctgaaaaacataataatttcatatgttcaattttatatttgtgacttcatatattgaataatttttactcaaagaaatataactttaaactacacagtcagtattatacaaaagcattggtcacacatcagcttgagtatataaaaaattttgaagcacatctcacctaaagatatttatgctttagttgaggatataaaacccataaataaaaataaacaaaaataatacatcaaaatatgctaaattaggctatatatgtcatcaatttgagggtatattgaaagatttcttattgatccataatatacctatttatggaatacatgtgatattttgatacatgcatataatgtgtagtaatcaaatcagagtaattgcagtatccattacctcaaatgcttatttttgtgtgtgttgggaacattctacatctcctcttttagctattttgaaatgtacaacaaattattgataactggccgggcgcagtggctgacacctgtagtcccacactttgagaggccgaggtgggcagattacgaggtcaggagatccagaacaccctgaccaacatggtgaaaccccgtctctactaaaaatacaaaaaaaaatagctaggtgtggtggcatacgcctgtagtcccacataatcaggaggctgaggcaggagaatcgcttgaacccaggaggcggagtttgcagtgagccgagattgcaccactacagagtgacactctgtctcaaaaaatatatatatattgatatctattgaacttacaactaatttctcccctctagctgtatttttgtacccattaaccaacttctccttatctctttctcccactctttctcccagctttctggtaaccatcattctcccctctaccttcatgagattaacgtttttagctgccacatatgagtgagaacatgtaatatttgtctttctgtgtgtagtttatttcacttaagataatgtcctccaggctcatccatgttgctgcaaatgacaggatgtccttcttttttatgggtgaataatattccattgtgtatacatgccacattatctgttcatctgttgatggacacttaagctgattccatatcttagctatagtgaataatgctgcagtaaacatgggagtacagtcgtctcttcaatatacatatttcccttattttggacatatacccagcagtgagattgcaggatcacatggtagttctatttttagttttttgtggaacctccatactgtcttccataatggctgtactaagttacattcctaccaaaggtgtatgagagttcctatttctctgcattctcatcagcatttgttattttttgcttttttataatatccatcctattataatatcacccaactgggatgagataatatctcattgtagttttgatttgcattttttgatggttagtgatgttgaacattttttcatatacaatattgagagattgatgtaaaaaattaatcttagaaaatgtataaagatctaagtcagaaaaaccattgccagaggtttgatctcaacctcattaaagttgatcctaatataatagaaaatcagactattaaagaggtagtttctttagaattgccagaacatttaatccttcactgagagcattctgcttcttggacctattgtgtagtgtgatgcacctccaggctaaaatattaccttcaaatcagaattttataaggggtaccattcttctattcctgcttgccctgggtgccagaatgctgattctcaacatcaggtagggtccacccagttcaggtgctttttcttcaacaattcttaaccagattagtttatgtggaacttaccaaagcagcaaaagattcatgactgtttatccccttcctttcctgttcctctcctcatcatattacatcttccaccaataaaattgataatttacttgattatgtgctcagtaaagatataccacaatttctaattccaaagtttcagtttttgctcattaagcagtggatcctgtttctatgctagcagtgctgatctatcttctcaaatatcaggccccaaaaggtggccttattttcattgatttctcatgcttatttcttattattatttctcatgcttagcttttctttattttgatggttaatattacgtgtcagcttgattgcatggaaggatgcctagatagctggtaaagtattgtttctgggtgtgtctgtgagggtgtttccaaaggagattaacatttgagtcaggggattgggagaagaagatccaccctcaagtgtgtgggtaccatccaatcagttgccagcgagactagaacaaagcagagaagaaggtatgacaagctggcttgccaagtcttctggcttccatctttctcctgtcctggatgcttcctgcccttggacatcagactctaggttcttcaacctttagactcttggacttacactagtggtttgccagaggctctcaggccttcggccacacacggaagtctgcactgtcagcttccctacttttgaggtttttggactcagactgagccactactggcttcctacctcctcagtttgcagactgcttattgtgggactttgccttctgatcatgtgcaccaattctccttaataactctctttcatatatacatatactctattcattctgtccttctggagaaccctgaaaaatacagatttcggtaccaaaatctgtattatgttgtcttttatgataacataaaagagaataatttaggtttccagaattaaaaacctgtgttgctattctacactgacttcacctctagagaaatctcaaatttctctagagagaaatggaattttaaggatggatttctttagttggttttggagtttctggagttctctgtttaaactgattagacgccaaaatggtaaggactctacttctagtagtatggagaatactgatagtccttggcatgaactgtgtagacatgctcaaagtaaaggctttgagtgctgaatctttttcaaactatttcagttgaagactttattttgtgtaatgagcccagaaaacatatcagtcatagtataatagtataatagttaaaagcattggctctagagctagaatgaattaatccaaatttcaactctcccactgtgtaactggattaacccatttatgcctgaggttgcaattttttttttagtttttgcaatcagaccttggtgatgacattgagcagtaggatataaataactcccacatgcttagggttccaataatggaacactagggataaatgggctaatagctatataacatagacagggcacttaatcttcctgtgcctcagttacttcttctataaaatggggattataatagtacctacctcataggtttgtggtggggaagaaataaataattacatcattgcatggcacatagtaaactttcagtagttaatgcaactgtttttgtttttatggttacgggatgaagttttctatttcttgaacccaattgctctgttttttgttattattattagtcttttatcattattttttctggctgctgcaatacctacctgggtctttatttctcccaatgctatcataaatgttttagatcccattagctaaaaggatcctttcctacctagagtccagactcaaaacagaccacttcatgcctctccatgcctaaataagggtcccttcacccactatggtagtgtagttattatatctcttcatgcctgatgtcctgggaatataactaaaactctagataggaagaaggatcagaaactccccagcctaattgtagagaaacccattgcagcctatctgagaaatgggaattttgcttgtgtctcacacccctagcatcactgtctcctgagccataaaataacagtaaacaaagttctcatttatgtgaaactttaacagcatgcatcaatcgagagatgttcaaataccctgggaaaactattcaaacaaaagcatatccactcacacaaaaagccacaaagaaatatcctctgctcttctttcttgctcttgctcttgctcttcaacatcttgaaagagttttatggaccatgggaagtaatacgtctttgcagctgacctagttgtcttaccacaatagtagaggtttctagcctttggttccaggtattgttaccaatttgactagtgctcccaattcatcagttactggtactgaggctcatagcaatgatgtcttggctttgcccagaaacatgaacacttccaccttatcttgagccaaattaagcctatttaacctgcaaccttccatagtcaataaggttacataattgattaatttgtcaccaaggccccatactcaagtatatttatttatttttggaaatggagataacctcagggaagttcctaaggccatctacagtgtttgtcatatgaccttttaccagccctactcttatacacatttttctcaccaagaaaaatggagaatttaaggtttataacaactcccagatattgaaccaaattaccattgaaatcaatatgccctcctacatttttcttaatctgcttgatcaacttgagtcagctgtgatttgtatcagctgaaactccaggacaggattagagggtaaggaagaagttggggggaagggtcttatctccctatcaatatcagaaatattttttaagtattcatgaaagactgtgttttcagatccttatgataattttgagtacaattgaccctcgaacatgtttgaactatgaggtccacttatacatggattttttcaataagtttactgaaaattttcttggagatttgtgacaatctgaaaaaaacttgcagatgaaccatgtagcctagaaataagaaaaaataaaaggtatgtcatgagtaaattcagtataaaatgtatttagatattagtctctttatgtgttaattgactatgatattgataacagtaagatattagtagtcaagtttctgtggagtcaaaatttatgtgtggattttctatttcctgggggttttgtgctcttaccccatgcatatttccaaagatcaattgtgtttggtaataggtttgaataaatgttaacatatttatgtaactctgaaaaatacacttttaagcattacaaatgattggaaaaaagaagaattatttaataaataatctttctttggtagatgggaaccagtaaatatcaaaggccttagaaacatgtataactcaacacaggaattctattcctagaaatctttttaatgaggtaaccaaaagctccacaatttggaattaagcaaaaaaatacacacacacatgcgcgcgcgcacacacacacacacacatatttgtgtgtgtacttatatatggatcttatgatagttatataacaaaaataatatgtaactgtttaaaatcatatttatctagaatatctgacaacaaaagaaagatgccataatatatttaagtgataaaccaaagcaatgaacgttatgcaccatgtcatatgagtcttaaagatgataatgactgcatggatgataatattgctactcacttgttttattttttactcttgagcacgtaacattttccccacagttacaatgcaataaatttaattcagaaataattatttttagtaaagaggcaaaaaaaaattccctacatttgaatgtattagtctagttcatgttggctgcatattagaatcaccaggggagcatgaaaaacaaaatatctgagacctactctaacttgctgaatcaaaatgtgtttcatttttagtgtttgttgttgttcatatttttaacatggttctcaaatgattttgaagtggtcaggcccacaaaagtccacactgtcatatgggtacaactggccttgaggataatattgctaactcctcaggatcttttcagaatgaagtgaaataatgtgagtgagtgatcctacagtcatgggggaataatccatctatgggcctatttcccaggacactgatatctgagaggtcttacatcttttggaaaagacctcttgtaagtagtttggtagaagtgctatgtctcttcagcacttcttcactgccttcttgtggtagcaaatcccagctccctgactagagaggggacctgcaaccaagactgagaaagccacaggctcctatctccctagtggtccaaggagtggtccaggcttggatcaattgatcattactaagaatttttcttatcatggccagcaaattgtcaagtaagcttgctccatcccagttttccctgaccagaaaatggcactattattcccccaatatgatcagagtaaaatcatctttccttataccctacattccacccatcagcaagtcctgctggttttcctttgccacaacccccaaaacttcccacttctcctggcctccaatttaccactctagtttcgggctactgtgacacttggtgcctatttggtcttccacttcattcttatcttgctaaagccgttgtccagagagcaaaatatacttgtaaaatataaaccaaattatgtatgtaatttcttagcttaaaattctccagtgaattcacattacatttattatagaacaatatttactctctgtggcctgacaagacatacttggtttacccctctctaaattcctccatttctccctcactctcttgtttctgactgtcttgctgttcctcagacatggcaagctttccctgattttgtcttttatctaccagaactgctcatcacccagacctacaagtgatcccttcacttatttctttcaagttttactcaagtatcaccgcctcagaggtaacttccttgacctccctatgatattaattcctccttctcacctccccgaccacccactccctgcatccatcaatctctttgctttcttcctttttggttcacagaacttggcactacctgatacacgggttacatgtccattgtttgactcttgtgaagtgaaggcttcacaagggcttccaccgtgattgtgccctgtatctgtacctagttgaggaccactatttatatgctaagttagacccccattgattggataaagtcaggctccagaagggcagactaaagccaccaagcaaggaacaagaactggaagagcttttgtttccagaatcaccccagctagctctactctttctatttttcatcccttcgatagatgaaccaaaaaagtctttcttttctcttcagttagtttgaatacaatttctgtcacttgagattgaaagatccctaactaatagccagttgaagattcagtttcaggacctgaggaattttagagggagaactgtgaaatgccacatctctgtgcacagcacactagaacatgtaagtccacacagcacagactcctcacctgcccgttaacctctgaaggcacggtgggccaccattattgtcaatataatcaaagaactttttcctcccctattgagtactttgttctttgtgtgttgtgtattcccgtcatctgctgcctgaacaactcagactcagctgcttcttatccttcttgtcctttcccttacccttccagatttgcaaatcattccagagttgtgaagggaattctaatcttttaaaattgattttcccagtttctcacacacacaggggaagcaaataatgcatgcaccatattatgtattaatacctttattcctaatccaatcttaaagcagactgattatccacttatccccacccctgaatttttttattcaaatgttcatacaaagctgtcacttattcctgaatgcctgaattttaagcaaagctgatgacttcacagaactccatacacattgagcacactgaaaccacctgtgcaacaacgcaaggcagtgtgaacaggcagggagctgtgtcaaggccagggtcagagaccagctgctagaattcttccctgaacccaagggagcaagcataggttttgtggcaatcttctcaactatagcattattgttgacattttgagtttaatataatgtacaggagctgttctgtgcattgtgtgatgtttagcagcattcctggcctctaccagctacccagtgtggcaaccaaatattcctccagattttggaaactgtcccctggaatgtatgtgctcagagaaggattgagcccaattaagaatcacatgtattcaaaaaaagaacttgtgtgataactcaaaaaatcaattctatctactgggtatactactatctcctcaaaatagtcagtaagaggtcctgggtaggtgaaggtgctacctctgctttacagttggaccataaaggtcatggcctttatgaaccaataagtatccattagaagtaaaattgtagatgagtgtgatctgtttataaatttgaaattttaagggatcttattttcttcatggccccttcatttaaggtgaaactctatttatagtgccttttgtgatagaactcgggctctcttctcaaacctacattcccactattccatcgcatgtgtcctatacccagccatatcaatatttttttattctatggaaacaatttgctttcttatatctccatgtcattcatacatactgttccctctgcctaaaatatccttcccaaccttcctttttactttttttttttttgagacagagtcacccacgctggaatgcagtggcacaatctggctcactgcaacctccacctcccaggttcaagtgatccttttgcctcagcctcccaagtagctgggattacaggcatgtaccaccatgcccggctaatttttgtatttttaacagagacaggatttcaccatgttggccaggctggtctcaaactcctgacttcaggtgatctgcctcccttggcctcccaatatgcccagtcttccatattttctttgatatgttacttcttatgatactgaaaacttcccttaattcctgttccttcctggcattctctattccaggcctgtaggtttgtctcctctctgattcacctattccaatgcctattcttataaatatcagttgagtttcttacccatctccaaatgatgtacttgagagccacatcattttatttaggcagatctaaattttgtgggtacagaagtttatgcaatctgggatgccctctttataaaaaaagaatataatattattaatataaaattaggtatatttatttagaactgggaaagaaatcacaacaaatgcctggaaatttaaagactcaaactcccttgtcaatttaccagaaatgcttacatagaaatatttcctaataggaacctggctttttctaccatctagaatgctctgcagctgtcagtatctcacagcaacctgtgcagttgagggtcaccagagcctaaggttcattacatttatggcaaatctgcctttaaaaaacgtatctctgcatctccaaggcccagtacaatggttatatggtagaaggtacttcataaatgttagtgatgacaatattaaattttatttaaaggttaagaaattccatcactcttttgttccagaaaaagacattgccagaaaccacctttctcaatatgacttagacaagactcatagatgacccccttgttcacataaggcaaggccagacacagaccctccaaattcccattctttgcctcagaaatgactaatggaactgcttgtcccaactgatcagctggaacaaaatgactgttaaccaaccttcctcaagatccctgacctctggctcacctccaggtgagccagcattcagctcctcccaagaatagaatagactggcctcacggaagatattctccaacctaccagcctatcaggccacctttgattccatttccccacactgcttctttcttgctttgtttactcctcccttcagaagcttgtagaccttatggtcacctccttctccccagtgcaacattatctttccccagccttctaggaagtctcttgccacagactttcaaataaagtctctccttactaagtctgaacttgctttttatgtgacagtgaaattactgaagaaaataagtgatgaatgactgagtgtgaactcttgtcaagcaacaagtgttctttgtaactctttcccgtactgttgcaatgataatgctattgctttcctactgagcctatgtggtctctcttttgacctctgttccttctgccagttgcaatacactcctctgtcaaccattactataagcttaatctgtcaatattgtcaaacagttctgacctctaccttgattttggcttaaatcccacctttgttataattcagtctagatcctaatccattcagactttttcctgccttagttccaagaaaacatgactctgtttctaaatcaaaatagagtatgtgagttagctttgaaaaggcctgatagatacccattgcaaaaagttagtgaaaggccattctggttgcaaacaattgcatgtaaagtcttggaggcaggaatttgaaattcatgcctcaggacaataaaattagccaagttttattttaaattggtagaataatgacagaaggttggagaaagcattttatgaatggatattgattgggattgaaaattatgagcattggttttttatgtgtgaaatttcagatattggcaaaatacataaatagtatcttataatgaatgaaaaagtactgaaactagaatttgggagacatttggattattcaaaatctttgaaaaatgctgtgatgatgatgatgatgatgatgatgacgatgatgagatggagtcttgctctgtcgccaggctggaatgcagtggcacgatctcagctcactgcaacctccgcctgccaggatccagcgattcccctgcctcagcctaccaagtagctgggattacaggcacatgccaccacgcccagctaattttttgtattttagtagagatggggttccaccgtgttggccaaaatagtctccatctcctgacctcttgatctgcccgcctcggcctcccaaagtgctgggattacaggcgtgagccactgcgcccggccagtgctgtgattcttaaaatgaaatcttggagcacagtacatttttgcagtacaaatatattttccaaattttgggtaaagactaatattttctcacctttataaaatacattaattgaattctctgttgatttcacaacttcatgttaattatagaatgcagattggcatatttaaaattttcaatgttctgaacatctaactacataaaggacagttttaaacttattctttcattggaggcaggtattatgttgaaggaaactgggcagataatgaaaattctgtattggcaccctgcataggcacaagatattaatatataaaactatgattaagataacattaaattataaagtaatttttacaatctttttttatagattaacaaatacaaacttcatcagacattaaaatccattatttcagataaggaacaatgatttataagagccaagtggtggatttaacacaaactcacattttaataaaagtgttacaaaattttagttattaaaaattcaaaaaggttaacattttagatataaaaagagcaaggcacaaatcgatttaatgggagataaagggtaaagcatgcaatgcttagactttaaaaatccaattattccaattgctctgcatacattaggcagtcatattttagtgctatcccatgccttacttgtcttgctgccttttgtcaaagctcctgtttgcattttaattgacttggggaaaagcaagggagaaaagaaagggaagttgtaaaattaaagaaagggctgtgcatgtttgaaagcacctatgtgaccccctctgactatgttatgccgatgctttaaatatcattctgctccaaaagtaagatccctatcagtctggctagttttaaattgtcacttccaaatttaaatacattattttatgaaagtttatcccaccactcttaagagtacttaataaacacaaaaatcatagtagagatacttggaaacagccactaggctatacacactttccacatgctaaaagaataggccacaattttgtttatgttatgtttcacaactatttaatatctgcaaactttcatgttctcatctgaaaatgaggatggtgagagcagctttataagaaggctagtagaatgaaggaaacggtaatgcctgggcatgcctgatgaagtgcaatgtagcttccctgggagtggctcatggtgttttgttagacattctgaagtgcttttgtagctgcttctggggcagtgggtctcaaacttctgtctccaaccctttttatactcttaaaaatgttactgaggactccaaagacctttgcttatttggattatatcttttgacactgactatattttaggttaatgcatattttttttcaatatgtataataaactcactacatcccagcataaacaaatgttttatggaaatctacattttccaaaacaacaaataaagagagaatgatagcattgttttacatttttcaaaatgctttaatgtgtcgcatgaaagacttcgattcttacatcagcttctgttgtcagtcttttatgatgtgttgttttggttgaagcataggaaaaaaatctggtttcacatagatctggggttggaaaagggacggcctcgaggtccccttaaacagtctgggggacccctagaagtcctgaagccacccttgagaattgctgttctggaaaatagaagcaatggggagaagagtagagggtgtgtttcccagcactggtttgtgccaaatctgggaaaacttgacggaaaaatactagagaccctgagacttatgttttgcctccacgctgcctttaatctgattgcctgtccattgccctgccgtaacccattcccactttgctcctgccaggaagatcagaattctggtctgtactcatttggcagaagaacctgggaagagaggataagagatacttgtacaataacgccttcatattgtgcaggttttactatactacatgaggagagtggggaatgtgatttgatttattattgaatattatagatccttgaaatatacagatatgacatttacagtttcacaagtgacattgaagatgcatggcaggtagtcatgtcactttgttgaggcatgagtttggaacaggtggcaaagctagtgggtaaatgtggcaagtcactgacaagtgggcttagctgactctcagcacctccatcccagtgtaatttaccagtggccactcttgttgggtgaacttctcctaaaataattaaaattattgttgaaaggcttgggttttgaaggggttttgttgttttgtgaaaaatggccttgggaaattaaaaatccaactactattcttggaaatggaaacagaaggtgaagctatagggcttatttaaaaaataactctacatttgttttggtttactatttatgaaataattaaggacccaaatatttaaatttaaactttattgccttttatgaaggtaattaaatgtaattgtggtatccacaaatttgggcatttggaaatatcaggaatctcctgttaaatctgaatttacatttaatattagatgaatcagtgttgttattaattctcagttttgtatggtttagaaatcttttgttaaatctatttttaggagaaactgaaaagtattgattattgattataatgagtagtatttatagaaactttgtaaagtaaaagagaaacaacttatcaaatagaattatttgataacttatcaaatagaatagaaacaacttatcaaatagaattatttacttatgtaaaattttatgtactatcatctatgaaggactgaatttaaaaggcttgaaatatttgcctcacatatataaagtgctaagtgtttgctatttttatactttcttacaaataccaattttttaaaaaaatccaagaagaagaaacaaaacaagataatttattgagtacctgctctgtgccagttacttttttaggcatttggaatagactgcccagaacagaactagatattgtatgtcatacatcacaatattttattccataaaagtctccaaattcttagaaaatgtcccttctagtttctctgtgtctgtgtgtgtctttactgtaacttattcaaatttgctctcactgaaatatattattgcatgtggcaattcccagctgtttatttccatctgaaataccaaaccaaatatttcttaattactgttaactgatgatggaagtatagacagtataaaccttattaataaacttactacacatgaaaaaagataatttagcaaaacctgttggcaggttcatcctctagagatacattacattttgattatttttttattgatactccttcatatctaatagtttataaggacattttacacatatagttgaaaacatatcaacatattaactttaatagaatacaagatatagaatatgatgtttaaaaatagaagactgtaaataggatttttatacctaagttagcttaaatatgtaagtaactatttaaatatcttataagaatgttaacacatttttagaaagtcttgaatccttggtccagatcttcttatatctaatctgcttataacttttacctagaaaatcagccttagatgattttaaatgacttagcttacctacagccatctaaaaacttgttttggacttctgattctggatagatatagtttcagataattgaagattaccaaggtactgtctgcttacgacacggaaaagcttaatgtttggctaattttagttgcatttgagtttgttaatttttaatcagtaagatttgttaggtaaccttaaagttaagtcactgctactccccaacccaaagccttctcagactccccattcacacctctcacgtccaatcataattaaacactctgtgttctcataacactttgtacatatcactaatatggaatttgttatagctgaatatgctaaaactggatggcaaaattcagggaatcgaaggcttctgttaggtttctccctctaatgcttcaggtagtgccaggaaataataaacccccaacaagtatttatagggatcaatggattaatcttgaaggggcttttttacttaaaacgtaataaaattaacatggttaaaataaaagctgtcatatgacatgtgctgaaggtattttatattctatcctttatctactttatcttttggggagcatactcactacattctttttccatatggttaaaagagagtgattcaaactctctgccttaggggtgagcatgtgattcaggacttttgtagtttctttttcacccaattccccagttatgagggccaatgtattcctttattttgcttttgataattctaacggagtgtcacacacattcaatagcttcctggctaaaataacatctgcattttagaatttccccataagaaatatttatcaggttcaggttctttagaagtttaactacagtttgatatgcatatgaaattctattttattgcctctcctactacaaaagtttttcactctcacagtagttttatttttcttttcacagtatttcaagtattttgatcagagccaattacttttaaatgtagttttttttgaatgatgttttctttgtaacttatcttatttctttcttgactgtctaatatccgaggctttgttgtgctccattcttttctcatgcttgccatttgtctcgattttcttcaatgattttttcagcctatttttcttactcaagataaagaaagacatagacacatccattttatatttcagcaatatttatcttaaataaacctacaaagcggttaaagtaagatgtcccactgaatgtcatagatattaggaatggcttatctttctcttttaactctctttattaaaagagagaaactgctaaagagtaaatatttgtttttttgaatgcatctctttagcttttgacccccacctgatctctcaaaaaagaaaaaaagtgacatttttactttccagagcctacacacagacaaaaatggctttaaaactctatgcatcagaggaatgctaaagaaagaaaaatatttcatgttatttttcgtgttttcactttagcatttcaattacatgcttgttagtgtacattcttcttatgtttggggttggttttgatgagtgtagtagcatgatattttttagaatgttttattacaaaatcagccaatactgtttaaggattacattaaaattggtaaactgccaattgaaaaaaaacattaaaaatagataatatctgaataattattttaaataaaaatatgtgtttttgcctagtgacatccattctcacagaaaagtggtattgaatgtttcatggtacatctatctcacagctaagacattaaaatgtgttgagaaattagtttccttgctattctttttttttttttttttttttttgaaacagagtttcgctcgtctcactcaggctggagtgcagtggcacaatctcggctcactgcaacccccgcctcctgggttcaagcgagtctcctgactcagcctcctgagtagctggaattacaggcacccaccactatgcctggctaatttgtgtatttttagtagagatggggtttcaccatgttggccagcctggtcttgaactcctgacctcaggtgatccacccgccttggcctcccaaagtgctgagattacaggcgtgagccaccactccctccttgctattcttgagcacattgtagtaaaatgacctatttggagccagaaatgaaccagccacctacacaaactcttgttaatcttttcagccaaattatagccttaaattttaatctcagaagaaaatttttgtcactcaatctgtgaaatacaggatcaaataaatggcttttgctttaattttttttacacttcatgacatagttgcttaccatgtagaatacttattgctagcaatgtaattatcatgaacagtgtctgaaacatccatttttagtcaagttctgtgactaatcaagctaaaacatacattttcaagagatccacctgaggactgtctatccatggattttctatcccactgcactttaaaattgactgggagcttctataaaatgctctctggatgtgcctcataccaaataaatagtaatctttgaaggtgtggccttgggttatattttttaaaactctacagataattttaaggtgaaccaaggttaaataccatttatttgaaccaaatgaatattcagaaacatgttattcaatttttagtcacttgttgagaactaatttcttgacaaaaaagacattcactttgtggttaatgtcaaaaattttacctttcatttcttaatatgaaatatattgcagaaatccctgataatcacaaacacctgcattttaaaagatttccattattatgaactattttttattattatttggatcttcctggggagactttatctcactgggaggtaatctatgttaagtcttaattcaaaaaatgaaagttcttgagaaagggttgaagcatataggtcattagcaaaaagctgatgttgaaatattcactgaagtatccattataataatgaatactaaattactataagatttattttcctagaatagtaattttcccatgtgagcactctgcaatattttacagtagtaggttcacttcgagagttgtttctgaatacgtatagcatatgaactaaatcaaattggtaaaaataaacatagaagtgagggagtaaccaaaaaaaaaataaagttatatccaaccttttgtttcagaacaataaaatgcaatctactgaaataaaatatttgattaatttaagaggttggtatttagtagcaaaatttaaagcaataaaatagttttggtaatggtatttaaaagtaacctaaatttaagtatttcttctcatcaaaagatacttctattataataaaatatcaattttaaattataattcttaaaatatttattaagtgcaaagtttaatgatatactgtaccagagatataaatataagtaagagatgattcctgcctttaataaataggtattcaagtgtggatgacacagacatatgcagaaaactcgcaatgtagtgactgctatactaataaagtgtggtgatcagaagagggcatgtttcagttatgaggcattgaccaaggctgaccaaaggaagagatgttgaaatgggttttaaagaatcaggagaagttctccatagggagcagaatgggtaaagtgaatcaataaacttagagcattctgcagaaaggtaagctgttcaatagggacagaaatgagaatgtaagtgcaaagaccagctgttagtggggctgtagtctccttggccccagatcataaagggccttgaaagttaagccaaggtttctgctcttcttcccaggggcaatggaaaaccattcaaacaatgtaattttgagtttcttaagactcctgtttccttggccactttccttagcctgacaccagcttgccttcctacagccatacatgaattttctttcatattgatgattttgctaactaattaaaatgtttcacaaacaatgacttgatttcttaaaaatcagaacaaaaacagtgaatgtcccataaatatatgtacacataatttatattatttctcttaaagatgagccattatgattgaggtttataatttcttcagtatgtgcaaatactataattttgatgtataagtacaatcacagatgaaatacaaatttagtttataataagtttgaaaaagctttgcaaccaataaataatgcctacttcatctgaaaaacttgagaattaaatcagaggaaggagttgcagactaagggatttctggggaaaggctgtacaaataattaccctaagaacacagctgtgtttgctttgttgttggataaaaaatggtattaaccttaaggtttcttttataatcctgggaaattttaagttttcaaaatgttttacttgttgaaagtaagcaaattaatactacaaacaaacattcattcattcaacaaatatttatgaaacaccaatataagtgaggcaactttctagaaacagagtatgcagccaagaaacagagtagaactgtccctgacctcatagggcttatcttctagtgagggttgtcaatatgtgggcaggggtagagtcaaataatagggaaattaactggtgcacaatattaacagataatggttgctgttgaaacaagaagagattggattgctaacagagggaggaatttgttcatttttattgaatagttggagaagggttcacgaataaggtaacatttaagccatgcatatagaagagagcagcaagaacaaacctcaagtttaaaaagtgctccccgctgttcaaggggaagcaagaagtccaatgtagctgcaagacaataagtcaatgataggatgaccaacaggagatgtggacaaaatgtagagatgcgtggagcaagggagatggagccaaatattgtagggccttgctggccatttggggaccttttttttcttttactgagtgaggtaggaattcattggacagtcttacattttagaagaattaatctggcttttcctaaatctagattgtggagaatgagggtataaggagtctattgtgataacccaggggaaagctgatggatgcttggatcagagtgaaagcagggaaggcagggacacatggttctattctaagtgtatttgttttgaagacataagaaacatgaatatcaatatgtaaaatattaagttactatctacttaatatgaaaattatctccatatatgtgacaggcttttattattaccaaaaacacaataatcacaaaggcttcttcaactctaaaacagttaagaaaatatttcatatatttttcattgacatcaaacatcaaaaaggagagaggaaaaactatctttgtgattgttgtgtgtccaatctatgtgttggcacataaatacatttactttacttataatatagtatctgatctgaaaaataaactgttggaatatatgtggatgtttgtttccttctaatcatttaaactgactgtgttattgaaatcaaatttataaactgcctgcctatgtagacacccagaagcaattacaaatgcattgaaaacatcattacttacattctggccctatacagtctagaagtggtatcttttcttcctggctaggtagttattctgaatcaaggagtctgactacttccggtagaaagccaacagtgggacttcaaccattacttaaatgtaggctggagacagaatctgaaaaggttttcatttgcaaattactgcataacatactacttcaaatttattagcttaaaacatgaagcacttatgatttctcataagtctcaatggatctcagctctgcttcttcccttgtctgaagtttgctggcaggttggtaggggctagcccgtctaggatagtcttagctggtatgactcagctctgccccttggattcttctcatagtgaaggtgaaagtacatgggacaaagtgaaaaatgcacatactttttcaaacctctgcttgtgttaagtctgataatgtcctattggccaaatcaagtcacctggccaagcgcacattcatggtgtgggggtaaaaggtctctgattatttaataaaaagaacttcaaaatcacaagaactttaaagagcaaacaaaacaaacagcctcaaccacaaacacaaaaatcattacaaccatcatatctgtgacaagtgtcaagtttggaagacaagcaagtttggttaaggccttattccaaattctgaccttttgttgttcaccaaaatgtggttgcagtgcctagaacagaaaagtgattcaaaggctgtttaaaacacttccaaatactccccccaaagcttaccctggtaagcacactaataggatcacacaagatcacattttggacacttaagtgaaaaataagagatacaagacatgaaattcaagaactattcagttcagtctttggaaaaagacaaggcaatttctggttggagctgatcccctggctcttaaattgtacttgatttcttcaagtttcaataatcagatctttgaaaatttcaccccatgcactctgatatcttatactttttctcttttattgacatcagacaacagctaaattggattgccaagtatgaatcaaaataattcaaagatgattaaaatattaaggatgtctcaaaggcatgacaatgtaccagtctagcacactagtccagaaaatgtaaccaagtctagtgtagtgttttccagaaggtcttttaatataagcaattaatttttaaaatgttacaataaaattaatataaacttcatgcctagaatctgttaaactcattcttcctcctgataattattccaattaatttgtggtcaaataatagtgattatggaaattttagagattccacatcttcttattctgactataaaccacagtctgggtaatttgctgcatcaataatgtcaaaattaataagctaaagtcaaaacagtattagaaacagttttaatatttactacaaatatacctaaaatctgctttagacaagagagaattaagtaaataaaagccaacaacattaagaatttattttgttattaccaaaaactacatataacatttcctattatccttgattcaacgcttttgccagttaggactccaatatgtacttacccatatcccaaagacccgtattctgtatcctgatgcctctttctcttccttccttgattaatcattgctgtaactgctgtagctgttctatagcagttctctcttttctgccatagatggaagccattttgaaaattctaacttccagttgagtagccaggaatttttgctattaataaatttctttcttgtggaaggtgtatgtgtgtgtgtgtgtgtgtgtgtgtgtgtgtgtgtgtaaatgtgtatatctaaaactttaattttcctatcttattattttcttccccttagacaaatctcagtttgttattattgtacctagagtaggagctaagaataatggctagtttagagatggaagtctgaaaaattcctgaatctaagcagttaaccttctttctatgttccttttgatgagattctgtactgtgactatttgtaaatataaaagcagctccctgagacagatggttatttacagtgttttctctattatgcaggataaattattaacaagaaaataattgaatattgaatatgccctggcaaagaaataatctttcaccaagtctgtcacacagtatgctgcaagcatgcattccaattagtagagtgggccaagtagattaatgtatcaaattgtttaaattcatgattcaatcctactttccttaagaacttagtacaattgcaaatcaattattattcaagtttgttaactttctgcaaatttcaactatattttatgactcatggatttaaatcataattcaatatgcatataattgaaaaagttttctcaaaagcttgttttcatttattttcattttgatagcattatatcacagctgatcaagtaatttatcatgttaacatattaaaatgcattcataggaaatattttacctcatttttataagtaattttttaagctaccaaggattggaatagaaaagaacatagttaggagagggaatagccaaattattttcatatctttggatcatactatcaataggagaaaaagcaaaactgtttaaccattataaaataacagtagactatatcaatggttctcaaagtgtgcagtacctggaaatttgtgagaattgcaaactctatcaccccagaacttctgaatcagaaagtctgcaattagggcccagccatcagtattttgacctcaaactgattctgatgaaaaggtaaagttgcacaactactctcctattgagcttttatctcttcaagcactgttgcagtcatattatcatttaatctacatttaaaagacaaagtattatcacaatatttaacaaatgagaaaaatgaaattcaggaagattatgattagcttcttcaaagctcctcagctacattgatggcagaaccaatatctgatttgactttcactaacatttgtctccattaacaaactcataattttcagcctaaatggatagaaacattaaaggaaaaggaaagtctaagtcagctgcaaagaattatgttacatagtttctgctatggagccaactttcattctttcaacaagtattataccagggactatggtaggtacaggagatacaaccagaagcaaaacagagttctttctcttatggatcttgccatctaccacgagaagcaggaaaaaaaaaaaggataatttcactatagaagaaagtatataaaggatgtaaaggtcactacgatgggcacataggaaaaacgcttcttctggctctaagattaaaggaagaggaggcaggtggttcctggaacatgaggtgtaactaatctttcagtagagtaggggagaaaatatcttaatccataaaaatagctaaagatgtgagagagaagaatgggcatgcatctttattatcctgccatttgttatctaaagaacagtgcaaacatttttaattttcattattatgaagggctattgtctgtatattatatttatatgtatgtgtatatatatttatatgtgtatgtgtgtatatatatgtgtgtgtgtatatatgtatttgaaatccaaaatgttttcaattgagttttcttattagaatgcaataatttaaatattttagagcataaaaattaagctaatattcattcagtttattaaaaaactataatttggaagattaaaaacaaaaacaatagttcacagcttattttatatttgtgggaatcagatacaaaaaaaaggtgacttgatgcccctagaaaatatttacagtcaatacaaacatgggagacagctttgaatatggtgtagaatacatgttaataaaaatgtataatatacacaaacttctggtctgctgcagtttgtatagcattatgaaattaatgaaaatatattattttcataacaagtgtcagcaaaatgcagcacagtaatgttaaactattctatttttgcagattcaacctcatattcagttttctcttacactccagcattacatatgatgaatgtgaaaaaataaacaggcaaacacctaatatattatagcagatggagaaaaaatagctaaatcggaatgatttccctaaattttcagtatgtgaagcaatgaaaataaaaatttaatattcagcctcctcattttaattatttcacaacagtgaacccatagtgatcagggtattttgtgtattaaattatattgtttggcattattgttacgtgattctagataatatttctatcagctaactaatttctacattaaccaaaatgtatagctaataggccaataaacatgacgagggaaaagaggactttctaaccctttgtgagtccacaaaaatgctcatttctagaaaaaccaaagaatacattgacctcactatcaatcaggtaatgtcaatgttagctgcagctctggctgtgcacaaattctttttgcaacaaggtgagacataaataaatatcccgtcagtgatattaaatatttattacattaaacttttaagtattgaaaacaacttttaatctcaggaagaaatattatgatagtttaaaattagttcataaataattggatatttatagatacagtaggttgctttcagagtttgctctcagcagggaattaaaatgcacctctatgcacatgctggtgcagaagagatgaaatgcaaaaccaagatctctccagaggacaccaacattcttggacaatttccaaaaggaggcacaaagtacaggctagttctaatttggtgtctgatagccaagagagaaggccattgttgtggaggtgatgaatggggaggcaatgaggaggggtcattacagaaatagcaagcagttgtggcagttttttgagttaaattttacaaagaatattttgaaaacaagatgggccaaacagaaccaaaccatctgtctatcttgggtctcaaagctgttggggaagagacagttattgagaaaccatatccatcccaaagatcttaaattggaagcatagtcaaggggttataatgccttctttggttgacaagttctaacccgcttcagtctattacaatctcagatgttgtctgtaataatgcttggtgtcctatgtcgttggatccagacatcgttggaataaccaaccatgtcccagaacagtgcttaatggaaacaactaagtgagtctaggattaggtcagggtttgatattatctatgctatttattgactaaaatatttcaaatgcaatctagcctggaatagaaaggtagacaagtcaatctagaatagaggtaaaaattattcaaattaattttgcaagtggatgttttaaatgcatgtctattatgacatgttttctagactctttaaagaactatgtcagatatgaagtagtatttattcgacttcagagtgaactgagacaacccatgatttagaaatgaggcaaaaattgtctcagaatagactacagttaaataaataatacttataagtttataagtattgtataacgatactcatgcatataagaaatcatggtatttctccatttacaattttgaaatttctattttcctattaaaataaagaaaaatacatcatctatgctagagggcttcatgtagccaagtggcattactccagcattgagcccccaaaagaagaaaagaggtgataggataaggaaagagcacaaagaaacttgcagtaaactgcacatacttttgtccttcaagaggcattatattttccttaaattcattgccagttttccttggggaccattgtctgttttctttaagagaatgtgaggatatatttatgtattttaactgctaaattaatagttaaaaattcaatgtgacttttatttctttcaaagaatgagattaaaattttaaatggtttcttttattaaaaagagactatatgcagttttatccaaatactttttctatgtgtttaattattgtataaccactaaacatattatataatttgtttttatgcaatagtagtggatatgtttttaaaagtttaactaatatatttttaagatgaatagaacaaacatttaatatcacttaaaagtgatattagaatgtactaccctgcactaacagctatttttgttacataaatctttaaatacactttcttattcttgcagtcatagttaaggaagaagttgtagaaaaaaagtaaacatatggtagatgctatttattcttttttctggtaatatgaaaagtcaaatttagaatttcaagctagaaatatctcagagagtatagtatcttttaccttaaatatattctaaattggtatgaaatatttcagtatctcatccaaacttgtcataaagttcactttattattttcattttcttatttaatattctcttctgataactgcaacattcgtggtgaatgtgattcagagttttcagtggctgtgaaaagtccagttagtcatagaattggtagctatggaagaactttggagaatatttcagattcttatagtgtgttgagaaatataaatcattgcattcaaatattaactaaattactgctcacctctgactgtgaaggagtcggggggggctcagattgtattggatttactcaatttattctaaaagtgccaaatgcatgtttggacagtagttcattttaaatttctttaaatatctctagtgtcatatataataacaaatgaattataatgtatattcaatgactatatttagtgtcatcctgcttttccttctttagaattttattagaccaccttacataaaaacagcatcatcaaattctgatgtggtatgattttctctgttgaataaatatttcaaaaaagccaggggcattagttaagaggagcattaaaaaaacaacccaaatgtcaatccaagttagtatggataaataaaatgtagcatatctatgcaatgcaatgcatccaatgatggaaatgaatgagcacagagcaaaataaaatgtgcagtgaaagaagtaaaaccaaagaatacatatcctatgattcttttttataaagagttcaaaatcaggcaaaactgttttatatcatttagaagtacatactataaagagcttcacagcaagtcaaaaaaagggggggccataagtgttagcatagaggtttgcctccaggagggagaacagcccctggaaatagaaagtggcacaagagggttatcttctggggtgttggcaatagtctctttcttgacctgagggcagttacataggtgtttgctttacaataacacattaatctctgtagccttctgtatatgtgccctaattctcagtaaaaatagataataatgatgatgatgatgatgatgatgatgatgatgatgatggtagaatagatggatggatggatacatagatgtaaaaggaaagggaataattaaaatcaataaaactaggatatttgatctattgctgtctatttcaaccaagaggtacagttggactgccatagaaggtacatcataaagggtcatggtacatactttggaaagaagtctaagacaggaactaaaaagttgggtctagaatccagatctatactttgacacattctgtgtatatcatggaaatgatcacttcaattctttgtgcatcagggttcttatctgcccactgaggtaataaccatttatagaaaagtctgtgataatttcaatgagattatacaaattatttggataataatttttcatctgcatctttctcccaaatcctccaatcctgtacatgaggatgtaaaaaaaattatgaggtataattaccagtaagcaccatctacttttacatatttcatgtatgcagttttttgttcgacaaacttttgtggtttttttaattattttgagttcaggggtacatgcgcagcatgtacaggtttgttacataggtaaacatgtggcttgctacacagatcatcccatcacctagatattaagcccagcatccattaactattcttcctgatgctctccctcctcccacctgccacctttcaataggccccagtatgtgttgtttccccccccatgtgtccatgtgttctcattattgagctcccacttataagtgagaagatgtggtatttggttttctgcttctgcattaccttactgaggataattgctttcagcaacatccatgtccctgcaaaggacatgatctcattcctttttatggctgcatagtattccatggtgtatatgtaccacattttctttatcaaatctatcattgatgggcatttaggttgattccatgtctttgctattgtgaatagtgctgcaatgaacataggagtgcatgtatctttatgatagaattatttatattcatttgggtgtatacccagtaatgggattgctgggtcaaatgctatttctggttctaggtctttgaggaattaccacaatgtcttccacaattgttgaactaattgacacttccactaacagcataaaagaatccctttttctccacaacctcactggcatctgttgtttatttgactttttaataatagccattctgactgctgtgagatcatatatcattgtagttttcatttgcatttctctaatcatcagtgatgttgagctttttttcatatgtttgttggatgcatgtatgccttctgagaagtgcctgtttatgtcctttgcccacttttgaatggggttgtttttttcttgtaaattttcaacaaacttttgttgagcaaaacactgtggtcatgaataaggaaaagggttttattatttttatgttgcatacacacatagtcacacatgttcacatgcacacatgtacatgtaccacacacacacacagaggcaattttttatttcttaattcccttttatgaattggtgtctctaaacatgataagggaagaaaagtatcaactaatgattatgcaccacttttcagaaatattgaggtcatagtctggaatattatgaaagattctttcaaattatgaccctcttgaaaataatttggaaataaactgattttgcatttaagtgacactgatggattaataagttaatgtatacctagattttgtgatattcataaaaagattgtaactgaatatttgtgtagtattgatttgattttagatacctttaattaatagcaacctaagtccaacagcacattttgcaaaagcaaatttatacacctgaaataaaatgtaagttgattttattaaatgaaagtccaaacttacttaatatgagtccattgagtccaaactcaatgatttaaacatattttctccaataaataatgccccatagctttcttaaattaatatttactcctgaaataaatattataccatatttattggtatgatatttaatagaaggtaaagaatttaatgtgcattttcttcctcaaataaataaatattgaacttaacttgtccttcgagcattgagatgtcttccactaaacacctacagctttaaacacacctcctggaaccctgcatagaatgatttaatagttacatattgagaagaattttaaaaagtgtctctgacaccctctttattccattgaagaacttaccactggtgggacagaagaattgtctgtggtcgccaaggtttttttttaacaattactaaaaatttactttttacatcttcatgcccattggcaaagtaataccaaattgcaaggtttaaactatgtaggttttatttttttatacaaacaacatttatttccaataatgcaattaaattatttgttgtctttatgtattatagctatgacaacagtacaatatatacccaactctatcatttcattctacaaccagtagtacaattagaatttgtgtctatctcttagcttattttgaactaattttcaggacacagcagtacaatgtgtagagtacagtgtggtgggcatcaatggttattctgaggaagaaaatgggcattaaattcttacctcctatgaaagaaacatagtaggggtgtaaatatatttatttcattcataactttgataactagggcctacccatctgccagactatattattgtgtaaatagctcccatctgagctaggtgtcttgctaactcagatcaattagtacttgtaattgaagctcaataataattactgctacatctagtgagcatttaattcctgtgtgccaggcatagctatagatacagtttaagctgctcaagtttaacacagtaaaaatgataagagcataggtgcttataaagaattactattacaaggaaactgggtatgaatacagtttttaagggtataattttgggccaggcttggtggctcacgccacactcccaacactttgagaggcctagtcgggtggatcttctgaggtcaggagttcgagaccaacctggccaacatagcgaaacctcatctctactaaaaatacaaaaattagccgggcatgggggcgggcacctgtaatcccagctactcgggaggctgagacgtgagaatagcttgaacccaggaggcagaggttatagtgagccaagatcgcaccattgcactccatcctgggtgacagagcgagactccgtttcaaaaaaaaaaaaagatacaattttgaattcactgcctatatctaatttcccagcatttattacgattcaccaaataaggtagcaatcatatatagggatttttagatcatgaggtttttaggtgtcttctggattcagatgagttccttgaaatcatcttgcaaactgaaagtgactgtgatataagaaataaccataaggctatggcaaagctgagagtgacagagtttatgcaattttccttaggaaaactgcatgatatctattttgaatcctccacctggcattactcattttatttatggaacgcattctccccagagtgacatcttctttccgtatccataatgtataattgtgatccttagaccttatcatgaaaggacaggtggaatattattttaagcaccaggatatttcttagtaaatatcatatgtagagtattgaccctttcagggacagcaatcacatagcaaaaggaaagcacaattttatctcttgttcaatcacattgttattctctttattctctggatttagggtctgttcctataataggtaacacttctaaagataaagaaagcacttaagagaattttgggatgtgttccacaagagacctggaccacattttcagttaatagtgtttgataaattgaccatgaaacattaaaaaaaaaacacagatcttaattcattaattgctgttagcattttattcgtaagataattaccatacatgtaatcattaatgatctacgctcatggagaatgtctttacaggatgatatttctgagatgttttaagactcctacattactgaatttgtaaagggaactgtgatttttgtttcaaaaatttaataagttaaatgattaatacatatagtcctcccagaaaaaaggaaaaggcaaatcatagtcatctctttcattactgtaaaatgtggtaataatttagagaccaatattttgttgattcaatttttgtcatttactaaattaaacaataatatgtataacataattccagttatgagtttactcttgggagtaactatatctttacttcatctcatttcctctctaaaaagtcatctggatgtgaaagtatacacacaaggtaaaatatatagtatattatagtgtaaaagtatgatttttaaagaacttggaaaaagaaagaagtttaatgggacttatattgggttctatagatgcagattaaaactaatagttacagtagttttaattcctatgtttcatgtatagaaaccatgctatcattcttctaaatctgtaagctttttgctgtagatttaggatttagagcattatatctaattctaaaacaaacatttgaattatgaagaagttcttatgctgcagaaatttatttaaatttagactgtcattagcatcaagaatattttttattccattaacaacttttaattaatcatacaatttgcttttatttcagaaaataccacgtatctttatagactaggagctcagatatattatttccagctttcttgatgttacctcatattgaagttgccaatggtaggactgcacaatctgaatacatatgatgagatattttatgcctcgttttccatctgcttgagttagcaccctttcaccattggccatttcatactacccaatttccatgtaatttgtctctctaatcttgtcagccccttgaaatgaaggtgcactttattcagggattattttcatgctcaagatcattttgtgaattattttatatcattataaataatcctactgttaccttttcaatacaagaatttgatttcccagcattaatgggttcattcaatagtagtgccaagttcatacagcaacactgtaattgcattttaatcagaaactagtaatatatgctgaagatactttgttaaattaacattattgctgtgattaacaaagcacactgttaagtgaatattgcatgaattaaattacatactagatcacttacatagtttaggatttcatgtgctatctagctacctcttcccacaaaatctacatccttatctgttttactcataaaaatgtaattcttgaagctcataagcatagctacttaaatgattcctttgcttaatagaaacatctttgttcactacaacaagcttatctgcactacattttttaggaataaaggatatgtgatatgtattatttgaaaactggcattcaattgccacacttggctgttcaccataaaactcctatttgaaatctaactttgaggacttctttgaggatactagagttatagttctgaaatagttacttgcagaaatgctatctattaatttaaattttggtttaaaaaactcataatatttttttttgagacaaggattcactctgttgcccaggctggagtgcaatagcacagtcagagcatattgcagccccaaacttgtggcctcaagtaattctcctcctttagcctccagaatagctaagactacaggcaagcaccaccatgcctggctaaatttttttttgaatgttgtagaaatggagtgccactatgttgcccaggctggtcacaaattcctgtcctcaagcaatcctcccaaagtgctaggattactggcatgagccactgcacccagccttaatcatttttagtgcacagtttagtggtattaattatagtcatgttgttgtaccacagatctctagaactttttcattttgcaaaactgacactctgtacccattaaacaataaatcctcattttcaaaatgagatagcttctctagatttagtaaagctctcttctttttcattattttgcttttctgtgaaaggggacttcaaatttattttgaggaaacaaatgtaaacactcatcttaaagtatgtatattaagactattttaataatcagagcaaactttcatttatttagctattttcagtttgcagcctaccatgccaaacattactttattgctgttccctgcagtccttttgacaaggatggagcactgtcagagctgcactggagctggagacagggatagaggacactcaggatgacagcccccacccagaatcctggagaggaaagttgctattgttgaaaacataatggatctggttgttattaaagtacctgaagtcagctgcataaattgggaagcatatgcacgcttctgctttactgtggcaatttaaaacaatataaatttcataaaattctcattgaaaaaaaatgaccaagaaaagccctaaaaatagtaggaaatgttacccatcattacatcctccaccatcaaggccaagtagtcaatacccacgccagataagcactgtgtgcctatgtgaggtggtcattaaagaatgatgaggaaaggaccacagaaatcaactggtgtcttcccaaagtcctggggacgctgaggaacacacatgggtctcataatgtccatgtccttcccttatacctcaatgctctttccaccttgccctggtggaaagtcttgtccatatcacctctaatccagcattctcaaagcagcacaaaactgtcttcagaagactgaatgtttctacattccttcatattaattccaggaaaagaattcccaagtcaaataattcaaatgctaagtgtattttttaaaattgtttttaggcactttctcttaggaatgtaaactctttgagggcagggtctatgtcctttcatcattgtgttcatcaggctttatcattgtctagcatatggtggatggataaacaaccatctccgtaaagatatctgatttctattccaactacacaagctccttttctagtatacacagccaccaaaataatgcttaaaacatatgtctcagaatgacaatcaagatagaagtcttaaagcaagaaagatgttttccttgtttgttcttctataaattctctaaagattcataaaatttagctatacaatctacttcagataatggcttctagatgctatgtagaaattggcccattatgcaagataaaaatcatctaagattataatgcaaatcagtcatcataaaaaatataaagatctagaatttatagaaattctactgagcatttattttatgtgaaagaaaaatacatccacagtacatacataattaaatgtaaatgtatgctgaaaaagttcataatcatgaaaaatacatatcttgatggactacttttatttggcaacctttaccttccaatatctgtcataatattagagtagattagaaattatatctacagtctcaactcattttatgaaatatgagtaacggtaggtatagataatttattttccctcagctgtacataaagatggataattacatctttctaaaaaaatgaagctgaccaggcgcggtggctcacgcctgtaatcctagcactttgggaggccgaggtgggtggattgcttgagctcaggagttcaaaaccagcatgggcaacacagtgaaactctgtctctactaaaaatacaaaaaaaaattagccgggtgtggcgatgtgcgactgtagttcccagttattcgaaaagctgaggcaggagaattgcttgaacctgagaggcggagcttgcagtgagcggagatcacgccactgcactccagcctgggcgacagagcaagactccgttgccaaaaaaaaaaaaaaaaaagaggaagaagccattaggtctcttctaacctttacctttgcagactttaatgttgtcagctagtccaacatcattatgcactattatttgaaggtgctcatccattttcccagcatcttttgtgttgtcataacccttacatgcagtatcagtaaatatggctttattgtttgacaacataaattccttagtgacgttttcaaaagaataagagtttttaaccatttagttaaatagaaataaattgatgatgggaaatgtctgcattctatgtttaatttttctatcaatctaaaactgctctaagaaatagaattcattaactaaagtaatgatgtaggaaaagtttaaactaatttactgtttacttaaactgcaatagcaaaggcaggagaataacttaacaaccttacagttaattattttacaggatatgttacctgcctttcatcttccctgagtataagacaaggaagcagacttaaactctcatgagagaaatgtaagttgtataaaaaaaaaaaaattctgatggtcagagtctgctaatagtattgaaacttctggatttcatatcctggatgcaggtgattaaattgtctggtatagcttaacattctcttgcctagaaagaagaagataaattagtcagcacttggaaaactgatccaacttcttgttactataattctatatttctcagactggtttgctaagcccattagaacaggggcttcatgaaattaaggtcacaggtctaattcttatttcaacctattagcttccctttcttctgagggactttacttcaaacatcagccaatcatcttgtaactttcacccagtcacgaaactcacaagacaacatacatggagtggtcaggcacctactcattcccataattctctggaacatacttcagtgtgggctggactatcggtgtcacaagaagatacatgacaccgcagagatggcccagtacagtttttccttgtcaaaatcataaaaagactatggtaatcctacaaattctgattcacccgtgtcaaagaaaggaaggaagcttcagaaggttgttttcttttctccttcagagacttacaccaaattattttgaatttgcatttttttccagtctttaattcttgaccagtaagaagtctctcaactctagtcattgaatctaccaaaatattttgtttcaaaaaataagaaaaaaatattgcatttttctacatttttgagtagaagaatctccctaatcattggttataaaaaatgaaaatataacactgaacaagttaatattacaaataacaaaataaatgcccactgtgtaaaaataatgcaaaattcatatttcaaagttaccataatttgaatacataggtctcttagagtcaaaaacctcataaaatgtgtgatgacatttttcaggacatatgtagcatcttctaatcagatgctaaatgtgatctattaactatcacttgggttgctgcagccctacatcgattgttttatcctgttgataaaataaaaatttacctcaggaatgactcactggttagtaaaactgaattctcttaagcttaggacttgggaaaatcaataattggaaagataaatgttttgagtcataatgaaaagcatgtataataaaatcctgtataagagcctgaggcatcatccaaatttatagaagtggtaactaagtgttcaaagacaggatagaggaaagagcctagaaacctggttcaatgtctggaaatatttgtctctttagagtgataaatgagttttaatcaaattgactgtagaaatagaaccaaaaggaacattattctaagtggtatcggtaatcaaggaagaaaagcctggtattaagaacttaccatcttttcagtggtcccttaagatgaaccaacgatttgaagaaaacaaacttgattataatatacaagcttgcctatatttatttataaaatattctcaaagtgtagtttaattttaataaacctctctctctgagtcagggctcataaaatttaactatagtacctggcctaatttttttgagtcatatgttaatgtaaatcattaattaatctcatatattgatgagtatagtatgaattatctttttataatatctttgatatataaatattcacataaaaggttataatgtgttctaaagaattaatttctgactatacattatatactactagtgtctagtttaagactatatatcacttcttgtttgggaatttatgtttatatttaaatgtcaataattatcttcactagctcaccaattacatgcaattagtgattacaggcaaataatttcctaaaaatttgaatgaaatgatcttttaaattgtgttatgaaatatcaaacaatatagagtttggattggcaacagtaaatagaacagagcatctccttctacccatagcccttctctgacatcctacaaataggaatgaaggagttcctcaaatctgcacagtcaccttagggcctgggtcaggttttacccccaagacacatatacgacagaaagacaggaaagtgtaatgtgatcaccagtaatgtttctaaagttcaaatttaaaactttcacagccatttataaattcttatataagtaattttaatcgtaatgcattgcgaataacaaaaactcctactgtaatagctttcttgggaatccactcaatcagttacatatgtataggaaataaaggaatgccttcaaattataaaaaatactgaaaaatatttaaattggatatatttaaaataattacttttttatatagaatgccatagatcagaatccatatgaaaattgaaaacatgacctattatttatcagctcccaatgcaattataaatagatttaattggcactgggatttaaggcttacttactagtgtgtaactaattaatagaattttcagctcactcagcatgtgacttcttcaatgataagctgaagttccgaaaaaaaaaaaaaagacttaaaatgactatgcacatgatttttaaattactctccatgtttatggagtaattgagaaacaaactaagtttcatagtttctgaggccctgataggaagccaagtaaggatttaatatgataaaaaacaaacccacaaaaaatcatacattaaaatactagtaagataaataattgctgtaagtgagcttctatattattaaaactttttggaatgtaattaaaattaattttagagaatttttaaaaatagttatgtaagaatcaatttctattttgaaaagtgtattatgactactaatgctccattggtttaaataaataacactggaattctatattttatcataatcatctttgttactaatatagctgattattatactttcattaatgccctttattcaacgtatatttttattctttgtacactcaacaagactttgtttagaagtttctgtagtcttaacctgcctacctcttctgaaatgtctccttattctctttttatctctaagctttctattaaaaagtatgtctaactcaatgctttcttaactacatttccaaaccttttactatgccaggacattcttcagattcctagaaccattggttgctgttctcatgttccagtgtccttgaattactattgtctgaatctgcattctatctataaattatgcatgtcttcaaatagcacctataaacttctacttctgcatgctgttccataattgccaaattactgcacaagaatattattctgactatacagcagcattctgaaatcacggatttaggatttatatagatttatgtagatgcttttaatatccacgctattcccggcatatttttccaccctatatgctgcagttccctgattacctggcacttctccaccatctctttcccctagtccccaatgataatgcaattgtcttccattaaactgccttctgcaccaccttttgtagggcctaagtcctgtatcttaatggtacatttttataatttgaaaaattagatgtttaaaaaaggtattaaagaaaatataagtcattgagcatttttctctatacaatcaaaagaattaataatatattggctgaatgctttagagaaagacttggaaatagtctgaaacattttttctttaaagaaaactattttgtattttaaaagaacctatttttcacacataaaggggacagacttttgttttataaaatatactaaacatacattctagtgtgtacccaaggcagtgtctgaccatctgctggtaaaatttaagggcatttcaggtcaactcaagcaaataattttcagttcttcaaattaggtattcctgtcaatattgtattacatttgacatttgcactgttttattgggttagagccctaagcagaggaatttttttaaatttacctgatatgtgttcaaatattccctagtacacttcaaagggcctaaaacgtacgttttgaatgaataaataatcaaatgcataaatttgcactgtggaatttacatgcacagttaagccatcaaatgtaaagacagatttctagtatacgcccccattgtatgggtattgcagattttccatacctggtagtcatttggtatgcttggaaattcccaaggatacaacttatattaactgtttctaggtcctgaattttcttctagaaacctgttgacaaacaaaaaaaaaatgagagggaattaggagatatatgttgtctttctacctctgcctctaacagagggactttagacaaatccctggactccgtagtttacaaacgcacaaattatgaggacattgtttttctcttagtggctatggcagattcagattgtattttccaaagttggcagtagcaatatttctcatccaacattctcttccacaatgtcacgatgacattcctctcattgagaggtgaaatccatgatccctccctttgaaaccgggtgggcttggaactcccttgttactaatagaattgacagaattaacattgagtgacttctgaaggttgattaggaaaagccaagtaatcaaggctttgtatatggaagcacttatgctggaaccctgagcatactataagcccttgactatgcttagtccactgtgctgcaaagaagcccaagttatattccagagaacaaccaagcagagcagccaggcagtcctcagcttccccagccactcaccattgcagcttcagctaatctctaactgcagccacaggagagactttaagctaaaaccacccagccaagtcctttctgaactccagagctttggggaatgttaaatataatagaatactttttgctttcagctgctatattttggagatatttttaatgcagtatacagtatcattccttaggtaaagaaaaatgattccatgccacaaattgcttctttattctttgaaaaaaatataacctttctaattgactacataaatgtttttgtcagagatatgttagttaagtgccttgaattgtttcaggaaaacatgctataacaataattttgtttatcatatcatgaactcattaaaaataaaatgttttttagttttaattacaccaagacacaacactgcatcataggagtaaaccacttgtaaattgtaattgaaaatgtaatttttgagggctacaggctgggtgtgtatagtctactctttgtggctttaatcctagccttcttgaatcttcattagtgaaatctataaagaatgtaatcatgtatctcagaagaatcatttgttaagtgcgactgagatgatatattccatcatgaatataaccaaaagaatatcttttaggatattcttttatatcttttttccaaaaaaaaagaatcttgaatagattcatctgaagtctaataggttttgttttatattctgtttttacatactggattagtgtggatatctagaatgttaggagcctctcaagggacataactaatattcatcaatggatccttcacctttactaaatattgtccccatagtagatggtcagtaaatgtttgctgactgaataaaagcctacaagaaacagtgattaattagagtgtgactttaaaagctaatcatacaaagtatgtagttatatactttggttaagaagataaaagtttatagtttgagatgcttcttctactccaaggtcaacacactctctgcaaccatagctttatagcaaacattggactaggtatatgggaggacaggtacattttcatgaatccaaggtgaaataagaacagctgatgtgacaaaaaatcaacgagatccaggcatggtggctcatgcctgtaatcccagcacttcaggtggccaaggcaggaggattgcttgaggtcagaagtttgagaccagcttgggcaacagagtgagaccctgtctctacaaaaaataaattagcggggcacggtggtatgcacctataatccaagctactcaggatgctgaagcagcaggatggcttgagtctaggaggttgacgctgcagtgtgccatgatcacactattacactccagcagggacaacagcaagtccgtgtctcaaaagaaaaaaaaatcaacaagaaatcatagaagttaaatttatagtcattaaaattaaaaaacacaaaatagagcaatctctagttcagatataaaagtatattaaggaattcatccagaacacagaaaacaacataaagaaacataaaaatattgacactatgcatctaacaagagtgctggaactaagaggttagaggaaattttattcactccagaaatatttactgaatacctgctatgtgctgggtactattcttatattattattattattattattattattattattattattattattattgagacagagtcttgctgtgtcgccaggctggagtgcagtggcacaatctcagctcactgcaacttccactccccaggttcaggcaattcttctgcctcagcctcctgagtagctgggactgcaggcgtgtgacaccacacccagctaatttttgtattttttagtagagacgggatttcaccatgttgaccaggttggtcttgatcttgtgacctcatgatccacctgccttggcctcccaaagtgctgggattacaggtgtgagccaccatgcccggccgtgctaggcactattctaagcacttgattttgcaatgaaaaagccaacaaaaagtcctcctgagattttaattttataagatggtgggataagataataaacaaatgaacaaataagtatataaaggagagaagcaattgatactatacaaaaattaatgcataataagagaatagcaagtgacaaagaaagcgatatttgagacaagatggtctaggaaggactctcagatatagttaaatttatagaaaaactggaacgatctgatgatataagttttgcaaatatctgggagaagactgttctaaaaactggaaccacagcagataaaagttttaaggcaagaatagttttggcatacttgaaaaacaaaagactagtatggcagagaaagcatatttaaggaaatgataggtaagtattttcagaattgaagaaaaccatgagcccacagattgatagcaccctctgaaggcaaagaaatataaatttatacccaaacacactatgtgggactgaagaatgtgaaaaattaggaaagaaatcctcaaagctatcagagctatcagaaaaactaccagaaaattcagacagattgcccacaatcaagtaccagataaaggccagtaaacaaagtagagttattttgaaagtcatgatggacaaactaatccagatttttgtgaacataaaaatgcattttcaaattcaaaagtgaagccaaagtaaagacatttttcagcataaaagttgactgtttaccacccacagatgtacactagaagaaggagaaggaagaggagggaaaggagaaggaggaaagatagggatggggaggagaagaggaaggaagaggacatggggaggaagggaaatcagaaataacagtactcacagaaatgaataacatgtcaacaaattcatttaactagtaactgtaaaaaacaaattatttttatatgacaagtaaacacgattgacaataagatggaaagtaaaatcacactatgatttgcatcacatttagcaggaaaataaaaataatggaaaagcacgtaaacatttaaaactgtttagactgatacacatggtggatataacagtatttctagtagtagtaaaaagtttagttcaaagatttaaatttttaaaattataaatattgctgatttggagcctcctaaatacataacattttgagaaaaagtagattgaagtactatattagttagaagaagactagctatgttacagtaacaactaaaactctaatctcagtgctttagcctgatgaaagtttatttttcactcacgtactgtctgatgtgactagctagctcttcttggtagctttcttccaatgatgactcaacaattcagttccgctgatgttcactttgcaactcaaacattgtgaattttcttccagccatgaggttaggaaagcacagaaaacttactttatttcttaagtgcctcagaccagcaattacatatcagtttcactcacattctcattgacaagaattattcacatggccataacccaactgcaagaaagtctgtaaagagaggaacactcatagacatttgataagcattctctctgccacatttattgacagttatttatcatttcacatgaaaaagttacatatgtttctgaaaaataaatctcaaagaaagttaaaagtaactaaatctcttcaatgtgtaaatagaaatcattcagaggggaatattatggatttttggatataattttatgttaaatatattttaagtatttacaaacaatataagttagcaaaatgaatgaattcacaaattctctaataattattcagtttctcaaacctaatcatattgaataaattcaatattttagtatgtacagaaggaagaaaacaagttaaaagctttctaattgttaattcaataaccttttgtaaaataaaaaataccttttaaatttgcaatataaagtaaaattaaagctcctttagaaaaatatataaatatttatatatttctatttatatattatatatttatatattatatctatatataaagaaatatatataatttatatatatttctaaaggagctttgagatatatatatatatatatatatatagagagagagagagagagagagagagagagagtcaaacttttaagtttagaaaggcaaagcagagtttaaaccagaagcacttttgttattcgtttctctaaaatgaattgtctaattttctcagattttgattattttgatggtttgttccactttataatgtcagaaaaatatgctacatcatattaaaaaaatagaaatttagcttcaaactacctttgccattaaaaagtctttttttctatctaatatgcacataaagcactattgttttattacagctaatgaatacagttaaatggaaacatttaaagatttctttttcccttacctgggacatattttttaatgttctttcctatgataagttactatgtatattgtaacattgtgaataaatacaagttagggtttgggtgaatatattttcacacacacacctgcacacacacttaaaattttactcagactttgagacctgagtaaatctaaggctacagatttacttgttgcagaaagaaaaaaaaaaagtcactgcaaagctatggaagaagtatgaggtcaatttcaagaattaaaagtaataataataggcaaaagataaagactagaagaactgagggtttgcttttcctctcacatttatttctgtgacacaaaaatgaatatttcttaaaaatctttaataaccttaataactgagtactagtaataaaaattatcaataactgagtacagctgataaagattatgacaagtcttatgtggttatatttcatgtgctaatgctcaatatatgtaaaatttgattttaaaaatgatcagttagcaaattcatttcatgttttgtgagtaaggatgcacattactgaatttcatggttttctcatttacgtatttcaagaacaatgtcactgcatggggcttcctctgtgtccaagaaacgtactcctataaagtgcttgcttgctttgattcactgcctcagacatgttccactatatctgtttgcatctgttttttagttcaaggttaaattattcatacctgaaatacagcacaaattgctgaaaagtagggtctaagtagccaaggggatgtttatttctgtctgctgaaaatgttagacgtaaaacactgataaagtagtagaatgcctttagtttgtttccttttaaattctgaggaattgcatcagactaataatcttaaatgaattgatctgatgctttgaatattattattttgcttttatatggatgattttaaaagatgtccactctctaagtaaaattttattatgtctggtcataaaaatatgctcagaggaaagtatttcccattttataggccaagtctgtaaaaataaaaaatgaaattctttgaaatttttggaaccacgtttgtttcccaggggcagtatggaatgatggtataaagaacactggatttgcttgcaaaacctaatatgttgacattttgtgaaatagaaatattccttttttttaattttgtagctctaactttgttttttattttaattttttattattatactttaagttctggggtacatgtgcagaacgttcaggtttgttacataggtatacacgtgccatggtggtttgctgcacccatcaacccatcatctacattaggtatttcccctaatgctatccctcccctagccccccaccccacgacagaccacagtatgtgatgttcccctccctgtgtccatgtgttctcattgttcaactcccacttatatgtgagaatgtgtgttttttggttttctgttcttgtgttcgtttgctgagaatgatggtttccagcttcatccatgtccctgcaaagaacatgaactcatccatttttatagctgcatagtattccatggtgtatatgtgccacattttcttaacccagtctattattgatggacatttgggttggttccaagtctttgctattgtgaatagtgccgcaataaacataagtgtgcgtgtgtctttatagtagaatgatttataatcctttgggcatatacccagtaatgagattgctgggtcaaatggtatttctaagttctagaaccttgagaaatcgccacactgtcttccacaatggttgaacgagtttacagtcccaccaacagtgtaaaattgttcctatttctccacttcctctccagcatctgttgtttcctgactttttaatgattgccgttctaagtggcatgagatggtatctcattgtggtttggatttgcatttctctaatgaccagtgatgatgagctttttttcatatgtttgttggctgcataaatgtcttttttttttttgagaaggatctgttcatatccttcacccactttttgatggagttgtttattttttttcttgtaaatctgtttaagttctttgttgattctggatattagccctttgtccaatgggtagattgaaaaaatattctcccattctgtaggttgcctgttcactcctatgatagtttcttttgctgtgcagaagttctttagtttaattagatcccatttgtcaattttggcttttgttgccattgcttttggtgttttagtcatgaagtgtttgcccatgcctatgtcctgaatggtattccctaggttttcttccagggtttttatggttgtaggtcttacgtttaagtctttaatccatctttagttaatttttgtataaggtgtaagaaacgggtccagtttcatttttctgcatatggctagccagttttcccaacaccatttattaaatagggaatcctttccccattgcttgtttctgtcaggttcatcaaaggtcagattgttgtagatgtgtggtgttacttctgaggcctctgttctgttctattgatctatatatctgttttgataccagtaccgtgctgttttggttgctgtacactcatagtatagtttgaagtcaggtagagtgatgcctccagctttgttctttttgcttaggattgtcttggctatgcaagctctcttttgggtctgtatgaaatttaaagtcgttttttccagttctgtgaggaaagtcaatggagattgatggggatagcattgaatctataaattactttgggcaatatggccattttcatgatattgattcttcgtatccatgagcatggaatatttttccatttgtttgtatcctcttttatttctttgagcagtggtttgtagttctccttgaagagatccttcacatcccttgtaagacgtattcctaggtattttattctctttgtagcaattgtgaatcggagtcactgatgatttggctctctgtctgttattggtgtctggttttgcacattaattttgtatcatgaggctttgctgaagttgcttatcagcttaagtcgattttgggctgagatgatgtgattttctaaatatacaatcatgtcatctgcaaacagagacaatttgacttcctctcttcctgtttgaatgccctttatttctttctcttgcctgattgccctggccagaacttccaatactgtgttgaataggagtggtaagagggggcatccttgtcttgtgctggttttcaaagggaatgcttccagtttttgcccatttagtatgacattggctatgggtttgtcatacatagctcttactattttgagatacgttccgttaatacctagtttattgagagtttttaacatgaagggctgttgaatttaggcgggctgtatatcttaaaacaatcggtcagcttagtcagtcagtagtgtttgagagacctgaatagccaaattaggaaaaaggattgcaagttgatgtgagttctttgagaatgaagacagtttcccactgagtttcgttgattctttccttacttaatcttttgtttctatttgtttgagaaaacgatgtaaaacttaggtgttactattttaaacaaaaattaattacagtcatatttataactaggctaggagtaaaagatatatttagttgggggaaaactcatttttattttctaattttgagaggtatttttaaaactaagattggttttttttatgaattgtaaaaatcttttgatgttattcttttaactgaaggatgtaagaccaaaagtaaaataaaataaaataaagaacactggatttggaattgaaaaccaggatccagtgctggttttgacacttgatagcctgaggggataatggtgtaacttcctgcatctataaaatgtgaggaaaacgcattttaatatgcatagtaaactaacacagtcttccattaccaatgcttattatcattgttgctttaatatgaaagtattttcactatatcaaagttactagcataaaatcaatcatcagtgaatccattatcaatctaatcagtgtctatctggcatctttgtcttgctagtgtacccacttcctccttttggtggtataactgggtctttccttcagggaacacattctgtgatgtgggcagatttatttcttctgtagccaaaagcataagaattaattagaatgtctgtcactctggccctgggatttttctaacgtaaagaaatgttgaaaaatgttaatgctgagtagccatctcccaccaccttcaatccacaatcaacattttattatagctaatttatccatttatctatcttcctacccttacatcaatgcatcttatgttttgatgcatttaaaattgacttgcaggtatcaatacagttactctaaacacttccacacatattattgattagagtttaatatttccatgaggcagtgcaactcaaatctctaccagatatggaatgttattgtcccagaaaattgttctctcgtgccccttttcactcaatctccatctacctctctcagctgcaatcattaccagggtggttttcaaccatatattagtttttgactacagtaaagctgcaaataaatggaatcttttgtgtaagatttcttcatatgtgttaatgtgtatatcagtttatcccttatttctgagtagtattctattatatgaatatattggtttgtttacgaattacgctattaatgtgggcatgaggtgtttttggttttcagatattatcaataaagcttctgtgaacattcttctacatagtctctcatgaaagtgttttcatttctcgtgagtaaacactgagaaatgtaaagcctgtcatagggcaggtataggtttaaaatgatctcataacttttctcataataaggatataatgttatattcccactagtaatttgtagaagtttcagttccacatcctcaccatcatttggtgtgtcaacatttttaagtttagctattctggagtgtgaatattagtatctaatagtagttttattttgcctttccctgatgtctaatgatgttgagcaccttttcatgcacgtattggccattcatacaccttttttaatgatgaacctactcaatattttgcccatttttaattggcttgtttgtctttttattgctgagcagtagaacttagttatttattgtagacatcagtcctttgccagatatatgttttgcaaattgttttttctagtttgtggcttgctcatttatttcttttcttttacggttagtgcctcttaggacctgtcctagaaacctctgtctacttcttatttgaaaaggtattctcctttgctgttttctaaaagctttatagttttaatatattgatctatgatccatctgaaattaacttttctgtatgttataaatctgggcgagagtttttgttgttgctgattgttacctgatgatttcagcaccatgtgtttaaaacaaacaaacaaacaacaacaacaacaagaacaacaacaaacccttaactgtccacactgggttcctttggtgcctttattaaatgtgaaatggttgtatatatgagtctactttctattgcctcttcagtttgttacattgatctattgtcaatttttatgccagtaccacactttccttaatgtagcattataataagtcttaaagtcaaacggttagaagtcctccaaagctgtttttcttttcaagattcttttacctattcaaagtttttattttttgcatttccatataaattttaacatcttgtcaatttgtttaaaaaattatgggaactcttttggtgtggaatgtatagattaatttgggcataattatattttgtatcttgcaatccgtggaaatgatgaatctcatgacttatttagtgttctttaatttctctaagcaatttttgtagttttcagtgtaaagctccaatattgttttaaatgcattcttaagtaatagcatgtattttcatacttttatatatagaattctctaatttttgaactgctgctagtataaaaaaaatgtgatagatttttatatacttagctcataccctgtgactttggtcgtttcacttattaatcatagtagttgtgttgtcaagttcttaggatcttcttcataagcaatcatggtatctgcaagcagaattttctttctttccacttgttgtgactttatttatttcttatcctattgcgctcttaagacctccagtaaaatgttgaatagaaatgatgtgaataggtattcttgctttgttccccattataggttaaaacactcaatatatgaacatgaaatatgatggtaattgtagtttcttaatagcttctcaatttgctaagagtgttatgaatgagtgttgatcatcaaatgcttttcaacattcattgaaatgaccatgtaattgtttcttatttattctcttaatatggtgaatgataatgatttttgaatggtaagccaatcttgagcttttgtaaaacagcgaagataaacaacattatcatgatgcattgttctttttatatattactggattaatttaacaataatattttcaagggatataaaggacattaatatatggatttatatttgtaaatgttgtattaatggtattgttgccttcataaaaccaactgggaagtgttctcactctatttgatgcaagagtttgtttggattgatgctatttcttccttaaatgtttggtagccttcactactgaaaccatatgggcgtatagtttttctttatagaaatattttgataacaaatgaatatataatagatgtagagctactcagattttattattcatttcatgtttttataatatttatttttcaagaaatttgttcattgcacttatgttgtagaatttcctggcatgtggtagatattttatttttcatttcagtaggtttgggagaacaggtgatttttggttatgtagaagttctttagcagtgatttctgagattttgatgcacccatcactggagcaatgtacactgtacccaatgtgtagtcttttattcctcacccccctcccactcttcttcccgagtccccaaattccattatatcatgcctttgcatcctactagcttagctcccatttataggtgagaacaaatgatatttggttttccattcctgagttacttcacttagaatagtggtctccaactccatccaagttgctgcaaatgccattatttcgttcttttttatggctgagtagtatcccacagtgtgtgtatgtatgtgtgtgtgtatatatatatatatatatacacacacacatatatgtacatatatatcacattttccccattcatttgttggttgatgggcatttcaactagtttcatatttctgcaattgtgaagtgtgctgctgtaaacatgcgggggcaagtgtctttttcatataatgacttcttttgctttgggtagatacccagtagataccttaatattgtaccacaggctcctgagacactgtttattatgtttcaatcttttaagtttttattcttcagattggattatttatattagtatatcttcagccgccttcctttcttcagttttcttttccttcagttagttatcaccactctgctattaatcctatctagtgaatttttaatttcagatatggttctattatataatttcaatttggtattttatatagtttccatttccctactgagtatttttatttttattctttgagaacataatttcttttatgtctttaagcataattatcatagttatcttagacttctttgctattaatagttccaacaactgagtcatcttagtgttgtggagtattacctgttttttctcttaaatatgggtcacattttttttcttagtatatcatttttatttgtattttggattgttttaataaggttgtagatacttttaattttgttacttttttcctaaggagggttgattgaattcattttagtaggcatttgacttggatggactaaaactacaagtctgtctcttttcaggtggccagcaactcaaatatcagttcagttgttttaactgtggctgggttgtttggcatttaccttgtgcattcctgattcagtggtcagccagatatttgggcagaaaaaaaatacatatatataatatatatgtatataacatagtgtatatctacactatataattatatatgtatatatgtgtgtgtatatatacacatatagaaataaatgcgtacacacacacgtatagctttttttttttttttttttttactttctggctctctcctttcctggattgtcacctgcccccctcacccctcccccacacacgtttcggcagatataaccctgagccatttccttcttccaggcgttcactctccttcactctccacctgcctatttgatttttggttggtttggttggtgtttattttgttttgttttcgtctccggttcctttgtgtagctttgtttttgtactttgtttttgttttcgtctgtattcctaaatttggttgttttaataggagatgaataccataccaaaagcacaattcccacaatgtgtgtttgcatttgtcttctaagtgaactcctgaattatccagctgcgttatctacatagagagccagatcatctgtctcaggcagttctcctttgaccagatctttccattatgaaagctcagggacattaaagtggttctcaaatccctttgttaaagaactgcgccattttactaagattatgtaatttttaatcttttaatacaaaggaagaaaattttatttagcagaggattaaactattctgctatgattttgtagctaaattaaaagaattatacttaaagatttttgttctgattagtgggtagtgttatttttatattaaaaaaacagataaaatctcagtccataacttcagggacaaaggaaatataatttttaaaaattttctaagtgataaaagactatacattgggtacagtatacacaggagatgagtacaccaaaatttcggaaatcatcactaaataacttatccaggcaactaaataccacttgttcccccaaaaactattgaaatgataattttaaaaagagctcccagaaaaagaatatctaattttttttttttcttttcattgtaagcctctaccacctggtaggagaaggtaatagtaaatttggtatcttctccgttttcttcccagggagtatttccacatgctactgtgttatagatgccaaacattagagaaaataatttagtccttggttcatctgactacactggcatccattaaaagtctattatttctttggttatttgtcatctatgcatggctttcttttcatcttaaggactcctattaagtcttgttctctctctcagctaactcctgggattctctttacagcatgagttcttgttcctgtgtccagagatctgttatcatgtttctaatttcttgatgctacttaccctcaaacacatagtgcctgggtatctatctttgactattcaggcattagccctttctcttttgcctctctcctggcaccatagagtatggtaaaattctgagacttggccaggtgcagtggctcacaactgtaatcccagcactttgggaggctaaggcaggtggatcacctgaggtcaggagtttgagaccagcctggccaacatggcgaaaccctgtctctactaaaagtacaaaaattagccgggcgtggtggtgggcacctgtaatgcaagctactcaggaggctgaggcaggagaatcgcttgaacctgggaggcagaggttgcagtgagccgagatcgcgccactgcactccagcctgggctacaagagcaagactcagtctcaaaaaaaaaaaaaaaaaaaaaaaaaaaaaaaaaaaaaaaaaaaaaaggaaaaacctgagattttgctgctgcattcctgaaactccctcaggactgtaaatacctccctctccctctctttttctctctctttcctttctccaccagcccctcccacgataccatcacataccgttcactcacacagagagctaggcttcagaagccccctggaattcccaatactgatgcactccctgattctcttcctgtccctggagaaggacttcttttctagtctggcggctaagaaagctctgcctttataacaaaactgtttatactcttagtctctcaggatttagacttctgaaacccaaaagctttgctttctgaaagtgtggatgtgagaataaaaatctagcttgaaggaagtaaagttataagtttgataggaattgagggggaggaggtagtgaaaattagttaattttttggaacactatcttatcacacacatttgccctttatacatttattatttttgctattcaaataaaagtaacaatatgtattttaacagagtaattttttatttgtgcttattaagttaaatttttcttttttctatcatcttggatataataaacgaagtgtaaatatatgtatatacctgtataattacagtcaagagtttaaagtttgtattctaacttgtctcatttataatttttatgctaaagaatgtgtgatgagagacctctgtggaattttgatgcaaatgtcaaccaaaaattcttggtagcatagatcatctgtctaattcaagacctaatgctgaattattagacaaacatctctgtaaatacaagattggtttatttttatcatgaataaaggggaattctcatacagttttattttactgtcctttagaccttacagtttaatatctaaatattagacatttacattagatatataattagactatctatctgatattcattagatagcctaatggatttgtcattattgtccttctgtcactttccatgtttaaaattttcccttattattccagcatcttcagtgtattatataagaaaaacatttatcaaactgctcttagcatgagaaaacataatataccaaggaaacaggagggaatttcagaaattagaataaattaaaactttgagttaattttttgaacgagtttttatgtttaaaaatgtgccatatttgtagggtctcttgaattacctgtaatatactataattgatttcagcttgatatgtattttttaacgtaaaaaaagatttcatgtactttgaagagtctttgttatcattatcttaacaataatgtgatatttatgttttaattaccacaaaacagcaaccaccacagactaactaaaataaactttgtatagcttccatgctacacacaaactaatcattcaaagttttctcaggatgatgaaatttttaagatcatgttaaattaaccataattttaataataatttatgtcaaaacaatattttttctgtatccttcatctccgtatctataaaatgggggcagggttgactaagtgattccaagatcttatttggctctaaaagtatttgattctaataaacaatgaaataaccgcaaataccactaagtatagacaatgagtatcaaaggaataatgacgcattgctctactatataaataacctttttttactgtaatcattctttacctgctattgtgaatcagtagttttgatgttaaattgtggtgtttttaaacaaacagtatcattttattttattttattttcctcagttttatttaggtataattgacaaatgaaaattgtatacatttaaggtacacacgtgatattttgatatatgcatggattataaaatgtaacaagctaatgcctctatcacttcatagttaccttttattctatagtgagaacaattaagatctactctttaagcaacttttaagtatacaatgctttactattaactacagtcaccttaatgtacataagatctccaggactttttcatcttataacagaaagtttgttcttgattgaatggttcactgagggcacaggtgcaatgaccccacacatgcataaattttatatatgcattttagcttcttgactcagcataatctctcatctgtcctctccggtgaattcttaattactgattatttatgtctttacctgctttgtttgcaagttttgcaagaaattttgcatattattgtatgtgtgtgaatgtgtgtatagcaatgaaatcatttctgttataagcacttgatagaagcatatatctttatatcagtcttgcgatttcagagtacttttgcatatatgagcgatcctaccttattttattgcctcacattgcaaaataaccttggctgttatacttcaaggtctcaggtgttgagtcattagcagctatggaatagatcagaattatattacagctgcacaactacaaacaaaaggtaatccaagatctttcaggcttaacatcagcatatggacaactccttagcacttggctgaaagaaagttaattcgggaatttcaagctaaattccctcaggatgacttctctgaatgatttttaactcctgtaatacaaatagaaaggcatgtgaaaataaatagtatgcaattaaaacagagagcaataacacagatatttgtgtatacatcttccaaaattggtcattttataaagaatgtattttagcatatttagtttatacatgcatgcacttgggaattatttagttcactgacatcctgggtagaaactagtaatagaaacagatctatgacaatttattagaattattaagtctatacttttaaaattaagcacaaagtggcatctaccagaattataaacaagaaactgaatttcagaacatttaaatttcagaaatctgtgtggctgtctggactgttgaaaccacctcctgttcttcctgcttaaaccctctctctgcctatactcccacccatatgccctaaatccatactcctcctaataggcaaattgatcttggagaaatcagatcaaatctcctatataagaccaagaatatttttccagtgtaccttatataaattaaaaccatctctgtggactctaagtgctgtcacgactgcatctgcctcttggacttcatctttcactcctctctcctcagcattgcagccacactagcatggacatgccaagtgcatttctgctatgctcactaatccatttgcctagactgccctgcccctgcctgtggatcttctaattttttttatttaatagactttatttttagagtagttttaggtttacagaaaaattggacagaaggtataggaagttttcatataccccctctcctttctcacccccttacactatattttgtattattaacattttgcattcgtatggtacaattgttataactgatgaagtaatattgatatattgttattaaataaagtccattaaggtttactctttgtgctgttgaagtccatgcattttaacaaatgtataacatcatgcatccatcattatataacatacagaatagttttactgccctaaaattcccctgtgtgccacctatttatcccttcttcttccttcctcctaaactcttggcaatcacaaattctttttactgtctctatatttttgccttttccaggatgtcatatatttggaattatatagtttgtggcttttgcagactggcttctttcactaagcaatatggattcaaggttcccctatgtctcttcatggtttgatagatcatttctttttagcactgaataatatttcattttatggctttactacagtttgtttatcatttcacctattgaaggacatcttggctgctttcgtgtttttgcaattatgggaaagattgccataaacatcaagttttcaactcttttgagtaaacgcttagaacaatattgatgaatcatatggtaacagtatgttaagttttgttagaaattgccaaactgtttgccaaagtggatgtacaaatttgtattctcaccaacaataaatttgagttcctgttggctccacattctcaccaggatttgttatatccgcattatggattttggccattctaatcagtgtacagtagtatctcattgttgttttaatttgcaatttcctgatgacatatgatgttgagcatcttttcatatgcttatttgccatctgtgtatcttctttgatggtgtgtctgtgcagatcttttgcacactttttaattgagttatttattttcttatgattgagttttcaaagtttgttgtacattttggatataacccctttatctaatacatgttttgcaaacattttctcccagtctttagtttatctttttattctcttaacatgtcatttgcagagcaggagtttttaattttaatgaggtacagtgtataatttttttatggatcaaacttttggtactgtatctaaaaagtcgtcaccaaaccaatggtcatgtagattttcttttatttatgttctagaagttttatagttttgccttttacatttaggtatataattcattttgagttaaattattgtgagttctaataattttttattgctgtttctcatttgtattctgattttaatgttaagttctcaaaggggcctttcctaatcatcctagctaaagcagtccctcccaaccaatcactgtttgatccattattctaattttcccctagcattgccattatctaaaattatattgttctttatttattttcattcttactttttatttctctataagtcctacgtgagctgagactcagtttgttttgtttactgctctacccccagggtctaagacactacttgaaaattatttagtgaataaatgaatgaacaagaaatgcatttaacaaaactcacagacacataatgatatatgttcaagtccttatctatgagtgtctttgtaagtaacaaagacagacaactaataggaatgaaaactagggtagcgaagaggcagcaacattcaaacaaaagtattactattttgtttgttttgcctgtagcatgtattaagtccaactgaatctagaatacgttgccacaagaatgttagtaatgttagctagaatcttagtaatgttgaatgatttgcatggaagtttttcaagtcccttatctattgccaatagatagactttatttttggagcaaacctatttaaacattgtgaacagtcaacagagctcaacaaattagatatagaatgaatgttccacaacagagtaaaagccatatatgacaaccccacaactaacatcgtacctatggtgaaaagttgaaagctttttctctaagaccacttctgttcaacataatactgaaaatccaagacagggcatttaggctaaagaaagaaataaaaggtatccaaacagaaaagaataaagtgaaattgtctctgtgtactgacaacatgatgttatagaaaaaatattaaataatccaacaaaaaatgttagaactaataaacaaatttggtaaagtttcaggatacaaaatcaactacaaaaaatcggtaatgtttctatacactaacaacagactgcctgaaaaaaaaattaagaaaacagtcccaattacaaaagagttaaaaggaataaaatacttaggagtcaatttaaccaaggaagtgaaatatctgtatactgaaaaccataaaacattgatgaaaataaaaggtgtcacaaataaatggaaagataccccatgtttgtgaattgaaagaattaatattgttaaaatgtccatactacccaaagcattctatagattcaatgtaataactatcaaaattccaatgtcattcttcacagaaatagaaaaaaaaatcctaaaatttgtatggaactacaaaaaatcctgaataactaaagtaacttttaccaaaaagataaaaagctaaaaagatttttaaaaaaagattaaaaagattaaaaaatagataaaaagataaaagctggaggcactatactactggatttcaaaatatgttacaaacctataataatccaaacagtatgatactggcataaaaacagacatattgaccagtggaataggatagagagcccagaaataaacccatacatttatggtgaattgatttttgacaaaggtgcaaagatcatacaattgggaaaggacagtcccttcaaaaaatgatattaggaatactggatattcatatacagaagaataaaaataggctcttatttcaaaccttgtataagaatcaactcaaagcaggttaaagccttaaatgtaagacctgaaactataaaactattaaaagagaacataatgggaaaatatccataacattgactggtctgggcaatgatttattggatataacctcaaaagcacaagcaccaagagaaaataaagatatcacaaataaatggaaagatatcccacaaataaattcttttgtggattgaaagaattaatagttaaaatgtccatactaccgaaagcattctatagattcaatgcaatatctatcaaaattccaatgttattcttcacagaaatagaaaaaaaatcctagaatttgtatggaactacatgggcttatatcagattgaaagcttctgcacagtagggtaaacaacagagtgaagagaaaacccatagatcaggagaaaatgtttgcaactcatatatcaaacaagagggtaatagccaaaatatacaaggaaatcaaactacttaataagtagaaaaacaaataaccccattaaaaagtgagtaaaggactcaaatggacatttctcaaaagaagagatacaaattgccaacagatacatgagaaaatgctcaacatctctaattataagagaaatgtaaattaaaaccacaatgagagattgcctcacacctgttagggcaactattatcaaaagataacaagcgttggcaagcacgtggagaaaagggaaccctcatacactgtaggtggtattgcaaattaatacagccattttggaaaacagtatgaacgttcctttattgtgagatccaggaatctcagtactgtatatatatatccaaaggaactgaaatcagtatgttgaagagttgtctgcactcccatgttgattgtagtactcttcacaatagtcacgatatggaaacaatataagtgtccatcagtgcatgaatggatttttaaaatgtaatatatttacacaatagaatactattcagccttaaaaaagtaaatttgtcatttttgacaacatgaatgcaactaagaggacattgtcttaagtgaaatatctaatggcattttagtggaaaattatgtaggaccaaccatgtcatccaaaaactcaatattttatctttcggggctgaaagaagaaccaacatgactgaaaataaataaattaacagatggcatttgaatttatgataaaagtaaacaatagagaaattatggtatggcttaatgaatataacaagaggcagcaagcatctgaagggtgtgtgtgtgtgtgtgggtgtgtatgtatgtatttatttgtgtatttatgtgtcattagatataccattagcttctagatttctgcattaatacaggccatgcatggaagagctgtataaaacgcttttccctatgctattcggcagtaattttttgaaagtcagagatggctgcatgtaaatgttactaagttctaccaatctctaaaaatcacatttaataacaatttgccagactttcatttatagaaagaaacagaattatgttagaaacacaataatcagctatttgtcttttcaatatcttctgggaaaaatttgcagagttttaaaaatttaaattatcatggtggacatttatgtccttaaggtatccatgtaatatatagatagcaaaatatctttgtttcagtttaaacatgaaaatccaaaattagcatatcataatcaagggaattgcctaaggttgtctttctgaaaagaaatgacgtttaaaaatttttgttttaaaatcttatgataaaatcaatgggactttttcataacttagagaagaaaataaaacatctagcctaatgtgacctcccaaatatagaaattgaattccattttaaatgatttcttttgatctttggacatatgcctattctttgcacgattatggctggaattggtgagcatagaattgtgtgtgcacactaatgtgtgtatgtgtgcatgtgtgtgttttgcttaaatgacattattatttattttttgatcagtgaaatgtctatcttttctgaagcatgagttttttactaaatgcaataaatttagtgtacattcaatttttcaaaactatttcaatccactctatgccaaactacaaattgtaatgccataagaattatattgcatgtattttacaactccaatctacttattggaaggagggggtggtgaaacatatgtcatgtagctgttaaaggagatctttgccaggtacttctaaagaagattttaattcaggagaaaataattgcaaagcagagaaggtctgtgagaagaatctatcttgagcacttaagctgaaaccagaagtccaaacaatgacctctgaatcatgggggtcaccttgtatcctctatttatctttaaaattgaacttatcctgaaatgtttgcttaaaggcaaatgttatttcctgatcgagatcttataatgaattaatgccagagacagaacttggattaaaggaaagagaatgtcttttgacttttaggtccgttattatcaatatgtttagtttcatagcttgtctcctattggagtcttaattcctttaaaattggaatttcatcacactcatctttgtatcccttagaacaccaggtacaagatcatgcacttaaaaatgtattgacttgaataattttccagtgcagtctacttgtctacataaatattgttagcaaattagacatgaaatggtaacattattgaacattggctgcatcttaaccatcctgttaatttcatttgcatagtctttgttcaagtattttacagttcaagctttcttttggaccataatccaaacatatttaaaaagtaaaaatgaagtcctttgtgggtattttttactttcataggagaaggtgtaatttaaacctgttggttgataaaatacaaaaagtatcttgggatctaagtttttcttcgggataccaatttgagtggtctgtcactttctgcttacaacatactgtgcttatcaaactaaactccccaaaatggaactcacgagcctctatgatatggctcctgactacatgtccaactttaccttcagtcaacctatggcttctatattctcatgagtgaacgtattagctttctactcctagaatatctcaactttgccattttaggagttttcacttgctttcccatatgcctgaaatgcatatgcttgattagtcccgtggttgtctccatagcgccctacagttcttggatttaaatatcctagatatttaaatatcttgtaaaggggtgttttctgaccatcttatctataaagtagctccccatcagaggtacttgctgtcacagcacattttttatttctttcacaggatgtgtcacaataatgatcatattcagtagctgtcttctaaaacaaagtataagttccatgagtacagtaacctttttctacctttttcccgaatatacccactgcgcagaaaacagtgcccaatagaaagtaaaagtctaggaaatgatttctgaatgaaaaaacaaatatttactgaaaaactgtgacttttgagatcttaatttaagcagtaaattaatttgaagggtaaagtataattctgatacttttttgcatttttgtcttctctaaaaccaatgactagttagtatacatgttgtaagccagccaaactgcattattatttcaacaattaagactataggacataggaaattaggaagttttccaaagtagtaatggggataaaaaaagaattttttagctttgtttttattcaaacaagaaataactatattttaaaatttttccccatcaaaggtactgaatgtaaataagtcccttatgataccaagtattttttcatatctatatccattttaataattagtttatgcaaaagttcataaatttagaggtttgttggaaagttattatttctaatctcctaataagctgaaagaaaattatgacttcaaacaatatattgaaaccttattaagagaaactggccacgtgtggtggctcatgcctgtaactccagcactttgggaggccaaggcgggtggatcacctgaggtcaggagtttgagaccagcctggccaacatggaaaaccctgtctctactaaaaatacaaaagttagctgggcatggcggtgggtgcctgtaatcccagctactcggaaggctgaggcaggagaatcacttgaacctgggaggcggagattgcagtgagccgacattgtgccactgcactccagcctgaggggcaagagtgaaactatgtctcagaaaaacataaataaattaaaaaaagagaaactgtgggaaaccccccccccaaaaaaaaagaaagaaaaaaggaagaatagcaggagtctgtttttataggaatgtcatttgagcttaacagatctagaggttaagctttgaagagttttaactatatatgtgattctcataatatctatttcattcacaggaaaatcagaataattcttataaggaaatttgtgatcttaatatacagtactataatattgacaacatttcattaaaattataagtacttattggtttcctttcaaagtgtcatatctgtgccatttctatctgtatagcttttacaattataatttatatttaccaattttcctttttaacatgatataaggtatgaaagtgttttatcacttcctaattattttattatattttgctatcatctactttgctatcatctatgttctgaaatttatttatgtctcttatatctgtatggtggaaattttttttttattatactttaagttctagggtacatgtgcacaatgtgcaggtttgttacataggtatacatgtgccatgttggtttgctgcacctattaactcatcattcacattaggtatttgtcctaatgctatccctccccctgccccccaacccacaacaggccccagtgtgtgatgttcccctgtgtccaagtgttctcattgttcaattcccacctatgagtgagaacatgcggcgtttggttttctgtgcttgtgttagtttgctgagaatgatggtttccagcttcatccatgtccctgcaaaggacatgaactcatccttttttatggctgcatagtattccatggtgtatatgtgccacattttcttaatccagtgtatcactgatggatagttgggttggttccaagtctttgctatcgtgaatagtgctgcaataaacatacgtgtgcatgtgtctttacagtagcatgatttataatcctttgggtatatacccagtaatgggatggctgggtcaaatggtatttctagttctagatccctgaggaatcaccacactgtcttccacaatggttgaactagtttacagtcccaccaacagtgtaaaagtgttcctatttctccacatcctctccagcacctgctgtttcctgactttttaatgatcgccattctaactggtgtgagatggtatctcactgtggttttgatttgcatttctctgatggccagtgatgatgagcattttttcatgtgtcttttggctgcataaatgtcttcttttgagaagtgtttgttcatatcctttgcacactttttgatggggttgtatgtttttttcttgtaaatttgtttaagttctttgttgattctggatattagccctttgtccgatgggtagatcgcaaaaattttctcccattctgtaggttgcctgttcactctaatggtagtttcttttgctgtgcagaagatcttagtttaatcagatcccatttgtctattttggcttttgttgccattgcttttggtattttagacatgaagcccttgcccatgcctatgtcctgaatggtattgcctaggttttcttctagggtttttatggttttaggtctaacatttaagtctttaatccatcttgaattaatttttgtgtaaggtgtaaggaggggatctagtttcagctttatacatatgactagccagttttcccaacaccatttattaaatagtgaatcctttccccatttatttcttttttttgtcaggtttgtcaaagatcagattattgtagatgtgtggtgttattcctgaggcctctgttctgttccattggtctatgtatctgttttgataccagtaccatgctgttttggttactgtacccttgtaacatagtttgaagtcaggtagtgtgatacttccagctttgttctttttgcttaggattgccttggcaatgcagacacttttttgtttccatatgaaatttaaagcagttttttccaattctgtgaagaaagtcattggtagcttgatggggattgcactgaatctgtaagttaccctgtgcagtatggccattttcacgatattgattcttcctatccatgtgcatggaatgttcttccatttgtttgtgtccccctttatttcgttgagcagtagtttgcagttctccttgaagaggcccttcacatcccttgtaagttggattcctaggtattttattctctttgtagcaattgtgaatgggagttctctcatgatttggctctctgtttgtctgttattggtgtataggaatgcttgtgatctttacacattgattttgtatcctgagactttgctgaagttgcttctcagcttaaggagattttgcgctgagacagtgagctttctaatatacaatcatgtcatctgcaaacagggacaatttgacttcctcttttcctaattgaataccctttatttctttctcctgcctgattgccctggccagaacttccaacactgtgttgaataggagtggtgagagagggcatccctatcttgtgccagttttcagagggaatgattccagtttttgcccattcagcatgatattggctgtgagtttgtcataaatagctcttactattttgagatatgttccagcaatacctagtttattgagagtttttagcatgaagggctgttgaattttgtcaaaggccttttttctgcatctattgaggtaatcatatggtttttgtcattggttctgtttatgtgatggagtatgttcaatgatttgcatatgttgaaccagccttgcatcccagggatgaagctcacttgattgtcttggataagctttttgttgtgctgctggattaagattgccagtattttattgaggatttttgcatcgatgttcatcagggatattggtctaaaattctcttttttgttgtgtctctgccagtctttggtatcagaatgatgctggccttgtaaaatgagttagggaggattccctctttttctattgattggaatagtttcagaagcaatggtaccagctcctctttgtacctctagtagaattgagctgtgaatccatctggtcctaaactttttttggttggtaggctattaattattgcctcaatttcatggcctgtgattggtgtattcagagattcaacttcttcctggtttagtgttgggagggtgtatatgtccaggaatttatctatttcttctaggttttctagtttatttgtgtagaggtgtttatagtattctctgatggtagtttgtatttctgtgggatcagtggtgatatccgctttaccattttttattgtgtctatttgattcttctctcttttcttctttattagtcttgctagcagtctatcaattttgttgatcttttcaaaaaaccagctgctagattcattaattttttgaagggttttttgtgtctctatctccttcagatctgctctgatcttagttattttttgccttctgctagcttttgaatttgtttggccttgcttctctagttctcttaattgtgaagttagggtgccaattttagatctttcctgcttttgtgggcatttagtgctataaacttccctctacacactgctttaaatgtgtcccagagattctggtacattgtgtctttgttctcattggtttcaaagaacatctttatttctgccttcatttcattatttatccaggagtcattcaggaggaggttgttcagtttccatgtagttgtgccattttgagtgagtttcttaatcctgagttctaatttgattgcactgtggtctgagagacagtttgttgtgatttctgttcttttacatttggtgaggagtgctttacttccaactatgtggtcagttttggaataagtgggatgtggtgctaagaagaatgtatattctgttgatttggggtagagagttctgtagatgtctattaggtccacttggtgcaaagctgagttcaagtcctggatatctttgttaatcttctgtctcgttgatctgtctaatattgacagtggagtgttaaggtctcccattattattgtgtgggagtctaagtctctttgtgggtctctaaggacttgctttatgcatctgggtgctcctgtattgggtgcatatatatttaggatagttagctcttcttgttgaattgatccctttaccattatgtaatggccttctttgtctcatttgatctttgttggtttaaagtctgttttatcagagactagaattgcaacccctgcttttcttttgctttccatttgcttggtagatcttcctccatccatttattttgagccaatgtgtgtctctgcccgtgagatgggtctcctgaatacagcaccctgatgggtcttggctctttatccaatttgccagtctgtctcttttaattggggcatttagcccatttacatttagggttaatattgttatgtgtgaatttgatcctgtcattatgatgtaagctggttatcttgcccattaattgatgtagtttcttgctagcattggtggtctttacaatttggcatgtttttacagtggctagttctggttgttcctttccatgtttagtgcttccttcaggagctcttttaaggcaggcctggtggtgacaaaatctctcagcatttgcttctctgtaaaggattttatttctacttcacttacgatgcttagtttggctggatatgaaattctgggttgaaaattcttttaagaatgttgaatgttgtccctcaaccctcttccagcttgtagagtttctgcagagagatctgctgttagtctgatagttaccctttgtgggtaacctgacctttctctctggctgcccttaacattttttccttcatttgaaccttggtgaatctgacaattatgtgtcttggggttgctcttcttgaggagtatctttgtggtgttctctttatttcctgaatttcaatgttggcctgccttactaggttgggggagttctcctggataatatcctgcagagtgttttccaacttggttccattctccccgtcactttcagatacactaatcaaacatagatttgttttttttcacatagtcccatatttctcggaggctttgttcatttctttttactctgttttctctaaacttctcgctttatttcattaatttgatcttcaatcactgatagcctttcttccacttgatcgaatcggctactgaagcttgtgcatgtgtcacgtagttctcatgccatggttttcagctccatcaggtcatttaatgtcttctctacattgtttattccagttagccgtttgtctgatcttttttcaaggtttttagcttccttgtgatgggttcaaacatcctcctttagctcctttagcttgttattaccgaccttctgaagcctagttccgtcaactcgtcaaagttattctctgtccagctttgttctgttgctggtgaggagctgcgataatttggagaagaggtgctctcgtttttagaattttcatcttttctcctctggtttctccccatctttgtggttttatctacctttggtctttgatgttagtgacctaccaatggggttttggtgtggatgtcctttttcttgatgttgatgctgttcctttctgtttgttagttttccttctgacagtcaggtccctcagctgcaggtctgttggagtttgctggaggtccactccagaccctgtttgcctgggtatcaccagcggaggctgaagaatagcaaatattgcagaacagcaaatattgctgccttatccttcttctggaagcttcatcccagaggggaacccacatgtatgaggtgtcaatcagcccctactgggagatgtctcccagttaggctacacaggggtcagggacccacttgaggaagcagtctgtccgttctcagagctcaaacgctgtgctggaagaaccactgctctcttcagagctgtcagacagggacgtttaagtctgcagaagtttctgctgccttttgttcaactatgccctgcccctagaggtggagtcaacagaggcagcccaccttgctgggctgtggtggggtccaccagttctagcttgcctggctgctttgtttacctactcaagcctcagcaatggcggatgcccctccccctgccaggctgctgcctcgcaggtcgcaggtcaatctcagactgctgcactagcagtgagcaaggttctgtgggcgtgggacccaccgagccaggcgcaggatgtaatcccctggtgtgctgtttgctaagacggttggaaaagcacagtatttaggcgggagtgccccatttttccaggtacagtctgtcatggcttaccttggctaggaaagggaaatctcccaacccctggcacttcccgggtgaggtgatgccccaccctgctttggctcacccttcctgggccgcacccactgtccaaccagtcccagtgagatgaaccaggtacctgacttggaaatggagaaatcacacatcttctgcatcaatcatgctgggagctgcagaccatagctgttcctatgcagccatcttagaaccggaccacatcctctttcaaggtatgaaagattattgaccttattttgtctaggtggaggaactgtatcatacagtggtatatttgagctactgtgggactgatctagtccttctataaagagactatctaaatgccttataaatcttgatatttttctaagaagcactatctttgagaaaaaacttattttctggtaaataaaatgaggaaatatgaggggcaaatttgagagccttcatctttcaattattccctttaaagctcccatttgattttggattatgccacggtgaatgcaaacaaatcccacttttcaaatggaataatttattttcttaatgtttgtgtttcaacctaaaagaattgtttttatacctacatttgaaacttcagaaaacaagattcacagaataatgaaaaactacattttaacctaaatgtggaactgtgattacagacattaccgcaagcaagtgattcaaacaccacttttcctgtgtcatcttttaaacaccactgcagattttttattttgaacatgtacttggcttctgcttctatctaagttagaggaacagtaattggatgtacccttgtgcctgaaacaataacaagcaacaacaaaaacaaacagaatatatgaaacaagcttttttttttttttttttgagtctcgctctgtcttcaggttggagtgcagtggcacgatctcagctcactgcaacctccgcctgccgggtacaaacgattctcctgcctcagcctcccaagtagctgggcctacaggcatgcaccacaatgcccagctaatttttgtatttttagtaaagactgggtttcaccatgttcgcaaggatggtctcaatctcttgaccttgtgatccgccctcctcaacctcttgagaaacaagcatttttttaaaattgcaaaacactaggcaataaagtagaaggaacccagagagatgaaaaacacagtgctacatttgcatcattttcctgctttcagagaatttctgagccacaactcgagaaaggagagcccagatggaaattgatgaactctgtaaggtaaggaaatgaaaatgagagcacagggacagcaaggcttttggaattcacagaatagagctctggagaggagaaagatacagaaggaaccccaaatatttgcataaggtactcctcaagtattcatcagagtactgatcaggacatgcatgtgaggaaactgacatttgtagtaccatccatcaatagcacaacacatattcatttcaagtatacatgaaacattgaccaagatatatactaagccataaaataagtcttagtgaattttaaaagattcaactcacacaatgtatttctctaactaaaacaggatagacttaaaattcagtcagtccccaaatatttgaaaatcaaaaaaacccatggatcaaagaagaaataaaaaagtattttgaagtgaatggcaatgaaaatacaaacataggaaaaactaaggaatgatgctaaagcagttcttaggaatttacagcactatatgctgacattactgaagaaaagatgtctcaaattgatgacaccaacgatcactttaagacactagaagacatgaaaattaactcaacatagcagaaaggaaagtataaatagcaggacagaaatgatcaaatagagatgatgtcggtaatgcaatgttggtttaatatttgaaatcagacaatgtaattcaccatgcgaactaaaaaacatgcagaaaaaaataaagaagacatagagagctatacttgttcatcaacagaagactcaaaatgattaagatgtcaattctccccagacttatctatagattaaatacaatgccagttcaaatccttgcaggtcttaactgaagaaattttcaagcttattttaaaactcgtatggaaataaaaaaatatagaatcactataacaactttgaaaaagaacatatttggagtagtaacactatctgctctcaaggtttattatgatgctacaataatcaagactattggactggcataaagaaataacttggtcaaagaaacagagtagagattacagaaatagatccacatatgggcaactgttgttcgttttttttaaatttatcgtctttctgaaaaatcttcatagaaaactatttggtttagctctcagtagcctgcccctgagctgtgaggaagcttgccttcttttgagctacctgatctttcttctgagcaagggacattttgggatggttctatctcttttaacttatttcctgggcgtcttctcatagactagattctctcatatagcagcatgagctttcttatacatctcctccatgtctagagttatgccgttctttatatattgagaggattgtttcttgtaagcatcttcatcttcctctacttagtagcacatgtaatctgcgacattctggctgataatgtgcttccagtgtacttctgcattaaattccttgctttcagaatcataaccgggaatcgtttggtactgtaagggatagacaaacctccattcacagctccctcagggcgccagaaactttattgccagtagtagttctggcaaggccttcatctccagtcacctccacttggccttcatagatcttgtccataccaaacctattgagaagcctgtggtccagcagcaggccagtacaatacgctgcagcgtaatttgtcaagccaaccttcacgccatattttggcagttcatgtgcatatgctatgcagactatcatatccccttctatacaggcataagcaatatgacaaatgatatctgttacactatcatcctgtatttgggtgtttcctatttatttttatcctgtatcaccaagcgtttctgagcatagtaatcaattttaccgtcccattgtcttctaaatttcacttggtgtctcttaaagtaggccttagtcttaacaactttaatgaaccacatcctgcagagcaaatgcccacgtctgcggcttggcagagacttctaggctcagcagcgctaggtggggaaaagagggagcaactgatttctgatgaagttgatgacagggaggaacgggaactctcacacactcctggtgggaatgtaaaatggcatgactcctacctgtttggaaaatagtttaacagttttttagaaagtttaatatatacctacctatcatatgactcagccattatactcctaagagaaacaaaaacatatgtccatacaaagacttgtacccaaatattcatagaacctttatattcaatagtcaaaaactagaaataactcaaatgaccatcatccaaattgtagtatgtccatacaataaaatgtaataaactactgataaacacagtgtggatgaatctagaaataatgatactgagttttaaaagctagtcaaaaaacagtatatatggtgtgatcccatttatatagaactcaaaaaaatgcaaagtgatctgtataactgaaagcacatcagtggcttcctgtagagaggattgcagtgggttctaatctctcattataaaggagaacaaagaaactttcagaggtgatggatatgtttactatcttgattgtgataaaggctccagaagtgtatacatgtgttaaaacattgaattgtacactttatatgtgtacattttattgcagatcaattatactttaacgctgttaaaatatgaataaagcacgttttaaaacatttagaaatccaaaatatcataaattaaacataaattataaatgatgtagattgaatcaattataataaaattacttaaaaaagtgttatcagaaaaaaagaaaatggtactctactatggtcacaataaatctaatgaggagaaatatttaataacactgataaacactagtggattttgttcctggttcaaatctgtcaattcagtatttcctaagattaatattaatttattgtataaaacatttgtgtttagtcaattgatagactgattatttcttctaaatacagaggaagctttatctgggaattgcattatttcctagtgattcttactacctattctaataggacacaatttcacagatatattcttcttgatttttgactaagattttaaagaaataccgtcttttaatttttgattaatttttttctacaatcttagaatgaaaattttggagcagaaaagaccacagaaacctttgtaatatatctcctcaatatataaaagccagaagtgagctcaatttaaatggctaacttaggatatgaggagtaattggcaacaagtgctggaaccagatttcaagtctcataatatccagtccaaaactgtgagacactatgtaggtttcttcaacttgacatattatgtatgatagcagagtggattttctaaataggtggaagaagcctttaccttcgactgacagatttgctgagaaaagacaaaaaggatcacagcaggttcagatgaaaaattgacaggagcctccacctaactctgatactgactcagcatgagatatatagatgacagcaaccaatactctaaaaaaattatatatgtaagaaaagatgcagcctagcaaacacataaaagtatataactgtgataattattaataattattaataattgcagggcccaccagtcttctgtcagtaaattgattgtacacaggtttactgcctgagtaatttgtttatcttgcctgcatcagttattttgttgaattatcatcataataacgtgtgtgaaccagtcttcttaaaagtgtaaagactttggtctcttcttgttgatttatagtttagtcatgacagcagcaacaaccaccacaaaaataatagcaaatacttatagggtgttaaatacatgccagccccatattagcactgtataacacttcacatattcccactcctttaaatacttcaggtatttctaaatacattacatatcttaacttctttaattgccacaaggcctataagtttgatgctatttttacccctaatttacagatgtggaaacagaaagatccattaagttatggagcaagaaacactctggagataatactctaaaccactgttttaaactgtagaattaactttacaaaaaataaaaaaataaaaagctttagccaaaatttagaagaaagattgtactccaaactaatgctttctgctgatattggcagaatttttgcttgctgctctaatagttttctgtttaatgagcaaattgctttaagtacacatataacactgcggcattaaggataaagatattcagccaattcctttctcatctgtgatagttctagctctgcttatttgtacaatagcactttgaatttaatctttagaaaaaacacaagaaattgacattataaacttctttaaattaccagtgaataaagggggcaataaaatcagtaatttattaaataaagcacaatggaagcattcattaagatgtcatgaaaatgctaattaataatcaaaacgtatcctattgatttgagagcttttcagttagacttccagataacatctagaaataagcactgtacattcttaagtagagatttcatgactaggtcatatccttatatagcacccctcttttggggtgtaaggaaataccctgcagtgaatatcctctgaaagagactgcgttatgagaaaaaacacaaagattatcttctaggtcactaacaagggctgattattttatgtcagtcatattgctcttcttttttcctttttgtcttgataaattgtatcagctctccaaaacccagcttatctcatccctttaatttcctttagtttgatttgtttcttccttaactttccagaacattgaggtctatacatagcatctagcaccaatttatatagtatttctccttttggttattgattctaactacttggttgagcattaaatattataatatacaccctactggtggtgcatctgtctcatgtttctctagctccacgcacctatcaaagaactacaggtaggagaccctcaggagcactctgctccttttgtccactgaaaagaaaaagtgtatattcatttggaggtctttgcgcagtactctgttgagatctacagatgcagaaagttaagagtacagctaaatattatgtaagttgaaaatgattggtgcattcattaggtaagaaagtcttttagtttttccaatctagtcaaacttcattaccaaattatcttttatccaataaactcatttttaaggttgaataatattttactctgtgtgtgtgtgtgtgtgtgtgtgtgtgtgtgtgtgcatatgtatttgtgtgtaaccacattgtctttatccattcatccactgatggacacttaggttgatttcatgtcttggctatgatgagtaggaccacaatcaacagatgtacaaatgtatctttaatatactgattttctttctttggatttatccccaaaagtgagattgttggctctattatagatctatttttatttttttgaggaacctccatactgttttccataatggctgtaccaatttactctcccaccaactgtgtacaaaggttctctttcctcatattcttgccaatatgtatcttttatctttttgataatagacaatttaacaggtgggagatgatacctcattgtggttttcaatagtatttccctgatgattagtgatgacagcaccttttcatctacctgttggccatttgtttgccttccttggaaaagtatctactcaggtctgttgctcattgtttaatcagattatttgaggttttgttttttttcaactattgagttgtaacagtttcttacatattttggatattaagcccttatcagatgtatgccttgcaaacattttttcccaatccatgagtttctatttcattctgttgattgtttcatttgctgttcagatgaaaaactaacgaaacccactgaactactaaactacttaactactaaaactgctagccgggcgtggtggctcacacctgtaatcctagcacattgggaggccgaggtgggcaaatcacaaggagttcgagaccagcctggccaacatgatgaaaccccatctctactaaaaatacaaaaaattagctagatgtggtggtgggtgcctgtaattccagctactcaggaggctgaggcaggagaatcacttgaacctgggaggcggaggttgcagtgaaccaagatcacaccactacactccagccctggcgataatgcaagactccatctcaaataataataataataaataaataataatgaaaaaactgctaaaaagcagacgcttttagtttgatgcaatcccactttcctagttttgcttttgatgcctatgctttcactgtcatagccaaaatgtcatcgtctagaccaatgttaataagctttttccctatgttttcttctagtagttttatgatttttggaaatatgtgtaggtcttattccattgagttaacttttgtacatcacttgacattatgcaaagtgaagtaagccagacacagaaagataaatactacattatttatttctatatggaaccaaaaatatttgaactcaagaagcagagagtagaatggtggttgctgggctgtggtgaacggagtaagggggagatgttggtctggggatacaaagtttcagttacgcaagatgaataggctctggagatctaacgtacaacaatgtgactatagttaacagtactgtattgtgtacttgaaatttgctaagctcttattaagtgttctcaccacacacacacaaagaatcttcagggatcccaaaaagtttatatgaatgcttatgtaatttatttctccaaaatccatgtaaaaccccaataatactataaatgactaaataaatagtgtataaaaaaataacagaggctgggcgtggtggctcacacctataatcccggcactttgtgaggctaaggtgggcatatcacttgaagccaggagttggagaccagcctggccaacctgccaaaaccctgtctctactaaaaatacaaacattagctgggtgtggtggtgcacaactataatcccatctacttgggtggctgaggcacaagaatcacttgaacccaagaggcagagtttccagtaagccaagatcacaccactgcactccagcctgggcgacagagtgagactgtgtctcaaaaataaacaaataaataaataaaataaaaaataacagtgataacttgttctgatattctctggctgcattagaatcactaaaaatgattgacctatgaaattattaatgctacccatagtaggctaatgatggatcacttccatgaatctcatcttcctcgtctcttaatttgaattgtaactgccatgaaagaccttttctaattattttaaatttactgaattagctgtgaattaagactgaaaagatatatttggagattaataaagttcttcaggaaaggtattttatttacatatttattttggtataagattccctacatcttataattacaccatcagaaacacaaacctaacttacctttcctccttgcatatttagcaaatgccataatcatgcatggcctgttactttctgaaccatttcctattgattatatccactgaaatgttgacattgaatgattgctgaactctatctgtacaagcactgaaagtatttgaaagtagaaattactcttcaaatttcatttcttttatcttttctgttataagaacttatcagtgatttccttctgtatcccattatagaaatggcatcatgaaataaaatataagctgacagttctcagatttattattgtatttgatatattgacatttttaaagagtggtgctctgtagttaaatgaatccaaagagattaaatctctttaaaaggagtcagtcctctaagagtggaattttcttgccaatgcagcttgatcagaccatagttgggggtgggctttcagaaattgcaacacttttcatctgctcatctatttgaggcagtattatttttttgagtttcaatatcttaaaatactgatttttctatcaatcattacaattgaatgcattcacattagttgatttctatgaaagtatcaatatcaatagaaaattacatcttggaaatggatttgactcatgtacttgaaaaatcagtgtgtgaggaaatttaaaagtccagttttcattaattttagcacaaagtgttttattgaaacaaaatgcttcacctatctgtattttagtatttgttacatatgtagaataggtaatgaccaagtcaggtgattttgggtatccatcaccttgagtatttatcatttctatgtgttagtaacacgtcaagtcctctctcctagctacttggaaatatacaatacatttgttgctaactataatcaccctactgtgcttttgaatattggggattatttcttctatttaactgtatacctgtgcccactaatcaaccttggtttaccgccccccccaatcccacccttccaagcctctggcatctataattctattctctgtctccatgagatcaacttttttagctcccacgtatgcatgaaaacatatagtatctgttgtgctgtgtctggcttatctcacttaatgtaacaacttccagttccatccatgttactgcaaatgccctaattttattatttttatggccaaatagtattcctttgtgtaaatatactgtatttttaaaaaatccacttatatattaatggacaattatgttgattccatatctttgctattgtgaatagtgccgcaaagacatgcaagtgcaggtaggtatccctttgatacacatatttctttttctttggataaatacccagtagtgggattgctgaatcttatggtagtattatttttgattttttgagaaatctccattctgtcttctatagtggttatactaactttcattcccaccgacagtgtatgagttcccttctcctcacatcccgatcagcatctattaaattttttttgtctttttagtaagagccattttaactgggataaagtaatatctcattgtggttttaattttcatttccctgctggttagcaatactgagtattttatcatataccacttgatcatttctttttgagaaatgtctattgtcctttgcccacttatttatttatttatttatttatttatttatttgagacgttgtctcgctctgtcacccaggctggagtgcagtggcgcgatctcagctcactgcaagctcagcctccccggttcacgccattcttctgcctcagcctctcgagcagctgggactacaggcacctgccatcacgcccggctaatattttgaatttttagtagagacggggtttcaccgtgttagccaggatggtctcgatctcctgacctcgtgatccacctgctttggcctcccaaagtgctgggattacaggcatgagccaccgttcccagccctttgcccactttttaataggatttttgttgttgttgatgagttgttttgagtttcttgtatatttcagatattagcctcttgttgcatgaatagctggcaaatattttctcccattcaacaggttgtctcttcactcaacggattgtttccttgctatgtagctttttagtttaatagtcacatttgtctatttttgttatagttctctgcgcttttggggtcttagccatgaaatgtttgtaagattgatgtcttgaagtgtattttctgtgttcttttctagtatttttacagttccaggtctaatgtttaagtttttcatggatcttgagttaatttttctatatatagagagcagtccagattcattattttacatatgtacatctaattttcccagaaccgtttattgaagaggatgtcctttaccagcatgttcttaatgcctttatcaaaaataagttggcaataaatatatggatttacttctggactcactgatccattggtctatgtgtctgctcttataacaaaaccatgctgtttgtttgggttattatagccgtctaacatattttgaagttgggtagtgtgaagtcttcagctttgttcctttggctgaggattgttttggcttttcttgctcttttttggtttgatatgaattctataattttttttaattctgtggaaagtgacattcttactttgataggaaatgcataggatctatagatgctttaagcagtatgaaaatttaacaaaattgagtttcccaatccataagcctgggatactgaactgtagttttagtttgttgttgtgtctttgtctggtttggtacctgggtaatgctagcctcatagaatgatttagggagagttctcacctcttcaatttttttgaatactttcaggagaattggtattagttctttatatgtttggtagaatttggctgtgaattcatctggtcctgggattttctttgctgggagacctttcgttactgattcaatgtcactactcacaattggtatgttcaggtttttttttactttttcctaattcagtcttggtaggtgtatgttgtgaggaattcatccatttcttctaggttttccagtattttagcatatagttgtgcataatgatctctgatgatcttttgtattttgttggtatcaattgcaatgtttccttttctgattttgtttatttgggttttttctcttcttcacagcaatattggcctgtaattttgttttgttttgttgaatgtgtttttttgaatctctatgtcattgagctctgatctgatatttactatttctttccttctgataattttggatttgacttacccttgctttcctaattccttgaggtgcatcattaggttgttgattataaatctttctactttttaaatgtaaatatttactgttataaatgtcccttttagcactgcttttgctgtctcccacaagtttgggtatttttgtatttccatttttatttatttcaagaaattttttgatttccatcttagtttcttcattggcccaatggttggttatccagaagcatgtttttaatcttcatgtatctgtatagtttccaacgttcctcttactgatttctagttttactctattgtagtctgagaatatgcttagtgtgatttctattttataaaagatttgttaagacttattttgtgtcccaaactatggtttatcctgaagaatgttccatttgctgatgagaagaatgtatattttgtaattttggataaaatgtcctgtaaatgtctgttaggtctatttggtcaaaaataaagtttaaatctactgtttctattaaaagtgcaatttaaatctactgtattaacattttccactattattgtattgaagtgtacctctctctttagatctggtaatacttgatttatgaatttgggtgatttagtgttgggtgtatatatatttagaattgttatttcctattgcttaaacaatctctttgtcattatataatggcctttgttttttctttactgtttttgacttaaaattgattttatgtgacataagcatagctactcctgctcgcttttggtttccttttgtttggaatatctttttccagcacttcactttgagtctatatatgtctttgtaggtaaagggtgtttcttgttagcagtatatatttagatcatgtttctttttttttttttttttttttttgagacggagtcttgctctgtcgcccaggctggagtgcagtggcgggatctcggctcactgcaagctccgcctcccgggttcacgccattctcctgcctcagcctcccaagtagctgggactacaggcgcccgccactacgcccagctaattttttgtatttttagtagagacggggtttcaccgttttagccgggatggtctcgatctcctgacctcgtgatccgcccgcctcggcctcccaaagtgctgggattacaggcgtgagccaccgcgcccggcctagatcatgtttctttatccattcaaccagtctatgtcttttaagtggagaatttaatccatttacattcaaggttattattgatatgtaaggtttacttcctaccacattgttgtttcgggttgtgttgtatattttttgttcctttctttttcttctttcatttgctattgtggttaggtagttttctgtagtggtacaatttgggttgtatctcttcttcatttgtgtgtttggtttatcagtaagttttatactttcatgtgatttcatgatagtaaatgttgtcttttcgcttccagatttaggagtcccttaagcatttcttgtagggccagtgaagggccatcagtgtttgcttgtctgggaaaaacttcatttcccctttattgatgaagaataattttgctgtgcatgatatccttgagtgggaagtttgtttttttttaaagcactttgaatatgttattccattttctcctggcctaacaggtttctgctgagccccagtgttagtctgatgggagttcctttataggtgacaatatgtttttcttgctgttttatatagttttctctttaatactgactttagatggttggactataatatgctgtggataatttttggtattgtagctgtttggggatcactgggccttctgtatctggatgtgtaaatctgttgctggacttggaaagttttgatttattgtttttttaaataggatcttaactaaactcttgttttctcttcaccctcagggacattgataattcaatttcaaaacacccatattcaagttttgagattctttcttctgcttaatcttgtttattattgaagctttcagatgtatttttatttcatttaataaatttttcattttcagtatttctgattttttttaaataactattcggaaaatttctcattcatatcctgacttgtttttctgatttctctgtattgctttaatcatttttatttatctttctgagcttctttaaactcagcattttgaattacttttctgggaattcatggatttattttgattgggatatgttgttagaaaattatatttttgggaggtgtcatatttccttgctttttgatgcttcctgtatcctcacattgatatctgtgcatctggtgtagtagttgcttcttccaactttttaaacttacttttgcagagaaagacattttcctgaagatttatatatgttgttggttgggtagagaactttggcctcaattttgagtgcatgcgatattgtagtatctgtgatttcatcagctgtaaagtgtcagtggtatctttgaattcctcggtggcttagggcttagaacacagttattagtgaagaatgtggtaaagtcttactggggacgaggatgctggatagtccagtctttgagtcccagtggtggtagtggtgggctaagcatgccttaccttgagccgtagagcaatgtatgctggctctggtgttagcacattcaggcaggccaattcttgggcccccagatggctttctcagatgccagtagtggcagcagtaggccaggcttgtgtgtgggttcttgggcctctgggcagtggtgtggtgtgcataatggcataagcagtggtagcacaactcagtggaacaccaattcatgttggtgttggtgttgtcagtggctgcaacaggctggatgggcaagtcccttgacctgcagctggctcatatgggttagtgtctgcagtggtggtattggtaggttggataatcctgacctcagaccctggcagtagtgttcaagtgccagtgatggtgagctggtctggtaatccctaggcctttggaatgtgtgcttgggtactgttcagatgaaagctggtgagcagatttgtcatcaggacccctggtagtatgttcaggcactacgtatgataggcagaggcagaatactccccaggtcactagcagaatgctcaggttgggacagcagtggctgtgttatgagtctgcttctggggaggctggggccactctcattgggagcagcctaggaaggcagctgtggagctcatggtttgcttatgcactggtcctgcagtagcagcagtggtatttctccttgggacatgtgaaagttcctggccttccatctccctcctgtggcagctctggtagcagtggccccagggcagaatgcaggcctttgaagactaagctttctgaatggtaccagctatgggcctacaaccagggaaggtggggccactctcaatgacagcaacatagacaggcagctatgggacatacagttgcctcatatcttagtcccacaacagcccacagcagcagcagtggatttgttctttgggtgtatgaaatgtctggcttcccttatctctccctggactgactgtagcagtagcaccatcagctccagggcaggatgccgtccttttggaactgagctctcagaatggtgccatattgcagctgctcaaggctgagaagactgtgaaacccagcatgagctccctctcttaagcggtgcctctgcgcaatctgtaggcagctccctatgttagtttctaggctcgtgggtgccgaggggcttgctcttggctaagattgtgtaagtccatggcaggaatgtggagccctggggatcacacattttccctttccctgtgtctgggagcttcttccagctcccagtcaatcccaactgagaaggctgcctcatttccctttcattctttgactttgttgcttccaataatttctctgttgaatattggtgttctcttatagatgactcatttgaactatgaatatctacttgccattttggtgtcactttatggagaggcatataatagctgcatctagtcaaccctcttcccttatgacagccaaaatattattaattgaaatgccaactgtacttattaaagagcctagatctgtgatgagcagtgattcatgatttgccactgcaaacttgccatctatcaaaccttaactatagttaataattgaactttgttagcagcaagtcatgaatttagtcataaggactccaaagattatctgatatttgactatgtatactcaatctttagctggctttaaataacctgctttatgtttataggtgtcttccccaaagaagagagtttatcaaacaaaacataataatgctggtgatcttaatgcctctcccaatatgtttttctgatgccactacacatctagctagatttgactctttagtatgtagccaacattaatgactgttctaatacacacttgatttttatttcacagaatacaaaattcttgatttattggaaaagaatgataatgcctgtatccctgtatgagcacttgctctagccacggtcacagtgccatctgtctagggtctggggaatttaggcccattgatcatttggagaggttgaggagtaaaataaatagtacccagctctatcatcaagaggttagtgctcaggtctaccacttcactccatttttgataccagaatctctgctctcatcaccatcttctgacaagtttgaagtctggcaaccaaggagcaaaagtgggtggggcattattcaactaatggatccatgagataacttctttatcaatgcctgctttgttatacagcgaactctctgctaacactcataccatgagaaatgattttaacaaaaccctaaacttactccacactctaatgaaacagtttttgctagctagcatttattaagcgtatttttttaatcttactcacaataaataatttataccaacaattggtactcaaggaattttgaataccctccctccctaagctctccttaattggaacagaagggatatgaaggccagggacagtggctcatgcctgtaatcctagcactttgggaggccgaggtgggtggattgctttagccaaggagtttgagaccagcctggctaacatggcgaaaccccatctctactgaaaatgcaaaaattaaccaggcgtggtggcacatgtctgtaatcccagctacttgggaggctgaggctgcagaattgcttgaacccaggaggcggaggttgcagtgagctgagatcaagccaccgaattccagcctgggccacagaacaagactgtctcaaaaaaaaagggaaaagaagggatatgagattggaccagctgctctgttatatattacatattcacaaaccattttcttagccaccttcagttaatgtatttttaatttttatctttttaaattttagattcaggggatatatgtgcatgtttgttaagtggatataatgcataatggtgaggtttgggtttctagtataccaatcacccaaagagtgaacattgtacccaataggtaatttttcaaccctcatgctcctcccatactcccccttttcagaatcctcagtttctatcatttacatctttatgtccatgtgtactcatttgttagctcccctttaaaagttagaataagtgatttatgatttttatgtttctgagttatttcacttagaataatggcccccaactttactcatgtagctacagaaaacataatttcattcttttttatggttgcatagaattccatagtgtatatatgtttaatcctatcatccattgatgtgcacttaggttgatttcatgactttgctattgtggatagtgctgcaataaacatgtgagtatgggtgtcctttggatataataacttcttttcctttgggtagatagccagtagtgagattgctgggtcaaatagtagttctatttttagttatttgacacatcttcctactgttttccgtagaggttttactaatttacactcccatagtgtacaaacattctcttttctccacatccacaccaacatctgtggttttttgactttttaataatagccactctgactggtgtgatgtgttatcttattgtggttttaatttgcatttctctgatgattagtgatgtttaccttttattacatgtttattagccacttgtatgacttcttttgagaagtgtctgttcatatcctttgcccactgataatagtttggatgtatgtcccctctaaatttcatgttgaaatgccatccccaatgttggaaatggggcatagtgggaagtggttgagtcatggagacagatccctcatgaatggcttggtgcacacctcacagtaatgagtgagttctgtctctctctgagtttacacgagattgtttaaaagaatgtggcacctccccattctctctcttgttcactctgtcaccatgtggcatgctggctccccttcactttctgccatgattgttagctcactgaggccctcaccagaagcagatgccagcactatggttcatgtatacccagcagaaccacaagccaaataaaattgttttcttaataaattacccagtctcagtttttcctttatatcaatgcaaacagactaacacatgtactttttaatggggttgtttttgttattgttgttgagttttttgagtcctttgtagattctggagattaatcttttgtcggagtcataatttgcaattattttcttcaattctgtaggttgtcagtttactctgttaattttttgttgttatgcagaagctttttggtttaagtctcatttgtatatttttgtttttgttgcacttgtttttgaggtcttagtcataaattctttgcttaggccaaatgttcagagcagtctttcttaagttttcttttaggatttttatatttatttttatattttcaggtcttacatttaagtctttaatctacctcgagttaattcttgcatgtggtgagaggtatgggtccagtttcattcttctgcatatgactagcctgttttccagtgccatttattggatgatattgtttattatcattgtttctttctttccccattgtttatttttgctgacattggaaaatataagttggtcgtacatatgtggctttatttctgggttctctattctgtttaatagatctgtgtattttatttttgtatcagaaccatgcagttttagttactatagacttacagtataatttgcagtcaggtattgtgatgcctccagctttgttctttttgcttaagattgcttgggctatttggctctttttttttttttggttttgtatgaattttaagattgttttttcaaattctgtgaaaaatgacattagtaatttgatagaaattgcattgatactgtagattgctttggaagtatgatcattttaataatgttttcagttccaaaagcatggaatgtttttctatttgtttgtgtcatctgcaatttctttaatcagtattttatagttctccttgtggagctcttttaccttcttggttagatgtatgcctatatatatatatatatatgtatgcatatatatatatatacacacacacacacacacacatacacatacacacacacacacatatacacacacacacacacatatatatatatttgcatggcaattttaaatgagattgagttcctgtcttagttctcagcttgaatgttattgttgtatagaaatgtctctgattttttgtacattgatttttgtatcctgaaactctgctcaagtcatttatcaaagttaggagtcttttggaagagtcttagggtttctaggtataatatcatgtcagcagtgaacagagataaggaggatgatgatgaaattatcagaacgtagaaactgtatttttttatgattcagctccttgctgtgccctttagactagctggcaatggtagttttattggtaagtggaacctaaaggagaaaatcaaacagaaaattcactatcttgtaatgtctcagattttatctatagtacagaaaaggaacagagtcttgtgacaagggctgcattatcctggggaagtaagcagcaacttaatacaagaaaatgggctgaagggtaaactgtcttaatgattactgctgattatattgtaagcctatttgtattttatttttccctttaattttataaagtgttcttgggaacagttttagttttccctaggctcgatttctttttcaatcttgaggtgcaagaattaatatggtccaaatttggcaaagactgctctagatttttttcttggcaaggggcatagccatggtgtgagtcaggattagaggaatgaaattctcaggtagtaactctaaatatttgtgagtgcctagtcaggggtatagtatgaacaaatttggtatttttgtctattattttagtgtaacatttaattgaacagtgaactatgaggtaaattataagccctattaacagaattgtgaatccaaactttaagaccccttgtaaagtgaagtaaaaatcttggagtatctgtgagaaaagctcagaaaatcagtcagacagagggtgtgtagtaagaaatgttatagtcaggaatgaatgtacaatgtagtctaaataaattgtagacaaatagtaaaagtccaaatataatggacaaggctagaatctaaaaacaagtgtagtatactttttttttttttttttttttttttgagacggggtcttgctgtgtcacccaggctggagtgcagtggcgcaatcttggctcacttcaacctccacctccaggttcaagcgattctcctgcctcagcctcctgaatagctgggactataggtgcatgccaccatgcccagataatttttgtatttttagtagagatggggtttcatcatgttggccaggatggtcttgatctcttgacctcatcattcgcctgcttcagcctcaaaagtgctgggattacaggcatgagccaccgtgcccagcctatacttctgtgtaccacaattgtttccagtctctcacttttattaaagaaaaaataatagtaaaaaatttattggcaaagtaagttttaatctttttatacatggcctgattatttgcataaaatacagcaaaaatggtgattggccatataggctcttttaagttggctttgctgaaactttttaataaggaatctcaggttaaactttttaaaagtctcttcagattactcaagtcaatgatttatctatgcctgtagatacctgtatgaattgggtaaatttttctctttttgaagtatcagaataacttggtgtttctgggcctattagaaagtgacatttcttatttattacggttcagtaactttgtaaagaaattgcatagacaaggtacaaggccatttttaagggacttttatcaactttataagtcaactttaattttttaaagtagtctgatcatttctgaaaatatgtcattttagtcaaagccttggcaaaataaccggtatctctaattgtttcctattataaaagagaacagatttttattgaacttatgtaaataattaaattgccataaattaagaattctcacatatagtttttaaattctggaaaaattaggtagagagaaagaaatatgtttcaaattttgcttacaaataaacaattgcttatttgtaacaatttttattcaattgttaaaagctataaatatctcaaaagaaaaagattttctcccctctggaaaacaaaatgaaaaggatcagtaatcttttaagtaaaatttaaaaattattttagtcctccattggtttagtgttttgctggatgttgggttagcaatcctcatgaacacataagctttttaatgagagtgctagaagttttttatgagtccaatgttatgatttttaaaattattagaaacctatatttgagtcttttttacaaatttttttaaagaagtaaatttgtactgtagaagaatcaaagtaaaagctaacaattgtctatagatgacaaaagtcttagattagtcacagataaaggcataattgacaaggaaatttggttatttttgtgacacacaatttaacatgattatcataattattagtgataacataactaagacatttaagaattgaaccagaaagaaataaaaatcctgaacagacaaataacatataatgcaattaaaccattaattcataatcttccaagaaaaagaaaggcccaggagcggatggattcactgctaagttttaccaaatgtacaaagagctgacacaagtcttatgaaaactattcctaaaaatagaggactaaggattccttcctaactcatttaaaaaaaattattactctagtaccaaaatcaggcaaggacacaacaacaacaaaagctacaggccagtgtgtcactgatgaacacagatgcgaaaattctcatgtaccctaaaacttaaagtataataataataataataataataataataataataataaaagttagcaagctaaatccagaagcacatcaaaaagaaaatatatcatgatcacacgggttttagtgcagggatccaaaaataattgaacatacacaaaccaataaatgtgatttaccacataaatagatttaaaagcaaaaatcatatgataatatcaatagatgtagaaaaagcatttgataaaatccaacatcccttcatgataaaaaccctcaaaatctaggcatcaaaaaaaaaaaactacctcaaaataataagagccatatatgacaaacccacagccaacatcatattgaatggggaaaagttgaaagcatttcccctaagaaatagaacaagatggggaatatccactctcaccactcctatttaacatagtactggaagtcctaaccaaatcacccaggcaagagaaagaaagtaaaggcatccagactggaaaacagaaaatcatttcctggaatttatccatttcctctaggctttctagtttgtttccatagagatgttcatagtagtctcatgatcttttacatttctgtggtatcagttgtatgtcacctttatcatttctgattatatttattagaatcttctttatttcttggttaatctagctagaagtctatcagttttgtttattctttcaaagaaccaacttttcatttcactgatcctttgtattatgttttttatttcagtctcatttatttctcctctgatcattattatctcttcttctgctagctttgggttttatttgttcttgttttttagttccttgaggtgcaacattaggtcatcaacttgagatccttctatcttttggatgtagacattcaatactaaaaattttttcatagcactgagcttgctctctcctataggttttggtatgttgtgtgtctctttgcatttgcattgaattttttttttatttctgcctcaattttgttgtttgtttgcccaaaagttattcaggagcaagttgtttagtttccatgtacttatacagttttgatagttcctcttggtattgatttccaattttattccactatgttcccagaagatacttgatgttattttgattttttgaacttattgagacttactttataggcaaatatgtaattatttttgaagaatgttctacgcacagataataaaaatgtatattctgaagttgttgggtataataatccttaaatgtctatcaggtccacctggtctagagttcagtttaagtccaaagtttctttgttgatttctgcctcattgataatgccgtcatgtaatgactggtgatagtgctgtcaatggggtgtcaaagtcccccactatttattattgtattgctgccagtgtctttttgtagggctagtgtaatagtatttgttttgtgaatacttcagtttttttgttttggagatggagtctcactctgtcacccaggctggagtgcagtggcaccatctcagctcactacaacctctgcctcctgggttcaagcgattctcctgcctcagcctcctgagtagctggaattataggtgtgcaccaccgcacccggctaatttttttgtatttttattagagatggggttttgccatgttggccaggctggacttgaactcctgacctcaagtgatccacctgcctcagcctcccgaagtgctgggattacaggtgtgagccaccgcgcctggccaaatacttcattttatgaatataatgctctggtgcatatgaatttatgatagttaaattttcttgttgcattgaatcctttattcattatatagtgtgcttctttgtcttttattactactgttggtttaatctctcttatgtaacataagaaaagctactcctgttcacttttgtttttcttttgtatgatacagctttttctaccactttactttaagactgtgtcattacccattatgtgagtgtcttgaagacggcagatagttgggtcttttgttttttgtaattcaattagccagtctatctatcttttaagtggagaatgtatgccaactatgttcaaagttaatatttatatgtgaaattttgttcctgtcataatattgttagctagttgctttgtagtctcaattgtgtaactgctttatagaatctgtgagatttgtacgtacatgtgtttttatgatggcaaggatcatccttttgtatccatgtttaggactcctttgagcttttcttgcagggctgttctagtgttgatgaattcccttagcatttgattatctgggaaagactttatttctccttcatttatgaaattacttgtgtcaggatataaaattcatggatggcatttttttaaagaactccacaaacagtgcccttatttctttgagcttatggggtttctgtttagaaatgcatacttattctgaaggtattttcttaataggtaatgtgatgcttctttctagctgcttttaagattttttctttcacattgaccttagatagtctgaagacgatatgctttggtgatgttcaacttgtatagtatcttccaagtgtcctctgaatttcttgtgtatgataacaacactcctagcaagatccgataaattttcctaagtttgcccatcaaatatgattttctttttcttcttctccctcaggaatgcttataagttataggtttgttcactttacataatccagtatttaggttttttttcctttttaaattttggtttttaaaatttttctcttactgaattaattcaaaagagcagttttcattttttaacttttaagttcagggttacatgtgcaggtttgttacacaggtaaacttgtatcatggtggtttgttttacagattatttgatcactcaggtattaagcctagtacccattaggtatttttcctgatcttctctctcctcccaccctccaccttccagtaggccccagtgtgttttgttcccctctatatgtccatgtattctcataatgtagctcccacttataagtgagaacatgtggtatttggttttctgttcctatgttactttgctaaagataatgacctccagcttaacacatatccctgtaaaggacataatcttgttctttgttattgttgggaacaggccccccaaaatctggccataaactggccccaaaagtggccataaacaaaatctctgcagcactgtgacatgttcttgatggccataacacccacactggaaggttgtgggtttaccggaatgagggcaaggaacacctggccgcccagggcagaaaaccacttaaaggcgttcttaaaccacaaacaatagcatgagagatctgtgccttaaggacatgctcctgctgcagataactagctcaacctatccctttattttggcccatctcttcgtttcccataagggatacttttagttgatctaatatctatagaaacaatgctaatgactggcttgctgttaataaatatgtgggtaaatttctgttcagggctctcaactctgaaggctgtgagacccctgattttccacttcacacctctatatttctgtgtgtgtgtctttaattcctctagtgccactgcgttagggtctccccgaccaagctggtctcggcatgttatggctgcatagtattccatggtatatatgtaccacattttctttatccagtttatcattgatgggcatttaggttgatgccatgtctttgctgtgtgagtagtactgcaatgaacatacatgtgcatgtgtctttataacagaatgatttctgttcctttgggtatatactcagtaatgggattgcttggtcaaatggtatttctttctctaagtctttgaggaatcaccacactgtcttccacaatggctgaactgttttacactcccatccaccatgagtaagtgttcctttctctccacaacctcaccagaatctgttattatttgacttttcaatcatagccattctgactggtgtgagatggtatctcttgtggatttgatttgcatttatctaatgatcagtgatgttgaactttttttcatatgttcgttagctgcatgtatgttttcttttgaaaagtgcctgttcatatccgttgctcattttttaatggagttctttgtttcttgcctgtaaatttaagtttcttgtagactcttgttattagacctttgtcagatgcagtttgcaaaaattttctcccattctgtaggttttctgttatctttgttgataattttcttttgctgtgcagaatctctttagtttaattagatcccatttgtcaactttttcattttgttgcaattgcttttggtgtcttcatcatgaaatctttgcctgtgcctatgtccttaatggtattgcctaggctctcttccttggattttatagttttgggttttacatttaagtctttaatgtatcttgaattaatttttgtatatactataaggaagggattcagtttcaatcttctgtatatgcctcaccagttatcctagcaccatttattgaataggaaaccttttccttattgcttgtttttgtcatgttttcaaagatcagatagttgtagctgttcagtcttatttcttggttcttgattctgttccactgctctatgtgtctattcttttaccagaaccatgctgttttggttaccatagccctgaagtatagtttgaaatctggtagcatgatgcctccagctttgttctttttgctttggatttccttgtcaatttgggctcttttttggttctatctgaattttaaaatagttttttttttctagttctttgaagaatgtcattggtagtatgataggaatagcatttaatttataaattgctttgggcagtatgaccattttaatgatattgattctttctatccatgatcatggaatgtttttccatttgtttgtgtcatctctgatttcttagagcagtgttttgtagttcttcatataaagatctttcacctccctaataagctgtattcctaggcattttattcattttgtggcaattgtgaatgggagtttgttcctgatttggctctttctttgactgttgttggtgtattggaatgatagtgaattttgcacattgattgggcatcctgagactttgctgaagttgtttatttgtcaaagaagctttggggctgagactctgggattttctagatatagaatcatgttgtctgcaaatagagataatttgacttcccctcttcctatttgcatgcctttatttctttctcttccctgactgccctggccagaacttccaatactatgttgaataggcatagtgagagagggcatccttatattgtgccaattttcaaaaggaatgcttccagcttttgctcattcagtatgatgttggctgtgggtgtgtaatagatggattttattattttgaggtatgtgtcttcaatacctcgtttattggagagtttttagcatggatggatgttgagttttattgaaagccttttctgcatctgttgagataatcaagtttttgtctttagttctgtttatgtgataaatcacagtttcttaatttgtgtgtgttgaacttgcatgcatctcagggataatgctgacttgatcttggtggacaaacttcctgatgtgctgctagattgccagtatttgtttaggatttttgtatcaatattcatcagggatattggcctgaagttttgttttttgttttgttttgtttttgttattgtatccctgacaggctttgggatcaggatgatggtggcctcatagaatgaattaggggggagtccctcccctcagttttttggagtggtttcagtaggaatggcactagctcttctttgtacatctggtagaattcaggtgtgaatccgtctagttctgggatttttttggttagtaggttatttattgttgccttgatttcagagctcattattggtctgttcagggattcagtttcttcctggctcagtctcgggaagaggtatatgtccaggaatttatccatttcttctacattttctagtttatgtgcatagaggtgttcgtaatgttctctgatgtttctttgtatttctgtggggtcaatggtaatatcccccttttttgtttctgattgtgattatttgctcttctctcttttcatctttattagtctagctagcagtctatctatctattttattaattttttccaaaaaaacagctcctggttcattgatcttttgaatggtttttcatatctcaatctccttcagttcagctctgattctggttctttcttgtcttcagctagctttaggatttgtttgcccttgtttctctagttcttgtagttgtgatgtcaggttgttaacttgagatctttctttctaactttttgatgtgggtatttagtgctataaatttccctcttaacactgccttagctgtgtcccagagattctgatatgttgtatctttgttctcattagtctcaaagaacttcttgacttctatcttaatttcattatttacccaaaagtcattcaggagcaggttattcaatttccatgtaattgtatctttttgagcaaatttcttaatcttgatttctaatttgattgtgctatggtctgagagagtggttgctatgattacagttcttttgcattttctgaggagtgttttacttccaattatgtattttacagtatgtgccatgttgcaatgaaaagaatgtatatctgttgtttctgtgtggagagttatgtagatatctatcaggtacatttgatccagtgctgagttcagttcctgaatatctttgttaattttctgtctcaattatctgtctaatatcatcaatggggtattgatgtctcccactattactgtatgggagtctatgtctcattgaaggtccctaagaatgtgctttatgaatctgggtcctcctgtgttgggtgcatatatatttaggatagttagctcttcttgttgagtttaaccctttaccattatgtaatgcccttctgtgtcctttttgatctttgttggtttaaagtctgttttgtctaaaattaggattgcaactcctccttttgtctgttttccattttcttggtaggtttttctctatccctttattttgagcctatttgggtcactgcatgtgagacggatctattgaagacagaataccattgggtcttggctctttatccagcttgccactctatgtcttttaattagggcatttagtccatttacatttaaggttagtattggtatgtgtggatttgactctcattatggtgttagatgattattttgcagatttgtttatgtggttgctttatagtgtcactggtctgtgtacttaagtgtgtatttgtagtggctggtaacaatcttttctatccatctttaatgcttcctttaggtgcttttgtagggcaggtctggtggtaacaattccctcagcatttgcttgtctgaagaggatgttatttctcctttgcttatgaagcttagtttggccagatataaaattctggtttggaaattcttttttttttaagaatgttgaatattggcccccattctcttctggcttgtagagtttcagctgagatgtccattattagtcaggggcttctctttgtaggtgatgtggactttccctccagctgcctttaacattttgtttttttattttgaccttggagcatatgaagattatatgtcttggggatgatcttcttgtggagtgtcttactgaggttctctgcgtttcctgaatttaagtgttgccctgtctagctaggttgaggaaatcctcatggatgatatcctgaaatatgttttcccaattggtttcattctccccatctctttcaggtacaccaagacattgtacatttggtctatttacataatcccatatgtctcagaggttttgttcattccttttcattctttttttctctagtcttctctacctgtcttatttaagaaagccaggcttcaagctttgagattctttactccacttggcctattctgctattaatacttttgtaattgcattatgaaattcttgtttttaagttctgtcagggtggctatgttcttctctatactggtcattttgtctgtcatctcccataatgttttatcattatttttagcttcctcgcactgggttacaatgtactcctatagctcagtgtacttcctttccattcaaattctaaattctacttctgtcatttcagccatctcagcctcagcctggctttaaaccctctctgaagaggtgatgcaatcatttggagaaaagaaggtactctgactttttgagtttttagtattcttgtgctgattctttctcatgtttgtgggcctatctaccttcaatctttgaggttgctgacctttggataggttttttttttcttttatcctatttgatgaccatgagggtttgattgtgttataaggtggagtcagctgactagcttcatttctgggagattttagggggccaacactcagctctcaacctttggactgtgtactataattctgggggacttctattgggccccaactttgttctctggtttgaaccttgaggtttggagttcactttgccgggggaaccaaagtgtggcagctgcagcaaagtgcaagtggatacaggggttcctacctccctgagagcattcaccacagtggtagaggcaaggcagcagctgggacagcaggttgtggggtgtcctgctggagactgtgctgttgcactagaggtgatgttggctggtttattttttgttggttttcaactttctcttggatctcattgagcttccttatagtctatatttctaattttttatctgtcattttcaaattttcattctattgaggatccattgccatagaagtagtgtgatcttttggaggtgtcaaagcactctttttacactgctggagttactgagctgattccttctcttctaaagaaaccgtcattttctttctttctttttttttttttgaaattgctattgtttgcaagggactttatatttattttttcctcccttgaaggtgtgactgtagtacatattttgtatgatcatttggcttctgggtgcttttagacaaccgaggctctgtatgaattcattggttatagatagcttttgtgtggtggctttctcaaattctgcttgttgtagctatacattgggcatatgagccaattcactctcttctaggaggccaggaatacagggatctcaggtagctgatgtcctccctagcactgtgtccttctgtcagccactttttgttttgttttggtttttgttttgtttttggtgaagtttggtctccagtaggtggtgccagagccagtttccctttggatattgagatgatgtgtggaagcacctgccctaatgaagctcatggagggagtttgtggtgggatgcactgaggtttccagggtggtaaagagagggctgcaccagctccccatcctgggaagtcaggaatatgatccacttccatatcatgcccctatctcagggttcatggccttcagttcagatagtcactgtcctttatctccaggccacaatgcaacttaggtctgtgagaaatgcctgtctggtggctactgatgaaatgacctttcagcagaacctcttcccccaacaccaaacagatgactctgcagttagttggtttacactgttttgcagtgatgctgccactctgtgtagaaaggcagaaattagccccgttctatgtacaagcctaagcagtgggcacaccttcactgaggacacagctatcccaaaaaatgctggaaggaggacacttacggcaacctccaacaggaaaggccttggctacctctgcagcagtgtacgggacagtgggagatccatttctggccactagggtcacctatccactagggcagaacagtgccccctttggagatcagcactgttacctgcatttcctctgttccgaggagcgctttggcagtctgcattccccctctctccctctctctagggtcagcacactcgaaggactatacctctagggatcccacagctccccagggacctgatggacctctgtagttgccaaagtcaccgtgggttttgaggttccctgggtaggttaatgacccataacagatacacaaacagtgtggtccctgccacctgagtctgagtttggtgtgagtgtgagcacacatggaggaaatggctgcctcgtgctgtgcctgctggaagttcccaaattgccaccaacaaacagcattgttctgggttgattgataggggaaccccgacagtttggctgttagtagtctgtcacacaggtgagaggagcaagagatccccctattgtaaccttttgtcaggactctaacttcctctggggtcaatctctgccagattctggctgccttccttttctgcatcccaacttctttgtatgggttctccaacaggtttcagcacactttcctcagttccacttgggtcatgattattcacctgcaaatttgatcttctttctgaggagaaatggcatccaacatctctagtcaactgtctggggaaaaaaactaatttactttctaaatgtttccctttagttagttaagtttaaaatgtgatttcctccaggaaataatgataatctctctcttttgtggctgaaatgtatgccccactctacatagcatacttagagtcagtgatgtggatcccaccctcatacacccttactctttttttatttgaagtaataaaataaaaacctttatcaaatgaaatgagttaatactgacagcgtatatttgaaaatgaaaaattgtaaatttataagcataaaagtatctccacactaataagaggaattattcaaagaaagaaaaaatattttacatgggttttagtgtgtgaatcatttcctttgtgatgaaaatgatcgtgtttaatgatatgaatcatatcttttaacagttatgataaatcttctaaattcaaactgaaaattatatatcagagtcttccaaattaaaaacaaaagaaaaaccctcccagggtgagttagtaatttttagagctgtattatctctcagtttatgcacttgaataccacttggtaaatgtacctgctgcaccaaagtatactttagtttcatgcagagtaaagataactcattatatcctttttatcatttgaacatcaatggctatggaaaaagtaattttcatcctgggtaaatttgctcatattctcaaggtgtacatggacctgactttgagctgtgtgtatagggttcttggtatattatttagtataggtctagcacattccagagcagattaatcatcctctaaatgctcacttctcacaaacagaaaccaatgtatcgacctccatgtgccctaacctgctgagctgtgttgatttgatttatgggaagttgatcattcacactaataatcttttatcaccttatgtatggggagcacaaggcattgggttatttttttggcttttgcaggagtctatccttagaatacaacagtgatttataattatttttctgaagtatcatttagatattctaagcaaaaagtctcatacagtgtaatataattagtactctatttctgaatggactttccctttcttgctttttttgaagcagattatctaagctcatttctattgagagagatctgctaacaaagcattcaagttagggttatcactgtcaaaatgaagtggaaaatggcaacaactccttttttcattaaaagctaaataaacaaaaattcatttagtattaaaaaaatgatgacaggaagaaaaccaacaaagctacctgcgaatatttcattacataattttaaacaacttaactatagataaaattgttttcagtaaacaaaatactttaaaaaaaaacaggtaagtcaaatcaaacatttactttagtgaaattgaaattattatttacctacctaagtgtcatctttaagaaaatgaaaatcaccataaatatttgtcaatgctgcaatatatactaattattccaaccaatactactactatctaccaaactatgtgcattcctgaaaggacctttgtgaagttacattacttttcattaattttaaggactttcttttccctggatctttaatttacatgtgtcagagtgctcccaaggattcgattacttttcattttattctagaatgttgataagatatatttgggaacatttatctaagctgccatttcatttttagtaaaattaggacataaacatgcaaacattatacctccttgtaaggcttaaataggtcagtgtactgccctggcacatagtaagaattgcataaatattatctagtttgaaaagtttttataattcctactaattaacattcactagtttaaagtatttctacaaataatttttatatttttctcttttttcacatgacctctttgcaattcttctatccatattcttctccaagttctttggttttatttccaaaataaaagtcctgaaatgaacaatcagatctaaataccacattcaggataatgaccatgagcactgaatggcagcataacatttaatgttttattcttttgtttttaatttttaaccgctttttttcttctatacaactaaacaatggctcgtatctttattagctgcctgaaatgactcctaagtattctaaagagattattgctaattcaaaatatatgattatgcactggtaattattccaaataaatctacttaatagtagcattattgatttgtcaacttgcagcattgtatttgtatctaggcctaataattttgtatttatttccaatttttctgtggttcagtgactaacattgcattgttactacaaactagatgaactgaaaatcagcatgcacatggtcagttgcttctggaaataattttaattttgccttgagttatactttcttagaaatggaattattaccatcccatgaatatcatttttcacatacttaacatattttttcataagttagttccatttatgtaaatatggttgtagctgcctagtgttaaaacttatggatgacaattagcacaaatattgagttacatttacttatataggatttctaaaagtgctttgggaaaccccaagtttatactaagtgctaactttaatcttgtttccaagttctaaaacatgaatgacatcatgaagtctcattctgaattttcagtgttgatatttattcagcaataggagcaaagaccctacagtcagtctctgtgggtttgaatcccacccttatcactcactagagaaaccttaggaaagttacttaacatcttctcaaataccttgttgaatttggaatgactgcttttaggataaatggaggtaagaaaagaggatattccaataaagtggaacagtttaataaaggcatgggcaggagacccaaagaagtaattgattaagttaggggatgcacatggtgtaataagttggaaatgtttaaaaaaagtgggttcacattatggaagacattcttgaacatccagagaaatagttgggcgaaaggtactataatgaaagctgttttaaaaacactacaagagtaactcatgcatgaggaaagaataaaaaatgaatgctgttgaagcaagaaagtagctactgcattcagcctgatgggtagtggagaaggttaaaccaatatgatactgtattaaaaaaaaaaaagaaggaattggaaaaatatgagagaattctaatgaaataattgcacggatgaatgcttctgagcccatcacatcctagtcacaattcctggtttcatttattttgtttcactgtttttcaatagcaagagaggaattaacagctaactgaggcaagcatcagcacagaggcagggagcattaggggtggagcagtcagggaacaggaagactgcagtgtcatcttgagtgacaccaaagaatatagccccataccacctatttcctccatctgttaacaacatttctcaaaaccagggctactgtcaaatttataaatactgttatttctaaatgtatttaactgatttaaatatgtttgctactgctggttcccttataatctccatttataatatttaaaaggttctgtgttggcattcagatggaagaaaaagcatgagaaatttcatcttgaatatgaggttatctaaggaaagaattcggttagcttcaggtgaatttattcttcccccctccagccccatcttttttatttatttatttatttatttatttatttatttatttatttattttgaaacaaggtcttgctctgtcactcaagctggagtgcagtggcacaataacagctccctgcaaccttgaactgccaggctcaggtgatcctcccacctcagtactctgagtgtctgggactacaggcgtgcgccatcatgcctggctaatttttaatttttttgtagagttggggtctcactatgttgtccaggctagtctcaaactcctagactcaagcaatcctttcactttggcctcccaaagtgttgggattacaagcatgagccactgcacctggcccttctttttctttttaccaaattatgcgtaagtatttccctgattggtttggggtgtttcgatttagtttaaaatagaaatatatgttttaaagtagtgcagacctctagcttttaatccagtgacagcagtaaataaaatgagatttgagaatatgctgtcattgatctgccctagcttcttttgttcatgaaggattaatagagaagaggtgatttttcagtcttctgtataacaacttctttggttcaatattacaggagccttgggtcactgtggtgaccatgttccctttgaccttttactttttgggttttttttttttttagattttctttgcaatttatgaacctcaagtgtcttaataagtaagtgcctctgtaggtagcctattgtgcagagttgcaataaaggaaaacactactagaaatgcaacacagcactaatcccattaacaaatgcagccagtgtcagagataccataagaggcaatttgactgagatgggaggacatcccacatcgtttatgggctgttgaacaagagactttcttagcctcatcagcaggttagctgcatatgaatcctcatttttatttagggacagagccccttgcttataatgctattggtcaaaaatgagcagtttttactgttgcctgcaacgttgctagcaccttatttggggctctttttataaggacccgcgatgaaagttgtagatggtaactgtgaagaaatctcccctccctatacccaccttttcaggctctgagatttgaataaaataacttttatagaaaatattttctatattaaattctataactctaatccaaatttgtagatcctcaatcttaaataaataagcgtagttttcttcaattttttatctaggatattttgtctcaagatcctatcaatgttacataatataaatcctcatattctcaccctgacccactaacttaacaagcagctgatatactgcccccatcttggccattctcacggattctataatacttctacagccacatctgctgtttccagctctccactaaatcatcaatgggcctaattttgccagaccctaggcccttagcactgtgatccaaataagttaataagaaatctctaattattggactagtagcaaaacttcatgcaatgggcttgggctgataatgcaacacaaacagtaacatccccttgttagaaacatcccaggttgccgtgcctgctgctgattcctgaatgcaaattgcaggtatgtttgggctctagaaaattagaaccagaaccccattagacaaaatcaggtatcaactcctgatttcacagttgagaaaaccacatccaagagtgttcaattttctgaccaaggtcacacagagactttgtgtcaacataaggccaagaatttaagtcttctgacttccggcctaatgttctttccacttcattttactgccactaagtccaagtcattaacattaacataaaaataatttgagcacatactccattgaaaacagactacattaaaatatcaaagatgtgaactgaaacatcagtctcccaaatggagtgagcacaaccttggatcgttctcacgttttagagagatgcctgtcagtcacttaagacccttaagattcccgaacccatgttaataaatttctagaatactttggatgctttagactacaaacatactagtaattactgctaaaaataatgtaaaaaatggaagctttattagttcacaaaacaataggccagaggtggtgaaagtccagagttagttaattcatcagtttaacaatgtcagggttctggttctctgtgattgtatcagctttcctttcctgatgccactatattcccaggcattagacacaaccatgggcaggggaaaaagtggctaatgcctgcctgtggcccttttctcagagttgagaaaaatttttccagtcaccttccccagtatattacagctcattagtcagaactgcatcacatgtccttgcctaaaccgatcgtggtctagaaaatggaattaccacaatttttttagagtaatcaacattcttgtgaatcagaaagccttcaagtatcttgacaaaatcagaattctgttggcaaaaaagaattaggatgtatgtaagggaggatggtgattgattcatataattgtgctatatttcttaattaccaggcatatggttctttttaaagatagttatgatgtaagatatcaggatcctggattcatcagcatctaacaagttactacttctggtggccaaatctggaagcgtctgttgcatgcaataacatggcacctgggaatatgcacttctgtgcccattatgactgatatgcgatacttggaagaatcattattctactcacagaaggaggaaacccagcaaatgttagagaacaagacttttaacgtaagcagtagtggaagatctgatttactcaccccagcccctttcccagatgtacttgaataaaagagtgagagtgaattcttttttttttttttttttttttttttgagacagggtctcgctctgttgcccaggctggagtgcagtggtgcgatctcagctcgctgcaacctccgcctcctggattcaagcaattctcctgcctcagcctcccgagtagctaggattgcaggtgtgcaccaccatgcctggctagttttttgtagagagatggggtctcaccatgttggccaggctggtctcgaactcctggcctcaagtgatccacccaccttgacctcccaaagtgctgggatgacaggcatgagccaccgcgcccagcccagagagtggactctttaacaatcaggctttatagtgcttcaaaatttagaccaggcctaagcaacagggtagtagggtaaggttgcaagtgggcaagcagaggtaacaacaggcaccttgtcttccaaacacacggagtagactaacttggctctagccgacagctcctgacagaggtgttgccagaacccgagctgaagtagaggcaagcctggagtgaggatctagataagttatgagcaactaaaagatgctacccttttccagctttctttcataaaaatcttactttttacgttatttcttctaaagctttctcattatgctgctagaaacccttctaaagatatattaccttaataaactagtgaaacaatgccagttttgaaaatgtgatcaggctgagaacccccttctccttctccccacttatgcttcaaagaagtggagaaaaggactgctctacctatggagtagccattctttattctttcctttcctaataaacttgcacacacacacaccacacacacacacacacacacacaagaagtgtagaaaagatctgaaaggtcaggttgtgtttagattctgaagggtttcctagtgctaggccaaattatttgtagtctatataatgcactaagagacgcagagaggaggtatgtacagagtagggaaagaatgaaaccagggtttcagagacattaatgtggttgggctgtgtgggagagaagagcagaagagaagagactagggcagaataaaataaagaagtgataaaatcccaaaccagggaaataactgaggcagaaagatccactggaaaaaaaaaaaaaaaactataataggaattaatgaaggactatctatggtaatctaggtgaaagtcatggtagaagttgactctagtggccaaggctgggtgacagagacaatgacagaaatgaagattatttttttaaaggagcatcagtggttttgttttcctgaccacaatattttcttgaagaaaaagatggcattcttctcttcctcacatctcatatttgtaaccccagaatatctcatacaatgcctggaacacaatatatgctcattaatattattgaagaaataggagcttgatttgtcatttagttgctgtcaatatgtctctgatactgtgatactgcagtggtaaattaacaatgaaaactaattttgtcaagcatttttcaggatatgcttttcaaatagctgccttcatctatagcatagagcatttctctactgcctcacatcttaaaatgttactctagcaccatctctagtgcgacaaaattacacacaggatacaagctcaggtgaaatcgttctgtcaatttcagtaagcttatacttattttctagactcctctgtgttctagcccctaccaaacagtccagcttcatctcttgctacttcaccttatcgctaaccctaaattcttctatctagccacagtgactcttctgatttctcaatgccatgctgttttctttgggtccttagttataggtagccacctttgcctggaaatgtttactccacttttacctttatgtggcacagtcctgctctttttaagcttttagctcagttacttccttccagaacttcttgtactcctacatatggggtaagggcctcccttgctcccatgatactctagcctttcttcacatagcatgtaccatactatttaattgcctgtttgtctacattcctcctgtatgaaccatattcttgtaagccccaagcatatatcctggttgtattagtccattttcatactgctataaagaactgcacaagactgtaatttacaaaagaggtttaattgactctcagttcagcatggctgggaaggcctcaggaaacttacttacaatcatggcagaaggtgaaggggaagcaagacaccttcttcacagtgcagtaggaaggagaagggctgtgcaaagggggcagggcgccttataaaaccatcagatctcttgagaactcactcattatcaggagaacagcatgggggaaactgcacccatgattcaattacctccacctggtctctcccttgacacatgaagattatgtggatgacaattcaagatgagatttgggtggggaggcaaagcctaaccatatcacttgtacttagcagttgctcaataaacattgtgaaataagtattgtgaagtaaacactacgaaattaattaatgaagaaaataaatgtaaagtatgttggttggcaaagttagaagtatttgttaaaaagtccattaatgatcttgtagaatcacgtaaacatgttgatatattagtataaatatattgcctacagattggcatacagtacagtgaaagtactacagtaagctgtacttggtctattttatgctccctttttcttcccaggaaaaaagagaagaataagataatggctatcagagaaagaataattggaacaccttagtcttaaataggtttgtttgacaagagtatgattaaaataatttcacatatagagtttaataaagcaatgacaaaagaaggaaaaatatcttcatatagccaaagagaacaaggaatttgcaaaattcatgaatagacatgaatagatgagaataaatgatgattggatatttaactattttggccactgaagatattagtaggcatttgcatagaaggcaaagcaaacattctttgctgatgttaatattcaggtttacaaatcactgtggtaagcacagttctgcccaggaacacaaagtgtgcgttcaacctacacagttgaaggcagtggctctggttctgccctatttactaggccacaattgctctattccccaaattgttctaatttacttaaagttactatatagtcaaaagggaatttcttgaattgtaacatttaattattttagacccgagatttttattttagtgtacagaaatactagtttagattccaataagtctgggacataatttcctttgtttactagactataatttgtgcttattagactggtatattattgaaatcaaataaacactgtaaatgaactctgtattttgtaaataataaaatattgataagaaaattcaaaacagtttcaaagtcattaataggtatattgcccaaataactccacttgtccttaaggttaaacctgtgttttgttgagaaagcctgctatacccccaatctgaattagctgctttgttttgtgcttctacaatactttgtacatacattattgttttagtcttccttattaatagataacttttaagtttcaaaagttacacctgcatttctgaaacaaatgaaaacatagttgtatgaaaagagataattttgtggattttcctccacatgtttctctgtcttggacatatttctatccatgctgttagcacactgacttaaaattgtttgttttagatccccctcttccattgaatctcacctcacccctggctgcaagttagaatcaccaaggacatttttcaagacactcaaatataccaacatttcctccctaaattctgatttcaatggtctgaatgaggtgaaaaccaggtgttacatttttaaaaccaccccaggtgttcttgctacttggtttatctctgtattccccatgttttattcttcctcttcttgaagtctcataagaaaatggtacctatagttgttaaataaattgattgtttttaaagagataaaattgccttaattggactagagaataccaaatctatttctaatttgcatacagaaatgcctcaccttaggcaaaaaaaaaaaaggcatcagaaaaattgaaagcaaaatgtattgccaaaaaataaattacattttcttatagaatttatataaagttggggtatattttagatggaaacatttggctctaacaagttaaattataagttttgaatatttcaagtataattaaattatggttcaaaattaacctgcacactcatctaccaccagaaaaatactagccattatttataaaaatcaaaattactcagtgatagttacttctccagggaagaaggtgagtcggtaataagctatgcccccataaccttacaatcacgctgggaagcagcagccagtagccaaactgcatcctggtggcactgactgatccttctgggaaccaagcccatgaccctagttttgtttcaaactcaaacacagaggatccctgcaaatccggttactcactgatgtgagaattcattttttcaaataaactgaaagctatggagtcttttttgggcactctagtccattacttttagctctttcatctaaaggaatttattctgcactttgttgcttattctctactgctgtttcttgattatttgctgaaaggtacctatcctgttgaggatggctgttgatattgcgtatttagtatttgtcctacggtttttatcctaatataaaaagcctgttctttcttctgtgctctccccgtctctctacctccgctgagcttcagattgcttttaaagggtgacctggcacacttctgtgtgcatgcactggtattacaaaacacaccttcccatttacttgtgagattaaatatatatatatatttatttatttatttatttatttaaagggattatgcttatatttaagaaaagaatttatgtctatataaaggaatatccatatcaagtattaggtcatatttatctcaagatgggaaataggacatattttaactacatgggtgagtagagaaataagtagtttaaactgctgttgtttgacttcccaagctggccacccctaagtgtattaaatcaaggatttttctcagcctagaaagttaaatagcaggtgtagtacttaatgaactgcagcgagttggacttattggtgtggcaaatagattgcgatatttctttccaattaaagttcttttgcaaagatcaatgaagcacattttcacaaattgaattacactaaactaataaacaaaattctcccattcccactgatggcaaattattgtttccttaacatttaaaatcccatcacaccattaattataaaatgcaagggctaggaaagatcaaatatttatttgctcatgtgtttctattttacttccaattttataagaaaggtaagaaacattatatgtaaagaaagctgcataagaataattttccaaacttgaatttttttggtctttgatccataagcactttttatttactaaataacatgcatgtcctaatgattaaaaggtctgatctttagtaaattagaaaagaatctgctatagagtaacctttaattaatgaatgcatggaacacatttacatcagaaacaatgggcttgatagaaaaatgaaaatagcttaggactttgcctctagaatcagtgagctgcttcagaaaaattaaaatattagtttagcaaccttaaatgtcattactttactcaaataatgcataaatgttatgatattcattttctaggacctcctcacccttcacctccccttgatatttcttttcaagtatactttggaagaaagtttatacttttatgtagttttcattttaaagtttttagtatttcaatattgatgcaggataacgaaaatggagtaacctcagaagcaaagaataaagctttaataggaacttctgttttcaaaccacaaaaggcaatatttggtgaagatgcacatgcaagatttcctctctaagaatatcctaggacttaagaagactttcccacaccgtggtctactacttcaaaattttcccagttgctcatgagaggatctgtattttgtgaacattcctagcatgatgaagagcctatcaaatagtattcccaagcctagtggcattttggtgacttgccaacccacgtctgtgtagcatctccaaagagatccagcataaagggaaaaaaaatagaaagaaaaatgtaaagaaaagtttctgatattccatcccaccccctcctttctcctcctctactaactccatgtttctctttagtggctcatctatgcagacgacttttggatttttatgggtcatttgatttaatttaaacagaaaatatgctgtgggtgtttgtcaaatttattttgcaaataaacaaacatacacacaggcatgctcaaaggcatgtcatttgtgacatacagttgcacacagaatgtcaaatgcatgtcataaatgaccatctgctaccattttatgcaggaaatgacattttaataccaaaaatagtagaaaacccataatatcagaaaaaatatttctttaaatgaaataagtttagcttcccaaacttacttatttttctcatttcttcatacaatggtgatgtttgtcataaatcaacataagcccacaatccagcttttgagaactacaataccaaatgccgtggctcaaccctttgtactaactagaaaggatctgaattatttctcaaagcataatatgcctactacttaccagggatcttgttaaatggacgtgctggtttggtaggtctaggagttgcctgagactccttatttaacaagctaccagatggcactgaggatgctcatctgtggaccaaacttttagtatcaaggaacaaaactgttttcttcccagtgttaatagctagcctgtcagccaaggcattattctttttagaacttttaagtatgtgtgttgggggttagtgggttggttattataatgagaagccttaaaaacccaaataatttaatctgtaaaaatgatgtaatggggcatcatttggagggataatatcttcttaatctagtaacctaaaccagaccaaacttaatttgtttacaaattatcttgggtcaaatcatgccacattaagtatcattattcttattctagttggcaatatcctcaccaacatttgtttctgattaaagcttctttaaattatttccagactattccttattattgattagctttttttttttacatgtattccagttacagatgaagcatagtattcgtatgacatccaatactttttcactggttagcatactgagataaaaagcagaaaaggaaatagagatattgattttaaaggaaaagtaacttccatttttgtagtattttatgatttccaaagggttaaccacaattaaactgccctccatgagcataggaatcatgcctgtttctccaaaactagccctagcacacaagaccagtgcctggccaataatataataggtatagtggattgaatagccccttccatcctataatgtgtcaatgtcattttatctgtatatagtggattgaatagcccctcccatcctataatgtgtcagtgtcattttatctgtaaaaagcatctttttagatgtagttaaggatcttgagatgggatcatcctggattacccaggtgggctctaagtctaataaaaagtaaccttatatgagacagaaaaggagacaaaacagaacagaagaggaggcaatgtggaagttgaagcagatactggagtgatgcagccaaagccaaggaaggctgcagccactagaggatggacgaggctaggaatagaatctcccctagagcctctgaagggagcatggccctgctgacaccttgattttggacttctaaccttcagaactgggagagaagcaatttgtgttgttttaagccatcaagtttgtgaaaatgtatcatggcagccacaggtaactaataacagtaaaaaagccaatattcatggaatgactgaacagctgaagtaggacagatatgagaaatcataataagaagagagaaattcagagtggcagagtaagttgcctaagtttgctcagccccagcatgatagaggtatttgtcaaatatctttttttaaaaagtcacagtacttccggccgggcgcggtggctcacgcctgtaatcctagcactttgggaggccgaggcaggcggatcacgagatcaggagatcgaggccatcctggctaacacggtgaaaccctgtctctactaaaaatacaaaaaattacccgggcgtggtggcgggcgcctgtggtcccagctacttgggaggctgaggcaggagaatggtgtgaacccaggaggcagagcttgcagtgagccgagattgcaccactgcgctccagcctgggcgacagagtgagactaagtctcaaaaaaaaaaaaaaaaaaaaaaaaagtcactagtattctgtatactagtgttggtctactaaaacttataaaatctgactagtttttaaactcttacaagccatccacagaagacaaaatgttagataaaataagattgtgaatatctttctctagagtaaaattaagcatttttataaatacctttcagcatccagtttttaagaagtttaagaattataaaatgttcacattataatcaaactggaccatgtttgtgagacatcagtgctcctgatcgtttaaacaatgagttagtccaattgcatgataaaaagaggaagtagttaagaataaaggtgaggcaggaaatttttgtcagaagacagacaaggatttgaatcatggctctaccatccaggtgcagtgagactttggccaagttacttaacctctctgtgcctcagtttcccaggaataaaaattataattcttttgggacatgtaaagattaaatgagaccacatttcaaggctcagactctggcatattgtggccattactatctagcaacaagcacacagtagaatttgatcagcatttgttgagtgtatttattcaaacctgcagttggactataataaactaagataatttaactgccttttggttgctcgagtcatctcagggcaatagtatactttttaagtgcaattcaaactattaacttagctacatgaagtcatataatgtgcagattctagatatcaaattttttttttttttgcatcctctcttgggtcatgagactttcaaaggactaccattaagagatcctgcatttgagaataagaagaaaaactttggtatagattcttttttattcaaatgcccattattctgaaattgatttactcttcctgatggaaaagtataaaatttgttggcctgcaggggaatttgcaaaaggcctatctggttaataagtcacttatctaattgatactagagtatcagcagggtgggttatgaaatcatgaaacaaatgatctgacagtcaattaattctgtttcatctttgtgtatgttcctagaggctctatgataggatccagtttataaataaaaaataaagagatgctttttgtctaggttaaacttgatttcattctgaacttatattgtacagttgttcatgagcatgagttaattgacaatgtttagcagtctttttttttttttccttttttgagatggagtctcactctgtcgcctaggctggaatgcagtggtgcgatcttggctcactgcaacctctgcctcctgggttcaagtgattcccctgcctcagtctcccaagtagctggggctacaggcacctgccaccatgcccagctaatcttttgtgtatgtattttttatagagatggggtttcgctctgttggccaggtcggtctcgaacttctgacctcaagtgatccacccgcctcggcctcccaaagtgttgggattacaggcgtgagccaccatgcccaacgtgtttagcagtctttgagaaaattttggttgaaggacattgtgttggatccaagtatactttggacacctgagctcccgcaatttccttgcatgagctactgaaagatagaaattacacacttgggcagtgcaattggattgaaatggatttaaatctcgtatctcaaattctatctatctttaaatctattattttataaaattatatagttcaaaatgcacatgagaaaaaagtgtctattaatctgacaattttcaatttatcttttgatgatgttattaaaactatccaaatctacttttggttgacatattctcttctaacttcttcatgaaagcttcaattcatgtacatgtgataataataataaaagttaacattcattgactacttattaggttctaggcacgggggaaggcactttatgtatcatttatttagtgtatgtggtttttttaaagcttggagtgactgttcaggaaactagcctaaatttttcattatatacataagaaaactgaggcacagagaagctaagttacttgattagccgaggatacaaagatggttagaatgtaactttgtagcatcatatctttgtgacaaaaagaacaatagccaatctgtgacgcaaaaacaaaggcggtttctcattccattctgtgcaaggcagagctgctcagagaacaaagctgtctttgaagctggggatggctccatctcaaatcagctctgtggggtgcagagtatgacaagatgcagccaacacagcagaaaatcaagttcaaaacactcaagttatttacaatcctttggtgccaaaccttaaagaaagaattcttattatgttttatgtatgtttctaacttgtcttcattagcttccctttgatatttttggcaaatcagtttaaccttcaaaagtcttcatttattctacttgattaaatcaaacaaatgaatagataacatagaatcaaatagcagtattgtctgttctgagaaagcaacagcacaaagaggtaaagaaaatgcaaattgaagctagatgattgtatacattactttattgaatgtcttaaatctgctcagatttggatggtggggaaagaaatacaaatgtttctagaatctacagttgaatatttgaactgctgggcatggaaggtttaaaaacaaaagctagttagaaaaaaagattgaaaaggtaagtttcagactctggcatttttgtcttttttaagttagtttctgttgaagccctaccttcaggattttcttcccaagtactttccctagagtatataaatcaatgcaacagtaccctgtaatagtatcttaacctggagaaatatcacaagactataaaaaaatgcttttagcaaaggtgtcaactttgcccctatatcatcgatgaaatgtcagcttgaaagtctaggtatgttggaaccattagagagaaaaagaagggaagacagattaaagaggccagaaagtaggcaatttaaaatgaaaagtttaggctgggtgcggtggctcatgcttgtaatccctgcactttggggggccatggcaggtggatcacctgaggtcaggagttcaagaccaacctggccaacatgatgaaaccctatctctaccaaaaatagaaaaaaaaaaaaaaagtagctgggtttggtggcgggtgcctgtaattccagctactttggaggctgaggcaggagaatagcttgaacccgggaggtggaggtggcagtgagccgagatcacgccattgcactccagcctgggtgacaagagtgaaactctgtctcaaaaaaaaaaaaaggaaaagaaataaagaaaattgtatggcacggcacaaacacagctagaacttttagctccataggaatagaattgaagaagttgaagataaattaggaaatggaaatgttgcaggaaaatgaaagggcactgttttacttcaggttccccaagaaatactctgagatgaagatctgcatccaggagtcttattagaaagtgctcttgggaacacctgtaagagaatgagagaaacagaattgtacagaaggagaagttacaatgcagtggcaacagaagctcagttgatcctacggaacatctggagctgggatggctcttcatatttgtctcaaatcaaagaaagggtttgaaactttgacccctacatcaacaagtcattctctgctagctggccttaggaaagggacaaactcttgagcaaggtaacttctttcagctgagggctattcctgacgatagacccaggtgggggccaaaaggagccaacactttctcagctgggagaatgaatgttgtggtgccaaatgagggatcaagtggggtatcacagcatccattagggctcaaccctgtgcttctcagatctccttacttcatgcagtcaattcatatcatctgggagcagcacctcaaagaaagattttggttagtctttgtcctgaagaaacttacaggagaaagtttcttttagacagactgtagccccatgtagcagttgttcctgaggttactcattgattctcttcttaactttcattctgtatttccatcaccctgggctatcatctatgtaggtctggtgaagtgacccaaatcctaattcctggggctccggcaactggtctctatgcccttttcaggctacagtagcattgcttgttcatttactgtcaaaattgggcagagggagaaccatggaatggcaaagtggatcacctgggtcccaaacatactttttgctgtttgcttctatagcaaacataggtaggtaggtagatgcctagctcttcctgatcatcaaggtcagttactccagccagggtaatgactcctctgcttttcttctgggccgttggcatgatgagcctgaagtgaccaggtggcaatcacagcttaaagtttaatggaactcttactgtgtacccagttgaagtgttttcccctgagaatacatccacattacttaaagttacagagacagaaaggaaaaattctgcaatcgggcccttgggaagtacgtaaagctacttctacttctatcatttggtctctggatttatatattcctatccactgggaacaaagcaccatataatagtcattggtttagagtgtagattgaatgctggagaatggtaccccgtccaagcaaaatattctctctaatctggcctcctcaaaaggccatcccagagctttctcaggtagacagccttggcatcatcttgagcacatttctacatctgcttttctgtgaagaaggtctctaggtctgagattatcttaggtgttatgctatgccatttgaataaacactctgtaagccttctgataatggagctggctaaagctttgtgtgcagaaaatgcagacccatacctggaaaatgtatctatttcagataagaagaaaggctacttctgccaggatagaaagtgtctaataaaacaattttgggatgggcacagtggctcatgcctttaatcccagcactttgggaggctgaggtgggcagatcactcgaggtcaggagttcaagatcagcatggccaacatggtgaaatcccacctctgctaaaaatacaaaaattaactgggcatggtggcatgctcctgtgagcccagctagttgggaggctgaagcacaagaatcacttgaacctgggaggtggaggttgcagtgagccaagatcacaccactgcactccagcctggtcaacagagtgagactctgcctcacaaaaaaacaaacaaaaaaaccattttgtcacaatgttgctttgtggaattctttgaagaatttttctgtatcagtgacccaacgttggtttcttttaatggtatgttgtgctgttttgtccacacacagctctgttcctggcaccacagctactggggtggctgatggaagatactggctgttgtcaaacggctaagtcaatctgtctattgacttgttggtacctctttgatggtagatgctctcttgaagacattagcatgtaatttacaacacagtggttccatatccattacatgaggctatgttcctctgttctatcagaggtaccacatctgatacctcagaagcattagggaaaatattttttggtgttttcagtgctacaccataatgaatcaatatctgtctcatttttgaagtgatcagattagttagttaaatggggatattatggagactaccacgctccatctttttatctttttaagggtgactctaatctccaaaaatcaccccctcctcacatttgatttttcccattatatagttcagaggctaaggaactaatataggggttctgtcacctaccaggtagctgaaaatgatcactagatacgtccatggccacatgtaacctggaatggggataggagttccttaattaccttgcctttatatgcccatttgcctcaattttaacaaagaaagttatgatgtgatgctttagtctcgagatatcaatgtcagcaattctcaaatggtttaaatatttcttttttcccattatcggaggaaatggctgtaggacccttttaagagaggaccaagtgaatgactactgtataccccttccatgatgttgcaaaatctttctacaagggaatcatgcctttccttttaaaatatcatagatctgagaattgactcaagtctggttagttagaaaagagatcttggctttttattggtgcttctgagttcagcttctcgattatatatgcttgatttccttggattacatagattgagcaatactctagttggctatctatcttgcacctagcaaagctatgttttaatcactttctccttaatgttctgcatgtcatgccaccctggctacccactctaatctttccactcgttaacttaattgtgcccaccttgcatctgacagtctaatatcatcacccactttctactttggaattcgatcatcctccttgcttactgaaaactcagttctgtaactatctatcttactgtcagtgctggcctagaaaggacagctgccactaccttcccagtgtcattggtgtccctctcaccggaacatttctcaacactttgatgaatggaataccctgtgggctcttccagagaacataatcaggagatagatttcctgtgcttaggtaacataccactctgccatccccacactgagacttggaggtcagactgggtattggagctccagagaaggtggaatcctcagtctttagaaaattggctacaccaaattcagggctttgaatgggaagaaaaaatgagacccaaagaattgagatggaaacaactgagtcaaagcacttataaattctaaatctccagatttcaccatgtactgcggcagtggcatttgtgagtatttattgtaggttattgctttttactcagtcttccaagaataatcctagtagtatattattccattcttccagggctattgccaggttgttaatcctttattacaggagagtgctcccatataggtaatctctcccatatccaatatgtcccatgccccttgacccagcaccctcagaaagcagccatttatataatcctgtagggctgagggatacatgtcagttacatcatctatctccttcggcatgcagttcctcttctaacagattcagcacttctctaggttgatcacgctctgatttaactctggtattggccaggttgccaggaggggagctatagatagatcctgaggggggcacatattgccttgcaagactcagttctttgaatcatctgcgaataaggggagtactaaatttaagaaaagcatgctccagttttgataacccagaaggctcagaggaatctggggatttaggatttttaattattttcacccagatgtcccatctgaattctttggatcccaattttccttcccattcaaggttctgaatttggcatagcaaattttctgaagactgagaattccatcttctctgcaattctgccacccagctttatcctcagtttgtactgccctccagttggtggagttgaaaatatcataggttgtcaaggagatcctctgattagttaccctcagccttttattatctccaatgtatccctggaatccagcaatagccatgaggtttcagagtccttctaatggctatttctcaaagaactgagatatgccctgcccttctttcatttccagattgcttactgtcactggaatttccattttatgtcaccactgataacattttaacaattgcaaagcttcaacatgtcaagagctctttgtacaacacagcctaccagcattaatggggtcctcattgccaactggtctatgaataatctagatccacaatctcattttaatgtttgctttctaggacctattctggtaccaaatcttttaaaattgggttccagggaaatagactttgaggcagagatttatatgtcaaagagttattagggatgctcgcaggaaaagaactgtcgggagtgagagaagcaaaaccgatgaggaagaacagtaatgaacttgcaacagaggcctcagctgatcctataggaagttttgaagctgcggtggcccttcataactgttccagatcaagaatgtgaccaggtcctgtaccctcatatgaaccagtcagtggatgcctaacaatgagcaaggaagctgtctttggccaaataaaatttccagtgatagagcctagttgtagccgtcagtagccaatactcctagcaactggagaaataagtcttccattcctgaaagaacatctctgtgacgccccgcagcatccgctacacactgaacacagaatattgaagtgaaggaactgcctaggtgaataaaaaataactatttttatttattgaaacaactatgggttgtttcaaataagctttctaaattaacatggaggaatatatatatatatagatatatatataatttcaacctttccacatttaagtaaaaactgtacatgattattttagtgacgatgctgatgtgctgacgatgctgatgtgtgtatttaagttccagctatatatttctaacagtcttctggcctatagtccagttataagcactaaacttggatttatgtagctctaccatcccgtttatggtgtcatataaatgtttttctttcctgtgttatgtttagatatcaaccatatgtctattattttattattaggattcttttttttttttttttttttttgagatggagtctcactctgtcgccaggctggagtgcagtggcacaatctcggctcactgcaacctctgcctcccaggttcaagtgattctcctgcctcagcctcccgagtagctgggcctacaggtacccaccaccacaccccctaattttttgtatttttagtagagatggggtttcaccgtgttagccaggatggtctcgatctcttgacctcgtgatccacccgccttggcctcccaaagtgctgggattatggctgtgagccaccacgcccaagcctattattaggattcactttacataaagtactcattagtagttgaacacatggatttagttatcttgttgcaatttgaattggctattggaaggaagacaatattaaaagtgtagttgaaaacatttttatggtgagcttcagggcatattatttgaagttctttggtgcctttttattttttattatttaatttggacaaagaagattctatatttattatattttcctttgaaatgggtggggtctcaaatcaccctttggagcataatccagttaaattttaaaagtatttgctaaattggagacatctggacactctggagttaaaattaaataggtataaacaaagaataattcaatgaggaagactaagtaacacaagtatagacatgtcaggccctagtgtatacctttttggagattagaaaaataggttgaagaacacaaatgaaactagcttagaaccaggataactgatgcaaattttcaaacatgtatataaatataatagccagtattacaacttaaggcatttttgaatactttggagaaggctcattaaagatgatataaatgtaggaaactacactgtacacaagactattcaatattagaaatattgagccggataaaggctgaggtgagagttacagtttgagttagatagctgtacagtttgggttacataaaggaatatcaaatgcatagaaatagagtgtttttgttgtaagcttttacttaaagaaagtaatgtaatgatatatctctacaagtaagatttaaggtaggagaaagtttttataaatattcagaaaggattaatgttagatattaattttctaacagtataaagactaagagctaggagttctctgctgttgaatgaggcttctagactacctcacttcttccaatataactgatcaaagacaagtttacagagacagaaaattgaagcaaaacagtcacttgcctgcaggtacttgacgccagtcccccatttctgaaagaacaaccttatcatactgggactccattggaacttctaagaaatcatggtgccaatcctttctgtatgaataattgctaaggttattgctgtgtccaaactaattttttctctttcgtagtaaagttctctcactggaaatgggtaaaagagactacaccatttaaagaaaaaaagagaaggtttaggaagcttgttgtaaaaatactgaagtcacaaacttattaagaaatccactccctagaatcttaaccctgacctaaccattagacacctctcacacagttttttctgtcaaatgagactcaaaaaattgactttgaagatctccacaagcatgtttcattattttcttgcagatatcagggatgtagatggctgtttctgaatcacagctgcagagcagctacatgataatggcagtcatatccatttatatttcaaattaacttaggagtaccatgaggatataatgttgtttgggccctgttaaaatcaggtctaccattctgatattctagggagagaacaataaaaccaacagacctcctatgggtattttttacaggaaagtgcatggctataggggatgatccaatgctggttcacatttggctcatgagagccaattgtgacatccaattctgcattaagggatattacgttggtaggttgattttcagccatagtgggaatatttatactttggtaatcaacaaaccctaaaactcagggcttcctttctgtcttttatcttctttttttaggcttagtgttaaatatttctacttgaaaacaagacaataaaccaggtgactaaagaattactcttaagaccttaattttttttttctagcaaagaacttggattcctgctagaaattcctgctagaaaggacatgactagtggtagagatgatgagatatttatctaaactggcggaaataacatactctttttttagaagttgaagatattatccactttaaaaattatatataggtgaaacccaaagttagctaattctatttgtaagccattcagtttagcatatccactacaaatagggaggaaacaaaatcaagtttatgcagaaaatcaatagaattcattttgaattgatagtatatctatttcctgtaacttttaagaaaaaaatatcctcagccaagtgtggtggctcacgcctgtaatcccagcactttgggaggctgaggcaggcagatgatcaggtcaggggttcaagaccagcctggccaatatggtgaaaccccgtctctcctaaaaatataaaaattagtcgggcatggtggtgcatgcctgtagtcccagctactcgggaggctgaggcaaagaatcatttgaacctgagaggttcaccctggagatcatgccactgcactccagcctgggcaacagagcaagactccgtctcaaaaaaataaaataataaaatttaaaaaaaatcctccagtggtattcctatggttgtgaaattagattgctggtccttctatcttttgtttctctctcttctgttgattctctctgggacctttattatcaacatagcttctaaataaggatgctccataatagaatgaaaaggtgagccacaattctatcagctttttctacttgtaatgggttcttaaaatggtttggtagaaatactgtaacatatttcaagaatgtctataattatctgaaatcctaactatttatgattctccagtgcctctgtcccaatgtataatattgccactacagaatagttgcgatttttgttgtttttaattatttctttggacaactttgaactaaagtagttacatcagctatgtattttgacacttgatagcatccagttcaatgttttattaacactggttagtactgtcttcatttttgatatttataaatgatatttctgccaacagaaagcatttttgatatttcataagtattcaaccacagcaatcagaagttttagggctagtaaatcaatagatacccaatcaaatgaaactgataattgcttatgctcaaagagagttagatttaagtaaggtgctatttagaggttgattgcattattaagaaattgcctgttaagtttgggttaacagctcagaggtgactgagttacctttttggtaatataaagaaggaaaactacttctccttaattacagaaaactgaaaagacaagtccacacattttttttcttcaaatatctcttgttggtctataatcaaccaggcactagattaaatgatgacagtaaggcaaaaataactgagatgactaattttaaaatgtattataaaataaagtaagtatagtacttaggctggatgggccacctgctgtttaagtcaaagcaatgttgtaatttaattttccatcactatttcatctctttttaagacagccaaaccatcctagggaatgtttgatagaaaatttgttgtaagggagcttctcaggagtagaacgtctctatttcagccaaacaaagctttctgctcagcttgtagtattagaaaaacatgcttatttgttcttacttgcacctattttatctgtcatttcctgcaaaataaacttctcaatataaatttctcacttttagaaactgacactttattattaaaataccaccttgtctttttaaaattccctcctttcaatttgggcagaacttgtgattgtgatgagatattactctcttgattcggttatgttactggacaaaaggggttttgtagatgtcatttagtttatttatgagttgacactgagttaatctaaaaggagattatccaggtgggcctgacctaatcacagcctcagccagcaccttaattgcagccacgtaagcccctaagcaaagaatccatctatgccatgatggactcctgacccacagaaactgcaagataataaatatgtgttacctgaagttgctaagtttgtggtaatttgttacacagtaatagaaaaccaatgcattctacatgcaagggagggaaggattgaagaaagaacaagaacgcaagagagtaagagacatgtgtccctcatctctcatgggtgtcttccatccagatccctgttccttaattttctttgacgatagacccacactactcattcttctgctccaacctcttactccacattcacagcatatgggaagggtacacacgtatacatcctttcttcatacatttaacataccctttcacctgccccagcgttatccatttttgcatcaggagcttttaaaagttaacacagaattcctggagggttgccaatttctttttagaataatttatgaaattttaaatgaatctgaatataacaaaatagggcagtttccaagtatatgtagaatattgcaacattcttagagggagaggaatatggatgtgagtatttgagttgtttctgctggattccagtgccctgccccagagcatgatgggccgtgggtgaactgcgcacctgctgctgctccagcaggcctgatgtatgttgcttggttcttcctcttaccacaaacttagcagcttcagataacacatatttactatcttggagtttctgttggtcaggagtccattatggcatatatggattctttgcttagggccctatatggctgtaattaaggtgctggctgaggctgtgattaggtcaggcccacctggatcctgctcactccacatccaccctctctgccccactgggttttcatctccactcagaaacagtcttctttaactggcaaccagataaaatcaacctaagtgaaggagtcacctttctccatattaatggtgcatcatcaggtatagaaagggaactaattaacataaagaaaatatcaagataataaaagaaaatttgttcctggaggacacagatcattggaaaacagagagatcttttaaaaatttaagtaatacactcagaacaatttgtgaatacactggtgtcccccaaaaaatttttttgcatagtgcctaaaagggaacaacttgaaaaagaaagaaccgtcctaggtggaaagctatgattgctaaagtaaaatatttaactagaaagagttgaaaaatacatatttggaagcctaaaaagtgaaaaagaaagacagaaaacaagggatggaaaatacaaaagacaccaaggatcaactcaagaggtttaatattcattcaacagcagttctagaaagaaaaaattaaaagagagggaggatagcaaataaatgataaaagaaaattcctcacaattgaaatacccaagcctttagattcaaagagctcactgaaaactcagcatattgaatgaataagagactcacagatagaattacccttgaactacaaattttcaaggagtctgcagagaaggaaacttgtaaatgagaacattctaaaaagcttctgagatttcaaaaaaatgacttgcaaaggaatgtgaatcagatgagagtcttgagttctcataagcatctgcagattctggatgaaaaaaaatgaatcaatgttttttaagttctgagagaaaatactttcaatctagaattctggagccagccaacttatcaaccctgaagcaatatcaggataagcacattttcagacatggcaaaaagttgatgttcaattcacttttttccttagcaatatgtttagaaatgtactccagcaaaagaacttcctcttaattaaacaggaaactagaaaacaactgactcattccaggatggcaatgaagaaatcttctagattaactttctgcagacctagagaacaagttccaaggtctaagggctctggcagggaggtctccaaggcaaaaagcaccgttaacagaagactacaagataaaactgactaaaagttctcttttttagttggggatgtaataaagaaaaaacgctacaagaaaaattagaaaaaaatgagaaactccaagaaaaaaaacaaaattgctcaaaaactcatgatctaaatctggtataaactgattttaaggaacgattttaagtaattggttatatgtttaaaaaataatttatttgactttaattccaggaacatccttctgtaaatgtcctaaagcaggggttactaaagcaggggttcccaaagcaggggttcccaaacccatgaccatggactgatactggtccttggcctgttagaaactggaccacacaacaggaggtgaaaggtgggtgagcaagtgaagcttcatctgtatttacagctactcctgtatttacagtacattcttgcactagtgcctgagttctgcctcctgtcagatcagtggcagcatagattcccacaggaagggaaccctattgtgaactgcctgtgtgagggacctaggttgtgtgctccttaggagaatccaatgcctgatgatctgtcactgtctcccatcatccccagatagaaccatctagttgcaggaaaacacgctcagggctcccactgagtctacattatggtcagttgtataattatttcattatatattgcaatgtaatagtaacagaaatagagtgcataataaatgtaatgtgcttgaatcatcccaaaaccacccccagtggaaaaattgtcttctgtgaaactggcccgtggtaccaaaaaggttgggaaccactgttctagaggttacaaaatccttagaaaagaatgcaatctatttggcctattattaaacatatttatacgttcataacatagtcataagcatatacacacttttcattatccattattagactgaacatattaataaagttgggtgtactgtttgaagccatagcattgaatgtaactctccacaaccctgacaatgaaaaggttagctggcaaaagatgagatttgggagatgatggaaaaaaggggtgaaggcaacaggcagggaattgaaggaaagtcaagtctttaaaatgtacatgttacaaaatgggaaggccaaagatactgccaaaaatgccatgttacaaaaaaaagtataataactattttatttaaaaatttagggtactaccaaacattagtggaagtagaaagaagaggatgttgtaagaaaaaagtcctcatcttatatatggaggaattaatagatacctcattaagaaagcaaatcaagaaacagagttgtacacaaatggagttgccaaactggctgtaaaactaaaagtagaaactggagaatcagatttttaaaagagaggtgttagaagacctacttttaataatagatctttctatattattttatttttaacacacatgagtaatgagggtaaagcatattattttaaactggattgtatttggtcataggaactgatagaaaaaaaattaaaattgaaagccaaagtataaaatacatggcaaaacacttcaaatcctgaaatgtttatatatgtttttacaaataaggtatatttgacaaaatgttaacataggtgttatatgtcagtaattacactattatccctagcaggttagggagctgacattaagccaactaagacaaacttagacacaatggggaaatagatttaaaaattaattaaaagctatttccatttagttagtctagtttctacccaagaatgtcttctgaattaactttcagacttcaaataaaccataactgaaataactaaatgactcccaatgcagtaaataattttactgagcataattaataaaattgaatatctggcttactgagtctggaataataaagtagaatgaacaatggaatagaaagaacccagcaatgatactaaggtgagagtacatatttagaatgcagttctgggtctcaaactcaaccatatgcgaatggacttgtgaagaacaaataggttttttgttctcttaccttaataatgatgggtgtccatttctacaatataacttttcttttttctcaaccctcatactttcactgaaagcacattcatcaagtaccatttattgaaaatgctgttctatattcaagagagagtatcagtatgtattggaaaaaggaggtatgtgtagatgttgtgcatttgaatgactattcaaaaccttactttcttgtgtagaggagataacacttaataaagtcaaagtcctttcaattgtttaactttttaaaatcagaaagtcatggctttgaagtatttgaaataaaaactggctttcctggtactacggaagcttcaacttgactctgcttttcaaacttcaaaaatcaaaagacttttatttggggtatcaaattccttgcttttataaatatgaattgcttggagaaattatcatttttactactgtaatatgaacttttgacaggttcttttgaaaattttttaaattgaatatgattgtgtgttcttcttcattagccagaagcaaggtcaatattttgaaagttcagcgtttctataattttttaaaaataatgaaaatcagggtcaaacttggaattttttaacatgatcttatctaaagtgtgacctaaatcataattcatatatggattataacatgggaatttaagatcaccaattctataaggtatgttattctctgctcctgcagctgaataacgttcgaaaccagaatcactgaaacttgttgcagtttcagactaagaccatactctggcatcatccctctccacagagaagaaaataaacacaattctgaactgtcagctccagaagctattgctcctcatctcatatggttttccttagttctagtaactgggctcttcattcatgcacatttgaccaagacctccccttgtacctcagttcaaatgaatgagtattttttttccttattctcagatatatatttattcattgacccatttatcaatttttattgcatgcctattatattccaggccacacaatatgatgggaaacaatcgttcttacctttagtaaacttaaagtccaacagaagaatgaaataggtcagtagtcttatttgactactgaacccggtatcccagatttgcttccctaacccagtcttcctaaatgcttctagggctggagtcctacccagagcccagtcactccacagttggattttgacagctttttgcaaagactttgttgaaattgacttgccatttgcctggacttgacatttggctaatatctgctgttggtccctggcctgatcacagacacagaccccatgaatatttctgatttcttggatgtgctaattcccattctgtctgtcttagtgacaaacaattcagcccgctctcatctctccctttgtctccttccccactgtctttgccttaactcagactttttttaatttcttgcctaaacaaaattttcttctaaaacaatttttctgtcttattttcctactccaacatataaactatctgctctatttaaaaagacaactattacttgcatcaaaaatgttgaaacccgaaagttctctgaattataatttataacataaatatacccctgaaaccactactcaagtctaagaatagaacattatcagcacctcaaaagccacccacaagcccactcccaatccctttctgctccctcatctccagaggtaaccactatgctgactgataacaccatacgttattattatattataataacaggccactattattgaactgtaaacaaataaaagcacatcatatatattctgtaccctggctcttatgttcaacatcacatctgagagattcatcatgttttcacatctaggaatagttcattcaggtttgttgctatgcaggataccattataagaatatactactaattattcattgtattattggctaacatttgaattattttcatattagcttattacaaataatgctgttgtgaacattcacaaacatgtaaatgcatatatgctgggttataattaggtgtgaaatttttctcatagagtacgtgtgtattcagctttaataattgatgccaaacagttatccaaagtagttgtgccaaacatagtgtatgagaatatacccacatgctttcaaaaacagttttgtcagtcttgtaaattctaacccttccagggagcgtgttgtagcattttattatagtttaaatgttcatttgtaaattctaacccttccagggagtgtgttgtagcattttattatagtttaaatgttcatttctcttatgactaatgtggctgagaactttttcaagttaattgactatcttggtattctctattatgaagaatgcctgattcaaatctcttgttcatatttgttttgggttttgtaatggttctatatcttggtgacaagttctttggcacttctattgaaagatggggtctatgtcccctcctcttttctttggcactcctattgaaaggtggggtctatgtcccctcctcttgaatctgtagaagcttgtgatttcaataatagaaaactgaggaaataacgctatgtgacctgggactaggtcataaaaggccatgcattagccacattgctcactggaaaacttgcttttgaagccctgaaccacaaggtacaaagctcaattcccgtgagactacaattttaaaggggccatgtgtaagcacttctgctaaataagcccattcttccagccattcccaacaaagcatcagacatgtcagtgaagctgttctgaactcacaacactagctcattctccaaatgaaactactgaatgatctctgtcgacatcattaaaaatggaagaatcatctatccaagccttgcctaaattccctattcataaaatcatgaatcataaaatggttattttaagccattaagtttggggtttgtcatatttcagtagacaatgttaacagaatttggtacctgaaagtaagataagtgttataataaaaccaaaagtatgtggcatcggtttggagatgaccagcagccttgaagatgctattggtaaaggctcaaaagaaaatgagtacactgttattggtggtggaagaaagcagaccctggctacgtagctgtggaaagtttggcaatactgttgcctgtggtaacataaaaagttgtcaatgtacctaataaacttaatggtctagctaaggagacatctgagcagagtgttgaagatgctgcctggcttcttctagctgcctataataaaatgagagatgagacagatgaactaaagaacaaaatattagggttttttttttagtagaatttggaaaaaacataaaggctcaaggtagtcttatatcccacaaaatatccataaaataaaatatagctgcaaggcaaagatcaaatcctgggcattaccagtaaaatattaccctggggaatccaggtagggctgaaagtttctttattaagatgttagaaggacttaaggtggcgcctcatagatcacctcagttaaacaagagtcttaagtaatgttaagggcattatttaaaactctctgctagaccatagtgcttctaaaggtattatcctgacgatattatcacagtggtgttatgagttggggaggttactctcaaaaaggtttgtgagtgaactttttgtctaatggagtagctcataaattgatatataagcaacctaaaggaattatatcagcttggactagaggggatagacagtacaaaatgaaaagaggcatttgaactctgaacttttatgtacagggagtaagctcagaaaaccattcagctgtgaacacaagctactctccatggaaaaattaggactccaaggaaagcatcaagacctcagaggacagagccaagattcatggagaatcattcttagaggggcagttctgggtcctaagcaaagaattggcaacacacacttgggaaattctaggatcactacggaccagtgactgctgtgcaccttttatctcccacttttttgagcagagtgtctactgtcactatcttatgctgtcccaccattgtatacgggttgtgtggagggcagataacttgtctgtttcacaaggtgtcacatgaagaggagtgataacctagaaactgaacctaaagcatctccttcacacatggacataattcagattatgagacaagattgtgaaccttgagccacacaggataagactttgggaagggagtttaaaagggatgagggtgtttttcacatggaagaaatgaaaatgatttgcgaccagaggttgggctctgacaattttttgacatggccataaattctttgacattccttcaatcaaatagcaagatcattgttttcttcctttatatctttgagggcttgcagctgctttggtcaatagagtatgattagaagaaattctatgtgatttccaggtctaggttaccaaagttatgaagctgcttttttatttgctgaaatgttcacttttggagtcctgagctgccacataagaagcccagttaccgtgagaacaccactctggagaagcaagtgcaagtatcccatctcagctaggcttagccttccagccatccccaacaaggtgacagaaatgtaaatgaagctgtctcagaccctccacaccagctcatctcccagcatataccaccagatgactctgttggtgccacgtggggcagaaaaatcccccaccgcaccctgtccaaattgctgaccaacaatatcatgagctataagaatatggtagtgggtataagcctctaagttttggagcagtttgttacacagtgatacataaccagaatagctgtcttttccaaattgttttgttagtgttctttatacattctggctataagaatatacggtcatctttatttttttttacttttacaattaaatttacaattcacttgatctatttgcttatcctgaataaattcaacactaattattgtaactcagtaatgtcttggtatcccactttattattattcaatattatcatggctattattgatcctttgcttttgcatggcacctacctgcagggagcagactccctgcatgtgtacattcaaggccaaatagccaagtccccagaatccttgaattcccttaccatttcctgacaaaaagaacaaataaaatgtgaaaaaagaaggaatgaaactgttaccacttgtagcaaacaagattatgtatgtaggaaaactatagattcattttgcctaaaacaatttcatataaatgcagtcatacaatatgtaatcttttgtgtaagtcttcttttattcagcataatgttttgaagattaatccatgttgttgaagtttatttcttgtcattggtgagtttattatctgaatatattatagtctgtttatccattctcctattgatggacacctgtgctatgtccaacttttgggcattttgaatagttatgaacactcttgccaaatactttctgttagcatatatcttcatttcattggtataaatgcatggaattgatatagctgggtcataaggtatgtgtaagttttagttttataagaaactaccagagcattctccaaattgttagtatcattttatgttctcaccaccaatgcacaagagttccagttattctccttcatatcaaaatgtagtgttgtcaatcttttttgttttagttattctaatgaatgtggatggtgtctcactgtgattttaatttgcatttattttatgacgaataagttattttttcatgtgctcgttgagcatttgtgtatctatctttatgaagtgtctgcaccaatattttacttacttttttgagttataggggtgctttctatagtctcagaaccattcctttctcagatatatgtgtagtgcatattttttcctaccccttggtttgcttattcatttcttagcaaagctaatgttcctctcaaaactttatgagaactgctattcttctgtatgtaatttgtcctttttttcctggctacttagaggatttttctcaataactttgaatatcagcaggttgaccataatgcaaggttttctttttatttaccctgttttggttttactggtttcttacctctgaaacttatatcttccagcaaatatagaaaaatgtcaaacatgaactcttcaagtactttttgcttcattctctctttcctctcttctcggactccagttgcaaatataatagacactttgatattgtcccacagggacatgtctccgggctctcttctctgtcttctctcttctgctcttaagccaatacagtgaatttttatttcagattgcatttttcagttctagaattttcctgtctacttaagcctagtaaacaggctttaaagaaccatcttgagtagataatatatcttttgatatgtaagagacacaggattattatctgactcctacctagagaaatctgataccaagaggctatatggagttggcaggaaaagaaaaagaagcctgagttgggagtgagctcctctcccatacagtgaagcaatggtgtgtatttccccaggtctacatgttgtccccttggaaggctcagattcatcataaaagggattctgcctaagagaatctcatggagaccatatgatcccaccatagtaataagctcctagaagcctagaagctaaagagaaggttgttgacagctagcaggagcaaaggcaataccaggtgaatggatgtgtaataggagatctctaaacaggagatctctaaaaaatttctaaaatgaatccatgaaaagaaagatatcttcctctgagcataacctaaagttgccccaaaacatcagctaaaaggcaacttggaataagaaaagaaaatagaatttgaccagatattccacctgacttcaagcatccagcctgttgcaggctaagctggacaagcagagaagcattaattggatcagagtggagattgtaatactacttgggaatgaggatgtatgatcaatacactagaatagattttattgtaatccttccgtgactagaaaacctatggggtttaatatttaatgtaagggctgaaaaaatattaatgcagaaagcaaatttgaaattactaaaagagaaagaataaggttagtatctgcatatgtgtatctgtgtgtgtgtatgtttgtatgtattcagtagcattgtaggatcacttctgtcatattatatccatatattaaagttatctatcaattatatgccttcatggtatatttatacacagataggattgtctgtgtgtctgtgtgtgtgtgtgtaaaatacttaaacattggccgggcgctgtggctcatgcctgtaatcccagcactttgggaggccgaggtgggtggatcacgaggtcaggagatcgagaccatcctggctaacacggtgaaaccccgtttctactaaaaaaatacaaaaaattagccgggcgtggtggcaggtgcctgtagtcccagatgctcaggaggctgaggcaggagaatggcgtgaacccaggaggcggagcttgcagtgagccgagatggcatcactgcactccagcctgggtgacagagcgagactccgtctcaaaacaaacaaacaaacaaaaaaaacaacaaaacttaaatattgacagtgatgcatgggaaaattgtatcaattttttttttagtttttagattttttaacttctacaatgaacgtatattctatttgacacacaaaaaaaatatactgtctttttcaatggactgtgagtctcttagtctgtttggtctgctataacaaaataccatacactgtgtagcttataaacaacagaaacttatttcctacagttctggaggctgggaagtccaagatcaaaatgccaacagatttggtgttggtgagggcacatttcctaattcataggtggtaccttcttgctgtgtcctcccatggcagaaggggcaaacaagctgccttgcacctgtgttctaaggttcctattgccattcgtgaagactttgccctcatgatcctatcacctcccaaaggtcccacctcttaataccatcacattgggcattataatttcaacatatgaatcaggagagacaccaaacagagtatagcaatgagttagtacttttcagttaacaaacaagtatctcagatattctaatcatgtcctcacagttatcatcattttcaaagttttgattttaatggtttgacacattagagagcaagtatttcagtatatttgaaggataaatcacatttaattccctttattaagtgatacacttgaaaattcccaaatactattgtaacattctccttaaggaactgcctttatttagactttcttcagtcttgaaattccattgtgatactcagcctcagagctgtaacatttgtcacacagataatgctttttgtccttgactttttttctctgtgtgtgtgtgtgtgtatgtgtgactatctcctaacatttttttttcatctcttctcttccctggatattgattacagcattgaagcatctgcctaagtttttactttttgaggctgtttgacatttaaagtatacataaaaaattctggtaaatctatgtgctttggtcattctttttttatttatatttttgctcttttactgctggctacataaactaaactatttacactccctcagtttttatgctgcctgtgagctaatcatttaactttaacatacattttattttgtcattgaacttgctttcaattattttctcctaacatttacagagagaccttacacatagttactatactgtcaccccatgttaatagctctctgctgtgggttctagacataaatgggtgtgtcagggtcctccatttctatttttcccccttacaaataaatgctttaatacattgaatgtgtaacttgctgccctttctacttgcatcttctctggttcttttaattattttatatcaccctgttacaaatgggtcataatctaaatatttatttggtctaactatcaaatgtttctttattgaataaaattcacaaaaatctgtggaaaaaatgcagtcaagaaagagggaggtaactttaccaaaaggctaaaaatcaagctgattaattcaacatttcttaagtttactactaaatatatataaaattactgaggaaaaaaaatcgacagtgatttccttttctaaattctgtgataatactatgcatagagagatcagtgtaataaatttcttaagctcaaaagataatcaaggctaaaaaaagaagtcatattttcaaacctacaatttagtttagattggtttaaattatagaatgttctggtacccagaatcaatctgcaagagatgtagcaatcttgatgaaggtctcagtaaattctttctttacttctagagggagtttaacagatcacatactgcctttacaaagtcctgtatttcataggtaacaaaatacccagtcagtcaaggatcaaatgctaatatgtggtgtttaatcacccaggagtgaaagatgccattgcataaagatatgattcctcccctagatttcaaagatatttaaacttctcctgcatctcaattctcctttaatcacaagaaaatcaccatgttatttatacggtcagtgtaacccgtaattgcaattattatcacatgaaatatatcaaagccactaatttccaacctgcttctatcacacttgtggttcaagtatggtagcatgtgttttgcagtgactgaattgtattaatgagaaatatacatctgaaaatataggctgtagaaaccaattgtcttcactgatgtcagtctcttcccattcatgctcctcaataaagatatacacaaaggataaatacttgaggggatagatatcccattttaagtgatgtgattatattacacattgcatgcctgtatcaaaacatgtaccccataaatatatatatgtaccccataaatatatatacctactatgtaccccaaaaaattaaaataaaaaaatcaaaaaaatgatatacatttttgtataaggtgtaaggaagggatccagtttcagctttctacatatggctagccagttttcccagcaccatttattaaatagggaatcctttccccattgcttgtttttctcaggtttgtcaaagatcagatagttgtaggtatgcagcattatttctgagggctctgttctgttccattgatctatatctctgttttggtaccagtaccatgctgttttggttactgtagagttgtagtatagtttgaagtcaggtagcatgatgcctccagctttgttcttttggcttagaattgacttggcaatgcaggctcttttttggttccatatgaactttaaagtagttttttccaattttgtgaagaaagtcattggtagcttgatggggatggcattgaatctataaattaccttgagcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggagttcactcatgatctggctctctgtttgtctgttattggtgtataagaatgcttgtgatttttgtacattgattttgtatcctgagactttgctgaagttgcttctcagcttaaggagattttgggctgagacagtggggttttctagatatacaatcatgtcatctgcaaacagggacaatttgacttcctcttttcctaattgaataccctttatttccttctcctgcctaattgccctggccagaacttcagattaaagacttaaatgttagacctaaaaccataaaaaccctagaagaaaacctacgcattaccattcaggacataggcatgggcaaggacttcatgtctaaaacaccaaaagcaatggcaacaaaagccaaaattgacaaatgggatctcattaaactaaagagcttctgcacagcaaaagaaactaccatcagagtgaacaggcaacctacaaaatgggagaaaattttcgcaacctactcatctgacaaagggctaatatcaagaatctacgatgaactcaaacaaatttacaagaaaaaaaaaaaacaaccccatcaaaaagtgggcgaaggacatgaacagacacttctcaaaagaagacatttatgcagccaaaaaacacatgaaaaaatgttcaccatcactggccatcagagaaatgcaaatcaaaaccacaatgagataccatctcacaccagttagaatggcgatcattaaaaagtcaggaaacaacaagtgctggagaggatgtggagaaataggaacacttgtatactgttggtgggactgtaaactagttcaaccattgtggaagtcagtgtggcgattcctcagggatctagaactagaaataccatttgacccagccatcccattactgggtatatacccaaaagactataaatcatgctgctataaaggcacatgcacacgtatgtttattgcggcactattcacaatagcaaagacttggaactaacccaaatgtccaacaacaatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcataggtgggaattaacaatgagaacacatggacacaggaaggggaacattacactctggggactgttgtggggtggggggaggggggagggatagcattaggagatatacctaatgctaaatgacaagttaatggaaatgacgagttaatgagtgcagcacaccagcatggcacatgtatacatatgtaactaacctgcacattgtgcacatgtaacctaaaactttaagtataataataataaaatttaaaaaatgagaaaaaaataaaaagaaaaaaagaaaatgatatacattttactcctgaagtaaacatgttaaataaacacattgcttgtccttttgatcaatgtcagaaattgtggggaaaaaatgagaaaaacattttcctacataggattgcatgcaagtgatcccaattgacacaatatggaagacagtggagaaatatctaggctgcccataatttatcaatcttctctctgccctcttctctgtagtggacatttggtgtctgtcaaagaacaaaacaactatgtatacagtacttgcaaaaaattaatgttttctaaagcattttaagtttttcttttcttattttggatgtactgaaagccccaccccaaccatatttctctcttaattcatagttatatactctattttgcttcttctagcagttactctagaaatttcaacataaacatttaccgtaaagataatccatgttaactcttcagaaccatgcaagaacctataagcaatttatctcacgccacagttttctctcttggctaaacttttataaggtgatattttagttctatcttattttttaacactaaaaattatgttaaaattttaataatgattttgtattacctacatgattactatgtggttgtctcaagttttcttcttctatctcatacctttcttttgtggtcatttgtattctggaaaatgttactggcagtccattcatcccaagtaatctcagtgtttgtctctaataccctcattttgcctattgtcttcaaagtcttattaatatggatttgtagggaaccattttctttcagcagtttgaagacatccttctgtctccttctgtcttctggctcccactcttattatggagatatcacttttaatctaatagtcaccccttgaatggtccctgtcatttctttggctactttatgatctcctttgtatctttggttctctgcagtttcactatgatgtgcccaatatgaatttctttacatttattattaagattggtgctttttatcaaaagcaccaatggattattatgtcattttcttttggaataatttctctccatatcctatgatctcctactgaaatgccaatgagaaatatcttataccacttcacactattctcctttttgtcaactttaatattcccatctctttgtctctctgggctacatcctgttcaatttcttttcatgtatcttctagtgtattaagtctccctttagctatgtctaatctgctctaccccctcccccagtcttctgagtttctcatttcaattcttctctttctcctttgtggaaatgctattttgttctctctaaaatgtgactagacatttgtatagtctcttgttccttcatcattttctgatattgtcctttattttttaatatattcaatgtgcttattttagtattgataatactattatctacaatctttgtgggtctgacttgcagtccattattttttataactctccttcatgtggcttgttaccttatttattttgtaattgtatttattgtgacctctgtttcataataattctttgagaactggatttaaagagattcctctagggaaggcttattcatgcttctgcaggtatctagggatgtttggattcaagtaaaatgtcaaactattagagtcagggcttttcaggtcacataattcatgtgaatcctgggtccaaactcttaggaacgtgagtttatgattaacaattttcctggattttaaaaaacaaaatcctgtttcttgtctacccagaaccatgctggaacctgcacatattcttgatgtatctttctgaagtgcaagtttttctccaatttactcaatgttggcgtctcccagagctgcaatattcaacttcagtgggtactattcacattgtggtccatgtaaaaagcattccctggaggtgtgtagtgtcttatgcgatgctcttggtgtcaccatttggacatcccagttttaaatgagcatctctgatccgacccttgcatctacccaagcttggttttctttccccagatcacttgatccattaaagtacacggttttctaggtcaccagaaatgagcagatagatcctttgggcaaacgccacctttagtgataccttatctttagaaattttgcttattagttttccctcatgccaaactatagcccactctcccatgcatgccaattaatgaattttaaaagatttctcacataatctgtacattattgttatatgttttttactggaaggggttctctggacatttggtttatcatattatcaaaagcagaacctatggaatctaccactgaaaacagagacctaatcactcttctttctgcttctcataccacccctgtaggcagaagagtcattagccatggtttcagataataggagctctgcttgttgcagtcttctgtactctagtggctttctttgatcatggagagcctccaaggactcgaataataatgggagttgggggttgaggggcacacagttagaaagggagaacaggaggaaacttgtacttctaacttgtcaggttgatcatttgttcctatgtttggtattcttggcttccccttgtcatatacattgttatttcatattataaaataattttgcctactgcatttagaacctatgacttcctaataaggaattcattgatattaatttgctacctttttttccttctaaaaaattactgactttcttacagtttcacagagttataagaggaaagaaaggatcagttattgaaggcataatataagactctgctgtgtactatgtatgagttatttttattattcctattttatagagaataataacagcaacaatagtaatagtaataagagctaatatctattgtcaggcactgctctaagtatttgacgtgtatcaaatataatcttcacaacaacctgtgggttaagtgctatttctattcccattatatagatgagaaaataatcttagagaagttaatttttcaagtttgtataggtaatgatgataaattgggggggtttaaactcaggtctgcctgactgcagatcctatacccttactatatacaaaataggctactctcctaaaatcatattgggcatttgggaaggcagtatttttacttgacaaaacaacaacaaaacagcatttttggtgttgctaaagagttaatacaactttagagcacgagagagaatattttatcaaactgaaaaaagtttaatgctttggcttttcaaagagcatttaattctcataggcatgcctatcctgtatttcttcatcaattgcagatgaactattaactttcaaattggtcactgcagggttctatttacatctttaatagagtaaatatcaaaggaacataaagtgtaggttaaatctaagaggattttcaagagaaataagtgatgagagcaacagaatgtatctcaatgccctatatatcagtaaagaattaattaaatgtattaaggaaaatgtagtgtcaatttgctctaattgagaaaatttttgagataaattattaaaaaaacatttaaatgaagaaggtttggtctgcataatctgcaggaaacttgtctggccaccaaggacttttttgctaatgagctttgacttggttacagtccctctgagagagaagatttagtctacaattggcttactaatgagcactgtcaacatgtggattggtctcagatgctctactctaaaacaaggtggaagttatcctctcaactaaacttgttgaacagaacttggtcagcaattttccctaccaccttcagtcagctacaaatcaccacaattgtgtaatattctggacaggatataacgaataattattgtaatatgagatgaattataatttttgaagcatcaggagtttccctttaatagctctcccagccaaataactgatggattatgaattttaaagatcaacattattagatatttcctagatttaacatatattggaatattatttgagcaagaaaaacaaatattttctatatttaagcaagtctctttaactcttaaatagctatactcagtctgggtgttgacatgtcattttaaccaaagagaacaaattgaaaagcttaactttccaccaacttcacttttataaacaagttctaagataatttgaaataaattttgaaagctctaaaattttcacagaaacaaaattctatagtttaccatattgttaagcaagattgtgattgtcattttttctgagatagatgcaaatccatttatcctaaaagtttatcactatgcagttatatacttaattagtccactagggccaaaacttttcaaaatagatgaaatcactttagtataatagtgttgctacaatttaaaattatcctttgctctgtactagtgcagggaagtttaaactttccctctgaaggttctataattgaatctgctgaaataaactgacaatagacaaattagctggaggcaaggcttacaaatttattatgtgcaagcacaggggagtcccaaaatatatgagactcaaataagcgtcaatggttgaagcttaaataccctctttctggggaagaaaaaagcgaggaatgtagtcaattttagaggaagagaaaatgatttttaggggaaatgaatgggcccccaaaaatctaccacagcctgggacaaggttcatctggactctgagtgtagtgtcaactctagtcttccttcttgcacgacattcatgaatttctttcagttaacaagatatgtggagaagggattcacaactgaatatattctggaggatccagcttttaggtagatagggaaacttcagagaaagccttttcactgcatttgctattcacgatgttctctcagcttgaagtccaaaatggcatatattggggtatcattttatgacccccagtgctagttagaaatggccaataatttaatattaatcggtaatattgatcagtaaaagcactgatgtgtgctttcttgatttgcttcaatcttcttattgcgcaagtggttgggacactaaccattatttagaaatctagttatcaagtaaatgaaaattcttaggctacattctacacataaacacactcatttatgttttggcctttgtttctaagcttatctattattatagagtcacattaaatgtgaatggttagtctaaccgtgagatcactccttaacctaaccttagttctccctgcagctatctttaggaagagaaactcaaacacttcatccaggttgttttgtttaagcatataaccaattttaaagtttattttagtagagatggttggacttacaacttttgtgttgctttttaacttgtaaatttagaaggctctgaagattctggaaataaaattctacttatcagagacaacatccccacttttctttttagctcctgtccttttatgtctttttaaaacccaactccaagtagaccctttcttctgtgaagccttttaattatttacttcacctgtttccaatcattttgcacagcattcaaaaattcacctcaaattatatttcacaaagagataattgcgttatgttattcttaaattgttttattgttgatatcttatctgcagctagggtgaatgtttatcaggcaataggcctttcatctttagaactgaagatatctctgataactacttctcttctggagagaaggattatcagtcaggattgtttactgtggtaacaaacaatccccaaatttcagtaacctacaggagcaaagttttatttctcaatcacataaatgttcattgcagggacttagattctggttcatgtcatcttcagcactggatacaggttgaggaagtagctactattctggtatactgttcatttcattataaggagaaggaggaaactgataaaacatgtcacttccacacttatttggtcaaagtaagtcacagagtcattcctaagtacatcagaatgtggctgtacacttcttccacattgaggagctgaagcaatcttatggccaagcctgaattccatgtttaaggaagaggtcatacatgatactttgaatttaaaacaataatgctttctaccacagagggaaaatatagaaagataatgaacgtatatcagtataactttatctagctatttgttctaaatgggtgaattaacttgatatttcatttttcacaattctttttttcttaatgcggggaatcctgacaatctcgcatcctctccagcctcatagcctaatatcttgccaattgtttcctcctcactgtggctagttgataaagcattacataacaaatatatgtttaacaattactatttaatgagacagctgcaaaaataccttatatcagttcctcttgaaattgcaattcaccaagcatagttccaagttcattaaggaaacacaagaaaactcaacatggtacttgatattaagcatcttataattttataggaaagttaaagtacaaatagctgtaattcagggtggaatgtgatgaatgcttaacaagaaataaaaaaatgccataataacacaagataggaaccattcactcacaaatttggagccacttaactgccccaatttttgtcatttccatctctaaagttccattgattcatatttgtcttccttcaatgttcttgaactattctttaataccaggactcttaataccattttcttcttttgcactgcagggtcaggttcatcatttcttccctctctcctattactttaatctctacctttttgttattatgttttctccaacttaccacttttcccaagttttcttccccatcaataattcttctgaacatatatttcactttccttatagttctaaagcttcttgagctagaagtctcgatgtactacctgtacttctgcaattctcattcatgactccaaccactgtaatctgcccctgctatcatcctcaaaaataaaagggcttctcgatggctaaatccaaaaatttacatttctgcccttcactattgaaacctgttgaccgctccttatttctttaagcaatattttctcttagtttctgagacatctctagtctcaaagtacatatttttaaatcaatttccatacttttaaatattattttaatgttgatgtgtcctgtggacccacatttccgtttaccacatggatatcttacatgcaattaaaatgcaataggttaaaaactgaccctgtcaacctaaaaagaaactcactcagagagacaagctctccagaataaatgaatttattttggaatagcagagaatttcaattcagagtacacaagcaatggcaggtcatgggcatatgcaggggggctgaggaaagagggcatcttttaaagacaaagaaaagaagttcatgtaagctattttgaaaccaaaggttacaaagaccgaaggtaataggggttacagaagttggtgttagctaatttctaggtgagtatccttgggcaagcaacttacctggaatgctacaatcttgaaaaagttcttgctataagttttgttcacagtttatgtggaggaatgtcttttgagaagtcctgttacaaacattcaagcatgggagcttctttctcatggcctctctcaactctattttgttagaatttgacacaagtggctccgttttacaacccagacgtattctttctttagtattctctaatttgactaatgggttcaccatcccttctaatcaagaaacccaaaagatttagtggactttttaccaccttcacaccttctcatttctaaagagtcaccactatcttttcattctattacaacatgacttgtaattcttcctgctcctttcctctactctactatagtatccccagtgactagtaatgtcggacatataccagattctcaataaatatttgttgaattaattaactcattaccaccttttgatgtttcttccatgtaaaatgtccttcatttgttgtacttgtacaaatagctcaagtcacgctttctccttaaaatgttccctgactccaaaaagaggtacttactcctctgtgttcccatagtactttgttaataagtctattataggtgaaagttatttaccttttatgttatatttatgctactgtttgccttatttttcccattagacattgacattcttaaggacagtcatcagagtgctatttatttttggtatcctcaccgtctttgcaatgtttaggtgaatcagcacagggttggatattgggatggatgtgaagttactaaaagcttcaccgaagagacagcatttaaacagtgctgttttcaaagtggtttctgattaaactgaaagtaaacagcattttctaagagtgcccagaaggctaccttagctgaaatacagggacactttggaggaagaattcatggcaaataagggtggggtggtagatcagagatgattgtggggtctcctgaatgacagataaatgcattccttttttttcctttgggcagaggtgaactatatatggtttgtgagcagagaggtgtacctttctcaaatttatagctttaggaagttattcagatgtcagtatgtcatgtgaaatggtacaaagcctgcaaaggctattggaaaaatattgtgacaatccagaagggaagaaatgtgtaaatgagaagtaaaaaaagagaatggtaaggagacacattgtaaaggtaccttccaaaggaccaaggaatgtggctgctagaggataaggaagagagacgataactgagatttcaagcctgagtgacagaaggcgcgctcctgcttttaacaagagataggaaatacaagaggaagcatgagtttgtgggagaagattatgagttcaattttggatatagtgagtttgaagagcaaatatgaatctgaacgtgaatatcagcacctacttaaactcttcatatcaggattgctttcctttccctattaagtgacttgaagaactgtcagttggtcagatattcaagaccaaattctttctgctaacagcagcctttaataatgactgccattttgactgattggaagatgctatcctaatgtgatctaacagttgaagcataaagtaccactaccagtgaagtgaataacaaaattacaagacatcagaaatgtaaccctatgaattttaaatagaagagaatgcatgcttcaggattatttttatataatatgagggtagtgttaagaaccaaatggaaaaaaaatccttgtttccccaaattgattaaaattttgatttttcacagtatttccattatgatataaaggtgactgatgctcatttcctatactttagatcttttgaaatacattaattttccctgctgtgaaaaatgacattcaaaaacagggttgtagggagagatgacaactttattagtctgtcgtataaaacaagttcttcactctcttcaagatctgtttctttctacaagtgacagtctgacatattctattatcaaattctaagtagccttgataaagcaccaataaatttatccttacaactaaaaataaaaaggaattctataaatgcatacctaggaaaaaaatgttaagaggctggtcatcagaacgattctatttgccaggttttttttttttttttgagacaggagtctcgctctgtagcccaggccagagtgcagtggtatgatctcggctcactgcaacctctgcctcccaaattcaagtgattcttctgcctcagcttcccaagtagctgggactacaggtatgcatcaccactcctaactaatttttgtatttttaggagagatggagtttcaccacattagccaggctggtctcaaactctgactttgtgatcctcctgcctcagcttcccaaagtgctgagattgcaggtgtgagccactgcgtctggccttgccaggtatttttaaaggactcttacactgtgattcctgtgcatgactgatactgtgactatggtcgtagcaggtatagagcttctaccagtagacttttccactatggaggagagttttggtacgacctacttttgtaaagcattactcagactagaaatatttttaaattttcttagagaacgattactcaacgcagtgtaaagtgatggtttaaaaacatatatgtttctatatattatcatttatggattatatccatttataatccataaacgagaattccagtagataactctggggattttggaatttaatgaatgtgtatcaaattaagatctgtgcattatatcatttatgcattgaatatgtttgagttaccataaaatcaaccaaacatggtttgattgctgcctgaatgagcttctaatcattggaaaacaattggaacacagcagggaaaggtaaatacacaaagagaaagtaatggaattaaatgcccagtgcttcagctcctgccatctgctttaacttagactacatgtagtacctaaacagcttgatatagttgaaaaaaaaacacatttgttagcatgaatgctgcccccaagtaaactttcctagcctgttacatcccaaaatctgttatactcttttcagatcgaagccttaaactctgaagcccaattacacagaggtggtaaggaaggagagagctatatctactattgctcttggcctctctccaactgcacctctttggtcaccctagggaggagggttcctgtggggaattagtgggggacaggattggaaagttggcagagacaaaattcttgttgctttaaaatgccatatcaaggaattgaatttgtaatatcttaatgctttcatacagaaaaggttaagagtgatgaaaaaaatatttaaaacaaatttttaaaaaccaaacggctagactctcaagagtggaaagtttggaacctactataacaattcatgtgatcaataaacttcacatctattataacaaggcaaacgattcatagttagctgcacttgtactgactgatttcctgtaaagcatactttcattatctttcatgcatgtttgaaaccacctattctggtatgagagggaggaagagtttcataacattaaagaaactctacatcaaacttaactgaccctaattagcctaatggattaatgacattttagtacttatgatttatagtaaacacctaaaagcggaaaaggcttctatgatgtgtgattggaagtagcagttctacagggaaaagatgaaaactctctgaactcaaagaagattcttcaggaaacatagatagactacataaaataatgcctttactcccaacatactttttaaaaattctgtagacaaaatgattttgctgtttcatataaatatactcccaactctctcatgccctttttccctaccacttgtccagtgtgacacattgtcttctgattataatcatgctgtatcacccagctccactttttttccttgaagaaaattctgttgctggattgtcattctaaatgttttaattctatcaatttctatctcttcccacaataaacatcattctcacaatatatgaacatttttcccccaattctctgacctatatcttgaaggttagaataatataaacacatgataaaaagctttgaaagcttttgtgcagacatggtggttagaaaaaaatgttctccttttaaagacaaggatctcaatattgagtttttcctatcacagcttgaactttctatgaagtctacggagcctcctctttagttacataagcaaaccattaaaatgctctctatcagtcccttgtcattagcatatttttgaaatcacttttttcatcatcgcactagttatatgtttctttcctaaaatgtcacatctgttcagatatcccatgttcttctttactcacacctgcaacccacatttcattctgcttccaaccctatcttttcctgtcttttcttatcaaacttttctactataatatctcctctgatttcctagtctgtggtcaagaaaaacctctctacctctttgcttcattaatacttggtgttctctcacaataaggcccaataggtcattttcacaagtagagacttcatttttcttttctcagcataaggagaaatttatttttgttctatttcatcctacctcatgctactcatctcaggttagcataaagtagttcaccctgttttgaagcaaaatttctacccatatcaacttaatctcacctcaatcaacaacctctgggccatccttccctatttttggaaaatagtacctagtccatagttaccctctttccactattactattatcctgaacgaatgtaaaagatggtccatctactttgattagaatctaattcagtctttgattcctcgtactccaatgacagaaattcaagtcagtttagaaactaattcacataatcacaccatggacctttgtaattagctgaaacccttatacctctaagaatctaaattctgaaattcccatttctgcctatatcttaattttacaattctttatcacctctactctctttcatatccccttaatcaaaaatcttcaccagaattcctcaatacttatgttgttcaacttcgcccttttggatttgcttctcaccttccacaacagaaccccgtactttaattatttcacgtgctgttgcctggccccttagtcctattgtatatatatattctcatttacagattatatccatttataatccataaatgagaattccagtggacaactcaggagattttagaatttaatgaatatgtatctaattaagatttgtgcattacatcatttatgcattgaaaatgctgtgttcctttatcatgggcacacctcttggcaacctctcaccttgtatcaaagtactgtctcaacttaaagactgtatatgaagaaaaagaagaagtttggtctaacatggaccagaatcttcttctgcaactcactactagttttgtaatgctgcgagcttcagttttcttgtccgtaaaatgaagataacttttcttttcatattataggaggttataaaagccacatgacataaataccctggctcagggcagacacttgataatgattctccttgcttctacctccttctccacttaaagagggtctgtaacctactcacattttaactgtatctcaatattcttcctcggctctttttctcattctctacaataatttatttcaatgttttctttagacatatgcccccacacctggttcctgattctcaacatgtggcatgccctctttctttcctttttctagttaaaagactctaaatcatgaggttatgaactccctcaattttctttccacacttatttagatattttcccctgctatctcaggggaagaagtaacttcttttcaaggtcaaactgtctatcactaatattgattttatcatattttgcctctgctaagatgatattctatcaatgatttcttctctggcattaataatctctcacctctggatcatgtccccactcaactaatctgcttcatcctttaaaagaattaaaaataaaaatatacatttctacccctcacctcagtaatgaatgttgaaaactcttttttcaaaggtcaaaaatgatctggtcattggcaaatgctgacccttcatttggttcttatctctgcagtttcccacaatattgcccagaacctctcttttaactatcttcccatggtgtctataatgcttcccttccaggtttatttgccccatagtttcctgagtaaccttgtttatccatctttaccaggtcctcttctgcaattccaccacaaatctctccatattaaactgacattatgtaaataaaatggaattctacccatttttttcagtagagttgtttttagaaaaagaagtcatgacaaaattttaaagttattgctatgtgtccactcccatccatgtccttaatccagtctctaccatgtctctcattttgattgctgtgctgtgtattaaaacagcagtgctcaccataacatgtattgatcttttttcctatgtttattgaggtataatagagaaattatataaatttatggtgtacaatgtgatgtcttgatatacatacatattgttaagttattaccacaatcaaattagttaacacatttaacacctcaccaagagagtgagagagagtgtgtgtggtgagaacatttaaggtctactctcttggcaaatttcaagtatacaatacagtattgttaactatagtatgatctaacatatatgtaatgttaaaaagttgcattcatagaagcagagagcagaatggtagctaccaggggctggggtggaggaaatggagagacgtttgtcaaagagtacaagctttcaattttaagacatatttctctttgtttatggatgccattttattgaaaaatctaacgtgtttatttctcataggcatacgttagagcaaactataataacacaattctgttgaagggatgagcaaatgaagtcatacttgggccaagtctctatactatccctaaacttcttgatactttcaggtctactcgtagctgaatgttccacttccaggcttttagtccccatcctctgtgcttgctccagatcgcattagagtcctggagggattttcactttaatggaggcattgtcagtttcagagattaaggtgggctattactgggataatgcatcacatctgattggaggtctccagaatgtagactaacgttgaggacattcttcagtgaggttgctctaatatatatactcgacagggaaaatgtgttgtccctgtgtaatgacagcctactcagtgttttaagaagcatatgttggccgggcgcagtggttcacacctgtaatcccagcactttgggaggccgaggcgggcagatcacatgaagtccggagttcaagaccagcctgaccaacatggagaaatcccatctctactaaaaatacaaaattagctgggcatggtggcgcaggcctgtaatcccagctactcgggagtctgaggcaggagaatcacttgaacccgggaggcagaggttgaggtgagccaagattacaccattgcactccagcctgggccgtaagagcacaaatccttctcaaaaaaaaaaaaaaaaaatagtatatgttgctcattagtatttgcttggtttcaggaagataaattcatataagccaacaatataaattataacacataagatatgaaacaatatagattataaaattataaatatatagttatagataataatttttttttttttgagactgagtctcactcagtcgtccaggctggagtgcaatggcgtgatcttggctcactgcaacctccgcctcccgggttcaagccattctcctgcctcagcctcccaagtagctgggattacaggcacctgccaccacacctggctaatttttatatttttagtagagacgggatttcaccatgttggccaggctggtctccaactcctggcctcaagcaatctgcctgcctcagcctttcaaagtgctgggattacaggcatgagccactgcacccagccgatatgtaatatattatgaattatatatatcttatatgtagttcattgctagaccttctcctgtcttctctttgggaatatttcagtctcattgttctctcctattgggtctctcctcttttgcataaaattgatatatcaggtaacagattcatacagcaatcagatattagtgattctttacacaggagatttgatgttcaagaatcatatacaaaggtgattagggacctaaatttcatgctgtattatgtttcgtctctattatagaaattgtataaacagcctgcagtgtgttctatttcctttccatggccaaatgggacaaatagtgatttcaactttccttgaagcatcatgccagtgtaagaaacaagtctctatcatttaagctgcaaatttaaacaagatcagactttctttcctaaaacaaaaaaatcaaactgtatatagtcaaggatacaacaaaagcttgagggaaaacagaataaaacaaggaatcttcctgtttaacattatttgaaatatatctctgggaattgttttaaaccaaattttaagactccaattttttgttgagaatacaaaggtaggtgtcaaggtcagcacataaggcctttctctgtgctatttatccgcatgcctggagaggattacatggatttcagagacttagtcccaagaaatttacaattgagggcaaaagaatatgtcatttgactatgtacagtgttttataatatcatgacttcttgataaaaggattaaggaaatgggatatatgtatatattttgccaacatgtagtagaaaatcccaactcttcctctgctatcactgttcacttccccccaccccaaataaatgccatgacattctgtcacccaggctgctgtttttaagattagaaataaaacttgtattgaaatggagctattcaaatatatgtaccagcaaatggggctacctgcatttcctgatgctctgcaatgacaaagcagtattcacaagggaaggaaaaccatgatgaatattttaggtagctccaagtctctgggaaaatcagagagtataccaaagaatgtagtaaaattgtatgtttttaatatttatgaaatcctggtgaggttaaatatgcctccagactggtactttcttaatacagggaaataattgcttcagaaaaaaattgctttcagaataaactataatactgaggaatttgtttgggcaattttataatatctttaataaaatgtcactttctaacaaccaacagatacaaagataatagggcagtgctatatggcaaagcaaaaatatagaattacagttttcctttcatgatgctactgattacatgagacataactaaaaggcaatgaaactgatcacaagagccacacattgtatagttaaaccttataatgcagattatcctctcagaacaataccaaaggtagtgtatttgtgtgtgggatcaaaggtaataaattatttattaacgtgagaaatagaaatatattaaattgttaaataggctgtccatggcagggaatgttcaatttattaattatccatgtaaagaactagagagagagaaatcttagagcaaagaccccaatctatcagaacaacggctcttacttcctaatttaaaagctctttcaatgagggagatgattttgctgatgggagtgcaaactgggaaggagaggccttctttaataaagaggcagaggtggagaaggtgagcaatttacttttgctgcatacctttttttatctgcttccaatgatgaatggaaacagaagatttttcagattttactttctcatagcaacagtatcataaatcatggttatatttgaaagaatgtgaatgattccttcaactaaagatcatttagcaacaatctttgagcgcacactatgtgcacaaaactgaaccatgttccagggatatggaggcaagtaacacagacatggtttttatccctgagcttgtcagtctaatgaaagccaaagctagaaaaattagaatatagtaggatctaaggctataacagaacgtagaaagtcagtgaggagcagtggctggcaatggggttaagaaggtaggttgaggccagcttggcaaagaacctaccttgagttataggataaagagattggattttatgttatgggcaacttgtaaacactgcctttatgccaattatgttaaatgaacttccaaaagtatctgcttggcagcaatataccaggaagggaatctagaaatgactctaaaaaaatccagaatgattttcctcagatcaaattcccaagtaagcaaatttgtccaaaatctatttgccagaggttaaaattaatccttacaataaaatatatctgatgatacactgcacaggacagggaattttaggagttaccagcttatgaacatgaacctctcgatatttcatgaaaaataaaaagtatgcctgttcacattcatcctttaccagctgatacctctagctcttgttgccttacaaacttgtttttctaaaatatttggtatcataaactcttttatcaaatagaacggagtgaagcagaacagcaacaactctaaatttctcaaaaatatgcaaaatgctggagaggcagcctgcacctgcagccccaaaagcaaatgtgttgaataatcagggatcccaaacagagctgcactagagtaatttactcagctaatcattatatgaaatagaacattagatttctgcaacaaagttgcatcaaagtagatgcatacctcattcgattaactaaaacatcacaaaatcatttagctcattagatggtttttaataagcactccttcctgggagagggcactgtgtcttttatttatttcttgtgcttgacgtttctggcacatggagatgtggtctgcatgattcaatatcctcaactattcatctcagtccttagtatcttgtagaaagatcaccgtgctttcagatatttaaaatacccttaagataagcatggtatttgtttgtcagtaaaagtttgaatttgggtcttgaacatgtgtcagaacagggtatctcaccttaatcagccacagaactaattttcaggcaggtacgtgttaaagattagggaaggacagcagctttagctcacttcctttagctcacactaactgacctttccagacctcaaccaattttgaaacagaacttcaatttaaatggttttctagtgtaaataaaagtgcttgggtttccaagaaaaatatgtgaaattgttagaaaatgtggaagttgaagtgtctctaaaatgggcaatggtagtattctggaaacttattacagttgccaataaccagtttacgaagtagggcaaacatttttctcttctattttttcgttaccttggccttcaaattctcagtttattatctgagactagtatatagcttttcatgacatctcctacagcgaatagtctctcaaccagtatgagagtgcacgctagacacctgtccatgcccacctacaacacacaaatacacacacacaaacttacttatacactgcatacaagaaaaaatcgctgtgcagcaatactgttcctgaaatgtgaacgtatatggtaaagttgtggtaacttagtgaagaaaaggaagagtaaaccaggtatgctttgttgtctaacactgtatctatagatttgaggtatatagatttctagccatggagagttgggaactatatggcatcatacccactgtgcttttgtgtttgtttttttcttttttaacatatctacagttggtaatgaactaagcacagtggttacctctggaatgagagaaatggagaaggaagatttcactatgtttgtattgatttcacaagttaacatttctacaattggaaattgttttacaattgatagtgtgttggtttaattggaaggttttttttctttcttggtggcacataaaataacagtgatcttaagatctatatgcttcagattctgcaaaatactcagtttttaaagcagtagcatatgggtgatttttgctttcttatgatcttaggtgtttttaaagtttttagataaaaaagaagaaggaataaaaaataataaaaggaaaatatgtgacaaattgttgagaaacaaaatagaagccgatagtggaacaattcatggcagaattaaatattataaggtgaattaaatgtatttaacttattagtatacctgtctcgtctcaaattagaatacaagagactgtgaaatctaaatcacctttgaattgcctctgggatacagcaccttgtctgctaacaacttagtaacttagtaaacattggttaaataaatggattatgaagtaagttaacttttaaatatactgtgcaaaatcatttagaccatgttttctatttctcacattccttaagcatttcttcaaactctgcctgcttgacctaaggaaaccaaacctatggcaatctaaaaaaaaacagttcaaaataataggaccaaaatggaaattgtttggtttgacactatattttcttgataataatcttgtattgtactgacattatctttgatatctctgattaaaaagagcttattacagtcagcctaaccaagcatttagggtgagggttcttctctgtgttcacatggcactgaacattctctgacaagatctcccaacgacttgtctgtttgacctttttgaaaagggaaaaggtttcattcatctttgtaactgagatgcttagtacaatgcctagcaatgagtgttctgtaaatgttgagtaaatcacatgactgaatgacacagtttcacaatgtagtatcagttgaccctggaacaacacaggtttgaactgcctcggtgcacttatgcaaatttattataaaaatttaaaatttagcaaaacatacacatgcaggcacttacagaccatacatggtgccattcccaatggagagaaatggaaacaaatgtaaagatacagttttaaataataactacctaaagttaactctagaacaccctgtactactgtaataatttcatagccacttcctgttgctattgtggtgagctcaagtgttgtgagtttccacttaaaacaccatgtgacactaaccatctccccgtgagcagttcatctcttcggtaagttgcagatcccaataaaaagtgatgtctcccggttccagtgtatttttcattgtgctttctgcaatatcgtaaaccttaaataacaccgttggacccatacgaagtgccactagtgatgccaaaagttctcccaggaagcagagaaaagtcttaacattatgagaaaaaagttgaattgcttgatatgtaccatagatggaggcctgcagctgtggttgcctgccatttcagacagatgattcatcttgtacacagacaatgtgaatttgtggtattgataaatacagtacagtacagtgaaggtattttctctttcgtattattttcttaataacattttcttttctctagcttatggtacaactacagtatttaggacatataacatacaaaatatgtgctaatcgactgtttacgttattggtaacgcttccaaccaacagtaggctattagtagttaagttctggggtagtcaaaagttaagtgtggaattttcaactgtatggggtcagcacccctaacccctgagtattgaagggtcaaccatacttgatattagcagtgcttattggtagcagaccacaaagatctctcttaggaacgtagccatacagctatgttaagcaggtgtggcaagcacaataatggcccctcaaacatatccctatcttaatccccagaatttgagaatatgttactttatctggtgagagggatgtttgcagatggattaaattataactcttgaaagattactgtggattatccaggttggtccaatatgatcacaaatgtcctggaaagagggaggcaacagtatcagagccgagaaaggagatgtggtgacagaagcaggggtaggagtgacacagggccgtaaaccaaggaatgcaggctgcctgtaggagctggaaaaagcacagaaagggattcttctctaaaacttccagatggaacacagccctactgatacactttagacatctccagaactgtaggataataaatttgtgtcttttaagctactgaatttgtagcaatgtgtgacagcagcaattggaaactaatatatcaggcaaatcgttggagataatttggggcttcaaatggcaggaaactcaaactggtttaaataataggatagcaagaagatgcattggcttagatattaggatgtctaacatggggcagaatgagttgctccattggctcaatgatatcatcagtgatgccacttaatttctgtctctatctctgccctgtatttctgtttcactgatgttatcctgaaactggttcccttataagtttgggaaggctgccagtagcaattggagttaaatttgtccttgttcacttttatcaggaaagagcccaccttctcataattatctaccttgatagacttgcactaatcaggacccatccctggagctccccctaagggctacctgtcacagggcccatgcctgaacaaaatcagggtcctattaggaaaaggagagagggggtatatgccagacagaatatttgccatgcaccacaaagaatgtcacagaatcctgtgccaagaatgtgaagggataaataaaagtggttaaacaaattgcagggacactgtgccctcagtcacagacctaggaaacaagttccagcttttacttggcaatgtttccccttgctctataaggacagttgtataatggaaggagcagcagcagttagtaaaacctcatgactcgttctgccaggcttagactggcagttagactggactttcttccacctggggaatggcaacgtgcccagcaccttggctcatcataccaccgtctggcttacctgctgcaggtcactgaactctggagtagattgacatcagatagcctcttgtgaattatccctaaaatgatgggtttcctttgaaaactgctaactcttcatacatttctacatatactttactgcattcttctgtgattgaaatttgcttcttaatatgttttataaatatccaacatgacagttcagaggaatttcctacccaaccaactctgtagtcaaagtaacaggaagaaaaagagacagatgggaaattatttcatttaatctccaacttccaatgaattattttctctaatattacagaagaggaaatttgagaactaaggaactaagctgcaaagcctataatgtcagagctgttattagccttagggaaatatgattcccaagcccatgctcttccttttgtattccttggagtcactccaagagttggatatatgtataaagttgatctacaagaaatgtctccttctaatactctccatgtgacttaaggcttattccagaactggtcctcatgtcctacagggaggctaagaagtctgaagacatcggacattctccaaatttatgtaaattagagatagaggtgaggaaagatccctctagactagttccagaagaaagcaagagtagatcaagttgcttaatgatctccttaggcctgttctttcctttaattgtaagggaaatctaagcacagtcacattgatcatcagaattgattagggtaatttggcttgccaggtgggcatactaaccatggccctaagcacttgcagaggactaacaaacaccaaagagaattcttcctcttcattatctttctgtttctgggaatcctttgagaaacaacacacaaatcaccccaactcgtgtatatagctcaggatagcactggtctccaggaaacagctccagacttaatggacataaataagcaaggctctaaggttcatgagggcacactgcattgtatacacactgcattcttagttccagacatagtgcctgacccctggcaaatcactagtgttatatgaaggaggtaagagcaggatggtgagatggtggtgaagtgcactagatttatgtcattattcaagaaaaattacagaaaacttttccttaaacaaggtagaccaaacctatagtaatggcctttaaaacagtgcaaatttcactattgttgttcacggggtagaaactagaggcctttttacccaataagatcatacgaattttcaggttttgcaaaatgtttgttagcatttgaaaagcatttccagttactggcaatcttcaagaaaatgcctaaaacaattttcagaaatgcttctattgaactctactgaaattacattttatgtagtcctgtgtgattgcttctgccttattgttcaagaactgttaataatgagtgagagttttaatatgcagaaaatgagcaacagaatgggacccaaagttcttttattttattttttaataaaaatttaaagaccttgttagagtcagtttccaggaataatttactggcatgtatgttgtttaatttatttctaatttaaagacaaattaattaacacataaagaacttaaaacagagcatatcttcaaaatgagatggctcagaagcattcaggattcacaaaacgttttttcacggcagttgtgaatttaaatcacagaatagaaatgataagcaccacagcatgtcgggcagcagcagtatgctgaacatggacaccactgtttgcatcactgtttccagtggacattttccacgatgtgaagtcaattattgcttccacttctacattagtgtaattggtttttgctctccagaggagaatttattaaggcaatttcagtaaataagggaaagggggtccaatttgctactgaatccattgggtatggataatcacttcgattttcctccagatcctaggggaattcttggtcctgctgcatgtattaaaaccctttttcctctttgcaagggaaagcagaatgctacctttttttccccaggaaagttggtatgcttgatgaagacgattctacgaagcagtacccctgaaagtattgattagcatgattttaaagaatactcagggcttgtacagagaacagttcaaaggaatgtacaaagcatgcgccttctctaaacatttttaaatgcttagttcttacgaagaaaacacatgctaaagctaaattttctaccgtttctgcatcaaatcagatccttgatcaaatcaagaggtgcttttctttcattaaagtaactctaagtatgaaagagcaatgatacctttccatgtgggcaagttctttctgcatagagcataagacataatgagatataattcataaagatgttgcctattttcagccaacatttttcatttacagtaaaatatttttggaatgcccaggagatttcattatttgaataggaggctggaacatcacatttacagcatgtttggcaaagtttggaatataatgtagaaatcagaattatctgcaaaattgttgatgcattcttcacaaattctgatgctgagtgcagctggattctatgggtgaagctcagagactccaggtgaagagcaacatcactatctgtgccatgtccagggagacattggtgactacagtttttctggccctggagaccccaattcaaagtagtagtcaatctgttacttaatccaatccaaacaaagcaaagctaaagaaaacaaaaacactctattagatgtctctgcaaatacaccaagggctagaacaccatttaattcaggtgaggacaagcagttctgcccctattatctggagtgttgctttaaccctcagctttgctttgaaaaccaggcctcgctttgcatcctcagtgcaatattaattcagaactgacttggatttgttccttgggcaaaaggttaagtgatccataaatttatttccctgtagatttggaaaaagaaaagtaaatatcacggtgatttgttagccaagttttgcagcaacagaatcattgaatacccctccagtaaccagagtcaatgctgtgtgatgaatagaaaataattaaaatatttatggctcacccacgtgaatgatgccaatgaccagaaagatcaaatcctcacagaaatctgattaatgagaaatgagtctaacctgcttcatgtttgactaagaactaaattccatcacaaatgtgcaaagaagcataattcatccctgcataatggctttttgttaacataacttcactgtgaagaaatgcacagtatctctaaactacaacatatttgttgcaaaatagaacctacatttttcaaaacctgaccttagattttgtgggcccctatccagtgactcaacattagtgtaataagtacgtttataactcatggcagctggtgccatgtgcagcagatcttgtttctgcaggtaatagccttcagacttaagctctttcacggaggagggtgtgcttgaaaagataatagtggtggagagattcttagagatggcaccatcctctctcagcaacaatagctcagttattgagtatccatcaagtatatgacattagtctatgctcactgaaagtttccatattgaatcctagtctcctttttctaaatgaagagcattgctttcatgtccctttgtgtctccaaataattgttcaatatgcagccagacaataggctttttcttttgagagtgatggaaagatatgccaggtacagagagcatcatggagtagaaggagcttcatgagatccgcttgtttgggcttctgcctctctaagcatgactgttgctgaagcgtttcataaaggagctctgaatgtcacacaactgaggccatgcctatccccatgcctgtacctttgctcatgaagcccccaccctactttcatgcccctgcctcactctcctgtcccacaaaagacaactccattcatctgaaagctgctatcctcttaaaacatactatgcttgtccctgagaatagaggtgaaaaaacacatttcaaccttcactgaacttataatccaatagggaagataggcattatgttaagattatcacaaataattaagtgattacatattgcatggcactggaaagaggttctgatactatgaaggcatataataaggggtcctaagcatagtctaagaaatcaaaagaggcccccaaaagatttacttagactacactgggcacagtggctcacctctgcaatcctagcacttcggtaggctgtggcaggcagatcacctgaggtcaggagttcgagacaagcctggccaccatggcgaaaccccatctctactaaaaatacaaaaattagccgggcatggtggtgcacctgtagtcccagctgcttgggaggctgaggcatgccaatcgctggagctggggagacagaggttgcggtgagccaagatcgcaccactgcactccagcctgggcaacagagtgagacttcatctcaaaaaaaaagaaaaaagaaaaaaaaagacatatttagactagaagttgaaagaaatgtatttaatgaggataacaaggtgtttagaggaaagaccattccggccagacagaatctaacttgttaaggctgagaggtgggagttgggtgagggcaagtgttgtgaaaagtatatgggagagagattatgtaaaccacaggcaaaatgggaagtcatcaaaagacaagtgatgacatgatcaaatttagatttcttaaaactcattctggctattgtatacattattgttcagaaaaagataagtttctagaccagagcagaggctgttgcaacaattcatggacatggcaaacctttaaatctctgttgataaaacaactttgcccatcagcctgttatcactgacatattacttttttactccaggtgattaatatatatttaagacactggacccagaacgcttatgatagcattgttattttgaatatgagctactaaagtgtccaagaccatctcagaatatttcaatttaaaaccaaatctgttttttaatgaatatacctattaaaacacttaacataaagtacacttccccttaatcttggccactgaagatattggagttgtctgaaaggacttgctattcatgaaggcatgacaatgcctatctgcactgtttgttataatgctttttccccaatcatttttgttttataagtggaattttcctttcctacttaaatactgttggtacttattagcacccatttttccctagagatgctacagataatcctgtgaaacatgaggtgaagaaagttaaatataacagttaatatgaatgtactaccaataatacctatgtctccagtgtgacattttactcaggaaactgtgttgggtttcagagtagtgccatatttcatacaagggaggaaggtctgacaaattttcctctccacaaccagtatctctgctttcttcctccctatcccatgaataatgtataagaatttcaagcatcttggatgtcctcctggataaacaatctgtatccttcaccaagcaatgggtatgtacttacaagccagtggcagaacatgttttccaggcagcaaaactctttttcatttccctaatttctgcaataggtcatcaaacatgccatctgctgagctgttttccaaagcatatggctgctgcttcaagtggcaatgtagaagaataactaaaagaagtcatatgtaggagagagtaactaaagcacatactattgagtcactcgtctccatgtccttaattctatccctgagtcaagttgaattcctaaagtcctcatacttgaaacacattagatttctcctttccatattcactgtcaatgagatccattttaacattatattttcaccattgacaaccagagacaaccatagaaaacccatggtatgtttactatcaaatggtattgaaaatgtgcttagtcctgtcataacactaatagtcattagataggaagtgagcatgatgtgctacgcacagctttcattgttccagacaagcagcatagctagtagttcagtacacagttcagccaagacacctgggtacgggttctgaatctgtcactcaatagttgtatgctcttgagagttaacttcttagtgcctcatttgtaaaatggggtgaaagataacagtccctacctttgggattagtgtgaagattaaatgacttgatatatataaagcacctagatcacttcccagcacacggtcaacattatgtaaatcttatatatcagtatctcatttaaaccacatgcaatctctatttgatatatgaagaatctgagtcacagagggctaaataactaccaccaaggcattctgactctagagcctatgatcttaacgagttctttatataaagacttgtgagagaatatttttatttttagggttatatctttgttttattaaaactctaggccgggcacagtggcttacacctgtaatcccagcactttgggaggccgaggcaggtggatcacatgacgtcaggagttcaagaccagcctggcccacatggcgaaatcccgtctctactgaaaatacaaaaattagccgggtgtggtggcacgcacctgtagtcctagctgcttgggaggctgaggcaggagaatcacttgaacctgagaggtggaggttgcagtgagctgagattgcaccactgcactccagccttggtgacagagcgagactctttctcaaaatataataaatgaacaacaacaaaaaaactctaaacttattttttgagttggctgacaacaagcacagatccaaatctgaagttcaacaataaagtcattgtattgaatttgctggtttccatttgctttcacatggtctctttttcgggatcttgattttctattaatattccaatttggctctcacatattatctgccttttataataaccacctcataaaacgacttaaaaagacaaaagtagggctgggtgcggtggctcatgcctgcaatcctagcacttcgggaggctgaggcaggctgatcacttgagcccagaagtttgagaccagcctgggcaatagggtgaaaccccatatctacaaaaaatacaaaacttagccgggcatggtggcattcgcctgtaatcccagctacttgtctacttgggaggctgaggtggtgggatggctttagctcgggaggcagaagtggcagtgaggtgatgtcacagtgagccaagatcacaccactgtactccagcctgggcaaaagagccagatcctgtctcaagagaaaaaagaaaaaagcaaagacaaaatttatgaacattgttttttaagaaacatttttctctgtggagtcagctaaatatggaaatatggaaacaaagtttatcaaatagataaatgttgttctaacaaggaccactgaagaatgaaaatgagaacactgtataagactatgaaacaggccaggcaatgtggtacatgcctgtaatcccagtactttgggaggctgcggcagatagagcacttgagctcaataattaaagaccagcctgggcaacatggagaaaccccatccctacaaaaaataaaaaagttttagcctggcatggttgcacacatctatagtcccagctactcaggaggctgaagtgggaggatcacttgagcccaggaggccgaggctgcagtgagccaagattgtgccattgcattccagccttggcaacagagtgagacccttgtctcaaaaaaagagaaaaaaaaaaaacaactatgaaatagggagaactactttgcttttgacagttgcgtaacttttctatctcagcttctaacagtcatatacaggcacactgcactccaaacccaattaatttaacttctccaagtcaaatttcttgacacattatctttttacctggagcatttttactacttccttctacccagattgttttctgttcagtctttttcccttcaacttccttttatattttaagatttagctcaaaggtcatctcctctgtgaagtaagcattgtctgacaccttagccatttgatgtctctccctcttttgtgttcttaagatgccatatatataatattggtaaggcattctattgatttattttttattcttttaacaaatattcattgaatttctgctatctaatactctatattaaagtagaattatcatatatatgttatttccacttttaaaaatagggcgatgtttgatccatcaggaacctgaaacagagcagcatctcagtatataactgttgagggaaagaactgaccaaataagataattttatgatttatagtcacattctaatttttaaccaaaggtgatattattccaattggacttttactttccaccacattctaaataccttttggtgctttcaaaaaataaaatctacccttagaaatattcaaaagtgtggtatatgtccatcctcacgctgctaataaagacacaccagagactgggtaatttatgaaggaaagaggtttaattcactcacagttcagcatggctggggaggcctcaggaaacttacaatcatggtagaaggggaagcaaacacatccttcttcacagggcagcagaaaggagaatgagtgcccagtgaagggggaagccccttataaaacatcggctctcatgagaactaactcactgtcaggagaacaggatgggggagccaccctcatgattcagtgatcttcacctggtctctcccacagcacgtgtggattatgagaactacaattcaagatgagatttgggtggggacacagccaaaccatatcatgtggttataccataagttttacatttctctccaagtgatgaaaaaaatacctactattgctatatttttaatatatattttaatcataaaatgctaaaattatcctagtacatattttttaatgtatttgatacatttttcctgttggagagattcacatttttggaaatgctagaacaaaaagaatgcacatattccagatctactgacctggaaaaatattaacaaatatttttatattttatattttattaacaaataacaagctcacaaatagatacaggtttggtagagcctggcacataaaatagcagggtccctatttaagaaaaaaaaattattaatagaaaattgctaggtcctctccctcctaaggccttggaagggcctatacaagtgaggggccctaaagtacatggttcattaatgtcatggtatacctgcctgtgtctgttatgtattgttaaagggaagaggaaaagttaaagaatatatatgatctttacatcctcctgaaaataattaaaccactttatgttatgtatatgttttatgggcaaatgaaaactctggaataatgcagaaccaaattattaaaatcaccttcatcaagacagaattaagtcagagggtaagataaagtaggagtgtgtgtgtgcatccacgcatgtgtctgatcattttttagacacctttattttcattattacagcaataatgcactacttttaaatttcaatcccaaaataaactttactgggtggggaacaaaagcatgtgcatgtgaaagaattccaaaaaaggaattttttggatgtctttggaataagtccatatcttcccaaagttactatatgaatataccacatatattggtttctgaaattctgctatatttgatacaaaattagccactttcttttctgagaacattgcctgtattaatagactgttccccaggcctctcataaacacaagccacaagacaatcagataagaagcgagaacgtaaaagctcagtgacctaccaatggggtgccaggtaaaccatctctggtaaataaaagacgcccactgtatcaccctgaaatcacttaaatcaatcatgttttgaaatcaagagaaatatttctctatagataagacaaacataaaatgaatacaaaggcatatgtaacccacaagaataaaatataatcaagacaagtcaagccaaaaatatatctcaaaacatccatgcgggaaccagttgattgtggcagagaaaaatccaatatgtatttcaaaacaacttatcacaaaaagaaattaaggcaaattcacactaggaaaaaaatgtttttcaaaataactagttctaccaaaatttgtgcaatctaacgtgtgtgacagagttgtgccaacagtattttccagcaggagactctatggttccaaaaggcagaatttcatagcaatacagggctaatgattgcaatgtatgatggtagttctagcctcagctccaagcatgaaagcagatacctttctcttaggtgttctgacaggcagatattaaagagcagcatgtgtcagaagatgtaggaaatcaactggcctctttgacagattttaatgtagaatgtttgtactgccagggcagtgggtatgacaaatttgagagatgacagtaataggagtgtttaagtaagagaacaagcttaatagagatgccactattgacaataacttgcttatgttaaaggaagagtccttgctttcattttccactgaaaatcccaatgccaattttttgaatccatttttactaaatattacaaaaataccttttagtcatttgcaaggatagaagactaaactgccagttatattgcctcatctgtttttcaagatacctcattccatcatatcattgacattcttcagttagggcattagtctggaccgaggcagaacctatgtaaaacgttgaagtgactgtgaaatgactgcctattttttgttggagtgcacttcaaattaaccttggagcccaagctcaggaatggttattaaccaacgtttgtactgaagcccgacactatgtgtaggataccttgtaattatcttaagccaattgtccagttattctgtaccacaaataaaatgtatgaaacaatacaatttttctctccaaaaatatatacacattttgtatttcttgcatttctctagtattcaagttaattacagtttcaatattatacctccagtaatggcctccttcctaggtatttgaactcctccagaaatgttttactctaactctgtatgcatggtcagtggtagagcatttgggagggtgaagtgccagttgtgaattgatgctaaatgaatgggtatgcttttttttttaaaaaaaaaaaaaaaaaagtccttttcactcatgggctttaatacccatgtaattataatgatttcaaattctctcaaggctaaaattaaacttggcttcctggatggccaaacaattgactattcttctacaccactcagctcccactttatctcaggctcactttgagcacaaactggttaaaaacagtcataatccaaatgctgaattaaatatgactaaaagatataaactgaatgggcagtttaaatctagtatcatccaattagaaccatagtggagcattcatcccctttccacctccccacactcccaatggagtgggagaggcaggggagcacagcctgagttctaggggcaagtgtgggtcatggtgctaaagtccaactggatggaatatgtagagccaaggggaaagttactagaagcatagttccattggagagcaagatcaatgtcacagagatgatctgaaatggagctgccagtctatagaaggcttggcaaaagagacaaggccatgtacaaaattgataggcagaaacaaggagattttcatgagaaaggagtcttgaaacaagtgcagagtaaaaccaagaaatattgctaaggttgtgaagaggcagctgggtgggcaagaggattaggtatttgtgacttcagatgtgatggttcttagaagatcttaaggacagtggaggacactattactacaccagagatcacaaaatcatgacctgactgttgacaggctgtttgcatatggatttgagcagagacactgaacccaaacatactgggtatgaatcttgaccctactacttactagttttatatgatacaaggcaacttccctaagctttgtagcttcaatttcctcttctgtaaaattgggataatcattagaatgattttgagcagtaaattggttaatatatgtaaaacacttaaggaaaatgaaggtcaaagaaggaaaaataaaaatatttttgcttcatctttttcattcaaaatttcattaaacgtatttcttctgatctgatgaaataaattttaaactatattcctaaaacttagattacctaatttattgaataaaatataaatgggaaaattggcactacattttatccaccaaaatgaaaatatcacattgaagaatgggttaaatatggtcaattaaatgccaaagctttaataatagtaaagaaggaaatgggtagaaacacacaaggccaaaggaaacacagaggatacaacagagggaaagaaatgtcagtggaaaacagatcatggagcggtaactgacttaacagagtgggagaagtagggactcaaatgcctaaagaagacgacttccacataaatgagctaatttccaccactgagctccctagccattctggaattgatgtcaccagctacaaagaatttaagaatgaagtttggatctgacacattgtataaagagcattctaagcccctagatcttctctccaaccctgctcaaccaggcaactggttctatttgaaccacaattatcaagagaaaggaggtttgtccttcagaaaagttaaatcaaaaggggccctggactcaggaatacaaggcacaaaatatgaacacaacgcagagatttggaccaagagaattctgtccatctttccccttatccagttcctggaacacaggtcaccagtgagcaaaccacaagattcattgctgaagaaattgaatagaacccaaagaaaatgcctacagatactaacatttgagggtcacacattaaaaatgtcagcttgccactcagtctcagaattttttttcttctttttttgagatagggtttcactcccatcacccaggctggaatgcagtggcaggctcttggctcactacaacctctgcctcaagcaatcctcctaccttggcctctagagtagctgggactacaggcaccagccaccacacctggctaatttttgtatttttattagagactgagtctcaccatgttggccaggctggtctcgaactcctgacctcaagtgatccacccgcctcagcctcccaaaggctgggattacaagcaagagccacagtgctgagcctcagaatcttatccctgtactcacccttcctcaagaacccccagaaggtgagcttttcccatgacagcaagcccttgtttgggaggtagagtctttaagaaataatcttaaattcatcaaaatcatcaaaatgaatttgatgcatttgacctggggaagaatagtattgaaagaagttttatagttctgaagaagagtttaggagtaattagtgacaggtagatagaaaaccaacctacaaaggaaaaaaaaaaaaagatcatggagtggtcactgacttaacagagtgggagaagcagggacccaaacgcctaagagaaatacttccatagaaatgtgtatgcatatttacaataatatagctactaatttgttaacactgaacctagaattgtgttctaaattagttgaaagaatgaagagataataactgggtagaattacataagagtctaatattctctcttaataggaagtccatagaaaatgtttaaaattgatgtattaagaaatactagtggaattcattattatccaagcagctaaaataatttaaagtaggtattgctgggaatgaaacttcgtggtggaagggtttaaggcagaagttatttttcactatagttctatagaacttgatttcttaaaccatgtcatatattttctcaacaaaagttaaaattgaagcacaaatatcttgtatgaaagcagtcatctaatctcttttcttgaaattagattaaacatattttcgtgaatctcagacagtttatagtgggtaacttatctttgttttggttgaatgttacaatagtttatgctctgctctttggctatcagcccctgaaggaaatatacaaaatttggctttgtcttgccatgtcccatctatcaccaggtagggaagttttgttcaatgatcccctgaattgagtttaatatgttattttttaatgttagactagtccactggataataaacataaaaggcaagatatttatttaagtatgtactcaatggaaattagtattttcaggtctaaaaaatttttatgaatattttcccaaaatagcaaaataattaaactaaaatataattatataaaatataattaatgaaaataaattgttatacatatcaagatcatttaagtcaaaatgtgtgtgtcatctgtgcaaaattaaacatgatcctatatctcttttgcgtttgattggaacaaaggatattttagacccccaatgctttacaacactcataatgtgaaattggaaaaacaaaacagaaaattgttatacatgagaagtaatgaaggtattaatttctagaaaaagaaacacatcaaagctttagatttgctctaaaaaatgttttgaagggtgaatattgtgctattttgaagagactcctaatttagaaagctcaaataatgtctattttttaaaatggaatctttctccagtcataggaaatgtaccaccacaactatgtaatcaatgtgaagcagatggtggagcaattatctggtgtatttgggcactaccattggccaatacacagaatatgggccaggaaatttattctgtgttttcaagctgcttttgggttgtgatggatagtgttgcttaatgaaaatctttgtattaatttagtttccattttacagtcctcatctaaataggcatctctctttgtctctgtctctttctgtctctatttctctctctgtgcctcttttttctatgtggctttttttctctctctctttctaagtcaagtaagatctatacagtgatgattttagaaatctaataatttgagctttatttttaaatatcagcatagcttgttactttttttttgaggaaatagctactccctataccagtgtacaaatctgagttatttcatttacttaaaatcatctagagggttcacaattgagagaagacactattttgctgattctgattatgtaattgagtaaaaaaactttaaaaatacattttaaagcacctactttgagcacttaggataatatcatcctaagagatattttacctttaattccaactaaaaattagctattaaactcatattggtttcaaacttttattttttactttgtctttttagatcagttttagtttcacagaaaaattgaaagtacagagatttcctatatatcccctatccccacacatgcacagcctccttgattatcaaaatcccctgccagagtggcacatgtgttacacctgatgaacctaaatgacacatcattatccttcaaaacagttcacttttggtgtggatttggacaaacgtataatgacgtatatccatcatgatactatggtatcgcagaatagtttcactggcctaaaaatcctctgtgctctgcctattcatccctacctccccacaactcctggcagccacagatctttttattatctccatagttttgccttatccaacatgtcacataataaaaatcagacagtatgtagcgttggccgattggcttctttcacttagtagtatgcatttatgtttcctccatgccttttcatggcttgttagctcatttctttttatcactgaagaatattccattgtctggatgtaccacgctttattaattcacttactgaaggacatcttggttgctttcaacttttggcaattatgaatgaagcttctataaacattcttgtacaagtttttatgtggacataagtttccacctctttgggtaaatacaaaggaacactattgtgaaataattggcaagagtatgtttacttttgtaagtaaactgctaaaccatcttccaaagtagctgtaacattttgcatcctcaccagcaaggaatgaatgttcctattgctccacattctcaccagcatttggtgttatcaatgttctggtgtatgtggtaccttactgctgttttaatttgcatttccctgatgacatatgatgttaagcctcttttcatatgcttattcaccatctgtctatcttctttggtaaggttgtttaaggtatttgacccatttttaaatatttttatggtaagttttattttagtttcaatgtgcagatttgtgatataggtaaactgcatgtgacaggggtttggtgtacaaaatagttcatcacccaggtaataagcatagtacccgataggtatttttttctgatcctcttcctcctcccaccctccaccctcaagtaggccctggtgtctatttttttttcctttttgtgtccttgtgttcttatcatttagctctcacttataagtgagaacatgcagtatttggttttctgttcctgtgttagtttgcttaagataatggcctccagctccatccatgttgctgcaaagacataatctcattctttgttatggctgcatagtattccatggtatatatgtaccaatttttctttaaccagtcttcagttgatgggatttatgttgattctgtgtctttgctattgtgaatagtgctgcaatgaacacacgtgtgcatgtgtctttatggtagagtgatgaatattcttttgggtatatacccaataatgggattgctgggttgaatagtaattctgcttcaagttcttctgcgactcatcacactgctttccacaatgttggcccatttttgaattaggttgttttcttattcttgagttttaagagttctttgtataatttggataatagtcctttatgaggtatgtcttttgcaaatattttgtaccaggctgtggcttggctttttgttgtttattttaataaagtcctccagtttgtttttttaatgattatatttagtatcttcatttatcactcactattttgctctgcagttgctaaaagtacttagacacattgtatatatacctagttttagaatactttgtgcttctctgataattcaaaattttgagttctatgtataagaaatgactacatggtaataatggtgatctgtaattaatattttttaatgttttattgtttttattttccaagcatacataaaagtgaagaaaataatctaataagccccatttgtccactacccaggtttgacaactgttaatattttgacagttttgtttcattgatcccttcttcttacatgttcatgtgttttgttcttaagattctgaattcccaaagaatatatttttaaatttaaatattgacaacagcaaaatagtatggtttctcaaaatgattccacaaaataatttttatctatttggttgtttatgttcttatatattattttaaaaatgatttctttagaaataactgaaatatttagtattcagaactttttatagatctacatcaagatcttttgaacatgtgcaaagttgccactgaaacataaaatgtatcatctttgataaatagcccttaaaaaaagcacttttctttagcttttttcctaaaaatactgggatttactaggaaagtataaaaactatactgtatgtttctaattttagagtttataaaaattttattctgtttaatataataaaatccagtgcagcttgctgtaattgttgattttggcaagatactctagtgtatgaatgccactgagatattaataatcatagtatctagttaatgcaaaaaagcttgaatttatataaattttttaattttcttttttttttttttttgagatggagtctcgctctgtcgccaggctggaatgcagtggtgcaatctcggctcactgcaacctccgcctcctggattcaagcgattctcctgcctcagcctcccaagtagctgggactacatacaggcatgcgccaccatgcccagctaatttttgtatttttagtagagacggggttttgccacgttggccaggatggtctcaatctccggacctcgtgatctgcccgcctcggcctcccaaagtgctgggattacaggcgtgagcccccgcgcccggccatatttttaaattttctaatgcagattgcttgtcttataggtgttcaaatttttctattccttcgcaactataattcccactttacccctaccttccctgcagtttatccttgggagtttttgcatttaatagcctcactgtagatcaagggaccccaaacattggcagtctatttaacaaaatacttgagctgatttattgataaaactagatgcaatttatttgcataagagtcttttaggaggcaagaggatagatagatagtcaaattaaagacaatagaaggtaaagcacagttttcaaggcctacaatgtggcttattatttctttgttttcttctctaatgcaaaaattggctctgaattgcacatctggaatgactatctgaagtagaatttttttaaatgcctagtgtcattcctcctaaaatgacagcatcttgttcttcatttgggtagttctccgtatgcactctcacttgttctggtcagcacttaatcctggcctggtgaattagtaaatcacacccttccgcctgccagccacatgatccaagctaaccaataagggaaaatttttaccccttatgagactgctaggcaatagaggtactctttccatggaatttgaatttggtaggccatgagcctgaacccagactaccaagtggacagagtctgcctcagtatggatttacactgctggaatcagaatatagagacaatgaaagaaggcatcctaataacatcattccaacctcttgatccagccattattggagtcagtttatttgaatttctgtgtgataaatatatttgttaaactttaaaaaaatttttccctttgccacattgagttgactttccttcacttgcaactgaaaataccctaatattccatttattcagacaagtcacactccatattttctaataattgtacttccaactttgccatttttatgcctcctgtatatagctaaatcatgcgtgcctcattactttaactccaagtactcatcagtgcccttgatctcaaattgtctactagctttcagcaaaagcccatttgatccaagtgggctagcagatgaagaggttaacagtgagaaagtatgatggagagaggctgaataaagaacaaactaatcacatgttgctttaaattttctatgagatataaagccaggtcatcggaatgtaatattatagaatgttagctgaaatttccataaagatgccttcacagaattattagttaatataaatttatttagcagttcatgtagcagccaaattagcttaactttctggcataactacttttgtttcccctcaggctgcaggatagaggaaattttatagacatacttggttggcatccttgttcaaatcctaactctgttatcttaatggaggtctttcatgtctctatgattcaatatctttctctgtaaaatgaaaataataatgttgcctttgcatttgattgtaaggattccataataaacagatgtgaaatatttgggaaaaagtgagataataattgtaagctagtggttctatcttttattatcaagcacttcaaattatttaaaaggaaacctccattaggtattatgcctgtggggcttactcaggtaatatatagtgacatatataaaattcagagctaatctatgatttcagagagtttaatattttttaatcatccgattatactacatactacatttaaactaattaatttagccattcccagttcatacaagaccttcgcatttgatattgcagccattcttttgctcttgtgaggagggtatccatctcaattataattcttttatcacatatttgcatatcttttttttactataactattaatggtgtagtgatgctgatttatcacttagcctcttttacctaacaatgttgccctgaagtaggaaaggatgaagttctaaaattaggatgtaattattaacaattcaccacctgaacattaactaacagaatctgacagtggctttccccacagacaaacctccacattcaagaaagaggattcctttataatgaagttagttctgacaccaatgtacattaagagaacaactcccaaaatattataactctgacttttagagtcttaaaatgtagttatggtttcagtagtaaaatctgagcaatactaagggtggttttattactttacaataagacaaaaatgattaatttcttaattaaatttttgatattaaatataagcccttggttcctttgcctatttctaaacaacaaagaagaatatatcatagtctatgatttgctatgaattatgttttgtgatggcttatcgaatcctcagaactgaactggaacttgcatttcctctgttatcagcaaaagcttttctgaaatgtttgcaaagctccagatatatggggttcctgaataaatattatcccaacactgatcagctgcataggtgaagaccaagttaggaaataggtctacaaggatttcttaatgaaagcaggtggctgttgatattttaaatagattcaataattaattagaacatttttaggactttaggtgcatttcacaagggatttctgtaatattcagaaggtagcccatgtaggaaagcacctggttcaagatcatcattcatgctctcctaataggggggaaatatttttaaaactccacacaggccaaaagttctgttcctagcaaggtagacttaatttttttgatatattcacatgctatagtttaggaatttctggagaatcaaagaactgccttcctaagaaagacatggatttcatgttaaagacagaaaaagatgatagttggccccatgtagctgcagattttgcaatcacagattgaaccaatcacagattgaaaatattcaaaaaaaagtataacaaaaataatataaaaatataacaactatttatgtagcatttatattgtattaggtattataaataatccagaaatgatttaaagtacacaggaggatacgcataggttatatgcaaaaactctgccattttatagaagggacttgagcatctgaagagtttggtatctgtgggttgggaaggacctggaaccaacaaccccatagatacagaggagcaacttatatttgtttaaaaccatttttggcaaacttctaaaacagactctgtgcaataaaattcacttgcttaataagtcacattccataccaagttcacataatggtagattatcctcaacttccatgtgtttgatgtccattcaatattttatgttttctaagtaaggtaaacaaatctgttgactagagctctgaagatactgaaggcttcccttccttctctgttaccatttttgtgatatgaacttctaccaagataaatttaaaatgcatttgttttatactctatgttttacactttgacatcaactaatctttgctcacaaaagaaaagttaggaccctttagcattaatatacatagtaaaaaatgctggaaaagtttttaaattgttactagcacttaggtaagttaaattcgcaagcaatatttttttctgaaatgcattgatcagcagtaaggtacaaaataaactaaatcacatttcatatctcctttctgtggtgtttttgaaattctgagtaatgaccctggttgagccattaatgcaaatcctcaaaacttaagtagtttcttgatactttccattttgaggcatcttttaaagaaacagcagatgcctctccacatgcattcaaaaaatcaataaaattaatcaataacactctccacaggtaatatatgttcagaagcatttctgcctatctatattgatttagagaattgcttcaaatctgttctgatgtgtataaaaatcatttccttattcatcaaagtttctcttccctgatatgttatttcatatatggcacacaatgatttttgtctctattcttgtatatttgtgataaatttcttatgatctgtgtatgagactcatttgaataaaatataaaatgagtattttgtttctttggagaaacctattgctcaaaatttaatcaaagaatgaataatcatgagaaattactgaagttattgtaatgagaaacgtaatgatgtatttcattcacatttttattatttataataagcttaaaaggtttgagtttgcttctatttcttataacaaagctccattcctgcagacacattcctacaatccagaatgacactattactgactatataaataatagaaaaatgcatagttttagccaattgctgactcatagtattgctagaaaatgtaacatgttcaaacctataagtgaattttgtaacctttttgctagtgtatgtgttacgtgtttagacagagtaataagaaaaatagatattctgaattttctgaacataaagaaatttaaagttttgatagatataacatttaataattctcattaaaaatgactgtatttaattaacccaaccaacttatatatccacagttaccttaactaacagtacctgataactggtggctcactggggaaactgtatttgatcaattaaagagtcccccaaggaaacacaactcttaactcttgatatattaactagtgttgtgaattattcctctaacaaaaaatcaaatatttctgtcaacattatttaataaatttcataactaacatagggtgctccattacaaaatgacatcatttggccagttaatacaccaccacagtaagtgtgcctcaaccagtatcttcttcaaacttggatttattaacaagtttcatgcctctcagtggtttttccttggaatttcagggaataggaattttcatattgacaaccgaggtccaatacctctctctaccttagaagattttactttaccaatctatcaaattaattttgtcttttcttaattcttaaattaagttgagatctttcagcaaaacaagaactgttttttttttcaggaacaattagtgtaaagaattggataaaatatattcactgtattcaaaaatattatttgggtgaggctaaggggatgtttgccaacatagaaagcataagcattggaaagaaaatataatctggtttgtttcccctatatcaaaaattaaatgacaatttttaaataacatcttaatataaaatacttacctaaagatgtggaagtgttttttctgcccactaaggcactgggtacattggatggtctccagaagctctaaaagaatagggcagccttcctgagtttgtcacttattcccaggaaactagttgtacaatcagattcttggaatcaatagatgccactagggcgaccatgaatataaaatttttaaaatatttcttttacttatgtaaaaattaatttaaatatattcctagagatgagcatagattcacactggaaactggagtggcacactcaagagagattttgatagacacatctctccatcatgttgtgttttagtaagggcagctgaatcaaagtggaagggatgacatggagccaatccaaaaaaaaaaaaaaaactcatctgggcatatcataaaagataacagcatgagccttggagtcatatagacctcaaatccggatgccatcacttacaagctgtgtggccttggagaagttgcttttctttctaaacttcatttccctcttctgtaaagcagagtatatgctagtattttctaataaaaatatgtgatatgtgatatactatgataatagtatgttgataattttaaattttctagtggacacatttttaaagaacaggtaaaattgatatatttatttatatatttatatttatatatgagatatatatttatacttattaattatatacatataaaatatatgttaaaatctataaaatgtacccaaaatggtatcatatcaacaagtaatcaatatgaaaatgagtaatagcctattttacattctttcttcgtttgaaacctggtgagcattttacaattacagcacattccaatttgtactaaccacatttcacatgctcaatagctacatgtgtgtcatagctgctataatggatattacacgtataacctaccccatagggttattgaagaataaaatgagataatgcaagtaaaggacttagaacagtgcttggcaaataatatgtactacaaatggtagtgtgaaagctgctactattatccactgatattgattatatcttccttgctctgctgggggaatggaaaaatatatggcatggcccctgttcctgagtaatcacgaagttaagaatgtaagacaaatatatagttaactagaatttttgacatcttattatcacatgaatggtatgaatgaaatgcaataagtgctcagaaaaggcagatcttgtactaggaatcccttgtaccaacttggtgaagaaaatcattttgaactaggatttaataggtaggttgatttttgttaggaagtaatggttagggaccatgaggacagctaggaaaaatattccactatagggaattacagaagaaacaatccaaaggtagggaagtgaaaaatacattcaagaaatgagggcaaattgtttgatggagagcacagagttcatgtaagagtgtacttgagttagcaaatgcagatttgtatcagagtgtagagatcttaaaagccatgctaagatacttggacattattcagtgtctgaaagaaatagtaaaaaagagcactgatttaggtgccaaagatctgatttcagccatattctgcaactgccacacgtgcattttcctaccttggccaagtcacttcagctcagctgttttatttgtaacataagatggttggatctaaaacaaaacaaaacctgagaacgtcagagatgaaaagggcctctttgttgttgttgctgctgctactgcgatcattgttctgtttatatttgtggtattttaggatgaggataacattactgaagaaatgcctcaggaattaatataggtagatttaaaagtaaaaatatgaaaatgaaaagatcattttgagaatcatttcagtggtcctagtgtctttaaaaaaaggattttaactaatattgtggacataacagttggaaatattaataaatggctgggttggattatagaaaatttgtttaaaaaaagaaagaatggctaggacttggattgaaggtggagagggaggcaaagtgagaaatgaattttattacagtttggagtctagaaaaaaaaataattagtattcataatagaaatggtagaaccagggagataatttggctggagatatgggaagggatgtaaaatgagtgtttttagttatcgggtacaatttttagtacatattatatatgcattagaatgtatgtatttagagattaatggatatatatagtgacttttgcaagaacatgagtattttagtttcagagtttcacaaagtagtagaatcaacattaaataaaacaattatgagattaacatgagcattaaagttaagaacttatgcaactagagaattcagtgatattcataaagaggccccaaagtgtgacacttatctgagtcttttttgcttattttttgttattattttagagacagggacttgcgctaccacccagaatggagtgtaacggtgggaatagctcactgcagccttgaactcctggactccagcaatcctcttgccttagcctccacagtagctaggactacagatgcatgccaccatacctggctaattttcttttaaattttttgtagagatggagtctcactatgttgtccaagctgctctcaaacttttggcctcaagtgatcctcctgccttggcctctcaaagcattgggattataggcataaacccagttggccctaaatcttaatttatgaaagaaattctaaagccagtaaatgaagcaagactttttgagtaataaagttttcaattcaaatcccaaatcaaggctgggcacagtggctcatgcctgtaatcccaacactttgggaggccaagatgagtggattacctgaggtcaggagttcaagaccagcagggccaacatggtgaagccccatctctactaaaaatacaaaaaattagctggccgtggtggcaggcatctataatcccagctactccggaggctgaggcaggagaatcacttaaacccgggaggcggaggttgcagtgagccgagattgcgccactgcactcaagcctgggcaataagagtgaaactccatctcaaaaataaataaataaagaaaatcccaattcaaccttctgtgagtctccttcttcattttctaggaggaaagaatagctacatcacagtgttgagtgaaaaacatgtgatgtaaaaaagaaagctctagacattcaatgaatgagggctaccatcaactcattccagtaaacctggatgacaaagaaatgggctcaaaccctttctatttaaaaatgtcataaaggtttttgtgctcctacttgtaacacactatgaatcttcaagcaacaagcacatattaagtactgataagtcaagttccatgatcataaaaaaaattgcaataataagcagcatgaatctcaaccttaaggagaacttggctacatgagaaggaaagtaagtattgaaaggtttaaggtaactcctggttattctaggtgtacactgtcaaaatcaaattgacttctcacacgtgtttctaaaattaatttaaaattcaataaaaattaatgaaaattgattgaaaagttttaaaaattgtagctagaaaaagtgtcaatattacacattttattagcatgagagtaagagtttccaaactatgctagtttatataaagtgatttttacatccagataaaattttaccactcaatttgtatggattaattcattctgtaaacttcttcaagggattctattgttaataatgcttaaattagtaagtatattcaaatattcaagtttttataacaaattcaattgaaactgttatgcctaagatattagtgaaactacttattaaaataaatacagcatataaaggaactatattgtattaagaaagttataaatttatttggaactaactttgaaagaccctctaatttataaaattagattgaatcatttaatagcagagcaatactttgaggttaggagaaatttaattcttgtcttcaaagccaaaaggagttggcaaattcatccaacagagtgaaatggacagcaacatatgctcctcattgagtcctattggtcaacagaaaaggtattgatttactaaacatgaaaatattctgaaagtcttggcagataaaaataagtattgattatatattttaagacatatgaaggagtcataatcactcagtgttgatatatactgagttatttgtataaaaaatagcagttacaaaattaaatcaatcttctccctagactgtttattttctttccattctgtgaaaagtatgacatccttataacttgaatgttaacaaaagaaaaaaagcaaggcattttttacataacagatgtttaaacatttatctgtattttaaaatacctttataaatcaattttgaccatttttatttttaacctattggtaaactactctgtttttaatcacaaatttatttcatgtgatttttatggaatgtgtgtattcataaattgttataattattcttgttaaaatactaagctaaataacaacttaataatctgttcagaaattacatgttacaagacaatattttgcttttaatattttaataaaagatttaaagtaaaaataaattatttaatttcacattttttaaagagacatatttacttcaatatgaacattattagttcaggtttcacgtaagttctcatgacgctatttaaaattgtatttctaccatattttcattccattgaccaagttctgatatagttaaatcttttatcctccctaaatttgtcattaagaccctgacattcagatgacaagtgatttgcagtgtggtttgtttttcattgccaatcaccaggagatttaaaaagatacccatgcacttctgtataaacactttctctataaatgctccactttgtggagatgctaccagtaatgagactatggcattttttattttctttctgagagtacctcttctctctcaaaccaattggatactaaagtactaatgtagcaattgacacaccctggtaagtaattttgaacattttctaacttagaaagaggttagcatccctgttcccagcaaaactaatttttaagtcacacattacatgccgtgtaataatccaatatactgtaaatgaagttgaacatgattataaacttatattcattttaggaattagttacgatacgtactcagtcttgcaatcttctgaaaatgaattcaggtaaacttgaaaaaccgcataataaatttgctgaccaaaatctgttcttgaaaaaacaaatttttggaacacctgaggcatggtgctgttgaattaatatgaggttccaatatcattttctgtattttatttaacaaactttcagaaattaccagagccttcataaatatttccaattattatttttagagatgtgaataatgatttaaagctaaatatttttctttttctttatggacttggttctgtttcgttttgtttggtttcacaaatagaaatcagtgtttaccccacttttcagctgttgtataaagactacaagaaaaaaagttatttgggaaagtcacaaacagcaattgcctatagagtgaggttggaagtgaaatccatatgtaatgcctctgtcagcaaagacttagtagaaaatggtttataataaatattcacatctgctgctttggacactctaatccatcctaaggatctttgctgtgtcaggttttgttctagatgaagaagcccagtagttataaaggtttgcaaataggttgtatttatcatggttagctttacttttataacttttctctgttttagaggtattcatgatgtttgggggtaaaatttgtgattaaatatttcactatagcttttatggtgatataattctagaattcttattataaaatggaccaatgctattttcacaatatatcacttacctaaaatctgtcaagaaggcatcattgataacaatgctatgctggctgtggaaagcaatggctaaaagcccaggctctggattcgaagtgctgtgattaaatgctagctccttctatacctagggtgtcattatgagcaagttacttcgcctttccaagcctctatttcttcacctacatagaggaggcattttttacataacagatatttaagcatttttaaatagtactaactatttaaaatacagataaatagtactatttaaaatattaaatagttaatactattaatactaactaatatattaaatagttaatactgttagtactatttaaaatattagttactactattagtactaactatttaaaatattaaatagttaatgctattttctttatcattagattactgtaacgatcattcagaattatccatatcaagcactaaatataaggatcatacggaattatccatatcaagcactaaatatagtatctatcacattaaaagagtttaataaattttaaatgttattactgaaacaataatatgccttctaagtatgattaaataatcccatggatagtactaatgtcatacttatttacactaagtactgagcttatgtaaacatatcctattgttttacttaactccaagtcccatgatagtttgttactggacttccttaataaaaatattaattaaaattggatccctgatttgttttcactttgaggaaatgagccactaaaaaatatatgatacaaaaattatgcaaataccctgtgctgtatttagccatcttatgtaaaaaaaatttaatttatcaaaatttgaattctaagctagagtaaaaactctcaagtcattttgaaatggaagtatttatttccacttcagcttcaaaaaaatttgttgagttcatgagtatcacaatttttaaagcaggaatgtatattgagttgtaagtaatgattagcataattattataaataagtttaaagaagaatacaaatgttttccataaattttgaaagctatgccttttaaaactttctaacatataatttatttgaaaaagaaagttgccttgcatagttgctttcaatctcatctcctcgaaatgctttattaatcacaaatataaaagaatagtaggatgtttgatgaaatctgcatataaaggaggtagaccattaggctctatgtcccaattagaaaattttataacctaattattgatgtgtcttaattttgactcaacttatttcttatacctacaggagctactgcatatttaataactgacccctaacacagaatgataattgaaaaaaatagaatgcttcattgcttataaactgtgaacacttgaaataaaactttgattcattctctctctctctcctctctgtctccctcaggtcgagttttagctcaggcaagtggcaatggtgttatccatttgctagatcttaaatctggggagattcacaaattgatgggccacgaaaacgaggcacacacggttgtgttttctcacgacggggagattctcttttctggaggctctgacggcacagttcgaacgtggtcttgaccgtcagcacatcccgctgcagagggcattccctttaaggcttgaaaatgcctcctgtagtcccaaaccagcaaagaactggttaaatgtgccagcaggtaacatttacagtctgctttaaaacatgctttggacatatattttagtgctcatactgttactaataaaaaaataactttatgctca

SEQ ID NO: 705 - DNA, 1126124 bp, Homo sapiens; identical to SEQ ID NO: 704

SEQ ID NO: 706 - DNA, 1126124 bp, Homo sapiens; identical to SEQ ID NO: 704

SEQ ID NO: 707 - DNA, 13044 bp, Homo sapiens
atcggtgacaggaccgacggcagacacacggacgttcagggccagcagcatccgcacctttatccgcactgtaggctgggctgggcagagcgcgcctggccccggggacaccactgtatcactataaaacccagaggaaacaaggaacaagtgcaagtccggggagagggaccactgtcacgcagagaggtcactgttatcaaaacgctcctggtcgtacacttcagccaccaccttgcggccagcaaaccagcggccattgagggcctggatggccttatgagtctcagaggctatggaaaactccacaaagatcttgacaatgatttctgcatcctcctcctcgccttgtttctcttggtagatgatgacgcggttcacggccccgaacttgccacactcctctgtcacctccccttccaggtcatcatcgatgtccttggggtccaccatgttgcgcagaaccatcactgtagactgtggggcagggccgaggggaagacagctgagcactgcggccccgcccccctaccctctcccccgccaccaccctgcccctctgcctacctcctgcttgcggagcagcttctgcatcaccatgtgtcgggcgctactgcccgagatgctcatgtgctcctgctcgctcagcatctctggccgctctgactcgggaaacagctcctcttcttccttctccttcttgggctccaggagacccagcgttggagggctggccaggatggggttcaccactcccaccgaggggatggtgaccgggataggaggacgggctggggtcacacctgcaggaaaaccaaccaggtccatcagtcactccctaccaccccccttcccagaaaggcacagagctggcctgccctgggctcagagggttgtgcccagaccaccagggccaggcagctgagggcagcgagccgagagatgccaggacaggagaggagaggatctggtaccacttaagactcacctgtgatgactccaggtgcctgggcagccatgacagcctggggcaaagtgcccaggggctgggccagggtcagtgctggggacaccagtccaggtgtgcccagggtacccagcaccgctgctccggccactgcttcctgcaacccaaaaggtcaccgtgctcagtccctggtctggctactcaagaccaccttgaatcagtctccaaggaatcaggggccagcccgcccaccctcaagccgacagctgtgtgggccctcacctgagctgtgatcttggcagtggctgcagcagctgccacagcagcggcaggtgggaggcctccaggcgtggctggtgtgagtaggggcatgggcggtgtgacagccttgcccacccgcaagtactggccacccaggtcaaagaggttcatggaagacacagcatcttgggacgactgggccttctcgtactctgtgggcaggagcagcagtgagcagggccagccccagcctcaggtggcccccatcccgcctcagccaccccagctcaccaatgaagccgtagcccttgtgcttgccagttgtggggtcccgggccagtgtgcaggacttgatcttgccaaaggcctcaaacacgctcttgatgtcatcgtctgagaggtcctggtgcacagaggccacgtagatgcggttgaaggcccgtgcctcctcagccaactggtctatgatgggctgggcctgccctatgttgctgggtctgcccacctggggaagaggcggtgagatggaaagaccggtcaacccaggcccggccacaaaaggcttccgtggaggggcagccctgcacgcctgcgggatcgaggccttggctccctgcctcaccttgatgttcctgccccccagcatcaccgagttcatctgctccaaggccagctgtgcagcttcggggacctcatactccacgaaggcaaagccctagacacagggacacacctgtcaggctgcgcgagcccaggggtgggggcgagcccgaagtggccggggcggaccaagcctgctgaccttgtgcttcatggtgacggagtcccaggacatgtcgatgctcttgatggggccaaagggggcaaaggcctggcggatggtgtcctcccccagctcatagtagatagagcccacgtagacgcggcacatgatggccagcgcccgctgccgctgagccgccatctgcagcaggacagaggggagagaaccgctggctcgtcaggggcggcaggaagctgggcagcccactcccctcctggcccacccacccagccctgctgtggggagggctccccacatgacagggaggtgcgggctccatccctgcagtcatagtgtgggggtcgcaggaccccgccacccaaagaaggaaggccaggcccagcggcaggacaggacgcaccccagcccgccaaggtcccaggcagactgcggcagcaaagccgacagatggtcaggaggcagggctgtgcgccctcccacccagaccacccctccagtctgggggctgggtatcccaggctgggctgggagatcctcccactgtcccagccaaggaccacgacagaagagggaaggaggaaccatccaagctggagggacccactggtttggtggccagaagagaggaggtcagaagacagggcagccactgcccagaagagaccccaggggaggagctcaggagccagatgggggctccctgaagagagaacgaggagcagctgctcatgctgggccaactcaggtgggggctcatgctgtgccttcccagtgccctgcaactcctcacaaaggagctgcctggagcctgtgcccccagccgagagagcgggcccaggcgagaccactggcctggcccccgggggcaccatgaggtagcagagaccctacgagaagcccccaggctccttagagctggtgacaggcctggccggtccagggccttggctgtgagcttggctattgcgctgagggacctccccacaccctcagggacgggttctcgcccctgtcacctcacaggaggcatgccagacaggggacttccagagccacacgcagtgggccacagggagcctgtgggccagggcaggcaaagcagacagctggagccaggccctgcccctctccacaaaaggccttgtggccagagaccagtttccctctttagacatcagctggcctaatgcaggccgaacctccccatcccgtggagaggggcctggaagcatctctccacatcaagggacttcccaaggtgagatatcttccttcaaaccaggcattccctgaaaacgagactgtgttctcctcacactgggccccctgacagacctcaggctccccactcagagcaagacccccccaaaggtggaatcacatccccctcactcagcaggctccccagacacgagaccaggcctgtccctcaggtcatggttcccccaagacagggccatgtctccttttcagtgtggggccccacccccaggcaggccaagagctctctccctgaccagacccccagcccgggctcccattcagatgcttcccagagagaacaaggcgtgtgttgccccatgggagccacacacagggatgacccctctgaacagaggctcccagagaagggtccacatcttcccctcaggatccccgagatgggacctggcctcctcctgagcctgcctctgggggaagggagggacacctccttcccacactcctctgcccaccacagccaaggccatagccatggcccctgcctcctccgccctggctgcgtggcctctgccccttgctgacagccaggcacaaggccctgcttgcccttcccttgctcgcttgggtccccccacccccaccccatccaaccatcctccctccagggtctgatggggccatgagttaggacccctctctcctcaggggcctgaccccaacccaagagccaggcagcctggagactgacggggctggaggccgtgggcacaccccgtgcgtgcaggtggcgtgggcgcagacgggcctggtgctggcagctacccgccctggccggctgccctccgcagttacctggccgattagttttaaggtgggccctcagagcagatggaggcctccccaggggcggtcccgggtgggtgcccacaccactggccccaccacgcctggcgctctgctgcgctcgtccagagctggcgggcagggccggccaggggagcaaggtccccagcacgtgggctgcactgcccccctctagccctgactaaggacatgagccccggaagaagtgagcatttctattgaccgattgcaaaggtgagagaggatctccaaagcccattgtcactgctgccatctgaaagacagtaaagacagagttcagtctgttggagccgagcagtctcccgctctcgtcaacacctcacgcagacagcggcaaggcccggagtccccgccctgccagggaggccgcctgccttcccacactgccggccgccagcacctgcccaggggggccgcagcgccccatgtgccccgccctgcagccttgcagctgggccggctggggcagaaaggaagggagggaggaagggagggagggaggagggcagtggagcacagtgaatggccaggacatctcctggtagcgtgaatgtctgagggctgggcgggggggcgtgaggctcgaggcccaggaacctgtcggcctcacaccggcctcttcccacgaaggtatcgcagcctccggccacaggcctggagcagggccccaagggaggtgcctccagactgtcccctcagtcctggggctgagcccaggtggtctggactcactgcaggggtgagggcctgagcagtcttatccaggccacgggggcagggaggcccacgccctgcatgctgccaccatcggctgtgcacagctggggcagggagcacgggagagaccagaggccacagtgtgaagaccaggaaggggaaaagggtagagctgcagccaagcagccaagaaaggggctgcggcgctttaggggctccagcgagcaacaggtgggaaaggctgggccactcgtgcctcagagaggaccccgggggtcccgagcatgagtctttgagaatcggagcactgtaacagcttgcggggacggccgcaggcccaggaggaggaagagcgtgaagaggaggagatggtggctgtggtggggagggcggtagaggctccggccggggctcacctgcaggttggtgagctgctgctgctggtgcgcgatggtctgcttcaccagcacactcttgatgctctgctccatggcgtacttcttggcctgagagaggcggcagtgaggagcactgggggcccagcccatgggagacaggcctgccccgcaccccgcccctgcccctgcccccagttgactgtcccacacctgcagtgccctgggaggtccatgctcaccttctgaagggcctcctgctgctcgggcgtcaggggaggcagccccagcttggcggctgtgctctgcccgttctccatcttgatggagtctgtgccctggtaagggagcaggggaatccatcagcagcaagctcaagttctccttcacgtggccccaggagggccacccctagcacagactgtcccctgcctggcctgtactcaggccagcccttctgacattgctgtccccagcccaggccactgtctcccccgggacccatggggtagaacacagactgaggcaggcaggtgccctggaggccctgggccaacccgagcagttgtggggcccaggccacagtggcctcctcgggaaccaccaagataaacagctggaggcagaaaaggggtccagccccttgttgtcagtctgaccccagagctgctatcacatgcccggcaggagagccagcctcagccgtcctccaaggcaggagaaaagggccacggctctctggacgttctgggactccttgctcccaggctcctccaggcttcctcacagtccctgccacagacacaggctcagcttccctggagtttcaaggggcccacccaaggagctaatacaagggcctctctcccaacagtgctccccccaccgtccccgcaggcactgtgcacacctcccagagaacacaggcctctctcgggccacacaagccctgaagagggctccagctcacttccacacactcttgcatgggctttgcctggcccactgggagaagccaggagcagaccccactggcaccctagccaggtgggcctggggaccaagaggcccttgggcagtcacagccactgcagacccaagctgatgccaaccaggattatgtttacgtccctcctgtcaaaatccatctctaagctttttgcagagggaagaacgcagctgtgtgagcagggaggcatggctagcaggcccatcagagtgtgggatgggcaaacagcatgcctgcgcctgtcctccagctcagcaagcacaaagatcactggcccaccaaccgggccctccgagacttccagacacagccttgagggacagcagagaagagagaagggtccccagcacagaagtgatgagcaaggacagagggacacaggaggcaggaagggacaggctggcccaagccccaagaaccccctcctgcctgccaagtgctgggatgctggcccaggctcaaagggcaggaagccctggagacccctccccaggcaaccagagccccaaccagtccctgaaggtcaaaggctggctgtgggtggcaccaggtgccccagtccggctcacaccaggcctgtcctaatcaccctcagcaccaggtgccccagtccggctcacactaggcctgtcttcaccaccctcagcaccaggtgccccagtccggctcacactaggcctgtcctcaccaccctcagcaccaggtgccccagtccggctcacactaggcctgtcctcaccaccctcacagctggccccaagcccattcctccttagtgggaaagagggcccaagagccagaggctgggacttgagagcaggctgtcaccatggtaatcaatgccaaccccctcagcccccagacatttttcaatctcctctttgtcttggtaaacaaaaggcccttctcccaccaaccaatggccggctgggcgccagccaagggccagggagcaccagcccccacatctcccaggatccaagctgcataccatgtcccagtcccaccccctgagtgtgcctgggggaccaagaggagggcccagccccaagaggctgccaggccaccttgctgaggccccactggaatgctctggaggcgggcgctaccatggagaagcacaaagaacccaactacccagccacaggcccagctccacctctgagaggacctgctcccaaggctgggccatcgaacagaccaagacccacctgcacccactctggagcctggggccgaaaaaagatggggagggctgagtcccaaccagacctgtgctttgacttgcgcattgcttcactgttttatttaaatgaaaacacagaggtctgaaatgaaatctgtccttctggctcctcaagcactgcgagttctgggaagcttggcccacccttcctgcaagacgctcatgcctaagaacgcgcgagctccaggccccggcgtccccgcccagccagactgtcaacaggccccgcctggtgcttggagcagggcagatgcagagggcaaaggccagctcagtgcctgggtggggagggtgcagggctggtgcggggagagggccgtggtcctgcgggcagttgtctgcccagaggcagagaagggttcccgaggttcctcccgccccgcccccagccagccctctctgggcccagggacgcacaggcaggcgggcgggcgggcgggcaggcgggcgggcctgagggagaggatgcttaaggtcagtacctgtggaggtttccatttgtctcccgctgccaccactgccgccgccgccgccggctcggacccccctccttgctggccattgacctgctgcaggcaggaaggagatgttgtaacgacaggcacaccaccccaccgcccaggcctgctctcctcccgagctaagggctgagctcctcacggataagcaagggaggccaggcagggaggcattcccgacatgaccccccagcccaaactgccctctcttcacacccatcagcacgcccagggacccagtcagaagcagagcggagcatgggctgggccagggctgccagcgagtcccagcggggatggggaggagggtagagagagctgtgctcctgccccaggcaaaagaaagccatcctctcctgccggcaggctggacggccaaaggaaccggctgggtgtcccccatgccctcctgaggcagcagcggtgccttcctggcaacctgtacacaccttggccagcccacaactcagccccagctccagtgccttccacaggctctggcccagcccaggtcccagttctctcctgaagacacttttaagcagcatggtgggcaggggtctggatgcgcaggcctcccttccctggcaacagaaccatccagagctgtctcgcaggaggacggccaagaggttagccctctgcactcagtaagacccacacctaagggggcacaggaaggaggagcagctccacaatggtcttgagggatggcagggcaaagacaggccacgggcaggaaacgggtaacgctgtgggggtcgggagatgatggaagggccttgagacctactctaccttctcagaggctgcacaacgagaagcaaggcagcatgcagtcaccccactcccagctcaaggatgagacccacaatatctaagaacagaagagatcagcgtgcccacccttggagccatgtgcgcaaagccagaggctgggctgacccaccagagtgtcccaggtccttcagcctccagaggaggagcagcaccaccagcccagctgcactggggaaggccaacccagcccgtgcctggagctgctcccaatgctgtcggcatgggtgtgctctagctgcccaactcagccccacgctgcctaaacactgcaccccggagagagtgaaaggaaacaaggggcccctcccactgcatgcacagccagagcagaggctgcctcttttttttttttgagacagggtctggctctgttgcccaggctagagtgcggtggtgcaactacggcttactgcaacctccgcctcctgggactccaggcatgcgccgccacacctggctaatttttgtatttttggtagagatgggggtctccgtgttgcccaagctggtctcaaacaatccacctatctcagcctccaaagtgctggtactacaggcgtggaccactgtgcccagccaaggctgcctctcattgcccacagcaagagatcacttcacgaccagtctccagatacccgtgaacagggtgaactgaggggcacttttgtaacttcctgctcccccaaatcactgcactaaccaacaagtaagccacaacagtgttgacagtgggatgtggctcggaaaaacattttcttgggaaaagccggcccactggtgcattctacacaggacaccccatgccattcctggcagatggaagttcccagctgcatggagcttagggttctgtgctaaccagacgctgggagaacttggaggaaaccggtgtttacaatcgcagctagtcacgtactgccatctttaggcaattaaaatggcgtctttatggtcaggatgcccccagcaccaggcagcagtgcttggagggatgggaagcccctctgaggggcggcacagcagaggggctctggggtgccaactctgggactgcctttcctcagcccagagcaaagaagagtatttccatcagaaaacaagaaaagcaatgtaggggctgggcgtggtggctcacacctgtaactccagcactttgggagaccgatgtagcacttaagaccagcctggacaacacagcaagacgctgtctctatgaaaaaaaagatttttttaaaaagtaatgtggccagacgcagtggctcacgcctgtaatcccagcactttgggaggccgaggcaggtggattgcttgaggtcaggagttggagaccagcctggccaacatggtgaaaccccatctctactaaaaatacaaaaattagccgggcatggtggcaagcacctgtaatcccagctacttgggaggctgaggtgctaccatgaattgcctgaacccaggaggcagaggttgcagtgagccgggatcaccccactgcactctagcctgggcgataaagcaaaactccgtctcacacacaaaaagaaaaaaaaaataatgtggagcgaatgactgaaggtcccaaggtctcaaggcttcaggctcctcagctgggaatggggacggcctgtctcctagggctactgtgaagattcagtgaaatcccaacacgcccccaaccccacaacctgcagtccctgcacatggaaagcagcaaagcaagccacaggttccagcactcatcagtattaacaacatccagtgtcagatacccagggcagagctggctgcaggacactgccttctatctgtcagttcccttcacacaatgaacactgcttactgcgtgcccaggctccacagtgagcgctgcagaggccgcagacacgagacaagagagaaagacgtctctctcaggagcctggtgtcagctgccagcaaagaatgccaaaatcaaagatgacttctgtggtttaccagcactacgaagaaagcacaggataagaaaggagtggctatgagctatgccaggccatggcagccgggggcctctctatgaggtgacattgcaggctggggcctacagaagaaaggaactggaaccccaagggtgatgaccccaaatgagagctggtctggctgtcagtgaagagaacggagccatgcgtcaaagtgaaaagatgcatccagaagacctacccttgctgcaaagaggcagccggcctcattctgcagccaccaggcagaaggcatgcccatgggaggggaggcccttctgcatcttctggcttccttccccaccaggccactgtcagccaagttcagctgctccattcaacctcccatgagagctgaagcagcatgagacaggggacaggctctcatcactgtgcccaaccaggacggtgggaacagataacccttctagaagcctttccatcccaatgattaaaagaggaatgggttagaccacaggctacagctcactcctggagccggatgcaagcctgaaacctgacgataaaaaaacacgtattaaacccaacagaatttggatggcaacaaacaccccaacagacaacccgttcgtggggtcagttatggcccacgtccaactcaacaatgacaccacctatctggcaccacgccacagcagacctgagcccccatttaaccctcatgagcacagggcgctgttctgcgggtgctaggggagtcaggcatccactctcctcctccaccttcccatgtccagtccttgtctctgagcctcctcctccttcaccatcaactctctgactgctgcctgaagacagtcaccaggtcctcaacccttacatcctttctctctggagtgcccctcaaaggtcacttactcctgtggcttcaagagaaaggacatagtagaaagagtggagttagccagtcctgtgaatcacacactgggctgccctcgcaagctgggtatcttgtgtaaatgcctctctccccctagtaactggtttctgcctcagtgggacatgggaccagcccgcccgctgggggcctggcaatggcagtctaaggacactccctggtcctgccagtccagccttcagccatttgcccaagctgtcttctcaaacagaccttatcccatcccgctgggtgtgggctgggggaagggtgacaagtaatacaggggtaaactgcggctgagaaaggtccaaaaggggattaggtcctataagctaagtggtgagaaggaaagaccagacttcatcgtgcatgtgttgtgtgcatgggtgttctccctctacgttaataacgcctgccctgcccggggaagtgggcactgagcagagcagggggcgactcactcctctggatgcccacgcagctccctagggcgcccagcaaatggcaccctgggtgggaactggcttctggtgcgcactagacctccaactgcctgtctggttccccactgcgtccccagatcctcccgcagagctggggacaatgcgatttctcaaaacacgtaggatgagagcgcacgtccttcctttccacgtggagacaagagaatggagataaccagatccctctccagcaccggagaacgaattcacagctgcaggcgtagtgagccaaggccgccccatgctctgagctgcaggcccctttctacaggtcccgtccccttctgatcccatcaacccgaaggcccacgcgtcacccccagaaccccgcttccgtcgtgaccacggcgcacacccccgtcggcaaagggaggacgacgacccccgcttgccggacctagcggacaggaacgcaaccccgccaggctcgcccgcaagggccacacgccgcgcccaggcccccgccccgccccgccggaagctggggtccgcaggccggaagctgaggccgcgagccggccgccggcgcgcgcccgccccgcccccgcctcacgcgacccggggacacgagggagtccgcgcgggacctgggaagaccgccgcattcttgggaggccctccgcgcccaggctgggtcgacgacccggccccgcaagccgagggccgcccgcgctcatgggggggctcacttacgagagctatggtcgccgtcgccatcttgcgtccgtcgcggcctccgcgcgcgcctcccactcttgctccttccgctgtctcgcgcgatctgggtgccggtgcacgga

SEQ ID NO: 708 - DNA, 12767 bp, Homo sapiens
atcggtgacaggaccgacggcagacacacggacgttcagggccagcagcatccgcacctttatccgcactgtaggctgggctgggcagagcgcgcctggccccggggacaccactgtatcactataaaacccagaggaaacaaggaacaagtgcaagtccggggagagggaccactgtcacgcagagaggtcactgttatcaaaacgctcctggtcgtacacttcagccaccaccttgcggccagcaaaccagcggccattgagggcctggatggccttatgagtctcagaggctatggaaaactccacaaagatcttgacaatgatttctgcatcctcctcctcgccttgtttctcttggtagatgatgacgcggttcacggccccgaacttgccacactcctctgtcacctccccttccaggtcatcatcgatgtccttggggtccaccatgttgcgcagaaccatcactgtagactgtggggcagggccgaggggaagacagctgagcactgcggccccgcccccctaccctctcccccgccaccaccctgcccctctgcctacctcctgcttgcggagcagcttctgcatcaccatgtgtcgggcgctactgcccgagatgctcatgtgctcctgctcgctcagcatctctggccgctctgactcgggaaacagctcctcttcttccttctccttcttgggctccaggagacccagcgttggagggctggccaggatggggttcaccactcccaccgaggggatggtgaccgggataggaggacgggctggggtcacacctgcaggaaaaccaaccaggtccatcagtcactccctaccaccccccttcccagaaaggcacagagctggcctgccctgggctcagagggttgtgcccagaccaccagggccaggcagctgagggcagcgagccgagagatgccaggacaggagaggagaggatctggtaccacttaagactcacctgtgatgactccaggtgcctgggcagccatgacagcctggggcaaagtgcccaggggctgggccagggtcagtgctggggacaccagtccaggtgtgcccagggtacccagcaccgctgctccggccactgcttcctgcaacccaaaaggtcaccgtgctcagtccctggtctggctactcaagaccaccttgaatcagtctccaaggaatcaggggccagcccgcccaccctcaagccgacagctgtgtgggccctcacctgagctgtgatcttggcagtggctgcagcagctgccacagcagcggcaggtgggaggcctccaggcgtggctggtgtgagtaggggcatgggcggtgtgacagccttgcccacccgcaagtactggccacccaggtcaaagaggttcatggaagacacagcatcttgggacgactgggccttctcgtactctgtgggcaggagcagcagtgagcagggccagccccagcctcaggtggcccccatcccgcctcagccaccccagctcaccaatgaagccgtagcccttgtgcttgccagttgtggggtcccgggccagtgtgcaggacttgatcttgccaaaggcctcaaacacgctcttgatgtcatcgtctgagaggtcctggtgcacagaggccacgtagatgcggttgaaggcccgtgcctcctcagccaactggtctatgatgggctgggcctgccctatgttgctgggtctgcccacctggggaagaggcggtgagatggaaagaccggtcaacccaggcccggccacaaaaggcttccgtggaggggcagccctgcacgcctgcgggatcgaggccttggctccctgcctcaccttgatgttcctgccccccagcatcaccgagttcatctgctccaaggccagctgtgcagcttcggggacctcatactccacgaaggcaaagccctagacacagggacacacctgtcaggctgcgcgagcccaggggtgggggcgagcccgaagtggccggggcggaccaagcctgctgaccttgtgcttcatggtgacggagtcccaggacatgtcgatgctcttgatggggccaaagggggcaaaggcctggcggatggtgtcctcccccagctcatagtagatagagcccacgtagacgcggcacatgatggccagcgcccgctgccgctgagccgccatctgcagcaggacagaggggagagaaccgctggctcgtcaggggcggcaggaagctgggcagcccactcccctcctggcccacccacccagccctgctgtggggagggctccccacatgacagggaggtgcgggctccatccctgcagtcatagtgtgggggtcgcaggaccccgccacccaaagaaggaaggccaggcccagcggcaggacaggacgcaccccagcccgccaaggtcccaggcagactgcggcagcaaagccgacagatggtcaggaggcagggctgtgcgccctcccacccagaccacccctccagtctgggggctgggtatcccaggctgggctgggagatcctcccactgtcccagccaaggaccacgacagaagagggaaggaggaaccatccaagctggagggacccactggtttggtggccagaagagaggaggtcagaagacagggcagccactgcccagaagagaccccaggggaggagctcaggagccagatgggggctccctgaagagagaacgaggagcagctgctcatgctgggccaactcaggtgggggctcatgctgtgccttcccagtgccctgcaactcctcacaaaggagctgcctggagcctgtgcccccagccgagagagcgggcccaggcgagaccactggcctggcccccgggggcaccatgaggtagcagagaccctacgagaagcccccaggctccttagagctggtgacaggcctggccggtccagggccttggctgtgagcttggctattgcgctgagggacctccccacaccctcagggacgggttctcgcccctgtcacctcacaggaggcatgccagacaggggacttccagagccacacgcagtgggccacagggagcctgtgggccagggcaggcaaagcagacagctggagccaggccctgcccctctccacaaaaggccttgtggccagagaccagtttccctctttagacatcagctggcctaatgcaggccgaacctccccatcccgtggagaggggcctggaagcatctctccacatcaagggacttcccaaggtgagatatcttccttcaaaccaggcattccctgaaaacgagactgtgttctcctcacactgggccccctgacagacctcaggctccccactcagagcaagacccccccaaaggtggaatcacatccccctcactcagcaggctccccagacacgagaccaggcctgtccctcaggtcatggttcccccaagacagggccatgtctccttttcagtgtggggccccacccccaggcaggccaagagctctctccctgaccagacccccagcccgggctcccattcagatgcttcccagagagaacaaggcgtgtgttgccccatgggagccacacacagggatgacccctctgaacagaggctcccagagaagggtccacatcttcccctcaggatccccgagatgggacctggcctcctcctgagcctgcctctgggggaagggagggacacctccttcccacactcctctgcccaccacagccaaggccatagccatggcccctgcctcctccgccctggctgcgtggcctctgccccttgctgacagccaggcacaaggccctgcttgcccttcccttgctcgcttgggtccccccacccccaccccatccaaccatcctccctccagggtctgatggggccatgagttaggacccctctctcctcaggggcctgaccccaacccaagagccaggcagcctggagactgacggggctggaggccgtgggcacaccccgtgcgtgcaggtggcgtgggcgcagacgggcctggtgctggcagctacccgccctggccggctgccctccgcagttacctggccgattagttttaaggtgggccctcagagcagatggaggcctccccaggggcggtcccgggtgggtgcccacaccactggccccaccacgcctggcgctctgctgcgctcgtccagagctggcgggcagggccggccaggggagcaaggtccccagcacgtgggctgcactgcccccctctagccctgactaaggacatgagccccggaagaagtgagcatttctattgaccgattgcaaaggtgagagaggatctccaaagcccattgtcactgctgccatctgaaagacagtaaagacagagttcagtctgttggagccgagcagtctcccgctctcgtcaacacctcacgcagacagcggcaaggcccggagtccccgccctgccagggaggccgcctgccttcccacactgccggccgccagcacctgcccaggggggccgcagcgccccatgtgccccgccctgcagccttgcagctgggccggctggggcagaaaggaagggagggaggaagggagggagggaggagggcagtggagcacagtgaatggccaggacatctcctggtagcgtgaatgtctgagggctgggcgggggggcgtgaggctcgaggcccaggaacctgtcggcctcacaccggcctcttcccacgaaggtatcgcagcctccggccacaggcctggagcagggccccaagggaggtgcctccagactgtcccctcagtcctggggctgagcccaggtggtctggactcactgcaggggtgagggcctgagcagtcttatccaggccacgggggcagggaggcccacgccctgcatgctgccaccatcggctgtgcacagctggggcagggagcacgggagagaccagaggccacagtgtgaagaccaggaaggggaaaagggtagagctgcagccaagcagccaagaaaggggctgcggcgctttaggggctccagcgagcaacaggtgggaaaggctgggccactcgtgcctcagagaggaccccgggggtcccgagcatgagtctttgagaatcggagcactgtaacagcttgcggggacggccgcaggcccaggaggaggaagagcgtgaagaggaggagatggtggctgtggtggggagggcggtagaggctccggccggggctcacctgcaggttggtgagctgctgctgctggtgcgcgatggtctgcttcaccagcacactcttgatgctctgctccatggcgtacttcttggcctgagagaggcggcagtgaggagcactgggggcccagcccatgggagacaggcctgccccgcaccccgcccctgcccctgcccccagttgactgtcccacacctgcagtgccctgggaggtccatgctcaccttctgaagggcctcctgctgctcgggcgtcaggggaggcagccccagcttggcggctgtgctctgcccgttctccatcttgatggagtctgtgccctggtaagggagcaggggaatccatcagcagcaagctcaagttctccttcacgtggccccaggagggccacccctagcacagactgtcccctgcctggcctgtactcaggccagcccttctgacattgctgtccccagcccaggccactgtctcccccgggacccatggggtagaacacagactgaggcaggcaggtgccctggaggccctgggccaacccgagcagttgtggggcccaggccacagtggcctcctcgggaaccaccaagataaacagctggaggcagaaaaggggtccagccccttgttgtcagtctgaccccagagctgctatcacatgcccggcaggagagccagcctcagccgtcctccaaggcaggagaaaagggccacggctctctggacgttctgggactccttgctcccaggctcctccaggcttcctcacagtccctgccacagacacaggctcagcttccctggagtttcaaggggcccacccaaggagctaatacaagggcctctctcccaacagtgctccccccaccgtccccgcaggcactgtgcacacctcccagagaacacaggcctctctcgggccacacaagccctgaagagggctccagctcacttccacacactcttgcatgggctttgcctggcccactgggagaagccaggagcagaccccactggcaccctagccaggtgggcctggggaccaagaggcccttgggcagtcacagccactgcagacccaagctgatgccaaccaggattatgtttacgtccctcctgtcaaaatccatctctaagctttttgcagagggaagaacgcagctgtgtgagcagggaggcatggctagcaggcccatcagagtgtgggatgggcaaacagcatgcctgcgcctgtcctccagctcagcaagcacaaagatcactggcccaccaaccgggccctccgagacttccagacacagccttgagggacagcagagaagagagaagggtccccagcacagaagtgatgagcaaggacagagggacacaggaggcaggaagggacaggctggcccaagccccaagaaccccctcctgcctgccaagtgctgggatgctggcccaggctcaaagggcaggaagccctggagacccctccccaggcaaccagagccccaaccagtccctgaaggtcaaaggctggctgtgggtggcaccaggtgccccagtccggctcacaccaggcctgtcctaatcaccctcagcaccaggtgccccagtccggctcacactaggcctgtcttcaccaccctcagcaccaggtgccccagtccggctcacactaggcctgtcctcaccaccctcagcaccaggtgccccagtccggctcacactaggcctgtcctcaccaccctcacagctggccccaagcccattcctccttagtgggaaagagggcccaagagccagaggctgggacttgagagcaggctgtcaccatggtaatcaatgccaaccccctcagcccccagacatttttcaatctcctctttgtcttggtaaacaaaaggcccttctcccaccaaccaatggccggctgggcgccagccaagggccagggagcaccagcccccacatctcccaggatccaagctgcataccatgtcccagtcccaccccctgagtgtgcctgggggaccaagaggagggcccagccccaagaggctgccaggccaccttgctgaggccccactggaatgctctggaggcgggcgctaccatggagaagcacaaagaacccaactacccagccacaggcccagctccacctctgagaggacctgctcccaaggctgggccatcgaacagaccaagacccacctgcacccactctggagcctggggccgaaaaaagatggggagggctgagtcccaaccagacctgtgctttgacttgcgcattgcttcactgttttatttaaatgaaaacacagaggtctgaaatgaaatctgtccttctggctcctcaagcactgcgagttctgggaagcttggcccacccttcctgcaagacgctcatgcctaagaacgcgcgagctccaggccccggcgtccccgcccagccagactgtcaacaggccccgcctggtgcttggagcagggcagatgcagagggcaaaggccagctcagtgcctgggtggggagggtgcagggctggtgcggggagagggccgtggtcctgcgggcagttgtctgcccagaggcagagaagggttcccgaggttcctcccgccccgcccccagccagccctctctgggcccagggacgcacaggcaggcgggcgggcgggcgggcaggcgggcgggcctgagggagaggatgcttaaggtcagtacctgtggaggtttccatttgtctcccgctgccaccactgccgccgccgccgccggctcggacccccctccttgctggccattgacctgctgcaggcaggaaggagatgttgtaacgacaggcacaccaccccaccgcccaggcctgctctcctcccgagctaagggctgagctcctcacggataagcaagggaggccaggcagggaggcattcccgacatgaccccccagcccaaactgccctctcttcacacccatcagcacgcccagggacccagtcagaagcagagcggagcatgggctgggccagggctgccagcgagtcccagcggggatggggaggagggtagagagagctgtgctcctgccccaggcaaaagaaagccatcctctcctgccggcaggctggacggccaaaggaaccggctgggtgtcccccatgccctcctgaggcagcagcggtgccttcctggcaacctgtacacaccttggccagcccacaactcagccccagctccagtgccttccacaggctctggcccagcccaggtcccagttctctcctgaagacacttttaagcagcatggtgggcaggggtctggatgcgcaggcctcccttccctggcaacagaaccatccagagctgtctcgcaggaggacggccaagaggttagccctctgcactcagtaagacccacacctaagggggcacaggaaggaggagcagctccacaatggtcttgagggatggcagggcaaagacaggccacgggcaggaaacgggtaacgctgtgggggtcgggagatgatggaagggccttgagacctactctaccttctcagaggctgcacaacgagaagcaaggcagcatgcagtcaccccactcccagctcaaggatgagacccacaatatctaagaacagaagagatcagcgtgcccacccttggagccatgtgcgcaaagccagaggctgggctgacccaccagagtgtcccaggtccttcagcctccagaggaggagcagcaccaccagcccagctgcactggggaaggccaacccagcccgtgcctggagctgctcccaatgctgtcggcatgggtgtgctctagctgcccaactcagccccacgctgcctaaacactgcaccccggagagagtgaaaggaaacaaggggcccctcccactgcatgcacagccagagcagaggctgcctcttttttttttttgagacagggtctggctctgttgcccaggctagagtgcggtggtgcaactacggcttactgcaacctccgcctcctgggactccaggcatgcgccgccacacctggctaatttttgtatttttggtagagatgggggtctccgtgttgcccaagctggtctcaaacaatccacctatctcagcctccaaagtgctggtactacaggcgtggaccactgtgcccagccaaggctgcctctcattgcccacagcaagagatcacttcacgaccagtctccagatacccgtgaacagggtgaactgaggggcacttttgtaacttcctgctcccccaaatcactgcactaaccaacaagtaagccacaacagtgttgacagtgggatgtggctcggaaaaacattttcttgggaaaagccggcccactggtgcattctacacaggacaccccatgccattcctggcagatggaagttcccagctgcatggagcttagggttctgtgctaaccagacgctgggagaacttggaggaaaccggtgtttacaatcgcagctagtcacgtactgccatctttaggcaattaaaatggcgtctttatggtcaggatgcccccagcaccaggcagcagtgcttggagggatgggaagcccctctgaggggcggcacagcagaggggctctggggtgccaactctgggactgcctttcctcagcccagagcaaagaagagtatttccatcagaaaacaagaaaagcaatgtaggggctgggcgtggtggctcacacctgtaactccagcactttgggagaccgatgtagcacttaagaccagcctggacaacacagcaagacgctgtctctatgaaaaaaaagatttttttaaaaagtaatgtggccagacgcagtggctcacgcctgtaatcccagcactttgggaggccgaggcaggtggattgcttgaggtcaggagttggagaccagcctggccaacatggtgaaaccccatctctactaaaaatacaaaaattagccgggcatggtggcaagcacctgtaatcccagctacttgggaggctgaggtgctaccatgaattgcctgaacccaggaggcagaggttgcagtgagccgggatcaccccactgcactctagcctgggcgataaagcaaaactccgtctcacacacaaaaagaaaaaaaaaataatgtggagcgaatgactgaaggtcccaaggtctcaaggcttcaggctcctcagctgggaatggggacggcctgtctcctagggctactgtgaagattcagtgaaatcccaacacgcccccaaccccacaacctgcagtccctgcacatggaaagcagcaaagcaagccacaggttccagcactcatcagtattaacaacatccagtgtcagatacccagggcagagctggctgcaggacactgccttctatctgtcagttcccttcacacaatgaacactgcttactgcgtgcccaggctccacagtgagcgctgcagaggccgcagacacgagacaagagagaaagacgtctctctcaggagcctggtgtcagctgccagcaaagaatgccaaaatcaaagatgacttctgtggtttaccagcactacgaagaaagcacaggataagaaaggagtggctatgagctatgccaggccatggcagccgggggcctctctatgaggtgacattgcaggctggggcctacagaagaaaggaactggaaccccaagggtgatgaccccaaatgagagctggtctggctgtcagtgaagagaacggagccatgcgtcaaagtgaaaagatgcatccagaagacctacccttgctgcaaagaggcagccggcctcattctgcagccaccaggcagaaggcatgcccatgggaggggaggcccttctgcatcttctggcttccttccccaccaggccactgtcagccaagttcagctgctccattcaacctcccatgagagctgaagcagcatgagacaggggacaggctctcatcactgtgcccaaccaggacggtgggaacagataacccttctagaagcctttccatcccaatgattaaaagaggaatgggttagaccacaggctacagctcactcctggagccggatgcaagcctgaaacctgacgataaaaaaacacgtattaaacccaacagaatttggatggcaacaaacaccccaacagacaacccgttcgtggggtcagttatggcccacgtccaactcaacaatgacaccacctatctggcaccacgccacagcagacctgagcccccatttaaccctcatgagcacagggcgctgttctgcgggtgctaggggagtcaggcatccactctcctcctccaccttcccatgtccagtccttgtctctgagcctcctcctccttcaccatcaactctctgactgctgcctgaagacagtcaccaggtcctcaacccttacatcctttctctctggagtgcccctcaaaggtcacttactcctgtggcttcaagagaaaggacatagtagaaagagtggagttagccagtcctgtgaatcacacactgggctgccctcgcaagctgggtatcttgtgtaaatgcctctctccccctagtaactggtttctgcctcagtgggacatgggaccagcccgcccgctgggggcctggcaatggcagtctaaggacactccctggtcctgccagtccagccttcagccatttgcccaagctgtcttctcaaacagaccttatcccatcccgctgggtgtgggctgggggaagggtgacaagtaatacaggggtaaactgcggctgagaaaggtccaaaaggggattaggtcctataagctaagtggtgagaaggaaagaccagacttcatcgtgcatgtgttgtgtgcatgggtgttctccctctacgttaataacgcctgccctgcccggggaagtgggcactgagcagagcagggggcgactcactcctctggatgcccacgcagctccctagggcgcccagcaaatggcaccctgggtgggaactggcttctggtgcgcactagacctccaactgcctgtctggttccccactgcgtccccagatcctcccgcagagctggggacaatgcgatttctcaaaacacgtaggatgagagcgcacgtccttcctttccacgtggagacaagagaatggagataaccagatccctctccagcaccggagaacgaattcacagctgcaggcgtagtgagccaaggccgccccatgctctgagctgcaggcccctttctacaggtcccgtccccttctgatcccatcaacccgaaggcccacgcgtcacccccagaaccccgcttccgtcgtgaccacggcgcacacccccgtcggcaaagggaggacgacgacccccgcttgccggacctagcggacaggaacgcaaccccgccaggctcgcccgcaagggccacacgccgcgcccaggcccccgccccgccccgccggaagctggggtccgcaggccggaagctgaggccgcgagccggccgc

SEQ ID NO: 709 - DNA, 13044 bp, Homo sapiens; identical to SEQ ID NO: 707

SEQ ID NO: 710 - DNA, 12767 bp, Homo sapiens; identical to SEQ ID NO: 708

SEQ ID NO: 711 - DNA, 13044 bp, Homo sapiens; identical to SEQ ID NO: 707

SEQ ID NO: 712 - DNA, 13044 bp, Homo sapiens; identical to SEQ ID NO: 707

SEQ ID NO: 713 - DNA, 13044 bp, Homo sapiens; identical to SEQ ID NO: 707

SEQ ID NO: 714 - DNA, 13044 bp, Homo sapiens; identical to SEQ ID NO: 707

SEQ ID NO: 715 - DNA, 326560 bp, Homo sapiens
cttcacacagaaaccaaccacatttttactgcatctgctccacgctggattccaacatgctggcccggagcgtggctggctggaagcaactccaacaggtttttcccttccccgtcatgtacattatttatttttgatcctactcactgtcccaagtccagaggcagttacaaaaaacactcttgatgcaaaccgtgagtggctacaacacacggatgggggtgggcgcgattcccacaacagggagtggaatccgggaagatgatatataggggcaagacgcccccttacttgctaagagtatatggagctcaaaacccacaattgctttgttttgtttctcagttcctggagtatgttgaaactacttgctcttaacattagttcgtatttttcatcagatatctgacctgatttaaaacatgtttgtttgcatacatctttttgtagtgcaccttatagttattcctactgatataggatgaagattataaatatctgcataaaaagagaaaccatgtgactctatatgaagacaaccatcacattccacagcacatcattggttcattttcgaattgtcaagcagtatttgaaatgagagagagagagaatataactgaacacaagcaccacgacaaaacaatcataacaacagaaccaaacccaacttctctattattaatcatgttaaaattttagctttgtttctaacacttttctttacttgttattttaagctccagtagcaggatcagatttctgctgcctctaggcaaatgagttatgatctgatctcgagttccaagggaaatgctcaaagttttatttttccccagttgaataaacagtaccatgtatattatctctcgtgttagaatagtgttgtcttcacataagactcaaataatggtattagtcattcatttccctgaacacagacaccctcatgcgtgctgacaggtttataaggatgcggtggcagccgcgggttctgggagctgctagacggccgagtttgatttcttgcagtcctgagcgatggagcccgggggtgcctggttattgtccgctttctctctcagatgcttggcttgtctgaaagattaatacattaacaagagctgaaggcctggggttgcacatcttcagacatgtttattagcagatggcacagaggattcaaaggtcaccacaaaagtgacattttaaagtgaaacaacaatatttatgttcagatagtctactgatgagatcatgtggaaatgtttttgattaaattagcttataaatggttgacaatctatagacaacttaaaatgccatgtctgtttaccaaatgttttcttctcacgctctcaccttctaaatattaacaaccaaatgctgttttttcttattaaaaattttttggaatgctcatttaactgtaagatcagtgtatctggtttttacttcctgggttgactatttttattttcttttaaacctaaaaatgttatctcctgcatgtgttctgagatcctacctgctattattactgcttggaaagaggttgaattctactatataaatataacccctttccattttttttttttttttagtataaattgagtctctggagagaccccaaattcagtctctttggtgagaccttctgttcacatctcattaaagcaaagctatgagctggatttcagaaataattacgacagctgcatcttttgcccgtgtagcccttgggagccacactttgtggcaatgtgtgctggtgtttcatagaaaacaacacggaaaaccgaatgcagccgaggggaggggcgcctcctctcaacttctttttcttttctctccgctttgcccacaacttagcaggaatgtgagtgaaaactttcaccgctgaaaatggcttagccagacaatgctctacagtatgaagtgaaaaacaatgttttgtaagttttacaagtctctacagtcaggacaatgcacaaatatttccaacaaagcaatgaaatgcaaaatcagtgaccaattagtaggttaaaactttcacagaaatattacaggagatgtatatggccatatatactggttttcatttctttacatttaattgtattattaataattgtgtaagatgtagatactattgtcgactttttaaaacattattatctatgtcttatcttttgtacagttacaattaaaagtgtaagaatactgacaggggatttactcacttttcaagagaacctttttcgatattcattgctccatcgattggatccagtccttgttcagaaaattgtttcaaggcacttaaggctgcctaaaaatgaaaacaaacagagagagccattcactgactctagtgtaatgaacaagtaactgaaagaaagctgagatagaaagactcattttcattagtctacataatttttttttgcattgtttaacaaaagtacactagaaagtctgcatgatcaggcagcagtgtatatacataaccggaactagaagggctttaagtctcctgccttatcccttctccacagttttgcaaaattgtgatgttttatctgcaaacatggcaacacctcatataagcttaaaatacttccatggtgacattgcataatttctcacgttactgaaactacacattctcttctctcaggtgtgacatccaaattttccaccttgagtattctttccaaagtaagcataaaggtattgttcaaattgatagacacttagccccagtcaaggtacagaatgtcagcagaggaatggacagtaggtcctcatgcagactgaggggatggatggtaagatgggatcctgagaggatgaggaaagagagaaagtttgggctggtcatgttctggggaggcaggcctgccgggcagagcctcccgaggtgttgataggctcggggtgcgtgggaagccgcagggtgtgaacaggctggtggagccttgctgtatagctgggaggcaccaaaaatgccatgctgataagatctacataacttgttgacactcttgtgcatgttccaaactgttatttctttgagtaagaatttgggtcttcctcccctcccccaagcccgacactgctgagtgagattggaagggctctgctgagtctgagatgggcatgagcaggcagggctgttttcatcctggggcatcccgctgggtcacacttggggcatctgtgtcttctcagctgcctttgaaaacgagctagctcttggcggtttcccaaacttttatctgccaagagctcctttagggtagctgactaagtgcatgatttcctttaagtttctttattcagaatatattttggaggtgtgattcttttttagttaatagtcttgtgaggtttacagaaaacttgggcaggtagtacacagagttcccatattcttccctcccctaaatacggtttccccaatcattaacatcttgcattggtatggtacatttgttatagctgatgaacaaatattgatagcttatcattaactgaagtccatggtttacataagggttcactctgtgtggtacattctgtgggtttcaacaaatgcctaatggcatttatccaccattagagtatcatataaaatagttccacagccctacaaatcctctgtgccccacctattcacctccccccacccccaccagccccctggcaaccaccaatctttttaccatcgctacagttttgccatatagcagttgggatcatacaatatgtcaccttttcagattggctttttcacttagcaatgtatatttgaagctcctctatgtctttttttttttttttttttgactgagtcttactctgtcgcccaggctggagtgcagtggcacgatctgggctcactgcaacctctgcctcctgggttcaagtgattctactgcctcagcctcccaagtagctgggactgcaggcctgcaccaccacacccagctaatttttgtatttttagtagagacggggtttcaccatgttggccaggctggtctcgaactcctgacctcgggtgatccacccaccttggcctcccaaactgctgggattacaggtgtgagccactgcacccggcccctctttttgtgaacgatatggcttttcataaatgagcttcgtagctcctttttattgctgaataatgtcccatcgcatggatgcaccacagtttgtccgttcacttattgaaggacatcttgattgtttccagtttttggcaactatgaataaaactgctataaacatccatatgtggaatttaatgtgtaatattcataatacttttttctttcttctctcttgcttttctattgttgctttttaatcacaaatcctatatccaagcaaaagtcggcatgcgtcctttctttttctttagattactccttcctttcaaatctttaaatcaggcttcctagatcagaggtgctaatgtgagtgcccatgcagatctgcagccctggcccgggcatcccgaagcagggaggatgtggtgctcaagtctcagttatcatcataatctctttggacctggagtgctgcagggagaaggtcagtgatgccaccccatagctcctgatcctggcccatgctcatgctggacaacagccaggtgggttttgatgggaggtaggcgctaacttcagtggggtgggagctgtgtggccatctccctggatactgttataggtcgaattgtgctcttcccccaaattcatatgttgaagtcctaacccccagtatctcagaatggggccttatagaatgtggccttatttaaaaataggattagtacagatgtaattagttaagatgaggtcatactggagtagggtaggtccctgatccaatataactggtatccttataaaaagaggaaactggaacacagacccacacagggagaacgccacgtgaagatggtggtaggggctggagtgatgccgcagcagccaaggaacaccaaagattgccagcaaagcactcgaagtgaggagaggggcctgggacagattctccctcacagccttcagaaggaaccagccctgccagcaccttgatcttgaacttctagcctccagaactgtgagacaatacactcctgttgatgaagccactcagttggtagtactttactacagcagctccagcaaactgtacagggacctcatagcttctctttaaggatagcaaaatctctctctctctctctcttctctctctctccctgtattattttttgttataaaaatagttttttgttacagaaaagtcagaatatatagacaagcaaaaagaatgtaaaaagtatccacaatcctgctcaccattcacatcttggcgcacgtctttccatatcacttgttttttttctctctttttttttgagatggagtcttactctgtcacccaggctggagtgcagtggtgtgatcttgactcactgcaacctccacttcctgggttcaagcaattcttgcacctcagcctcctgagtagttgggattacaggcatgagccaccacacccagctaatgtttgtacttttagtagagacagggttgcaccatgttggccaggctggtcttgaactcctagcctcaagtgatccacctgccccagcctcccaaagtattgggattacaggcatgcgcctctgcccccagcctccatatcacttagtatcctctccccatgtctacaaactgtagcctggatcatgtcttaacactgtaggtaacctgcttttttttttttcaatgataaataataattgtacacattcatggggtgggtaacaatgttgcaatacacataatgcatagtgatcagatcaaggtaattagtacatcaatcatctcaaacatttatcatttctttttgttgggttcatacaatattctccttctagctgcttgaaactatagaacatattactgttaactatagtctttctacagtggtatagagcaatagaacttattcctcatatctagctataattttgtatcctttaataaatttctccctatccctctcttccccctacccttcccaacctctaatatcctctgttctactttttacttctgtaagatcaacctttttagcttccacacatgagcaagaacaagtggtgtttaactttctgtgccctgctcatttcacttcacattcgcccagtttcatccacatggccataaatgacaggatttcattctttttttacggccgagtagtattccattgtatacatataccatggttttttgtccgttcatctgttgtgtgctcttttcattgaatgtgtgcagtatcaacagaaacatttcggtagcatcatttctcatgactgcacagtatcctatcgatatcctgtgtgataccaacactgcatcaaatttcctattggttcaatctttatgcatcatctcaatactttccttatgataaattcctaaaattgcatttctgagccaaagatgatgtccatttttaaagatttttttttttttttttttgagacagagttttgctcttgttgcccaggctggagtgcaatggcgtgaactcggcccaccacaacctctgcctcccgggttcaagcgattctcctgcctcagcctcccgagtagctgggattacaggcatgcaccaccacgccagattacttttgtgtttttagtagagatggggtttctccatgttggtcaggctggtctcgaactcccgacctcaggtgacccgcctgcctcagcctcccaaagtgctaggattacatgcgtgagccactgtgcccagccttaaagatgttaatatgagctctctatccacccttggagaggttgtgccggcagcagcagtgggaggagggtgttactctaggtgcttctggaattacctctcagaaccattttgtgggtcagagaagcaaaccagttttgtcatcttttggccccaccttattttaatgtgttcatcctggttgttgaccttcttcactagacttggctttgtctgaagttttgctgttttcaaaaattaaactcaccctcaaaagactgaggtttggacagttctccccaccctccctgcaagaaaggaattcacagaggaatttgactctcagggagctttgattcagtgactctgaggtccttttaagtcctgaagtgctaaggcggctatgctgagggcagtgcatgtgcccacagcctgtgtccatcaaccggggcccactgtcccacctcacacatgcgcgtggggcgctaaaggccaggctcactcacttgtaggctccaaggaccaatccatgccagacctttttccagatattcccattttcacggagtgggctcatgaacttcaagttctttgtatattcaacagttttaacaaaagaccagttacttttcttctgagccattaaaatgtgaattattggcataaattctgaaatttatgaatttcttccaaagtggacaattacatttgaaattttattattttttgtaacataatgataaattatttaacattttctgtgatgacaacacctgaaatatactctcagagcaatatcaaaatgtgcagtactcaactgttagctatattcaccacactgtgcagtagatgtccaaaaaaatcaaacttatcctttttatctgactgagactttgtaccctttgactatcattttcccattccacctacccccagcctctgtacccaccactgtactctctgcttctgggagttcaattgttttatatctcacatataaatgagaacatgtgggatttgtctatgtttggcatatttcacttagcataatgttctccaattctatccatgttgttgcaaatgacataatttcttcctttttaaaagctgaacatattccattgtgtctatataccacattttctttttccattcatccattaatggacatttaggttgatcccacatctttgctattgtgaatactgttgcaataaacatgagggtgcagatatctcttgacacacaaatttcaaactttttaggtaaatacccagatgtgacagtgctggatcccaaaagcaccatcacagagggctactgagagccaggaaatggaactgtgcaatgtgatactgctgaatggggttcctacgagctctagggcttctcggtcctgttttattcctagcaagggcaaaacaacaactaaaaacaatttttaaaaatcttttaaaaaatcgtttttaggctacttatagcctgttttcactaggtacactgggaatacttggttcttagtgtggcctgaacaccagaaccaaatgacctgcttcacccagtccaggacccatggcacctgctctcttccatctgaagagaactgcatatatgagacgaaggccaggtctcagggagcagcttcagcgttttagctcttgcaaaatctcctggacgattttatcaacatgccaggcaggtcccccgtgcactgtcaaaatgatcgtcatccctccaagaatgtcctagagtctggaatggcggcgtgctctctcacttgatgccacgaatggattttcagaattcttgcgtggctgctctcctccacaggtatgcttaaaagcttccaaggggcagtcccttatctacctgatcagataactcaacccacatctcactgataaccctgaatacaatagcttataagtatgagagggatttcttttcaatttataagaggcagtggtgaccgatttatcttaacctatgtaaacagtaatagctaccattcgatgagcatcactccgccattgtcatgggactggccctttacctgccatgacctgagttgttatcacagccttgtgagatagttcctacccataaggaaacagaggctcagagaattcagtaacctacttaaggtcacacagctaataagtggcagagcagagatttgaaaccaatctatattcttgctcaggtctttttttttttttttttttttttttttttttttttttgaggcaaagtctcactctgttgctcacgctggagtgcagtggtgtgatcatggctcgctgcagcctagacctcccaagctcgagtgattctcccacctcagcctctcaagcagctgggactacaggcaggcaccaccatacctggctaaatttttttttttatttctagtagggacaaagtcctgctatgtcaccaggctggtctcaaactcccaagctcaagcaaccctcccgccttggcctttcaaagtgctgggatcacaggcgtggctcatgtctctttatttcctccaaatttaaagccgctcacgttccagatacctgatttcagcagagtttcttttaatattaatatttcaaaatcactcattacctcttccacactcattctattgtttctcacaaataattacttgaggtaagctcataaaattatctccattttctagaaaaggggttgattgttttgtggggagcacacagtgtcccgtcagcagtccgcttccagccctgggttgacttccgaggcttcgctcagcacttccgtaacacttgcaattttggctaaaactaaattactaattattttgtcacttgggttttgttacccagtggccagagacaagactactggattctccatttcttcacattctgagtatcttgttccctcctccatttctctgaaaattctttttcatttcttactttcctgtggtttctagcaggagggagaagccccagggttttgctgggcttgtggcatgtaggatgctgcagtgagaagaggcactgggattgcaaaggtgaagcgaataaaaatcaagggtgaagggtttaactgtgatgtacagatagcaacaagctcaacatgttcaggaaaacagagtgggcagggcctgccgaccaggtacccctctcacaggtacggacagaaccctcagagcggctgcctccctgctcaccatgagctcaaggaatcagggctctcctctcacacttcatcaccccctattttcccagaaacaacactttacagattaaagaacgctatggaaagagatgagtttgcttctctttctacaggatcatgccaatacctgtaagagccacactacctttagcaagacccaagtatatactgaagctggcaagcagagtgagcttttgctatcagattgatgatttcaaagaacatataatgtagtggctttgtgaacaaacactgaaatttaacagtccacaaaaatgttttactacatacctccaaacctgttcagaagatggtaaaatcaacaatatcctcatgtttaaactactctaacagaataaattgttaacttgctagaggccagttgctttaaaaattcaaagcattataaatatgctacataatattaaaagacactttggaatgagagaaaaagcaaataaccttcattttggaagacatacttgaagcctgattaagaagcaagctctaaactttgtatttactgagtgggtaaattgataacaaggtgtttaaatcctaccatctgcagttcactttcaacatggacaatttgctgtgtagtaagtgtaaactaatcttggggagttgtgggaagaaggcaaatctgggttccttaatgaggaacatcctgaatgatgcttaaatccaagctgtgtaacttcccacacgccgcagattagagaatttcaaagatacactaacataagcatccagaacgctccataagtctttggccataaacaaatggacaactaaatgatttcatttcccagctcagaagatgttttcctagcaaatcaaaacaaacacatttagcatctacttgtattttaccacagcctactaactggaatcttaaactcagctttatgacaattaatatgttccaggattttaaaaaaagaaataaaaggtacatctaaagcaataaatgtagcttcctttgaaggagaaaaattaaagaagcattttagagaagtggatgacatttcctttccttattcctgtcttttcaggtcaacacatattcatttgcatgtgactgtgtgtgcgtatctgtatgtgtgtccgtcccttagaggaaagcatctgcatagatacaagaaatatttttgtcccccaaagattttacaactgttttgtgagtaaagccccacaggttttagaacaggtgtctctaccatttcatgtatcgcttgttttgtacgtagttatagcaatggagaaacatgatgccaataagatacttttcatgcctatttgttggccttggtttgcgcacgcacgcctgtgtgtgtgtgtgtgctcacagaatggaggtgagtccagtcatgtctgtaatttctaactttcctgttgtcaattagcaatttgcaaatagtgttgaaaccagccctgcttctttcttcaggactaaacagtttgtaacgacaatgtagcagcattcggccattctctgagagataatggcagtcttcattagcaacatgtgggtattaacttatccccttgtgacacgtagttctttgtggagtctttgagcattgatgtccaatggatctttttattttgtctttttccatttcagtctttccccactgacgtcatattctggttcccagaaatagacaagtagttcccattaaagtcgatggtaacaaaatatgtctaaatgtggccttcattttttaagtgttcaaagtttggtttgttttgccttttctccctgaaaagcttgttcatgttgaactcctcctgggagctgatctaactgctagattcacctcaaaatgaacacagtagtcatatatgcagttaattaaatccgtctcctttcacaaggaaatgagaggttttgaatgtaaatgtcttcatctgcagttgagtattctcctaatttctcatcccagcaatctctgatactgaatctatattaaatcataaaaataactgaaaaaccagaaggttcttcaataagcttgaaagtttattgtccaaagtatgtcaatattaatatttctaagttatccttttctttctttgaaaggtctgtaattaaatactgtgtctctttttatataaaataagagaaaccaaaaagacatttgtatatttctaaacttaaaactttacgataggctcttcagtctattacatttcagatgaatcaatgatatgactttttgttaaataaaaaaaggattatattgagcttgagttaacccacttgctgccctgttttctaataatttcattatagcctgcactttttattcatgcttccacgatcctatcagttcaggtaatttccataaaattggtactttctaaaacggcttacccttggaacaaaggagcatctgcctgctaaggtggtggttactcataaaaaaaatagaggagtaggtggtcggagagacacatagattttagacagttgcctaagatgaagaacaggtgttttcactctagaatttggggaattcatttaaaatcgagcacttaaatcacagacctagccactgcctttatttctgcagtcaagctcttagaaggatgatggtgtagctgctagccttgacaacaacgcagagtggaactgacagcaggagtaactgcacagaatgtgttctgtgcttagaacaaatgttgagtgcagagtcctcgctactaggccttcctctaaccaggctgttttcctaatattattccttttcaaattcctgggttttgtcatttatttatttatttattttttgagatggagtcttgctctgttgccaggctggagtgcaatggtgcaatctcggctcactggaacctccgcctcccgggttcaagcgattctcctgcctcagcctcccaagtagctgggactacaggcacccgccacgacacccagctaattttttgtatttttagtagagatggggtttcaccatgttggccaggatggtctcgatctcctgacctcatgatccgcccacctcggcctcccaaagcgctgggattaaaggtgtgagccatcacgccccgcctttttttttttttttttgacagagtctggctctgttgcccaggctagagtgcagtggcacaatatcagctcactgcaatctacgcttcccgggttcaagcgattcttgtgcctcagcctcccgagtagctgggattagaggcgtgcatcactatgcctgagaaatttttgtgtttttagcagagacatggtttcgccatgttggccaggctggtctcgaactcctgggctctcaagcgatccatctgccccagccgcccaaagtgttgggattacaggcgtgagccaccgtgcctggcctatttaattatttttgattcaacacaaagtcccctttgtcacggggcttactgaaacagagctgcgggcacatccacctgctgctgaggcacgagtccacacggcacgctcactctgtgtggcgggcagaatcgtagcgccccagatgcccacgtcctaatcctcagagcctgtgaacacattacttcccatggcaaaagggactctgtgcatgagatgaaggtatgaatggtgacgtgggaaggttagccttgggttctcccggggtccactgcaatgacacaagtgcttaaagtcagagaacatttcctggctgtggtcagagagaaagatgtggctagggacaaagggtccaagaaaggcaatgttgctggttttgaagatggaggaagagggctttcagcttctagaggccactcacattccttgactcaacacaaggaatgtgagtggccggcctctagacgctgaaaaaggaaaggaggtggattctcccctagagcctccaaaaaggcagtgctgactcctgattttagcccagtgagacacctgtctgacttctggcctacagaattccaagatcacacatttgtgttgttttaagccactaggtctgtggcaattcgttaaggtagcaagagaaaatgaatacactctccctgtcacctgaacaaggaagggagagggcttggcatgtggagtctgttagacttggattaaaactccagctctactgcagaccagctgtgtgtccttatgcaagtcattttatctctctgagcctctttttcatcatttgtaagctgaaggctacgtgactgcaccggattatctgagaggtgaatgccttgaccatagtggtgtttaataaatgagggctttcattacacatctttctctcttttgctctctcttgagtccaacatccagtcatgaaattctttacactccctttctcactccatattaatttaagttcaatttcctttgtatttttgttcattccttcagcccattgctctctcacttgtcttcctaagagaatcctatcattaagccactctctcaatcaaaagccattaataactcccgcccctagaatcacattccatatctttgccccagcattcaaggcccccattggctggccccattctacctcacaacctcattgagtgccagtccatttcccagagtgtgaaccccaacccaggagaccagtccctagcctcaggaacacctggcagatgtcagcgttatccacacgctccctggccagctggtatggagatgccccccctggaccttctgccctgctgaggttggtctgcccactgtctccacaccttcgcccctgcagtcttttctgcttctccaggtggatgtccctaatttcccacctgcctccctctgggttcctaacagtgcctgccatttgcctctctaaactgtgagtcacctttgatatgtttgcgtcttgtctcccaggtagctggtaaacccttggctggtggggccccttccctctttgaaatctccacagtgtgtccacagaacatcctcaaaaaatattcctcagctgatgacccatccacttccatctgaagttcccccaggaagacaggtgctcgcagacaggggtcttattctgttctgtctgttctcagagccagcatcttgccctggttggctttcctctcagcaggtagcactccatatttctctccgcctctaacacacccctcaaccccacccttgggctctgcggccaaaatgcaaagggataaaaagtcctaggaagcaggactgggttgtatctatcttgtccgagagaaatgttcctgccccataatttacctccaaggaatatggataatagttactgtctttttgagatgtcagtcatctgagatctcaatcttctctcatcttcgaggtctgaaacaagtgttttgccctcttcaggccagtctggggtctgcaaaggagatgcctgggaaaccttatctgggaggactccacaattggggttttgcctaaaaccttggtggtggcacatcctgaaccagagggacctgagggaagcacctctcgcccgagaggagcctgggtctgtagggcaatcatggctgagttctgcctccacccctcacccctcaccacttggaaggtctgtttgagatttcttggtcctttgatattcgactccaacaaaaatgtgaagcattcctgctgaacatgggcacagacagctctacttaggaatttcattttggtttgagtaagcaattgataaaaccttacattacggttatttcatcatttttgctgcacttagcatattcctggattgcatgtgggagggctggggagagggggtgatggtcaaacaagataagctttgaagttctgtttaattctgaatattggttttattgaaatagaggccccagcataaaagatggtaaaggcagtttctctcagtgggtgagggatgcagtgagcctgacgtttttcttgggacatttggtggccatcctagtggtgggaggacagcaaagacggagctagaacagacctttgctccgtcccaaatttctctccttaacctcctcttatacctgattttacacgtatatttatctatttatatttttcagcttttaaaaataaaagttctaaacctttgcaaaagtacaaaggataataatacactgaagctccctcatccatcacccagatgaattatcagtattttgccaattttttatttatttatttatttatttatttatttattttgagacagagtcttactctgtcacccaggctggagtgcagtggcgcgatctcggctcactgcaacctccacctcctgggttcaagcaattctccctcctcagcctcccaagtaactgagattacaggcatgcaccaccacacccagctgatttttgtattttcagtagagacgggttttcaccatgttggccgggctggtctcaaactcctgacctcaggtgatctgcccgcctcaacctcccaaagtgctgggattacaggtgtcaggcaccgtgcctggtctattttgccaatcttgtttcaggtgtctcactccatgtttttcctgtaatattccaaatcaaatatcaggtaaagatacatgccattaacacacctaacaatattaactctaaatcctttatatcatctaaattcctatgcgaacatttccttgatagtctcaacaatgtcctttaaagtcagtttttgaatctacatcctgacagttcacacactgtatttgattgattgatcctttaagatctaggagttctgttgtgggcaggataagggcccccaaagatgcccatgtcctaatccatgtcacctgtggtatgttactttacctggcaaggcaactttgcagatatcatcaggttaagtacctggagatgggacaagtagccaggattatacaggtgggcccaatctaatcacacaagtgcttaaaattaaagaacctttcccagctgaggacagagatagagacatgatgatcggagaagggtgtgagggatgggtcattactggctctgtacttggaggaaggggccatgaacccaggaatgcagtggccactagaatctggaaaggcaaggaaacggcttctcccctagagcctccagaaaggaactcagccgtggggacacctcaatagctccagcgagtccatgggagacttctgacctatagaactgcaagatcacacattgctgttggtttaaaccaccatgtttgtggcaatttgtcaccacagtcatggaaaaatgaatatacatctttttaagggggactgaaagtcacactgaggtgtaaggttggtgatgggcccagggaaaggtaagggtctggctgagatgcctggggaggggaggctgggcctgagaagagcggcccaggtgccaggggaccttcggttgcctctgcccactcctcacgggccagtcaggcaagaagagaagagctcgccctcctgctgcagtggcctcttcgcagcaggatcaggccacctcccacctacacccttcagcagcctcccctgcccttggaaggcaatcacgcaccatgcccccgttactcctccgctctgtgctgggctcctttctgtccctctgctgggacaagctccctcctgcctcagggattcccgctggctagtccctctggccatcccttctccactggctgctcatcagctccaggtctcagctccagggaggcctccactgaccactctgtctagagtgtgccccccaacaaatcacaggactgtgcttatttccctcatagcacttgtctcagtctgtcattatttctgaaggaaggggctggcctgtctgactcactactggggtatggccatgcattcaacaaacactcatggagaaccaggcaccacgctgggcgctaacagacagtcatcacctttccatggcatgtgtcccagcagggagacaggcaggacagcgacggcagtggaaccagacagctgtgaggaaaggacatacagcaatgacaccaagaggtggtgctcaagtcaccctggaggaaatggaggtgtcccagagaggcagcatttggggtgagccacagggagctggggcgcaaagccactcagattggctgcagccaccagggcgagtgggaatccaggacaccgtgagtgtcccaggcagtttcaaagctgtggtgcagtaaagggcaatgccttattctggggaaggctgggccaagcccagggagtggaagctgcaggcaaacggattcgggctcaaaacaggaaggaatcttgtgtccagcgagggcaagctagatgctaagactgggtgacgcctactaccttgggccaaatgtcagatgggaggcaggtggctgtgtaggcctctcatctttcaggctccctgatactcagggttaggcccgctaacggggacaaggccacataggtaaacagcaccagcaaatttgcaacgtgagaagggctatcagagaggtggcgttcagaactacctaatgtgtggggagcttgatttgctggtaaaagctgtcttccttcccgctgttaggaggacacatttggacctgaccttcaccactggtcatgtgagaaagcctctatacctggttcctcaacgtctccgtttagaagactgcatcagcaaaaccatcctaccatgggaattaactgatggatgtgtctggacttcccagggggttctccatggacagtattgtgctggtaaatatttaacaactgactcttcgtggggagaaaatcactaagtgtagcatctgttaacacctccaccctggctgatgcgcagttgggaagacatgtgcacagctggcaccgtgagctggcaggagctgctccagcacccgcattgcatgcaaaagtcaagcactatctccagctccctgaatcctgtgtgaaggcaggacagcaagctggttaagaggctaagatttgactgggcatggtggctcatgcctgtaatcccagcactttgggaggccgaggcgggcagatcacttgaggtgaggagttcgagaccagcctggccaacatggtgaaaccccatctctactgaaaaatacaaaaattagcctcacatgggggtgcacgcctgtaatcccagctactcaagagcctgaggcaggagaattgcttgaacccgggaggtagaggccgcagtgacaggggtgggaaagaggctgagattcgcagctgaacaaacttgggctcaatgagcagctccaactcttaccggtcatatgaccttgagcaagtacaaatctcaattagtaaataggaaagcatcttctgctgatgaagcattcattctgttctaaggacttgccatctcctaactcacttaatcttcacagtaaccacaacaggttggtttgactctcattcgcagttaaagacgaggagacggagacctagaggaagtcatttgtacaaggccatatggcttgctcctgatagatctggaatttggactcaggcagcctggttctggagctgaattctgaactacctatatcatcccacctcagtccagtgagagaacgtgtcacctgagtgctcaagatacatcaagagcccgaccatgtcctggagcctcttaagagcgaagctcagggtgcaggacctgagagggtgttaatcagccgcttccatttttttcttaatatgggaagaccagattttgcttggcttctggaaaccgctgccatcttgcttttcctcctacttcagctcttggtctcctgtgcagctggcttttccttcttcctgacttttcaagcccatccttggacctcttatcttctccatcaaaattctctccctggatgatttcactgaggccgatggcttaaatcccttagaaatactgatagctccaaatccctatctttagcctggcctcctgccctagaattcacttgtctaagtgcctagtggatttctccacttagatgtctcataagcatttcaaacctgcccaaaacgaaacttgattaccatccccaaaccactcttccctaagaaaatggtgtccccgttccaccagttgctcaggcaaaaaccctagcaatcagcctcacttgctttcattctctctcatctcccacatcaaacccattagcaaattctgttggttcttttttgaaatgtactcggaggctacttctcaccacatgctctgctatggttctagcccaagccactgtcagtctctcccagagacacaagctgtaccttcctaactcgcacccctgtgtgcatccctgtgtgcatccctgctcacccaaagccaaccctttgcatataaccagagtgatttttttgaaatgtaaataagaaccggtcaccaccctattcaaatcctccaggggcttctcatttctcttagaacaaaacccagactcctgactacagccccaaagccctacatgatcctgccccatttacagctccaggctcattacctacctcgtgctcccagcccacggatcatcgcctaccacatgctcccagcccccggatctccagcacatcagcctcttggctcttcttagaactccctgaattcactcctgtctcaaggactttcctgtgcttttccttagacaggagacacccctcccagttcacatggctcactcgcttcatccaggtctcttctccagtgtcccctccttgtgacccctggatctaaaggagttgaaccaccccactcctacccttatattctcatagctcctcacgctgcctcacttttagcaagatttcattaaaattttattgctgtctaaaattctattatatatttaaccatttacttgtttagtatctgtgtcttccattagcaagtaagttctggccaggcgtggtggctcacacctgtaatcccagcactttgggaggctgaggcaggcagatcacctgaggtcaggagtttgagaccagcctggtcaacgtggtgaaaccctgtctctactaaaaatacaaaaatttgccgggtgtggtggcatgcacctgtaatctcagctactcgggaggctgaggcaggagaatcgcttgaacctgggaggtggaggctgcagtgagccaaaagaaagaaagaaagtaagttccatgaaggcagaaattttctgctttattcattgctgaatactcaacatctagaattgtagaccctccatagacacttattggctgaatgactgaaagaatgaatgagtggttagaaacagtacccatgtggaagaatatatagccacctcttacacacagtttcattaattctcagaagttttctatggcaattagggagcagattatttcgcccgtttattgaaacccagaactaacgattgatgtttaaagactaatccgtctggagtaagtagctgctgaatgttggccgttcaaatgaagtaagttaagtattatgtgtctctaatgtattttaaacttgttttatgtcaattatattatcacaactttggaagaaactttattaggacaaactttaatatttttttctagaaagtattttttttaaactaacacaaatgcaaagtcactgtaaagttcaagaagtaaacgatatcttcttttagttacagctgaaaggaaagcacatcactaataataccaaacttggtttggcaatttttagaaaccccatttaggccaggcgcagtggctcacacctgtaatcccagcactttgggaggccgaggtgggcggatcacgaggtcaggagatcgagatcatcctggcgaacatggtgaaaccccttctctactaaaaatacaaaaaattagctgggtgtggtggcgggtgcctgtagtctcagctactcgggaggctgaggcaggagaatggtgtgaacttggaaggtggagcttgcagtgaggcgagattgcaccactgcgctccagcctgggcgacagagcgagactccgtctcaaaaaaaaaaaaaaaaaaaaaattaaaaagtaatgtttaaagtctatacttaaaataaccatttcaaagaaaaagctagtatcctgatttctgcaaaatatcctcattaagacaatttaaccatacgaagagatttactctgtgtttgaataatatggtcacaagtggtctcccttacctacctccacccctaaatgagaagaaatttagtatactcatggggatatgagttaggcctgccaaatacttttggaaaaaattctgctaaattgtttctagaaactgctagtactgttaagagggttgacacattctaatatagccaaacacagttttttctaattgcttggctgcaaatgaacttgtaaggttaaaagtataagaatttattccatgatcagtgatggaatcctaatccatcttaagttgcgtgcatgacaactggcatttcctaatatgtattacgagacagagaattttttaaaatttttgcctgagggtacattccctttcaaaagcagaagattttcttcttttgctttctcaagatatcacgctaaacttcattcttgatggttcatcgattaaggaagcaagatagaaaggagaatccatgatagatttataaatttggggcaaaatgtaacacaaagcattccaatacgcaacttcaaatcaaaacctcaacttgggcaagggatgttatatcaaccaacagcattctttagaaatgcctgacattcaattggatagaattatatattgaaatagattgtaggcatattgcgaatgtttttcctctagcatctggtagtatcaaagcccaggaggaaaaaaaagggtgactgtgccagaattaaaaagctgcctctttggataaatatgtggaaaggttatgaattaatttatcaaaaggctagaagaatttgctggaagtcggagggagaagcggtttctaaaagcaataagctatttggaatttggcagcatgcaacttagtgctttgtatagctagtattattagccaaataagggtaaaatgacatttcaaaggaggaaaacgaatgaatgaatacatgcatagaaagcaacaaggcaatatcctaatttgtaaatgtaagtagtagtcatagtgtctgagatgtaatgtgggatgagccccaagggaaatcaggcaccttctcaatgaagcctttttagacttcaaagaaagtagtggctgggtgcagcgtatcacactgtaatctcaatgttttgggaggccaagacaggaggactgcttgaggccaggagtttgagaccaggctgggcaacatagtaagtctctgcctttaaaaaataaaaattagctgggtgtggtggcatatgcctgtagtcctagctacttgggaggctaacgtgggaggattgtttgagcccaggagtttgaggctgcagtgagctgagattgctccactgtactccagcctaggtgacagagtgacaccctgtctcttaaaaaaaaaaaaaagtagtgacttgtgatttgtgatctggataccagttaaagttagctaactgctaaacaaacactccagaacctcagtgattatggaaagcccaagtaggtgttcctgggcagtagaccctggtcagtcagggacccagactccttccatgttgtgactctgctctcctctaggctagcattatcgtcctctccttttagccagtggaagagaaaataaaatggaaggtagtgcataggaggatattatgaatgaagagtgacagctgggtgctgcggctcacgtctgtaattccagcactttggaaggccgaggcgggcagatcacttgaggtcgggagttcgagaccagcctgaccaacatggagaaaccccgtctctattaaaaatacaaaattagccaggcatggtggtgcacacctgtaatcccagatactctggaggtggaggcaggagaatcgcttgaatccaggaggtggaggttgcagtgagccgagatcgcatcattgcactccagcctaagcaacaacaagagcaaaactccatcaaaaaaaaaaaaaaaaaagaatgaagagcgaaagccctcatattccattgaccagaacccagtgacatgaccacacctaactccatgagaggctgaggagtgtagctgtgagctgagaattctgaggaagcaggtgtgagtaattagtttctactgcaaatggtaccatgacattgtactcacttgctgaggaatctctgttctatccccccatggtaaattgtaagttcctagaacaggatagagttaggtcttatgtatctcagtatctttaacactaacactggcatggagttgatgctccatttgtagtcagtggatgtggctgtctggctcacaaagcccagcacagtgacctggtgatgttaagactggtgttctgtgttttaatattgccaagaaatacttgcatttttctcccctcctcaagatggcttccctgtgaagacacttccagaggacacagggaccacatgctaacagtaggcaaggggcacatactttgttaactctcattgtgtcttcaagctaggagaagccttcagaggaaggcatcctcgcactcttcacctctagaaggagcgcctagatggggaggctgtgttcctggaagacaaagaatagggcggagggtttctagtgaaacccaacctcatgaataaaaagagagccaaactcgaaccagacgtccttatcagccaagaaagaagtcagaatttacaagtgagtgagcaggactatagaactttagacaaatccagaatcttattctgtctccattttatttcacttaaaacaggaacagcccccacatgaatattcagggaccagagaggaaggggtttctgcagggttgcactccactttgcagtcaggctaggagaggatgaatcctaaggaagagatggcggcagcagtcccttattcatttttttatacgaaagtacaaagcaaaacaaaaacaaaaacaaaatcacaaaacacaaaacaaagcccccaaaacaaaattacaaaacaaaaaaagtgcaaaattacaaaacaaaaaacaaaattttaagctttattttttaaaacacaattaccatcaaggaaaaatggatacattggacctcatcaaattacaacttatgctctgtgaaagactctataagagaaggaaaatgacaagctacaacagggaggaaatattcgcagaccacatatctgacagagggccagtatctggaatgcatgaagaactctcaaaactcaacagtggaaacaaacaatccaattagagaatgggcaaaggacatgaagagacatttcaccaaagaggatttacggatggcaaacatgaaaagatgctcaatatcactggctactaagaccatattatacacctgttaaaacagctgacataaaaagtagtgacaccaccatacgctagagaagattcgggggaactagatcctcagccacttctgatgggaatgtaaactggctcagccactctggaaaaatagcgtggcagtttcataaaaaactaaacattcacttaccatacaacctagctatcatactcctgggcatttatcccaaagaaatgaaaatttatatccataaaaaaacctgtacacaaaactagaaacaaccaaaatatccctaagcatgtggtgggttacaaattgtggtgcatccataccatggaatactactcagccatcaaaaggaacaaactattgatataacttggatggacctcagggacatgaagctgagtgaacaaaagtccatctcaaagagtcatgttattatgattccatttatgtaacatttttataatgataaaagcatagagatggagaacagattcatggttgccagggctggggatggtggggaagtaggtgtgaggggagaatagacagcacgagggagagcctcatggtgacagaatagctttgtatctcgatcgctgagtggttgcacaaatcttacacacgtgataaaatggaacagagctgcaacataaggtgtgttctactaatatggatctccaggttttggtactgtcctacaggtcagtgagatgtaaccactggaagagactgtgtgcagagtacgtgggacctctctgtactatttctactacattctgtgaatgtttaattatatctaaatgcaaggtaaaacaagaacaaaattaaaactgtgcttttggaaaaacagtattttacatttttaatttaatttaatttaattttttttaaagactgggtctcactgtgttgcccaggctagtctcgaactccttgcctcaagtgatcctcctgtcttggcctcccaaagtgctgagattacagacgtgagccattgtgcctatttttaattttaaaattaataactctcattgtaaagtgtttaagactatttaaatgttaaaggaaagtcccccatactgtctcacccttcaatcaactccaatctcatgtcacagaataactactatgaacagtcaagtgtggtgtgcatcttatttgttatattcttttctgtttgtttgtgtttttgagacacagtcttgctctgtcacccaggctggagtgcagtggcaagatctcggctcactgcaacctccgcgtcccgggttcaagcaattcttctgcctcagcctcccaagtagctgggactacacagaggcatgtgctgccacgtccggctaatttttgtattttcagtagagacagggtttcaccgtattggccaggctggtctcgaactcctgacctcgtgatctgcccgcctcggcctcccaaagtgctgggattacaggcatgagccaccgcaaccagccaattattatattcttatatacacatatatggacttttggttttttcctcaaatggaatcactatgctaactcttctgcaacttttttttcccacataataataatacatcttggacatcttttcaagacaccataaacagctcgatctcattctttttaatagctgcatggcattgcatcatatggctgtgccataattgatttaatcagtcccataataataaatatttagattgtgtccagttcttaccaaaaatgctgcaatggatattcctctacaaacattttgtgcaaatactacatctataagacaaatatatgattttgatagataatgtcaaattgctttcttaaaaatttgtaacaagttgtgggtaaaagcagctttaaagagaacaggagggcagctgcatccccaagggcctggaagggaagggacccgaaggaacctcgctgaccacgaggtggaacccctggaagaaccagggcgcctcccacctgtactggtggggacaccaggcttatggaaagttagcagtcgttttccttttcctcccccctctgggtggctaggggacacttcatctttatcaggaaatgaagtgagattatctaacatgagaggatctatcttaccaccctctggaaagcgacagcagggctagtctttcctctcaagacacaccgggacattcccatgagtgcacacactggctacggcatccatcgatgggatttttagccaacatcttccaacttcacttcctcgtttccaccaccgacccattcccaaaacaattctagtttgactttacactggactaacccgggtgcaaagtgactggaccctcccaaggaggaccctaggcaaaatcctaaaatgggcctgccataaactgatcctctccctcccagctgcaggtacccatgagtgttaaactagagaaggcaaatgttggcataatcatattggcttacaggaattcatgggtcagggaccattttgggaaggaaggatataagattttaacgtttgctaaaaggagatacaagtcttttttttttggagtctcgctctgtcccaggctaaagtgcagtggtgcgatcttggctcactgcaactgctgcctcccaggtgcaagcaattatctgcctcagcctcccgagtagctgggactacaggcgcacgccgccacgcccggctaattttttgtattttagtagagacggggtttcaccctgttgtccaggctgttctagaactcctgagttcaggcaatcagcccgcctcggcctcccaaagtgctaggattacaggcattagccaccacgcccggctaggagacacaagtcttaaaaggactgagcgacactgatgtgttcctgagctcacagttgctcagaaactggggtctcagtgaggtcatgggactcatccacgtcacggggctggaagatgacccacctggccttgaaccctggttatctgtttcccaaatcagagttggtggacagagcaacgacaatccagctggagcgatggttcagggtatgtgttcacccagccctttcgggacgtcgcgtgcctgcactgtgggaacgcaagtggacagccggtccctgccgtgggcgctaggggccagtgctcagcgcgggaatattcccaccgccacgtgcgcgcggacagcgggtactctgaggaggggcctgcagcccggctggggctgggaagacttcctggacgaggggcagcccgggttttcctcaaggatgagctggagtcggcccccggcgcaggagcaaggtgccgggagagggccgagctgggtgagaggcctgggccagccaacagcggccttcgagcagggaccgcgcagctccgtgtccccgcagtgggagggcggcgggcaggggccgggcgagttaggccgcaagcatctgctggggccgtcgcagcaccatcccacagaccgccactgaatcaacagcagccagttctccctgggctctggaggccggaagtccaagagcaggcatcaggatgggtccctccttggcctgcaggtggcggccttctggctgcgtcctcccagggccttccttctgggcagcacacctggctgctctgtgtcctgatcccctcttctgaggacaccaggcagattggattggggccaactcttatgatcttatcgccactttacctctttcaaagattttatctgcaaatacagccacattctgaggtactgggggttagggcttcaacggatgaattacagaggtgggggcacaatccagtccgtaacaaggcttttgtgtcatttccaggggcacagattctcccaggcaccaactggaaccagggcagcagcgagctcagatttgtttttggaaggcctgtctgccctggggctgggtgggcagtgggaccaccggcaagaggcctgcaggacagattaagctccctcttgactaagctcctacaccagcccacccctttcttgttacaaccacttttgctgcttggctctctggactcctgaggcccaggagggcttagggtgggggtgaggcggggagacacctctcctggcagccccctcactactcctgcctctggcaggaggagctctgcagggtcactatctggacccagcccgttgggcaccttctgcagactcagaagggagcagcacttccccaccagggctacagggagggccagataccttccaagaggcagtcctggacaaaggcagcaggatatgccgggctggcagaggcaagggatcagtggacaaccaaatggccttcaaaccaacagaggatgggtaaatttggatgcatggatttgggggctttatgaatttagacattttaaaatatgtattaataagtaacagaaacttacttctttaggcacaatattagaaatattggaagtatattagaagttattaaaccaactggagatctttttagccaatgttttaaacacatttatgactagagcaaaaacttactttcaaaatattgtgatagttgtatgtcgacataacttaggaaaattgcacacatttttatcttatgtagtttaaaactattcttctgtgaagaggtgcataagtttcacccgattgccaaagagtccatggctcaaaaaaggttaagaatccctgtttaaccaaagccacggatgagatgaggtggagtccaaggagaggaaactaaagactcattttaccctctagtaataagacgtttgggggctaggacttcagaaaagttcaactgctctggagcaactggaaagttcagggcttcaaaatataatacaggtaaagaaaagcaaagtattggtattcttctgatgacaaatgttctttgattttcatcatccttctgaacacaagtcacaagtttgaaaacctgtataatgctgatcatctcaagtaccctctgccttcaatcttgggtgtgtttatttgaaacctaacaatgtgtgcaaaaccaggagaaggctggggagtgagggattttgccaaagtcacacaagtgtgtgtgctgtttttgctccaagctgattagatgcttctattgttatgtatcaagacatctcagggtgtggttgccctaaaggagacagtgaggcaagaaggtgacggcatttgtagttaccagccaccctcctgctcttttaggatgtttgtgtatacacaccctaatgccagcacatgaggatgtggagaccaggcccaggaggaatccatcctcacaaacactgaagaacccagttatccgtgtgctgatccacacgctgccggcaaagcctgtagctggcaggcatcatgccacatttctctcccaaagcaaccctataaacgtaatccttgaacagggccttctcatttccagcagctctttcataattttgtgctttctactttttgaaatgttgtcttggctcatcccacttgaacctacagccgtcagcttctttaataggggtgtctataaagaactgccctaaaatatgcttttccagtgcacttaatgtctttccaattacatccagatgtgaaaagctgaaggaacagttctcaggactggacaagatgacataaatcttgcagctgacagagatcccactgagctcagttggggaaactcacagagaacttgtttggggccagaaaagcggctgggtataaagacagatgtgtacactcggattcaaaaaaatatgttaagagagagaaagcgttcctctaacacagtgcctacaaatacggctgaggcatgaagcaggctgggctacccaccccccgcaactagatcaaaggaggtgattgaaaaggctttggagagagcagaccaactcagcgatgcttcctggtctccttaattgctcttctcagggtgaggaaggtgggcactcctgacagaccttgctggaggagaacaagggctgtttgtgcagctgaggacttggcttttatttttttaatgattaggttttgtacactttccagaatgttccttttaaaaatagtatattcttccttctcttctccagatgctaggaagtgcaggttcaacccaaaccgtgtctatttcaaagggacacaaaaacccagagctggagttaaaggagcttggcggcatgctgcccaaggactgaaggctttggttttcttttaccttcccaagtaattttgtttttgaaggttggaaaacaaattccacagaaggatcagcttctgcaggatacagcctggagcaaggcagagcaaggagctgggtgcagggctgagccaggaccagggcagacacggtctctcagacaggtgccgccctagacagacagctcctgatgcatccaggggctcgctttctagtatttcaggttcccaggggaggaactgagggttttcttttttctctcaagaggctccctccaattatccactgcctcttctctaactcttctctctctctctccctatcatgacacccggctctgtgacagaggacagaggggcttcgctgcacacttgctctgaggaggctcaaagggcccatttgcagcacctggtcagggccactcttgcaaacctcgcctgggcccagcccacccagtgctggagaagccctgtcctccttggctgagaccttttgcttttcctgccatgcatcccacggaaggcctgatgatggtgcatttcattgacaattttatgaccctggccatttccccctgtaacaatatctttaaaatggctccttgtcttcaggtgggtgagagcagggctgtgctcttccctctccttcctgtcactaaacgtctgtgccttaagcaataacactgaagtagtagaatgtgagttctggatcacagaactgcacacataactttgaccacttttgtttccatcctgagataaaagccaaaacgtattttttaaatttatgttttacatcttttagttgggcattgcttttctgagtgaattctaagtattgtaaagatgtcttcaaagacagacaacctcgactctaaagaaattaatgcaaattacagtgtatctcagtgacatgctaatttatagcaccgtaaaggtacagttcaaagctccaacgagccagaagaaagtcggtggattgatggtttgcagtaagaaaggtttagaaacaataaaatgtaactaggattttagtttggaaatgaactaggggtccatttgttccacgttactgagtttttaatttagatctgctgttaaaacctaatgcattttgtatttgtggctagtaaatgactctgactcggtgtcttcaaggagacattgaaaaagaacaggaacaattctcaaagataagacttgcagctgcaggtttcttaacaaaaaatataatctctagatctcacctctaaaatgtgattacaaagcagaaaagtaaaatgaaacaaagaaacaaacaaaagaaacacctgtgatttttaaaaaagaggttggcaattattgtaaaagggaaaatgcatttctgtagaagcaaaattcacttgtagtagcatataaaatatcatgctgtatattcatgaactggcaattattaatcccaaacacgtgaatttgagtaagaatgtaaaagctatcatttgatgttacaaacaatgactatgtaagcatatcttcccatttctttgctcagtaatcctatcatttacactctacatggacactgaatgtgcaaatagattcagcaaacacactctagattctaagagctgtctgggaaaaatcaaggggcaccttgttacctacccaaaccaaactggtgaaaattggcacgagtgcttaggtgctttgaggcctgagtagctaaaccagtttgaaaatagatacctctttttagagcacagaaggagaaaaaaaatttttaagaggcaattaatttcttaggataagtagatttttgttttaatttttataccaacaagaaattaaactctggtagtacaaataacatcttttttttaaaaaaaaaagatacaaagctactgatcaggcatgtatctgttttgttttaagaaagcaaattcccgggtgtgggtcagtgtagccctctctctgtgaggatgacagttttctgaagtgacgacttgctccagcagccactccactccagagggctgagcttcaagctgccacttggatgcatgtctgtgtagccagaaaacaaatgtacacttttactaaatgttgtgttccttttactcaagatcacctaattctaaatatattttttacaaaaaaaaattcagaatattagactatttaaaaattagttatccttaatgaatataaaggttaataaaattatttctcaatagagcaagctgtaaaaaaggaattccgttccccaatctagcagtcacaaattctgcactttaggctgttagtttttaaaatgccacacattcataaagttgtgttttgctacacatgccaaaatattacacagtagctgtgatatgacaccaaccggacaaatttaaaatttgtggaaccctgaagaattacatttcttcttggattatcttattgctgatttcatttgcagctgtaacctaatttttacaatgttaagtgggcctaccttcaactcacatagttacttttgcttcttgataatatgatcataaaaccgaatttgaaagacttccttttgtgatctgtgtatctgtatggagggatgttttctcaatccctgaatcagaggtggcaacagacaagggtagtgaagattaggactcaatagaatggggtcctaggtcactctgtcccaacaggacatgccaatcatttatccatccactctcttcttcaacacagaaatagcaatcacagaccatgatgacatcttccatttgaatggcattttacattttcttatttttaaagagagaagaataagagtattaggcaaggaaaagactaacgatggcattctttcaagccgtgattaatatgcatggtctgtagatgtatattaacacacacagatcatggatttaaatgactttatagtaaagccacagtaggactgtgcctccccacaagacaatggtgcccagtgagagctgcagcctatgcagatctgggaagctgtggctgtggagaggtcgagtggtcctcccaccactaggagagaggtagtttaggcaggaccttggagtccaagccagctcatgcttagagataggattcagcttcaactggagatggaaacatttagccagttcatcctactcagtgtttgcggcatgaccctagaattctaccatgtgcaaccctaccaaaaacatgccttggtgcaggcagaagggccatctggatcccatctcctcatacaaaggtgcaggtcacaaagcctcctgcccgctctgcttgggctggctctgagactcacagctatctatctagagactcacagctatctgatggtaaggaagtttacacttgcaaaggctcaggaaggagaggttgtgagattgatttggggaatttagcaacttggtctctggtcaaactactactctctcaggggctgtgcggtcagggcgaaggttttgggagccaggagtacaggttgggagtcaaaggccatcatgtttaggaggctcactgttgctgcagcagacactgacaccagacctcccttgacctagagagaatgtgggacttgtccccattgggctctggggcagcctcagctcagggcagtccagagcagcccaaaccaggagtgcgaggtatgttcacaacctccagagacaggcccaggggtgctctgtgcctctgctgaggttattccctatccttaaaaggccctaacctcttatcttcctctgaaaaaccaccgtcatttcctcccctaaagtgctctccaaatttcgtgtctgtcctttgcacttccagaatgctttgcccatatatctgttatagttttttttatttttttatcacactgataatatgtgagactacaacgtgtctctgtacaccacctggccgtggtcaaggggggtgatgtacatatctctctagccccaacacataacctaaaacatagtggatgttcagtacatatgagatggatggacggacggatggatgagaagctgaggtttaatgtctgagtgtgtcatccaaatcaaagttcactggctgtttttagagtttaagaagatggattaaatgtctagacccatgtcagaaaggatccatgtactggtacaaatgaatgacgatgggacatgctctccagtgggcagactcaggctcagcagtgagacaaatacccttaaaatcttcagatctgtgaacagcacgtgtttctatcttgttgtcatggagcattgttcagttaaaaaccgaaagtcaaacggaataaataaatgtgccgcaggagattaggcacaaaagggcaatcgaaaatatacagtgtggtctatttaaaacaggtcccagttggtgatatagaagactttaaatagggcctctttaaaacaggtgaacctaaattaatccagtgtaagaactggaacctctcatcttccattacatggagaaagaataactgaaatctgcccagagttatcaatcattcattcagtcaggtatcttttgaacacctcctaagtgtacaatatagtccctgctttgctgaggatgtaaagaaattggaaatgtggacatgaaagaggaagagtttgctaagtgggagggggagggagcaggtgctcctcatggcaggaagggagggggcagaacagtcctggtgtggaggcaggaacgagcatggggcccatattcggaggtcttggggagtttctattgcattccgtcttaccagataattattctcttcctaccgttcctatgtgggttactggagctgataacattctctatgtttacagccactgatattttctctatgatgacatatgtttcaagtatagaaaaatgtatatgcaaacacatttgggcatctatttaaacaaggaaacagtacaggggctgctagattcaaattccaggagttgtacagaacattttattgagtagggaatcacacgcagtgtaccgagtaacaacatttaccaaatgaaaccaaggtctcttaatgttcccaaatctttgattctctaatacaataaatatattgctactcaaacattcttttagccctgacatctttaacttgcattgggaattctttgaagttgagttttcctcaggacatattatatccataaattagatttttttcataatcctctctggccttttctagctcatcaagggcactgaaagggatagaaacgatgactgtgcagtcagatatctgttttcaaatggaaaatggcgagaatactaaagagatctaccccagcttagaaacacacagaaagaaatttcaacaaccaaaaaccacctcccttcagatgttactatctacatgacaatcaacaatccaatacactgcaggttggtgtccaagcccaggcccttggaggctgcagccctcccaaggaccccattaggataagggccaacaaggctgcccccaggggctgtgtggcctccacactcttacactcttacatgcatagttgaatcttcatctcgaatgaaccgcttaggcttaggcaccctctcatatttccattggtgatgctgtcacaagggaatttcattttatactttccagcctaagagatttggtacaaaaaagatatgccgccaaaataaaaagatgggggaggaaaagaacatctcccacgtccctatgacgccaaggctttgctcagaatttatttaagtctgggtttaaataccattcttggctttttctttggtgtaatatttgtatttgcctgactctcctctccattgaagtatccctattttagctgtttttattcacataatttccatcaggataggcatgatatgcaaagtacttaacaggtagggagtgcatgggcaccaactgagcagaactaattgccaccctgggctggggcagagcctgagatactcccttgttgcactgggtgtgatcccttgagtagctgggtcttgtggaggtgaatggggtctcaggagagggacctaggcacggggttggaggagggcactgaggacttaaggccatagctacttaccaatagcagataattggcaacatggaagtatttcaatattttaacaacctatatggacatactaaggcacactaacaccaacctgctgaatatcactcccattaaaatctacccttaaatttcattcctaaatttgacttttaaaatttccttcccaggaacctcacaggaagaactacttcattaaaattctcagctttacttccataaaataaaattggtcctaggattgacttggaattttggttttcaccattatgattttcctcattagacaattcagcttcatgataatggatttgaatctcatggtttccactttgatccctgttcagtattattctaagaaatccaggaatcgtactcttattccttctttcatttaatgtacaaacacctttttactttatcagttctttgggcttaatcctgtctagtaagtttacagaaacaagaaagaaagagaaaaaagcctgcagtttcagtaacagttgccagacattctctcccaatacttgtgaagcaaggctcaaggagaaagctaaaaaactgagaacaacaacaaaaatcacccaaaagtagctacagtgtagaagcttcttttaaaaaaaaattcactaacttgaatattttctctaactgcaaaaaatgttggtttattctgaacccattcaaagatatgagaaagttacctcttgttacatgaatctgatccttgtcaggtatattctcaaaagaggaaatcagcattttatccagatatatttggaaccaaagtggtataaaccaagctctgaatacagaaagaacaggaagaagttgatgctggtcagtgggtgggtggcactggagaagggcagtaacacttgacattaattatacattgccccatccgatcctagtcagggtatttgccaagaagttcttacattcctgtggccagggaacagggccacactagagtttcgtggaaaacaacagtgcattataaaacatttaaatcattccaactccctacaatgactaaatgatttgacaaaattattttatcgaatggaagcctactttcatgaaagtaatcacattttcatcttaaggatttttttcaaaaagaactttcctatattcatttttctttaacaactaacggctgctgttttggtgttaacttgccaaggtttttatattactaaggtaaatgcagagacataatttgaaaaagaataataacatttaaagggtgctcctactttgagagtgtatagtcacagaagagaagccaagaaaccaagctcctcttctaacatgaagaataaattcctagtgaatacagataatatgaactatttcagataggctttattattagatttgcaccaaaaaagccatatttttccagtctatagaaatagcctttgagaatacattttccatatagaaatcagaaacccctaaatacattctgagagccatcttgaatgtccaaactttttaaaaggggaactttaaatagttggaagcactctggtttctggagctgcatttttacccttcaccctgtcaggaaggggggcctcctgtgtgaagtcgcctctcgttaaggtgatcccctccgcgaagacctcaaccagcagccctaccatgtgcagagctcccactgaaatcaaaacccaacctcaagctcacgcagctccgcctccacatatcgtcacatcccacacatgctgctgtcatcacacccacgctgttgtcacaacacccaacgggctgttactaagggccctggtatgctgctgaatatatgcattcaataggaattttcaaaacatatttcaggaatacttgtccttggttccgcatcatctgctcaatgcagccactgtctctggaaggagcaactcctatcgggcacggctcctttgactcttggggcctcctgcgtccccagccccagccgtgaatacacaatggagatcagaggaatgctgcaggaggaatctagggcagtgcttaattggatcattccccttctattagaccattcatataggtcagcacatctcacttcaccctctccctctactcagcagtggctgccaacccaagctcagatgcaattcaagttatgtatctgtatcttcttaagattcccagggtcttagcctgaggtacctgacaagttatgtttctggcaaaacattccttctagcctcttcgatgctacggaatagctgtggtctctatatttaatcaaacaaaaactagaagaaaatgggggcaggagggcattgttgttgttttgactaaagtggtttgggcaaggtcatctgttccaggttagaagagagacattatttgacagacagcacaaattactgattcaatacttgggggctcttaattcttgttaaacatgtatggtgaattactacaggggacgagagaggttttgaacaagtttaaacacatttgacgacatctagcttaaaaactccttgtcacctttcctggaaattgatgtgagtacccaacagaggtaaaggatggctaaataattattacattggccttttgaggaaaatgcctaagtggcagggatgacttgttctctgctaaggctctgagtactcttagatccatggtcttctagacttgagctgtcttgtgcattctctagttgctttggaggtctccattttggtgacaacagaggcattatcagttgcttctggaatgacagccataattatttagtgccagacactatacacagctttatttttatatatattcttcaaaccaaagtcacaaggagctctaagattgtcctaacattatcttatggtaggttggtcacatccttcagatttctcatacgcttctgagagcaattcattccaatggtttagccattgacacaagaaccagcttaagaccgagagcctgaactgtagctctgagcttctgtttctggggtgtgcctgctcctctcctctctccacactattttccttctttcagttgagttcacccaacatacattgggtaactgtgtgccaagttctttcgaatgtattgggtagtgggtggtgatacaggctgtagagtcagaccaacctggcctgaaacctggctaggagacttaggggaagttactttacccctctaagtctcagtttcttcaatgactatcctcaaatgagacaatgcacacaaagtatttagcagagtgcttggcacacaggagatgtgcaggacataatatctctcactattacacagatatacacgacagatcaaaaacagctcatgagctagtgggaaggaaaacactacaggccatctgagtatttcctagtaagggctagtttcaaaggagtaataattattccagccttagtaagtgggtaggtggaagatggggctcagaggagtaatacaggaaatgatacctgagctatgctttattggataagcagtggaagccatcctctgtggtttgaaagacaatcataaaccttgtagagtcataagtaacatggcaaatatgaggtgactttggaagctccacaccatttcttctatgtattaaatgcacatgctaaggagaggataccacttgcatcatgtcatgctggtggcagcaaagaggccaacagagagcacaagcacaagcacggcagcaagtaggaggaggatggagactgtgtaggagggagagaatgaggtggggagaagcagaagccaggcaggaacgcaaccgcgggctttcaccaatctgtggaatgtaggggaactcaaactcagagcctgcagggatggaactggacagtccccaagaactctgcacttgggactctgcccagccgtgtggccacacccagggccccagctgtctggttctcagcagctctgcccaggctcttcacctttgtcaatccgatcttcctgcttctttgtctgctttgattacctaagccatgcctgccacatcaccccatccctccatcttttctcttattatcccccatatagaatgactttttgttcacatctatcggtaaaaaaatttcacctattttatttttatttacttatttatttgtttttttgaggcagagttttgcttttgtcacctaggatggactgcagtggcatgatcttggatcattgcaacctccacctcctgggttcaagcaattctcctgcctcagcttcctgagtagctgggattacaggtgcctgccaccacgcccagctaatttttgtatttttttttctttttttttaatagagacagggttttcccatgttggcatgttggccaggctggtcttgaactcctgacctcagaagatccacccgccttggcctcccaaagtgctgggattaaaggtgtgagccaccacacctggcctattttatttttttgacagggtctcgctctgtcacccaggctggactttagtggcatgatcatggcccactgcaacctccccctcctgagctcaagctgttctcccacctcagccctccaagtagctgggaccacagacatgcactactatgcccagctaatttttgtattttttttatagagaaagggtctccccatgttgcccaggatggtcttgaactcctgggctcaagcaatcctcctgccaggcctcccaaggtgctgggattacaggcgcgaaccaccacagctggccaataaaacattataaacctaaaaaatatgtaaaagattttccttattcctgctgcatctatgcacttcaagccttgcctatattgtgatatgccaaaatatgtgttagtcaaatttaatgtctttatgatatctagtattaaaaaaagacaacttctttgagtgcctttagagtatacacagcaaagactatgggattccagagggtgtagccaatgatggtgaagaaaccttctctgaacatgtttttgcagaataatgacttctttgaaggcagtcatatgaagaagcaatgggaaagccccttcttcttccttccaggatgcctgcctgccggcctctccacttgcacttcctgaggcacagtggagaagcagaatctggtagacttgggtttgacccctggctgtgtgatcatggacaaattatttagtagttatgatgcttactagaaagtgacaagatgaacactgtccagttttatctgactttgtaccttcaatgcagtatgctggtctttaggaatgaaaatggccatagaccttgtgcatggcaacatgcatgtgctggacttttgctggtctatttttactttcttttgacctgcctcgaactgatgaaatacaaattaaaaacacttttataacaatgttgtccagaaaaactgtattccccatatctacttcatttcctatgtgccagttctggagagtaaatatggtttctgtatgaatttctgagtacttgttcataaaggatactgcttcataagaaagactacagaaaaataaatcactgtaatgattacagaagctggtgttactaatgttcacagttcaggttgctaagtttttctaagtgctcaaggccttagtctgatgctctttgctttaggtttaccgactgatgtgcaatccaacatttggacccttacttttatgagaagcatgttcagaaaaagaaatcaaggtatatgtacttcatttggggaggaggctttcaaacaggaaatttcctctgttccttgtttatctcatatctggaatgaataaatttcatttttgtaaaatgatttctgctgagtggcaaccacgaggatattcatgaactgtggtatgcaggacgagataaggacagtaccttatgtctcctggaactgactttgagggatctttcattttctccttccacacagatttgctcaccttgtgtgtactgagaaggaagtggggttggtggctacaaaagacttcaaagtggtgttaatacatcataattcttctcactgaaggccagatttattaggaaacatctttagtacacctattttttccttttggtaaagaatttggatttcgagacaacagtttacaatgggcctgataatctagcaatttctagcttttgaataaacttttccgggatattgcctgaagtaaagggccctgttttttgtttgttttggatttgtctttttgcacacagctcctaagaaacaggctggcagatagatcaagcagaacccagttttgagaggctacccaatcttctaagctcacgtcaagctagcaaattggttctcagaagtctccattttccctcagaattgtctctgaatgaaggtccttgcggctgcttactgttcttttagagggtgacacctattctctattctccttcactttgaatatcatttttcaagctttctgagaagcgctgttacacttctatgaagagactccaactgccaatcttgaaatattctttgaaaccagtaacaccaggtgctctgtccaagaagcaaaggaggcagctccatataatagacaatgcaacatttgttcacaggcagcattggatttaaatacgcacacacagaaatgcacacgtgcatgtgtgcacgcgcacacacacacacacacacacacactgcagccttaatagctcaatgtttctcttgaaacactccaagggtttcaggaaatgcaaggaaactttcaaaaacaaagtgtaaaaaaaaggaaacagaataatcaaaggaaagattataaaaggaatccaaattgaatatagcttgtaataacatgcttaacagaaaggaagttgggaggttagatgaagttatatcaccaacctgcaaataaaaacgatctctttcagagtgattaaagatctactctttgtaagcaatttcagaggcatggatttgttttgtgatatcatattaagaagatacagctaaaatgaggtcattgcccaatggaggatgccaccattttctcagcataatttatgtatgaaaccaaaaaacttataagaataaacagcaacatgattctctgtactcttgctgagaaaatacttaatttcgttttgagtttttagacagtcttgcttatcaaagagcagaaaaatgcaaaggagagaagtcaggtgaaagagaaatgagcccaccccggcccacactgacagctgagctgggcccctcaatttcccggccacggaggcagtgtggccaaatagcactggggtgtcctcttcagtgctcaagagtcatttccatttcttttgggtgcctattttgtgttttctagcacacgcaataatatcgtagtaagtatttaatggcattttttaccacagttcctttacaatatcctagaatatagcccattgtccttaatttctatatttaataggaatgtttttgactagaaaatatgttatactcactttctttgttagtagaggtattagaatgcctcacgtattactgtatttcttaattatgtcttcaaactaattatctctttctaactaggcttgggtggctgcatataattttttgtttgggatgtttaacttccctctttgcttttataggagagtgtttttaacctctttctgctccttttttgagtttgttgtgactgatgctgaacaccaatcattctgtgtctgcatcactggcttgcttggttggaatccttttaactgtgtgtgctcactggcgtgtgcatatgcattgcttgattagaccatacaggacttggtgtccccttcccttgttgtctttcattctattgcagcctatttctcacccctgtcttcatttatttatttacttattttgagatggagtcttgctctgttgcccaggctggagtgcaggtgcagtgatctgatctcagctagctgcaacctctgcctcctgggttcaagcgtttctcctgtctcaacctcccgagtacctgggattacaggcgcacgccaccacgcccagctaatttttgtatttttagtagagacagggtttcgccatgttggctcacccctgttttcaaaggcagtgtatactggtgtagggtcatgcccagatgctctcatcttaaactcttgactaattcatcgaacacaagaaatgcattcttgcattttaggatagcacacttgtagacctcacaaatgtaaatggaaacccatacattacattcctttaagccaaaataccatggttcaatcttagaactggttttctgggttttagactcatggagttacccatgcatctttattattttcaggttctattcatttttaatgtggctagaaactggagttctgtgtctttaaaaaaaataatccctggtgtttgtaataaaattcctctagaggagaggtgaaagggcttgagcaacgcctttctaccctctggcttattagagaggatgaaggtttctaggcaggatgaaagaaataatccaggaaggaagccaggaagaaaaagggggtggaggtaaacttaagccagtgtcaagaggttggcgaatggaagaatgtgacacagaagagggggaaaggagaagccactctgataaatctcaccatccttccttaaaggcctgtttcaaaggcctcttgccatggagttgccctggcctttcccactctctcactctcccacctcatgtcagcctccactggaatcccagaacgttttatctacatctcccttacagccctcatcaacttctactttgtgctgtggatatttatgtgacttcctgtaagccctccactgactcgccatttaataaaccattattgagcacctctctgggtgccgggcgctttgctagatgccagggatacacagacggttgtggcaccgcctcagctctcaggagcctcccagtcttggcatggctctggtctaccaggcccaccatccattgtgcccaccatggcctgttagtgcagtctcccctgcctgaaatggccttcctctccttttctcgtttgtctttcaaggccttagacataaactgttcaggaagttttttgggaaatgttgagttcctatagaatatgcacacacctctttcagcacttcccataagttgacatcttccatttacaagtctatctctgccactggactcagggcagaagtctcactttttaatctttgattctccaacttcaagagctatgcctgttctatggtagatagccactaaatattagttgagttaataattgattagttcttctcggccgggcgcagtggctcacgcctgtaatcccagcactttgggaggccaaggcaggtggatcacgaggttagaagatcaagaccatcctggctaacacgatgaaaccccgtctctactaaaaatacaaaaaattagccgggcatggtggcgggcgcctgtagtcccagctacgtgggaggctgaggcaggagaatggcgtgaacccgggaggaggagcttgcagtgagccgagatcgcgccactgcactccagcctgggagacagcgagactctgtctcaaataaataaataaataatttaaaaaaattgattagttcttctcacactgtccctctaaggtggggtgggaaagatatcatttgtccccttttacagctaggaaaacaaaggggcagagagcatcaataacttgcctccaaatttaaatgatggtagagccagacaagaagccgtgtctgctctattctccaggctaaacagatctggtattagaaaaaggtgtacctgtttcccctgtgtccttttacaaaccactgctcaatgaaataaaagaggatacaaacaaatggaagaacattccatgctcatggataggaagaatcaatatcatgaaaatggccatactgcccaagataatttatagattcaatgccatccccatcaagctaccaatgactttcttcacagaattggaaaaaactactttaaagttcatatgcaaccaaaaaagagcccacattgccaagtcaatcctaagccaaaagaacaaagctggaggcatcacgtgctacctgacttcaaactatactacaaggctacagtaaccaaaacagcatggtactggtaccaaaacagagatatagaccaatggaacagaacagagccctcagaaataataccacacatctatactatctgatctttgacaaacctgacaaaaacaagaaatggggaaaggattccctattcaacaaatggtgctgggaaaactggctagccttatgtagaaagctgaaactggatcccttccttacaccttatacaaaaattaactcaagatggattaaagacttaaatgatagactaaaaccataaaaaccctagaagaaaacctaggcaataccgttcaggacataggcataggcaaggacttcatgtctaaaacaccaaaagcgatggcaacaaaagccaaaattgacaaatgggatctaattaaactaaagagcttctgcacagcaaaagaaactaccatcagagtgaacaggcaacctacagaatgggagaaaatttttgcaatctactcatctgacaaagggctaatatccagaatctacaaagaactcaaacaaatttacaagaaaaaacaaataaccccatcaaaaagtgggcgaaggatatgaacagacacttctcaaaagaagacatttatgcagccaacagacatatgaaaaaatgctcatcatcactggccatcagagaaatgcaaatcaaaaccacaatgagataccaccacacaccagttagaatggcaatcattaaaaagtcaggaaacgacaggtgctggagaggatgtggagaaataggaacacttttacaccgttggtgggactgtaaactagttcaaccattgtggaagacagtatggcgattcctcagggatctagaactagaaataacatttgacccagccatcccattactgagtatatacccaaaggattataaatcatgctgctataaagacacatgcacacgtatgtttattgtggcactattcacaatagcaaagacttggaaccaacccaaatgtccaacaatgatagactggattaagaaaatgtggcacacatacaccatggaatactatgcagccataaaaaaggatgagttcatgtcctttgtagggacatagatgaagctagaaactgtcattctcagcaaactatcacaaggacaaaaaatcaaacaccgcatgttctcactcataggtgggaattgaacaatgagaacacttggacacaggaaggggaacatcacacaccagggcctgttgtggggttgggggagtggggagggatagcattaggagatatacctaatgtaaaggacgagttaatgggtgcagcacaccaacatggcatatgtatacatatgtaacaaagctgcacgttgtgcacctgtaccctagaacttaaagtataataaaatatatatatatatttaaaaaaaaaaaaagaaagtgtgtctggatggagactgagtagaaggactgagtaaggagacgggacagatgtggtaggaggcctattcggcaaaagagaggtcactgaatcacaaccacttcttgttgtctctaaagaagacaggttgggggttaatgctgctgcgtggattctatccacggtcagttcgagaaaggaaaagaatatgggtgagaaaaacaagggtgaaaagcagattaacaagtggctgctactggataagaactcacaaaaaaatatccagacagagggcacctggggagaatcagattaaacctcgaattagagcgaggttgtttgacaaacaacactgtgacccaggaaatatgggaaaccgctgagcagatttatgagtgagtttctaattgatgtggcttttaaatgtgcagatatatttttgtttttatataagggtaaacaaaaggcagcacaagcagtgggaggggcctgactgatccatctgaagcgagaagccctggatttaggtctctcaaaatgtacaggctctgtgacttgggcaagtgactcagcttctctgaaccttagtttctttttaaacagtgggtaaaggtgatgcttttgcagggatgtggtgaggatcaactcttctttacactagtgaattcgcatttgtttttcaaatgattacattcagggttggattaggttgttggccagctttctcagaggcttctaggcagatgtgtcttcatgtctccttgggaaggcttcagtcgtgtggctatccctgactgcaagggagtctgggaaaaagatccccagttttgcttttcctttggtttggcttctataaagggaagaatttaaggcagaagagaattaggaaaagctttagattagtcaacataggctataatacccaatacagggtagcaacagcacatgtgtatctgcacagaagaaagggattatgagactaataaagcaaagtcgtaggctggggaaggtgaatctaattaaatagtaaattaaaagtagtagaggccaggcgcagcagctctcgcctgtaatcccaacaatttgggaggcctagatgggaggattgcttgaagccaggagttcaagaccagcctgggcaacacagcgagatcctgtctctacaaaaaaaatttttttttaaattagctgggtgtggtggtgtgtgcctgtaatcccagctacactggagactgaagtgggaggattgcctaagtccagaagcttgtggctgcaatgagctatgattgcaccactgtactccagcctgggcagcagagtgagatcctgcctctaaaaaaaaaatttttttttaaataatagagatagtggcatgaagagcccagtaagaaattactgaagcagtgccaccactagtttctaggaaaaataacacataggcatgtttcctgcaaaactgagtagagattgagttactttttcagggtctccctttttcatcatctgacattaccatttgctttttatgtcttctctttaacctccactcccctccccaactcctaatagtttttagttcctctaaatcagtactccctaatgctactttatagtgaactcgattttccaaggtttttttcctctttctttcccccaataactcaactgtcttatatttaattttctgacattctaattctctctttttttttttttttttgagacagagtctcactctgttgcccaggctgcagtgccatggcacaatcagggctcactgcagccttgacctcccaggctcaagcaatcctccagccttggcctcccaggtagccaggactacaggcacacactaatatgcctggctaatttatttttttatttttattttttttttagtaaagatggcgttttactatgttgcccaggctggtcttaaactcctggactcaagtgatctgcctacctaggcctcccaaagtgctgggattacaggcatgaactactgtgctcggcctcatattataattcttgattcctccttctgtaattaaaaaaaaaaaaaaggctgggcatggtggctcacgcctgtaatcccaacactttgggaggccgaggtgggtaaatcacccgaggtcaggagtttgagaacagcctggccaatgtggtggaaccctgtctctactaaaaatacaaaattagccgggcatgatggcaggtgcctgtaatcctagctacttgggaggctgaggcaggagaatcgtttgagcctgggaggcggaggttgtagtgagctgagattgcgtcactgcactcccgcctgggcaacaagggcgagactccaactaaaaaaaaaaaaaaaaaaaagagagaagaaggagaaggagaaggagaagaaagaaattcacgttaagacgtaggtaggttagcactctcttgtaatacttgcatttaagtagggagcattgtacgacagaaccagtggaagagggactttcagatcccttgaaatttgtcagatattacatacctacgttgtttgagctaaatgctaacactattaacaaaacccaggagtggaggtgcaggaagggaatgcagaatggattcgcctttcatcagtgtgtggtgtgataggacagggcggtagtgtactagaattgggtggagagggacaaatctgtcaaaacatgagaagaaaaactgatgtgctaagaagagatgacattacgtttaaaataaggcttcatgaaaagctatacagttgggtaacacccaatcaaaatagtgccgctaatggactaatgatgagcatggagatataactgtgaattatacatggtaactgagggaggggagtgggtgtagagagaacagaactggggaaggatatataaagggaaagtgaaaagttggccccacatacaccaggccaaagttacagaaaatgcctttgctttgcttattcttcagtaaaatacattatttttttctcctgggtgttcaactgtaagtgtgcactattagaaaaccatcaataaaaaaattgataaacgagggaataattacttaaaatataaaataattaccagctttacaaaagaattctcttcaaggcttaagtgccatttaaaataatgttcaacatgccaaagaaattttttttttgcatatagtacaaacttcaaagaattctgtttcataaagtaaggatggctcatataatagagagataaaagttgcagtggatttggttcagcattaaaaaaacaaaaaacatacactgctaatagataaaggagacagagaaacacaacccaccttcggctgtattaaggggtcattttatatgttgtgccagtaagctcctgtttcaccaagaagaattcattaagtgagagcaagtcaatgaaaatgagctttattaaaaaagaactgatgtaattaaaggtattggtgaaaactagctcagttatgaaggggaaatgactcagcagcaaatttaagaaatgaaaccatatacattagaatcttttcccagttttaagttatttcagaaaaaaatataacactccacacaatagccaaggtgcacgccagcatgaaggaggaagaagtgcttatataaaactgtcattcttcacatactagtgaattatagcattcatatgctggcaggccgagcagtcaatgaggagagtaagaaagcctgagactcaggctgacccggcttcagatgggcagtggtgactttcatcagtgctgttctacatggtacagtctaaatgagaatacgtgacctctgaaatactcaagagctgtatactggggaaaatacgcctaagactcttggagcatcccagatccaataatatttctgtcaaaaaaatgtataggtaagtcgaatgatagaatatccacagcagaatggctgtgcaatacggttttgaaaaagaatcatcctatccaagtttatgtggtcttagtcacatggcctgaatatgggacaaaaatccacacgcctcaagtccaagcaatgtgcacactgggcgtttttgcagacctcagatatatggatatgcgatgaagccagagggctgtgtgaggactggcaccttcttccccgggaagccctcagcttagtgttgtcttgtgatctgaacattggcctggaaggagagagaaacggccagaggcttggatttgccagtgatgccacatgacaagccactgcctagtctaacacctcctaatacagcaccatcacaaggattaagtgctcactagctaaaaaataaaattaaaaggtggatctgaaggtgctttgagtattagaacacttagacccacctcaccctcatgccaaggatggcaggcagaaagcgggaggagtgaagaggaacattgtgagaaaaaaggagatggaagaaggttggaaatttccagctacaaaataataaataacccatagtagactaagttccaagtgggtggcgctttgcaaatgagaatgtcatgttttcatacactctgtgatccacataacctttttgcccacctcagagagttgctaagaccaaccaatgaaatattgtctgcaagagtggtttttgaactacaaatcccttaataatttgctgtggtatgtggtctaaatggttaaaaaacaaaacaaaacaaaacaaaaaaacaaaaaaacccacaaaacctgggaagcttgaagaggaatacctgaaaatggttaggcctttagcaagtccctggagtctgcaggcattttcttcttgaaatgtctgccagcatgcgttggaactgaatattctggggtaataaaagggatatttcaccttataaaatgcaaataaaagttgagtgatcaagtttgggggatgggttacttcatgatctaattactgttgacttattgtgatatgtaaggaaagagcgctagaaaaagtctcagtgcatctgaaactttatcttacctaaagaataaaaagaccttcaacactttctactcacaatccgctgctctattaacaaacaaaagcaaaaccaaagcccaccactttctatctctgagcattgttatggttgggtgtctcatggctttgttccatcactcctcaggtagaggaggtgtattctgttcatcttaatgggtgtgtcttttaggggaggaagaaaaaaaaaagtaggctggtttgaatttaagttaatccctgccttctgatatttatacagcttatttttatttaatgttccaacagacaagtagcctatatgccaaagtagcagaaaaggcaacatttaaaaaatgggccagtctcctcaatagaattgggtacacacgttcaccaaaagataaaaataacagtgtacgtcacaatattattcaacatagctaaaatctagaaaggttacataaattatgagacagccacataactgaatattatacaggcatgagaagaataacctgtgactataaacagatacaatattgagtgaaagaaacagaaaacagattcaagattgagtcaccaaagagtatttacagtaagatttcacttacgcaaagtacaaaaacaaacacaactaaattatgttgttgggagacagaacagtggtgacctttggggagagggtgtgactggaaggggatcatggggtgggggcttctgggaggctagcgtgtctcctgagcaggatactgattacacaggtgtgttcagtttatgaaaatacattaaatgtacactgatgtacacttttctgcagtatattgtatttcagtgagaagtttttcaaaaaaaatggagcagccttctaagttggcaggattcagttagacttgctttgacgtgtgctctgaggccatctgttctcaaaccccctgttcccacagatcaggatgcagctgaggcacagaagcttgatttgcttcgaggctttgcagctgagacccggaacatatgaatgagtattttactcttactgtaaatcattgagtcagtaaatagatctataaattcagtggatgctattttagtaatatggattttgttccatttttgagatgtcttaaaaaccttagagatttcacatctcctgtacgaaagaaatcatctataaaaacggtctattgaatttatttaagtcaacaaaggattttcttactgatatgtgatcagggtctcatttaatactaatttagaaggtccctttggaaacaatcatgctatgattttaactccctcattttgtgggtcaggaatctgatacccaaagaggttaaatgatatgcgtatggccatgcaaatattccaaagcagaatatggactagaattcaggttccctaactgctaaaccaatttacttttcattctagctttctggcttccacattattgttgattcacagaattatgaacaactaaaaacagatgatataaaattgacaatgtaatgacactaaatgtttacttcattgtgacagtcatattttctaaagagcagggccaataaattacgtggccctgagtaattactggtttttagaaattagctaacaccagtttagaaattaatatgttaacagtacttgaaaaaaatggaatactcttatattggaaatgattgttaccaatgggagcgatatgggcacctttattttcttattcaagaacataccttgtcagaggagcacgaatgacctcagagcacccagaacagaatttatcaggcccttctacacacctctgaggacatttagctgagatgaatctggtgttattatggaagttcttgccttaagaacatttggattatttttatcttatgatgctctttcaaggactatttacttgctgtgggtcatttctatttgtaaatggtaatagtcacctgaaattgaaactgtatttacccatgtccattctgtttccaagaatctagattgctctaactcacttgctatagaacaaaagaagttcattatttttcaactgccttactttctgtattatgggtaatgtactatgactttgtattatgacccttatcagattaaaaatatatgtttccttgatcacagctgtataacatttatggtctgattcagtacacttctaagaataggaaatgcaagattaaactaggctttaaaaacaaccattgatgaaaatgaattaacaacgtaaatatcgaggcagacgttagtatcttaccgcattctcatcctaaggccctcagatcactggggggtgtagattgtactttcctctcaaatctgaggaaatggttacatctttcatggcatttatacccacagatgacttgctggccaaaggcccagtggacacatggagacaaacgctcgtgagagcagccagactaagaagtggcttctaggtaccatagaaatgtcagcatagtgagaatattgcatatataccatcccagttctaattaacaactgcaggggcataatgtgaagttaattcattcaacaagtattactgagcacctactctggcaactggagctcaaatgagataatccacgtgaacagcaggataacacttcctgtgacactgaagaactggaagaattaaccgggtaggtgggggtggagtggaagagagtagtgccacctggggacactaagaggttcaggagagtggagccatcagacgggaggggaagagttggggctacagagatgagcaggtggcagagcatggacagacccatcattcttgttacagaggttggttttgatcctttggacagcaagaattctaaaaagcaatgctttacacaccgtaggatctcatctattagttagctctgaaataactttcatggggtccaaccagcactactttttcaacaaaagagatcaaaatagaataggatagaaaaggacagaaaacataaaacttgttcacatatatatattgatatgagtattgggtcatgatgttaaattcattttttattgtgagtcacagtccagaaagtttgaaggtcacttctttgaaagcatttaagcagaggaatgatatgaacagccttgtgcttcagaaaatcaatttggctgctgtgcagaaaggactggcggcaggcctgagtacaggaagaacagttgccatagtcaggctaaagaggacaatgctaactgagggcagggccagtagacggacagaagttctacagagggataccaggagggatacactgaggaggacaagatttagctgaggaaggtgtccaaaatgcaacctggactgtctaggtttctgcattaggcaattgggtgggtcttgctgcccttctttgtggcaagtaaggaatgccagagcaaaagcagttttagggacagaagaagattattaggttgagacatgttgagataaaaagttgaaaacatggagaataagtacaattttgataactttatagaaacaaattcattatactgctctacaaaccaatcatgatcaagtgtctattgtctgacacactgaagtgtgatactaatgttagaaatatatatatgtatatatatatatttttttttgtagtaagaaaatgcagtaagtacagaagggatttgcaagtgctcacaatttggggacaagtttttataaagatcttttaaagcaaatgcaagaacacttacagataagggctataaagattaaagataaagtatatgagcatgtacaggggtgtccaatcttttggcttccctgggccacattggaagaattaagaattatcttgggccacacataaaatacactaacactaacgataactgatgagctaaaaaaaaaaaaaaaaaaaaaatcgaaaaaaaaatatctcaaaatgttttaagaaagttgatgagtttgttttgggctgcattcaaacctgtcctgggctgcatgtggcccatgggcagcaggttggacaagtctgatctagcacaatacctgacgcagagtagatgctctaaaaatagttttttttttcccctccacttttttataccttgtcattaagtctcaagatgcagcaatgcaaactatttacataagtatatttcaagtcacttgatagctagagttagcaaatgatgctctgattcacaaaacggtttatgttctttgttttacaagggctgccaagaagttaatgggcaaattcatgatgcatctctagtaaatgtacagaaactcaatatatgcattttgcatatttcacctatcctatttttaagcctttttctcaattccttcaccccccaaaaatcattaagaattgtaaaaaatcactttaaatatttttctgaaataagccaaagcctatagacaggtgggtagatggataaatagattagatagacagatagatggttgaaactgacggatggctatattttaaattattaatcaaatatctacgactttgggtagctgaatcagttgcctgaaccttggtttcttttattaaaaatgtattacatatcataatgtagagagaaaagtataatgaacctccatgaacccatgccccagagtcaacaattatcaattcatggccaattctgtttcatctataccttcacccactcccccaacccctggattaatttaaagcaaattctaaccactacatcatttcattggcaaaatgtgttagtattaatctccaaagaacaaggactcataactacatcactgtcgtacctttaaaaagttagtaattccttaataccatcaaacatcagtgttcaaatttcccctactgtttcttcattttttaaataatttgtctgaattttagatactgattatttctgggtcaacttataaaacgatttctcagaaagttaaactgaggaccagaatagagctttcccaaggaaccttcccttcacggcatgagactgggattcctctagctgttcattcaaatcccctctctcttcctgctttctccctattctgcacacacacacacacacacacacacactctcatacaatgggggaaagctttaaaacttgtgctacatgttaggctgtatgaaaatgaatgtttaacattaaaataaaaatgataatacagtagaaaaaaataaacaagcacttaagaaaactagtcttaagaattatcaaatttttaattaatgacaactatcaaaactttgagcaggatatcttccaacaaagatacacttaaatatacgtgtgtgtgtgtgtgtgtgtgtgtgtgtagacctaaaaagaacactttactgtgcattttgaaataaaacatcctactccaaagtttctgaagttttatatccattatatctctcaaagtatcttcaggaacgtagacatattaaaatgaatcgcttcaggaaaaacaaaaaaaagcatcccacactgtcagatgcatctttccttctactgctcccgtcttcctactggtttccctgtctccagtctttccctccttggtgtcatctagatgacaccatctagatgacatagatgctagcaaagtttgttttctaaaacacagaaccaaaatctcatgtcttacttaaaagtcttccattgttcaccactgtctacagaatagagttcaaatttctaacagtggcagtcaaagactaatataatctacccccacccaattctccagtcttctatcccactgccctttccaccccaatatcctcaatgccctggctatgttggaatagtcccattccctgaacatgtcttccttatgcctctgtggttctgttcatgttgttctctctgagatacaatattccctatgtatccaatgtataataaatgtgagcttgcaatgaagagataaaggaataagacatgagcttttctctcaagaagctcacaacctcattacagacagagataagtaactttcaagagaggtgtgataagtacagacatattaagatgttctaggtttggtgacaacacgaagagggattttgctgtggacatgagactattagcatttggaaacacaatgtgcagaaaacacatggagaaaggagggtccaatggatgacttaaaatcccccaaaagtggacatgtcaaattaatatatagccacgggatggttatatccaagagataactgaaaatcatttgcagctgatcacaggtaatgcctgtgagagactgtaattgcaaactcaaatgtaatcagtttgcttcttttaagaagcctttgctatcaaataaacacgaaatatgtaggaaccaaactggaagtgcaggatggtaaagggaggctgagcaatctgacttacgcatgaagaaaatgaagcagttacttccaacaaagaatgaagcatactaaagtacacactcagagaaggaagaaattcaatgtgatactaacaaatcaagctggcttaaacttaagtgtgccatacttgctgccacattcactctgacatcgtttaaatcatgtaaatattttaaaattcttgtcataaaaagtataacacatataaaagaatacatatatgctgttttatttcaaactcacacatactacacacaagtattcatgtacccacctgccaggttaagaaatagaacattatcagtaccttggaagcccttagaatcctcctgtccaattgcctttcactctctccctctgagtgggaaccactgtcttgctttttgtattaatcattcctttacttttctttataacttcaccacacacatttttaccacctagaaaacacttggggttttagttttggaaccctgcacagccagcgcaaagccagagtctaaggaaagcacaacattgccattatagatggagggctgggagaaaagaaacagcaggggcctgcctcatctgcctcaggttctctgaaaagtcaaattgcacttgggaattctgatacatgccaaagtttgagagccactggctagggtcccttctagcttctgattctagaataagtatttggatcaaaataagccaaaaaaacaaaaaaacaaaaaaaaaaaacactttttttgagtgaaccaaactaaagcattctctagcgagaacgggctttctgcaaccccacatttatataatgttgctccaaccaaaggctaaattgttgtatgttagttatatactaataacaactatgcaaagaactaaaatgttttaaataggattgtatttcaaaaatatggggaaatattcattgctttgaatttttagctgtgattcttaaaggtaggaaatactgcttgttgaaacattataatgaattttcactacatgtaaccagtgagttttggggatgaatcacagttgagtatgactcaaaaattccctcctcttaaaacaactctatagggcagcgcttttgttttcctttaggtctagtacagtaggtgggccattttctgagtccagtttccctactgtgaagttagtctgtgtgtatatagtcttttgagtgctatcccacagaggtggggttctttttccttttatttgaatttacttttatacctggagagattcttttggctgcggctggtttatactgtttgagcgcctccgaggtgtggggccacacttggtgcttcacacctattatctcatctaatccccaccataaccctgctggataggtgttgcatgcctcattagagacaggtagagcactggcctgtgatcgcattgccaggagtctcttggtgagctggcagataaactccctgactccaactcctggagaattcccaccggggccaccatagctactggctacaacttcaaaaaaaataaagaataaagaaaacagaaagatttatgatcttaaaaaaaaactgtcttttttttagttgaaaaatttaatagacatttgcacatatgaacaaattggtttattttcaggtatctctaggtatgaaaggaatccaaaggaaggagaagaaatccttcgccttggcactttgcaaactgactacttgcaaacacacactctcatacgagcagtctatgccaaagaagctcttttaggagacagtaacagaagtgatctcagtattctgccctgcatttaacatagaccacttatttgtgttaaaatgtatttaagttttatttttaacagaagtcttttatttgggttacaagctatatatactattaagaaatttattttcatggtcagagaaattaagaattactaattgtgacagatattttaacatgtagcaataactgggggttatatttatagtttgttaattgattgaaaacactcaaaaataacacttcacaacttcatttgcaggatcatgttgagaaattaggaccagctactgtgtacttacaccaaggttcaggtgttaaagtacagatgctatttaaccaactgagatgacttaattggtggttttctctataaagaatggtaaacagagctcccatatctcttataatttccttgtatcagaaccaaaaataatatttaatatttgctttgcaccttacacaataaatttttaaaaagccccatacacatcagtggtcagcaaagaatgtgcaagcctatcacagactctggagggtggagttgctggactttttcctctggtctctagtagcataaaaatggagttacagaaaaagtgctttcaacatgctgataaaagattaaaaagaatcacttggcctgaaggaattttaacaacataacattaaggagaaaagaagctgtaaaataaaaccaaaaagcatgtccacaagaacttaaagaaatcaggggggaaaaaacctcacaaattgtctaggcagtcgtgagcaatcattgacttggtttgttataattttaaattaacttcccttaaaatatgtgatttatatgtgaccatttatatagctcttatctatgatttcaaaggtgatcagttcaaagcttaatgaattttcttgatattgaatttttcaacctttgaaatcttatatttcagtaatgtactattaccttaacatttaagcaaagctgcatgatctagagagaattcaatctcttctgatgattaaatttcagtaattgaacataaaaacatttggaacaagaaggactgtataaatgaactgtcagcatatattacaacattacaatgttgcttaggtaagaaaatgctccttgaagaagttggcacaacgagaagccaataggaaaaacagaggaagtaagctatcactgaaataatgagcaggaattccattaaggctccaggccaggtatgtgaaggaggtgtgattgatacgcaggacttggagattaactgtgtgggacttgctgaggccatgcctacatgcatctaacatagtgctatatttggtatcagactttgactgaagtggtgtttacagagtcactgctcttgctagttcttttcttttaaatgctaaggattttgtttcagccacagcgtcaggaagggagcattttcacgaggcaaagaaaaatatagtcatatccggagttagtctcacattaagatgcaattagtgttcacttttagtgtcaacaactatttaaaaagctacatttcatacaaacacagggatgacaatgaccatgaggtcatcaagtccctgtgttcctatcagtaggtccccttggatattgctaataaatgataagatttcagaagccaacataatgatatgatataaaaacaatgtcaaaaatttgatatttatgagtatggcagtatggaagaagacagtgttctgaggctgcttctagaattgctacagaggattggaatctagttcaagttaacgtaacatccttgaaaggttaaaagacaaaggttacttctgaatatattatttctatcgcaagtgactacataatggaatagaggtcagcttggtggatctggaaattcttagtctttaaaacattctttctggaatagaaatgaagccctggaaatcttgcagagtagaactcggctaatgaatggctttctatgatacgatttactatatagtgagggttaaataatgttctatcagattcacctattacttacaataaaaggatatttaaaaagtataacaaaaatatcttagtttgtaaggtggatatcagccttgcttaccaatacccaagttacataaaagggtcccattttcctgtttatggctcctgcttttccctagaagaaatgaccagcctgtgattcccagttctgccactagctcactgtaaaaccctgataaatcaatcactcggcactccatggcaatcacaaactcagatgtgagcacactagaggttagttcaaattacgtacaaaggtttctctaataaaataaggattgacaactggggccatgacagaagagaagtcactttaaggtatttaccttttccataccttattaattagttgacaattttacatcataattacacttgatccttcttccaagaccaaattcaggtagatacattctaatttcacaggcaaaaaacccagaacagcccctgttgtttggattctatgatgcattcctcaaccccagcaactggtattacaggtactgtttaaaatgttgctttgttaccctgagaactacatccttactctttttttttttttttttttttttttttttgagacagaatctcgctctatcacccaggctggagtgatagtggcacactatagtggaatgtgcagtggcacaatcatagctcactgcagccttgaactcctgggatcaagcaatcctcccacctcagcttccagagtagctaaattatttgttctaaaattattattcatataacacatgagcattgattctttccaagacaggcacaattctgtgaatgtaaaagttggtgctctgcccccgggaagtttacaatccaattaccaagtggcctcgtgagaaaagtgccaagtgcaagtaggaccacggaagggagagatccgaacctgctagagaattaaaatacatgcttctggataaaggtggctactgcaatgggatttcaagaaccaatataatggcaagctcggtagctcagacccgtaatctcagcactttgggaggtccaggcatgtggattgcttgaggccagcctgagcaacagagcaagaccctcacctacaaaaaataaaaatattagccgggcatgagcacaagcctatagtcccagctactcaggaggctgaggcaggaggactacttgagagcaggagtttgaggctatagtgagctgtaatagtgccacagcactccagcctggacaacacaatgggaccctatctcaaacaaacaaacaaacaaacaaaaccatgataggcaaaagtagggaaaaagctgtccaaaacaaggaaaggcagagtgaaataaatagtcaggaaagcccaaggaaaattaggtaatttggccaaagccaaggactgtgtgggggtccagtagaggaagaggctgacaggaagttcagggtatactcttcagggtcttggcttcttctcttaaggagtctagacagagggaacaacatagaggccagacctctttctataagtaactaacctgttaactttgccaattaggtacataatagaatatccttcctcttattgattgtgtgaactccgtgaacacaagagtcatgttttctcactactgaatcccaggggctgccattagtaaacactccactttttttgttgaataaataagtaaatgaacaagtaactaaattgattcattaaaggtacatataaacactttaattttgctattagtattctcttagtaaaaataagttcctgtgtaatttatttcaaataaatgaacacttgaataatccagcagtttcttccctccacattactttctttccaggttactcaaaatgtcatataactagagaaatattaacaaattttatatgcaagaagatgatgtcacaaacatacttcagactggttttgcatattatcaactagctattagtataaaaagtagaacagctactctatcaaacatgaccgctaattttagaaaatcctttctctttttcctgaaaaatatccattatatatatatatatacacatttataagtaaatatatatatatatattttttttttttttgagacagggtcttgctctgttacccagactggagtgtagtggcatattatggctcactgcagcctttacctcctgggctcaagtggtcctctcacctcagcctaccaagtagctgggactacaggcgtgtgccaccacacctggatgatttttttattttttgtagagacagagtcttgctatattgcccaggctggtcttgaactcctgggctcaagtgatccacctacctcagcctctcaaggcgctggcattacaggcacaagccactgtgccccacctcatatctgtttttaacagggttatttcaagctggaaatataagcaaatctttttataatggcaacagaaaactatatgtaatatttcaaaacttccctttctcactggccattgaactcttgagacgtctggaagtggtaaaggcaataagctcttgtgacattatccaagcacgaaagcattttcatgaaatcatggcctaagaacactcttgtctatcaggctgccagtgctatctgtgggtcagttaggaaaatgatgcaaagaacttcttttgaaaggattctccagaattacctctaggaaggactctggtgctcagtgcctataattaactctggtgggtggtaggagtggaggttggcaaatgtgtgtcttgactggcatgtgagtgagggaatttggtctttctctcccactaatagccattggaaattaataagaaagtgaagaggtgacttgtgaattttatgtaataatagaggaggctcccaaacattgcaatgattatgaatgaagaatttacttctttctcctttttcacataaacacacagaagtgcccttccatttgataaagagggtgataggagatcttctggtttgtttgtttaatgtccaagtcttgcctgatcctgctgcactctgcaatttgaaaaggaacacttttcttataaatagcccacataaggcatcttgggacatcttaagagctttacatatatctgtacaaggcaatattgtggcattattatcaatgttgaacaatggttcaaataatcccaggacaaattagcttaatacagattaaccactcctaccacaaaagaaaaccaaaatttgggatccaagaaaggagaggttaagttccaaaaaccaaaaataaatttttattaggtacaaactataataaaaaaattagtatatcacaacctatgttagctgattgagataaaatatttggaagaatccgtgattctgaaatacaaattttcttacatatattctttgggaaaaaaatctgtttaccatgaacaaaaaaacattttgtgtggctcaaatatttaagctaggccaattagtttgtttagtggcatacagtttgcactcaataaatgttagggaatatatgtgtgaatgaataaaaaatgtaccataaatactttttgtctcttgaaaatacaaagggctaatataattgtactcttttacagagtaggaattttttaattaccttaacttgtaaacataatttcaaattccaaataaaatgataagactaaaatcagaaaacaatatattatgttctgaatttttacagcgcttttgacactatgtttatattccagttgtgaatgttcaaatataaaaatgggttcaagttttctatttagaagaccaaattcaccataaaatagctttggatcagacagatcccagcatttatgtcttgctggttcaaggaaataaagctgtagtaaaggaaataaagctgtaataaatcgctccaaagcaaaggcaaaatgaccacccaattaagctataactttaaaaatcaccttgaggttaccctgggaagaaatatgaggaaaagggcaattaaagatcagtcttttaaatctgaggtctcctcattgacaatgaaagattcagttacttaaactgtttttcactgtttcatttatgagttgcttttaacaatatttcatccctcaacagaggaaataagaaatccttaaaaaaaaaaaaagctataccagactatcaaaatcgttgctaaggaaaataaactaatcaagattgatctcctgggtcctcagaagttcaccaattccaaatgttctcataagtttcaaaagagaataaaacaattaagcttccttataatacaatgcttaataactcattgtgggtcagaggaattaatgacagtggcattttataaaatacatttaactctaattaaaagtactcatttatttcttttctgaataacctaactgtctctttcccacatactaaaaagtctgggtcaatttttttttctatcaattcttaagggattttctagaatagttttaaagaaaagatgggatgtactgctgttagcagtactttcagcagaaggaatttttttttcaaatttattaatttttaaaaacgaacaacaatgtaactaaagaaaaatgtctacaaagcaaacaaaatggtgacttcctttatatgcaagcacaatgatccattatttccttttcaagaggccttcaatattagttactgagagagcaaatgacaatgaaaaaaatattaattgcattactgaaaagagactataaggcaataagcttattttccctcatttaaaaatgctcttcctgcttcttttaaattccattaaaaaaacatagtttgctacaaatgacacacaaatgggatgaataaatagttaagtacaactgatggaggtcttaatctaatgtaccgttgtctgtcagctaatctctcctggtttaacaatctgagtttaactacttcatgatgaatgagacagggtgcaaatgacctgagtgtttcagcccataaaacaggcttagggaaataaaacctgcaaatttgatcaccagacttagattgaccaccattggcaatgcagttagggttttaaagcaattgtctacatgtaatattaagtaatgaagttccaatcatttatacttaaagtaccatttgctctaaagcagcttactattatatgcaagatttgccgttacataactgaaattcagatagctctgaattcaaaggtggtgagctaattgtcagaggacctcagtgaggctgagagttttatagactcagttctgcagaaagtttcttaggagcattaacatgtactcacattaagcaagaaagactccagttgttaacagcagtaggtctattgttcaggaagtaatacttttcatgagattcattatgaaagagaggggggaaatcctttttggcattctgcatataaaatcttctcagaaagacatctgcagtttaaaaaaattccacctacttttactactacaacctttgttaatttgctacagttctctgctccagtaacttaaaagtcatttccttaagaaaacagatgacagacaacttgagtgactgattatattgtgccatcactttgtttttctcagaggccttggtttaagaggatggatgttcgtgtaaatgacagcaaggggagcttcgcataagatttcacttctgttcaaagacaagctaatgtaacctcactgcggtgccatcaacttgacaaatggacaccgcgcaaccctctgcctcccactgaaacccgagagcctgatttacacaatattctccctgtagatggaaaaagacttcatgctgctaggctgtataatgggttgatctgataattctttgcatgtaatgaaatttgataatatgaaggtgagatgcatctcaaagaatgaggcaagctaatgaacttgtaaaactacacttaagtcttttaaaacctgaataaacattaaaagggacttagctcaatccatgttgagaaaacgtagcagttctcatgttttaactctgcaatcaaagatacacggcctttacttaaaaggaataaaagattccagctccaaggagtatagctctattcaaacaattcaatatgatctgtagaaattgctgtgccttatctttaccatcagattttgctggtcctcagttccttacctcaagaattctacattactttatcctgttaaattattttcctgggagctcaatattcttccttctaaagtaggaaatttcttaaagaattgataaataatgccatgcaaaattaacaaatagttcatctggagatttaaacgtaccttaaactggcacaaaaatcacaaaaattagagcttcataagaaacatccacttctgttttaaagtcgtaagttcttacatattcaaagtatgaatgtttaaataaagtattctgaaaagaaattcatggtatagtttattttataggcaaggctgatctcaaatcctcggcagtaaaactgtctattagtattaatgcctggaaataaacaccatgaatgtaaactacaatcagaagcagttttaacacatgtaaatgttgaatgaggtagaattttaggcttatatttactttgctgttgtcacaaataaaaaaagcacttatgaaaacatttcatgctgaagtgaatggatctcaacagctgctgatttggtgacatggagaaccccagaggagacatcctgctgaattaacgttttggaaatgttaaaaagaaacttcaaacagaccttgtttagcaggcggtcaaagattttgctctgtggggatcatgtgaaggctagcagagcagtcactcagccatgaatcagacttgtcaatagttgcctattttctcaacaggtgacttaaataggcacacagtctatttcccctaacatttctgtgtgtacttgtgcacaaaaaaatcatcctagactttgctctgggatttatttaggaaggcacagcatgcagggatggggaaatagttgtttaaggggtttagacatattttttaaatgtgtacttttgctttttttaactaaaaaaattagctaagttacatttaaaatcttattttcaaacaaacttttatcctaagttagaaacctggaacagattcaatcaaataattataggacagtaaagaaccttgaagatagcaaagatcaaacccattatttcacagatgaggaaactaaggcctacagagctttaagtgatttgccaaatatttacttgttcatgtgttcggactagaacttccattttctgactccttggttcaaaattagtacactaaacttatccttaagaaataaatgagaagtagtcttctttgagcaatgtaaaaatacgcaagagaagaaaccattaaactgagtaagatctcatggttcagtgtttttctgatttggcgtgttttgattattttcctttatgctggccacagagaaagagagagagttaatggaaaattccttccccacaccaccaagaagtagaggtgggggctggggtgagaaaaggcccagtaccaagatgtgttttctactttcaacatttaggagtttagtgtaaatgtagagtacaaaaacaataaagcatttctttgttactgactcagattggcattgtaaactatgccatacaagctactattatgtcagaaaattaccaggtatccattaaatgagctcagactgttttctattgttaagaattttttagttgttttggaaagcctaagtacagagttcagtgaaagttctcagaggtgactccacaatcacagcagtactcattaccttagtcaacctctcctactgcttccatcaatgcacggtcattaccagccaatgctaaaatggaatccgaggcttagtaaatcacctccaattgacaagatgcttcctagataagtactctcttgaaaatactttctacatgattcagagttaaaaattaggaagaaaagcaaatgccaatgccatcaacatacacacacacatatacacaaacctcttaggacccaattcctaagaattcactgattcttgttattaaaattcatcttttggaagtttaattcttcatatggtatgaggaaacaggtactctaatgcaaaggttgatgggagtgtaaaagacagattggatttatacatcaaaatgaaaaatgcactcatcctttgacccaacattcctacctatagaatgctgaggagataattcaacaagtgaggaaagatatatgtgcaaagattatcatggcagtattttttatggtagtacaaagctggaaattaagttggtggttaaataaaggtatatacatacactggcatacatgcagctgttaaaaatcactattcacttaatataaagctacagtagtaatagcaaatggatcaatggaacagaacagagaacccagaaacagacctacacttacttggtcatttgattttcaaaaaaatgccaaggaaatccatttatgtcagaataactgaatatccatgtggaaaaaataaacttcaacttcttcctaacatcacacacaaaatttaacttgaggtctaccttagacctgaatgtaaaagctgaaactataaagcttttagatgaaatcaaaagagaaaatcttcacaaattgagaatagaaaaaagtttcttaaagataaataatcataaaataaaaaactgataaattgaactgcatcaaaatttaaaaattctcctcatgaaaacacattgataagaaaatgaataaggaagcctaagagactaagagaaaacagactaagagaaaacatttgcaaaacatatatgacaagggtttggataagatatataaagaaatataacttaataatgaaaagacaaacaacctaatttaaaatggatttaaatttgaatagactcttcacaaagaaatataaataaccaataaacacaggaaaaagtactcaatgttattagtcattagggagtaacaatttaaaaccctaatgagataccattacacacccaccagtatggctaaaattaaaaggtcagtagcaaatgttggcaaggatatgtagcaactggaagtttcatacgacgttggtgggagtgtcaaatggtgtcttatacaaaacacacacctaccctatgacccagcaattccacctctagggattgatgcaagagaaaaaaacatgtccacaaaagccttacacaagaatgctcacagcagctgtattcatgatagttaaaaaatggaaacagttcaggtgtctatcaaaaggaaaatgaacaaacaaactgcatttatgcaatgaaatactatttagcaaagaaagaaacaaattatggatacacagaacagggctgaatgtcaaaagcgctttactgagtaaaaggaacattacatttcatttacataagggctggaacaatgattgcctttgagggtcgtgtgggctgagatttactgaaaagggacgtgaaggaacttattgtgatgataacgttttatatcttgacaggggtttgagttgtacaagcatatgatcagaacttgtcaagtggtacacttaagatttgtacactttgttgtttatctcaaaagaaaaaaggaactcacgtttatggacgcccatgctaaagtactcggggtggagggagtatacagatgtctgcctctttctttgaaatccaatacaaaaatgagatgggttaatagagacccacttaaatagagagatgaggtgaacaaatatagcaaaatattaattatacaatttaggtggtaggtatgtgggtattcactataaaattccgtctctcttattctcttggtgtgtgtgtgcatgcatgattgcaagtgacttacaaacagcatgtttaatttttcaaaataccatttttccaaactgacattttaacctctattaatagacacttgtttatttttgtactcaatgaagtttaacttctcctaaaacatagaataattaaataattttcaagttcatctatggcaaatgtcaaaggaagatatacaataaaactggttctgcttgatcagttgatttggatattgaagttttccacatttttagacaatatgaaagtacagtagttttgcaccaccttctattaaaaatctacaacatggctcagagcagagactcttttaaaaatgatcaacaacaataaattgtaagccacttgtattgtaattaggaatcccaaaacttttatgaaatattatcttaaattttaacggaagttttgttaacaaataacattataaattttgtagattactgatttacatgcatgtggaaggaaaagcaaaatccttccaattgtgctgagccattaaaatggagatgaaccataagatactgcaaagcccagaaggtcatgtgtaattaagcacatattctccggcttcttttatcatatattcatattaaaaacttaaactgtattccacttataaatcaatggattctgctgataaagatgggagtttttaattcttatttgttgggtatgatttttttccattttcaatggaaataataaatctctactttgtatcacattctgggatggttgggtgtaatgcaaaaatatcatgtaaggaaactgatatattcaaattagaagtgagttggtctctccaaaggtatttggtacttttttaagtacctgttaagtgctgttagagtatgcattttcctctcaggtatacaaacactgagcatcatatatcaaataaagtagaagtattctgccatttaattggaattgaggatttttaaatggttaataagaaatagtcaaaatgttaaaggcagtttatcttaagcatttacatttttcttctaacaagttattttttaaaacatatcagttactttactaaatgacttaattctttatttagtgctttatctgctaatatactatcatagaatcttccagtgttcaaataaaatgtcaataaaaacttatactttttattagtcaatatgcccacatttaactatatggtcccttacttaaatcataaactactctaaggaatgattcataaagccaaatatatatatatatatatatatatatgtatagttaacactatttattggatttacctaacaaaaatgtgactataaaacaatgattaaaatatctaaaagattatataaatgagtattgttttatgatattaatctacggaagcaacaattgattcatacagttgtagaattccattttggaactttctctcacaagactgtccacctcaagtttgtatgttctcttttgtctccccgcacacatatatgtacacacacaaagctgctctcttttataaacacattttgtttcagacacagtattacttagcagacacctccaaataacttgtagttatttctaaaaatcaaaatcagattatacagatgtctgcctctttctttgaaatccaattcaaaaatgagatgggttaatagagacccacttaaatagagagatgaggtgaacaaatatagcaaaatattaactatacaatttaggtggtaggtatgtgggtattcactataaaattctgtctctcttattctctcggtgtgtgtgtgtgcatcaaaaatacacaaatttgctatcaaaagaatgtttagaaaattccaagatgtttctgaaagtggaaacctaaatgtattactaaaatatgcatacacagcctcctccccagatgtgaagatgaccactttggaggaatcaatgcttacttagatgtatatgctctggaatgtgtatgtgtctgtgtgttgtaactgccacaactgaaggaagtgtgctagaatggaaagaactgtatcaggtatcacaaagcctgggtctgagtatcagctctgccatttataagttgtacatgtttagatcaatccctttacttctttgggcttcaatttcctcatctttgacataaaagtgttgatctagaccagcacagtccaacagaaatatagtgcaggctacatatgtaatttttgtagccacatctaaaaagtaaaaagaaacagatgaaattaattttaataatattctttatttaaccaacacagtatacccaatatattaccatttcaacatttaatcaataaaaacttattactgagatcatttacattcttttgttttttggtgctgcctttcaaatccagtgtgcattttatgcttggagcacacatcccaatttggatgagtcaaatttcaaatgctcaatagccacatgtggctaatggttaacgtattagacagcacagacctagacagttgctaatagtcctttcagttttataatttttattactttgttgttgaaaataatatattaataaaattagcatcaaattcagtgcaagtatataaaaatcatagatcaaatgcttccatggaacatctactttcatcaggaaaggttcattaattcttatctggcagtttaaaattctggatgatttttttctaacattgaacaatcattaagaagcaaagaactggcaattatcttctgaactcaacctcacagaaagtggattacttcatctattaaattggcttaagtctattaaataattgccaagtccccatttcacattctatgatgcagatttggctctaatctgaagctttagatctttatgtaatcataagaattgcaagactggttttaaaatgaataaacatccaaaattactgctatagcagtaaagcttatttaatttctgctttgtttcatgtagtctaaattatgaagattattaaagggctttattttagtgaaccacatttatataagcaaatcaatattcaataataaatattgcaattcttggcaaaggattgggaaaggccatgttcattaaaacaggtgatataaaagctgatactcaggttctaactgagaaaaatgtataaactattagctatgaagtatccctcggtaataaagactgaagtagaacctacttgcatcacaggacaacttttcgagttatcaattacacttgtaatagaacctctgcaagttatttatctccaggtaaaaatcatacataatttcaactagcttatcagtttttataccaaactttacagaaattatataaatgttctccctgatgttactataatcttttgacccttttcttccccctcaaatttataacagactagtaataacacactcgagtgtttctttatcagtataattaccataacagaattatttcttaaaaagaagtgaataaaacatctcacatgctttgtcaaaatacaaaaggtgtttctgcaaatctctaaattttgttttaacaaatacacagtgaaagctggtaatgatacaacttatgtacacgtggcaacataatatactgatctcttaatgtctagcacaggacacattgtgtttgtaaatttgccagtaagataaaaatcatgtccgttgaagttaactttctacatgatttatattatttaatgaacatttagcagagccagcctgccacataatactaccttatttctggggggaaaaaggtaaacattattgctatgctgtagtcacctataattcctccaggcaattatctattacatgtcagagaccagtgaaaaaagtaataaaggcaaaggcaaagaaactctaaacataatatggcccatgcccagcacactgcctggcatttaggagacattcagtgtttgttgaatgaatggccatagaacatatgtacacagtacagtctacatgtgtgtatacactgtagcctgcattgattccataggtaaataaatacactatacatttagtaggtatgcatgtttacttttttttttgctagaaaacttttatcctgattctgaagtccaaatctagctcttccttggggtgacataaaaactcaagtctctttcctgctttcatcattaagtacttcatttgttcatcaagtatttgtgtaactggcactatgataggcatggcgctgacataaaaagaaaatcataaagacaaacacatagactaataattatagtccttattttgtaaacaagggaattgctatttggggagattaagaaacttgcccaaggcaacccagcaagtgagtatatgaaccaagtgtcaaagctgtatccatatgtttttcaactaccccatgagacataaacattgagcagctaagggaatgtgacggttaattttatgtgttaacttggctgtgctgtggtgcccagttgcttggtccaacactagtctagatgttcctgtgaagacattttgcagatgtgatgaacatatataatcagctgattgaataaagcagattaccctccataatgtgggtggaccttatccaatcagttgaaggccttaagagcaaaaacaggattcccagagaagaaggaattctgccttaagactgtaacacagaaatcatccctgagttccatcctgctggcccaccttcaactcaaactgcaatattaactctgcctgtttccagcccacttacctgcactatagattttgcacttgccagccctcacaatcatgtgcaccaattatttaaaatcaatcagtctctcccccacctactctctcaatacatctatgtcctgttgttactctggagaaccctgactgacacagggtgtcatggctaaatatggaggttgagagggcatcaaaatgtggctagtagtgcaatacttgaaagtggataggacccaaatggacccaagataccaaggataaagccttgagcacaacagcatttaaggggccagcagaagtcaaagagccaaaaggaagagataagtcagtcatggcaaaagaaggcttcacaaaggagggaggcaatcctgcagaaaaggcaagtaggaggaagtctgagcataggcctttgtatttggcaatcagtaggacaagggtgactgtggccaggtcagttgcaatggtgactgggatggtatccatcctgtattcactgtattgtctaccagtgaataagaggtgagaaactagaaaaaggttggcagttgaggaaaggaagaaaacaatagctcaaaaaggacagaatggtggaggtggaagactgtgttagaattagggagacatttgtaagttgagggaaaggtgtcactggagaagaagataaagatagatagaaaccagtgagaaaacaagtcccaggagtaagatatccttgcatatgggctctagaccacgggagtatggaataactctaatcagaagtgaaatacctctgtcaaagacaagcagtgatagtcaagagattggcgctctcacggattgagctgaagctggggctccatgcctttattttatttatcttatacttttccagggaattaagaggtgaggtcatcactgagagttcttattaaataacatatatgtgtctagtaccatatgggattcaaaaaagcacaagacccattctttgccagtctatctgtcaagctattatggtccagtatacagtctctcagaagcaatggagcattggttccaggaacccacatggatacccaaatccacagatgctcaagtcctttatacaaaatggcatagtatttgcatatgatctatgcacatcttctgtatactttaaattacctctagattacttataataccgaatacaatgcctacctaccacttcgttggtgtggattcaacatactacttggcacatggcaaattcaagttttgctttttgaaactttgtgaattttttttttccaattatttttgatcactggttatttgaatccacagatgttgagggctcactgtagttaaattatccctagtattaagttacacagtattttgtgggaaacctttaacaaactatgcttgtttctgccagtgattagtaaaaaaaatattgttggccctgtttttcatcatttgtgcactttaaaaaaatagaagcttgaaaatgtgatttctgctagttatattttcgattagaaaattaaccatatgatcttagtggcaataagaatatgaccgtgataaaattgcacagtatattttaatcttactctgttcatatgtttagaagactaaacttgagactaattatatgatcaatgtctcctgttttattattttacctcagaatattaaagtgattacacaaataataagtaatgatatttttcccttaaaatataaaggaatttgcacaattttctcacattctgctaaacaaggagatgaatggttagaggctaaaatctttaagttctccaatgatgcattaactaaaccaaagagacaactttactcatttcaaaatgttttattataacagcagtcttcgaaggcaaacacaaaagattctactatgcttagattttaaaacataaccaatttaatgcatcactaatgatgtacaatagatgtcttctgcagtaccaattcaaataagagactgatgtaatctgccagatacttcaaagtaactaatttggtaataagaaaatacttcttttgtgcaaactttcctacttaaaaaaaaactgcagaaaccctcccagttgaatatttactaaataaaagtactgaaccctcattaaaatgtgatttaataagaaaaagagaaccatgtactttaggccttcaaaatttatcttgagtaacattaggcttttagatggaaatacatctctatacaaagaaaacagatattaatagcaaattatgatctattttagaattgtgtatttatatttgacatcttaaaattttaaatatctattacatttgttgctattatgttatacaccctatatacacacactccagatgccttatctatgaaagtatactagtacatttcacttctctataaatcttccccagtatgtgtaagtaaaacatttcccagactctaaacctctaaaggtaaaagcttaggtcagagtttcctgagcatattctactatgatgttaatatgttttcctggggaaagaatcttagatttctctttgcctttgttctcccttacccattagagaattcaaaattttggccttaatgggaaaagaaagtataaaattcaacaagtatttccaaaagcaagttcaatgcaataattattcattggccaagatatttgtcaattgctcttttggctcacaaattcaaccaaaatataaatgtaaattaagatgttttcaattatctattgcttcttctccagcagcagctaatcctgagaaagtacctattattccagagaggaaaaaggaagcaggagtttccatttctgttggccacttgggggtaggagtgtgtgtgcagaactaggacacaggagatacttcttagggctccttctgctgatattcaaaaaacccagaatccaaattacctaatttgtggaaaacattttcttaaaattggattttttttatggctaataattgggcagaattagcatccatgaagttacagtaggattttcctttattacatcatattttaggatatatgttcccaattaaataaaaaattattgatttgaaccacttataatgttaccaatagagcattattatgatacctattctacagaattgcagaagcaccagaaaaaaaattcctcataagaatttgctaacttcttacttcatattaactgttgatacatgtcctataccagtgcattagccataatgcttgcaaattttcttgacttcccctgacccactagatagcattcaaattcgtcatcctagtgtccaagatgcttcactctctgacctgtacctcacattctaacccttgttcccactaatatccaaagatcaaccctatacctcaaccaaaaggtctgtcaaataaatgaccttgtgcctccccactcagtgtctgggcccatgctagctctagctagtaaaaggcccgaatgccttttactaaatgcgttttttctctattgcctagagggagctctggttcatccttcaaaggtcaccttctgcataaaattctctttgtggaaatcactcctgccccatctctaaaattccttaagcattttgcttatatatctcataggccagttatgtgttgttgttgttgttgtttacattacagattttcttctaattataatgattaatttttagggacagcatccattttttatacacattttaaaatccacatgggcacatattgtcacactggcttacatgaggcagatattcaataaaggtttattgaatgattaacttttatgttatcataattttgtatttggatttattcttatttgagcaatcattgtagaaaccagtgggaaaaactgctactgcctgcaatctcctttcaaaagcaaacaatagaaatgattaatctcttaagttacaaatttgattggaagtaagaatagagatcaacctcatgcataaaatgagacagcagaagcccataacaagactgatgtcaggagctaagcaaaaggtctgaatgacaggtgccctcatagctgtggaaaagacacgctgcatagcacagtgtacatgggagacaccatttggcataaaacataaatgaatacatagtacatcgaagtgctttataatgaagttatgctgaatatatttttttactaccctattgaagtggtcaaattttaaaacctccaaatcaatgaggcttaaagtaatagcagggctcatttccttggatgatacatgattctctgttgggagttctatcatctacataaactgagaagccgggaatggaagaattaataaaatagggtttcttttcatggaattgacctaaacagtgaattactatttgaaaattactcatctaaaacaagaactaaacactcaaatgccttgattcttgtttaaaatccaacagcacttttttttttttggcacatagggatactaaatgtttgttgattttgttgaatggataaatgaatgactagctgctttttaaaattagaatattaatcacttcttggccttttggctaagaccaagtataaaattagaatattaaataattaaacaagtgatgcaacgttaatatctgagcatgtacttcaggggaagaaagtgaaaatttgtctcttggctgagactgagaaatgttcccctaaattttatactgtttctggctttgtaggacaccacctccagggaaactctatttctctttgacagtcccaggggcctgaccaaccttagggagggactcagtttctattagaatgaaagcaatagtctgctgcccatcaaagatatctggagacaaaaggacaaagtaaaagacatataaaaagaaagaagagggaaattgcaactgatgtcaatattaaaatgaaagtggaccattatttggtgaccttaataaagaaaacctttgaatagcacactttgaaaatgctattttgtctcaggtcatttttacgcatatcccaagacccatatagtcagtaggacctccagaaacttttcacattcatgaaagcccagagggggaagcaacctacagcgatattagcttaaaaatgacttctaatagcttcctaccagctactatcagatacaatagcttacttaaaatggaactgataatttggcaccaggttcttcaatacttggcatttcccaaggactcctgagacaaaattatcaatgaccacagtcattttttctttagtgtttcatgtgaaagaaatactaagttgtcacaaaatattcatattgctatcaaaaatcaacacaagttgtagattcatttttccttcctttattttacagactttagggattacatagactatacatttcaaatgtatagagtgtttgaatttttcaaaatgacagttttggggacgcaccgcttaggaagcagagacaacacagggtgtgggagcctagctgttaggtctctctctggcagcttacttttgccacctagtgggggaggcagtttcagagtcaggttttatgttttgtataaataaggttgtctcctttaagacctaatgatcagctgatttgaaaaaaaaaacaaaacttgtttttcctagtgaggattttatatagatttttaaaataaccttaaataatttctccaaattggtttattctatggctattggttttctttcaagcagttagtattcactacaatgattaacttagagaattcaaggtaaaaataaaacttttttgtatacatctataatttgtaactattcagaagaaaaaaggccttttcctggtttccagttattttctatcccttgactttgtagtatctcacaagatctatcttttggctcattgttgttctttctacttaggtggggaccaaatctatatctttatccctaatttctcactgtggctacaatcttcaatcttcagttatccaccaaatcatctctggaagacatttaatatggcaaaaacctaagtcatcgttctccaaaaggatcaaagaatgggctctccttttgagccagtgtggcaggcttaatcagagctagagtgcagcccagggctaaaaatggcagaagagatttttttaagcaagtaaaaattaataaaacagttaagcaaaaggaacaatcagaagtcaggatcagtttactgggctgggcaggaggaaacacaatgatcaagagagggtggagcaataatagtgaacaggaattgaggtcaggaacatgggaaatttgaggcaggtcacaaagttaaagctaaaaaaattggaaataagaagtaaaagaggttggacggagtaccacagctcaagtcctgaggcttgagtccaagaggaccccctgagacatggaaggtttggacctaaaaatgcatggtgacatgtttttccactctttcttcaaattataaaagcccctagttcccatggagagtcagtctgctgaatttcttgaagtttctgacctaaataaattattgcttatgaaaatttccatgatcatgaatgaccttataatagaagcttagaaaactacttcttaactgctttattaaggtgtaactgacataccataaagttcttctgatacggtgtggatgtctgtcccctccaaatctcatgttgaaatgtactccccagcgctggaagtgaggcctggcaggaggtaactagatcgtgggagcagatacctcatgaacggtgtagcatcatccccttggtgataagtgagttctcactcatcacatgagatctggttgtttaaaactatctggcacctcctccctctctctcttgttcccatgcccgccatgtgacacgcctgctcccacttagccttctaccagaattgtaacctttctaaggcctcatcagaagccaagcagatgttggtgccacccttgctgtatagcctgcagaactatgagctaatgaaccctattttctttataaattactcagcctcaggtatttctttatagcaatacacgaatgggctaacacgtgttccattgtgagtagttttagtaaatttagaaacttgtgcaaatgtcaccataatctagtctgagaacattttcatcaccacaaaagttcccctgtgcacgtatgcagtgagccgttgctcctaattcctagtccaaggcagccactgatctgctttctgtttctgaagatacagacttgcctcagagacattacaggtgaggttccagaccactgcaatagagtgaatattgcaaaaagcaaatcacacaactttttttgtttcccagtccatattaaagttatgtttacctacactccagtctattaagtgtgcaatagcattatgtctaaaaaaagaacatactttaattttaaaaacagtttattagaaaaaaatgctaacaatcatctgagtcttcagagttgtaattgctggtggagggtcttgcatcagtgtggatggctgctgactgatcagggtggtggttgctgaagactggggtggctatggttaagttcttaaaataagacaaccataaaatttgctgcacggactaactcttcctttcacaaaaaatttctctgtagtatgcaatgctgtttgataatattttacccacagtagaaatgtctttaaaaatcggagtctatcctctcaaaccctgctgctgttttataaacaaagtttgtgtaccattctaaatcctttttgtcatttcaacacactcacagtatcttcaccaggagtagattccgtatgaagaaactagttgttttgcttatccataagaagttcaagtttcatgagattgcagtaattcagcgctatcttcaggttccatttttaattctacttctcttactatttctaccacaccagtagttacttccctcactgaagccttaaaccccctccaagtcacccatgagggttggaatcaacttcttccaaatccctgctaatgttgataatgttgacctcctcccatgaatcacaaatgtatcttaatggcatacagaatggtgcatcctttccagaaggcttccaatttactttgtgtagatccatcagaggaataactatctatggaagccatagtgttaaaaaatgcatttcataaataataagacttgaaagtcaaaattactcctttacccatgggctgcagaatgaatgctgtattagcaggcatgaaaacaacattcatctccttgtacatctccatcatggctcttgcatgaccaggtacactgtcaatgagcagacatcttttgaaagaagcccttttttctgggcatatggtctcaacagtgggcttaaaatacccagcaaaccatgctgtaaacagatgagctgtcattcaggctttgctcttccatttctagagcacaggcagagcagatttagcctaattcttaaaggccctaggattttcaggatgggaaatgagcagtggtttcaacttgaagtcatcaggtgccttcaccgctaatgagaaagtcagcctgtcctttgaagctttgaattcaagcattgacttctcctttctagctatgaaaatcccagatggtatcttcttccaatagaaggctgttttgcctccactgaaaacctgtttagtgtaactacagtcttcaatgatcttagccagatcttctggataacttgctgcagcttctacatcagcatttgctgcttccccttacacttttatgttatggagatggtttcttttcttaaaccttatgaaccaactgctgctagcttctttcttctcttctgcagctttctcacctccctcagtcttcatggaattgaagagagttagggccttgctctggattaggctttggcttaagagaatgctgtggctggtttgatcttctgtccagaccacctgaactttctccatatcagccataaggctgttttgctttcttatcatttgtgtattcactggagtaacacttctaatttctttcaagagcttttcttctgtacccacaacttggctaactatttggtacaagaggcctagcttttggcccctctcagcttatgacatgccttcctcactaagcttaatcatttctagcttttgatttaaagcaagcaatatgaaactctttcagttgaacacttataggctgttgtagggttattaattggcctcatttcaatattgttgtgtctcagggaatagggaggcctgaggagatggagagagatgggggaatgggtggtcagtggagcagtgagaacacacagaacatttataaagttcaccatcttatatgggcatgatttgtggcaccctaaaacaattacaatagtaacatcaaagatcactgatcacagattaccataacacatacaataatcataaaaaagttggaaatatttcaagaattaccaaaatgtgacacagagacatgaagtgggcacatgttgttggaaaaatggtgctgatagacgctcgacatagggttgtcacaaaccttcaactggtaaacaatgcactttctgcaaagcacaataaaatgagctatgcctgtaatttaccttttctggaaatttcatatatatgtaatcatacaatatgtggtctcatgtctatttttcatatagcatgtttttgaagttcatccatgttgtaatatagatgtagttcaaaatagtgcagtagttccttttcattgctgaataatattccattatatggataaatgacattttggttacccattaaccagttgatggacatttgaattgtttccagtttttgactactatgaataatgctgctactattatttatatacaagtcttcctgtaaacatatgtttatttttcttaggtagatacttcgagtgaaattgctggatcatgtggtaaatttacatttaactttttaaagaaactgccaaactattttccaaaatgctgtacattcctaccagcaatctacaagcttcctatataaagtttctccatatcgtcaccaacatttattatggtctttttgagtacagtcatcttagtggggtgtgaaatggtatgttatcgtgattttactttgcatttccctgatggctaatgacattcagcatcttctcaggtgcttattagccaactgtatattttctttgggtgaactgtctgttcatatcatttattcattttaattgggttgtcttctaattattgagatataggagctctttatataaactacatacaattcattaatcaaatatataatttgtaaatattttcctctaatctgtggctttttaaaaaacattttattttaaaataaatttttaaaagcagagggtcagaaaacatcagtggctgccaggggtggggaagagaataactgcgagggggtagagggaaatattttgggttatgcaactgtttaatgtattgattagttatataactatgcatttgccaaaattcacagattggatattaaaaagggtgattactgggtgtaaatcgtaactttctttttttaagagaaagatactgaaaagaaaggagccacatattttccttatgtgaaaaaaaatagggtttatggttttctctggtagatagtaaaaacaattactggggaattatagtaaagaacagtaagatgagagatttcttcaatatacaactggtaaaaaaaaattaagaataatatgcttatgcagaggaaatttcttttttgtatttgagttgataatttgacctggaatttttctgttggcataaaactgttagaaatgcttattttttaaatttcacaaaattctcaggtagtaagcaaagcattagaacaataaaggcctctacaactagttccatacagcattttgatgtaaaaatatgcataaatctttaattggaaagtatatttctttttctttttctttttttttgagactgagtttcgctcttgttgcccaggctggagagcaatggcgtgatctcggctcatggcaacctccacctcctgggttcaagcgattctcttgcctcagcctcccaaatagctgggattacaggcatgtgccaccacacccagctaattttgtatttttttaagtagagatggggtttctccatgttggtcaggctggtctcgaactcccaatctcatgtgatccgcccacctctgcctcccaaagtgctgggattacaggcgtgagccaccgcgcctggccagaaagtatatttctttacagtaaaaaattaataatatttggacaaatagtcaaatttgtacaaatagtacaattcagatgtaacacactaactataaactatgtatttttacaagaactaatttcaaaatatacatatatggatgtattagtccattctcacactgctaataaagacacactcaagactgggtaatttataaaggaaacaggtttaactggctcacagttcagcatgactggggaggcctcaggaaacttcaatcacggcggaaggggaagcaaacacatccttcttcacatagcagcagcaaggagaagaatgagtgcccagtgaagggggaagcccctaataaatccattagatctcctgagaactcactcacatcatgagaacaggatgggggaaactgcccccaggattcagttatttccacctggtccctcccacgacatgtggggattatagaaactacaattaaagatgagattttggtgccaagccttatcaatggatttacacaattgatatttagaagctcttcaaatctatttgtaaatttaaaagttaagtagaatcatctctgccttgcaattgggagctgcagaaggtcaactggcagcgcctgcctgcgtgggcaacgttcttggtgaccactgaaggcagtgtgggctcaccaaagcgaggctgctctctgggttccttcctctttggctacttatggtgtcggtgcatgagatgctctatcttatccacgaagggaaacaacctactggacatctgaaaaagtgaggaaactaaacatgcagtgttgtgcttacttctaagcaatggagctaatccagaagggtccataccaggctgattaaagcacttctcttttggtttagtattcaccttcatcaacatcactttcaccatcatagtcattctacccctcctcctcatcttcttcttccctcctttcctctttaagaactttcaggtatttactagtggaaaccttctttggcaataatacaccttcaagaaactgaaaaatttctgattcctctgctgtatttgctaaattactgttagtgctttcttctttctactgccatgaccgtaggaatagatggttagagacttaacaaagagttgtgtggccttggccaggagcacctcgaggttgatgcacaacaccatgggagaactcttcatgatgaccagatgtgggacagggacagcaagagaagccactgctccctgcacttgtctttgcccacaaccacgtcccccacttttccgcccctcccatgtgggtggcagctggtgccccaccatgaggtggctctcaattttcattttcttaataatgttgttaatgcaaaaaagttttaagttttggtaaagtccaatttaccaatttcttcttgtatggatcatgattttggtgtcatatctaagaactctttgcctaacccaagatcatgaacatttctcctatggttctttgagaagttttaaagttttgggttttacatttaagtctattatctattttgagtgaatttttgcatatggtatgaggtaaggctccaaattcatctttttcatatgaatgttttattttcccagtaccctctgttgaaaatgttattctttcctgattaaatttccttggcatttttattgaaaattgatcaaaaataaatataaaagttcatttctggactctcaattctgttccactgatctacatgtctatccttaatgccactaagtagagtactgtagttttacagtaaaacttaaaattcagtagtgtaaatgtttcaattttgttcttccttttcaaaactgttttagcgattctggtctctttgcatttccatacacattttaagatcagcttgtcaactgctatccccaaaagcctgctgggattttgacagggattgtattaaatctataggtcaatttaagagaaagtgcgaacttaacactaaaggttcatctaatccatgaacattgaatacctctcatttgttttagatctttaatttcttttagcaatattttatagttttccatgtgcaaatcttgcatctctgtgtttaaactgattcctaagtattttattctttttgatgctactgtgaatgaaatggtcttaatttcatttttggtttttttttaccagtatatagaaatacaacaaatttttgtatattcatctataaattatatcctgtctgtaactgaacttgtttatcagttctaatagggtgtgtgtgtgtatgtgtgtggggggtgggtatttctcaggattttctacatacaggatcacatcatctggaaataaagaacattttgcttcttcctttcaaagctacacgctgatctatcttgaagtttatgggtgtgggttcttctgccatctcaaatctgttattgagttactcaagtgaatttttcatttcggttattgtacttttcaactccagaatttccatttgactttttaaataatttatcttgagattctttatttgttgaaccattgttgttatactttcgtttaatcctggttttctttaattccttgaacatattttagctgctttgaagtatctgtctgcatagtacatctgagcccactcagaaacactcagcttctgcttccattcactgctttttccccctaagtattaatcacccttttctttctttaaatatcttgtaattttttaagcctgaattttaggtacaatattgtactaactctggatttttatgttcttccctcgggattgttgttcttgctgtggttttctttttttgtttattaagttgcctaaactaaatctgtggaatccatctccttcatggtgcatcgctgcttatctctctacttaattttttaaaacttatttttgtttttatttttaagcctgattcttaggggtcactcccatgtctgcatagcttagtggtcagccagtaattagtcggtggttatgctcaaataccctaagctagtaaagcttttaccctctgcccatgggtctgtggttgggttgggggagcccattaaaaactcaggcagttttcaagtctgccctggcatttactttctgccaggcctttttgcatcttctctgcatatgtgcagatttcacagtcatccagggtgtataggtagcttgagccctctttgatatctcctgcttgtgtttgaagtgttttggtgagtttatcaaggctccctatcactgtgccattttcccaaatctccctgatagatttctggctagtctgctgatacactgttggccccaactaggaatgtaacctcaggttcactgagttgctagctagcctttcttgtctcttaccgagatgtctactgttactcataatgttggtgggcatggggctttcacattccatttcatatcaaggaaggccactccatcagtgaaactgatggttttcatggccttctttacccttgtagaactattgtgctgagtctgcaggtgggggatgggagcacccgcaggcagaaacaccacaaaatcctaattagcttacttggagcactatagtttgtctatgaataaatgcttctcaatttgttgagtgtcttttatcaattttcagagtcctaaagttgctgtttttgacaattttgtctagttctgttgttttttggaaagggaatttgttcagctctcactctgttcttttggtagtctacctttagaactattgttaagagctttttttcactctttcatactcagctggtcatcaaggcctgctgattttttctctgcaatgtctctttaggagagatgctgctttccttgccattttcagagtcacacccatcaaggtgatcagtatccattcctaaattcctatgatagaagccttcctcctcatcacagtcagttctgcatctggctgctagattgatcttatagacaccagcataatcacatcccttgttcctgaatgaagaacggctctttgttgcaaagaacataaatttcatactgctcagcctacctttcaagaatgtattcaactgccttgatctcatgtacaatcatttatgtctggaactcccaccaagttgagtttttctatccccacatattctttgtcaacttccatttttctaccttttctcatgctgtttcccctatgtggaatgtccttataatctgcctttcaatttttggtccatcaactcctaaaagaagcttaatcagattaattcttctgttgttgatcattcctatactccatagctcttcagtattcatatgtagatttttaaaacatttctggcacaaaatcttactggtttgcaattggtcttcaattgtttctgtatatgttttattttttctccaacttttttttcctttttaaggatttattttttagaacagttttagattcacagaaaaattgagcacaacttacagagacttctcatataacccttgcctccaacttttaattataatcaatttaggactttatttacaaaatagaagatacttcttagcatctagtacagtggtggacatgcagctggtggttaaaacatgactgttgagtgaataaaatgtttcttgatcttcaatgaaaattctaaaaactctttgaaaatgaacacttttggatttttttttcctgaagaccttaactcttacatatacctctgaaagcagcagtagtattaaaactatttaatagtgtgccatgaaaactgaaaataaaattagaaaagaaaacagagtcctgaaaactgctgggccaaataatgacctattagttcctagaccatggggaagtcccagaggtcctggacatgaggccatgaaggcagggggtgaagcatgaggtagcagctatttgccatgtggaatgaaagtatttaaacattttaacaattggcacgacagtatcaggggacagcctgaatgtcggttctgccagcaagtagactgatactctctggatttcataatggctatagaatatctataaagtggaattctgtcaaccttcagcagttttggatttggagagaaatatgagaataagtccctgaaatgtaaagtgcagacaagaacagtcagaagccagtgtcaaggatcagttaaacagcaaaagatcatagagtacaaaagtaccataggccaagacaaaccaacagtggagaccctaggtaagtaaccagaagtcagagttcaaattaagtaggtggaacaagccaaacaaatagtaaggaaattctaggtgaggatcccagcaaacagttgtctaggaagcagaaatgcatggataaggagactctgacttcaaggcaaccttctccctgtgctgaaaaaatttctcttttttttttttttttttttttttttgagacacggtctcactctgtcacccaggctggaaagcagtggtggctcactgcaacctccaccttccaggtcttcagcatatcagtcttttagagtaagacatttaagtgtgggtcttgatagggcactgactctttttttttttttttttggaaagagagtcttgctctgtcacccaggttggagtgcagtgatgtgatcatgactcattgaagcctcaaactcccaggctcaagcaatcctcccacctcagcctcctgagtagctgggactataggcacacaccaccatgcccaactaattttttttttggtattttctgtagagatggggttttgccatgttgcccaggttagttgcaaactactgggctcaagcagtctgcccaccttggcctcccaaagtgctgggattacaggcacaagccaccatgcctgacctagagcagtgactcttcttaccaaacagtagaaaacctgacctaggtttgctcgtagcattatcactgtttcatctatggagggtaacagaagacattttttttttatcactaccttgcccttaaaatttaattttcacatattaaattatgtgaaattaaatttcacatatgtctagaatatttgggggtttaaaaatgccttcaaatttcttccatcagaggatgcaaacgagaagccaattaactaaagggtatttaaaaaaatatgtaatctaaaaaggcattcagtgccaacttagaaacaaagagagtaggccaaataactattagcaatgaaagaaaaatattgaaatttttgaaaaataaccagtaactggtttgtctaaaaaggaattttggacatggggagaggcatgacttaattgaaggtgtattgctaagggagagaaggttaccgcttttcagttttaaatagtgtaataaatcatacgcaacaccataatttaagtttatgaggaaggtaatactctttaggttgtaaaagtgacctccagtgggcaataatgctctcaaatccgtggcctagggaactatattccattgatcatcactttaaaaaagtctatataggcaacagttttccactataactttcacatctatttagcaattatatacatatggttatttattggtttaataatgtatctggtttgattcattagtagtgaactgttaacagaaaggtttttagaatatttccccagtgatcttcaaatcaacatcaaacatagaggcatacagaatagtaggaatagtaaattcctacctaaatatttttaatttagaggggacactaagaattagaatactgaatttaaaatgaagaaactgggcaggcatgatggcttatgcctgtaatctcatcactttgggagcctgaggtggaaggatcaattgagcccaggagctcatgaccaggctgggtaactaagaaaataaaagagaagaaaaaagaaaagaaaagaaattagcttattaggtgtgctggcgtgtgtctgtagtcccagcaattcaggaggctgaagtgggaggatcacttgtgctcaggagtttgaggttacagtgagctaagattgtgccactgcactccaccctgggcaacagagtgagttcttgtctcaataaataaaaataaataaataaaggaactactgataagcagcatatgtgcaggtccaaaactgaacaaaacttactagaaaatctagaaaacactttgggttctatttatactttgtctcctatgaaatcatgaacatcaaattatcttcagagataacctgttatgaaacaccaagctacagataactgaggtacagattaaataaccacatttttagtcttttttagtgtgaaaagttaggtttttttaattctaaaatttcacactttttgcccattaaaatagctgttattcatcatttcaggaaaaaaaaaagtgggagaaggaaagcaataagtaagttcgtggcctttgactctagtccaaaattattttatagctcaaattaataagtcacttgtgtgcacaatatcactggatatatgcaatctctcagaaatgtggttatgctgttctaagcatatatgaaattataagtcagttataaaatacacaatattcaatcttcccactagcttcccctataactcactgttggttctggaaactgcttatacatctgaaatgaaaaaagtgaaagatcactatggaaatagcagaatattctttattacttaaaaaaaaagttctgctcagaagtgtttctaaatggaatttcagcaaggagagaaaagtaacctttgccataggcaaactttcttttaacactctgataaatactgatgaagacagacttatttattattccttcagaaaataaaattggtttccactgtaaataaattcaaaattcagtcaagtctaattgtgctataaaatgggcaatacttccagaaaactggcttctttccaaaagagaatggactctgaataaccatgtttaaggcaatatttgatacaaaattcagaaggtgaatttttaaggcttcttccttctaatcctaggattgaactagcaaacttttcctgtaaaaagtcagatagtaaatattttaggacgtgcaggcaataaggtctctgtcataactactcatatctgtcatcatagtgtgaaagtggccataggcaataccaaaataatggttgtggctgtgtcccagtaaagctgtatttacaggcactaaaattcaaattccatataattttcacatgtcacgaaatactatttttcttgtgatatttttcagccatttcaaaatgtaaaagccattcttagttcaggtggtgggctgaagctgactcacaggccatagtttactgactcttgttttcgtccacagtctatttttagtctattatttagatagaataatatctatcctgtggtgagaagctcctggtgacttttcctgctgtaattttgtttaagatatgattaaattccttaactataagatataatttgtgtaaaacgaaaattgtatataataaagttaaatgtcagcagaagacattttagttctaagatcaagggacaagtttcggagggaggaccattttgaaatatttaaaaaaatcaacaaatacgaaagcactttaccaaagcaaacattaaagttgatgttcatttttaatatatctgtcttagcactctaattcataaaaaataaacaaaaatcaagttatattttgaattttggcagctccaggacctcctggaagttgccagcggcagtgattatacccaatctttccacaccccacagcacttggcgctgctgacgtacagagcaagcaaagccgctgaagttcaaaacctgcactgaatctatctcaaacaaagaatgccaggacccactgcagtgacccctaggatgaagacatggaatctgttattatgcaatgtcacttaagtatgtcttttatattaataaaaaagttcgtcttggtaaattcttgctcaaacctatgacgtctctttagattctgaggaatgcagtcatgaatgacattattcagtgattagtgacttgtatactaataaggaggctgcccctggtacttgaagaaagtaatttaggacgccacgaaaaatgtactcatatgcataatatgttagaacaatgaaaagttataaacagagaaaagaactaatggagatattatgatggatttctaaggccaattacatgtatttacagtatgtgaatacaccaagatcaagctctgggattctttcacaaaaaaatgtccttatagggccaccactagaaaaagcttactaggccagacattctatttctctcactaattttaccaaatgaattttaccaaacctaagtcattctaattttcttagaaattcaatttaattccatcctataaacacatatcaagtgcctcgtaagtgcaagagcataaacactgagaatactgaggtgagcaagactctgccctgtatctcaaggagatcactgcccagtggggtagaccaacatgaagagatcttgggagacagcttgataagtgtaacaatgggataatgtacaaagtacagatagagctcaaaggaagcagagttttaactctctcttggtttggggaaggcctattgactggagtgacatcttggctgaatctgacagaacaattaaaattaccctatgagcaatgagagaatgggccaggcagagggaacacacatgcaaagatacacatgtaagagcatgaaatatggtaactcaggactgctagagcataaagcgtgggtataagtacagggtgaatggtaaaagatgagattggagacataggcaaagaaccaaatcacagtctcctgagatttcatcctacagacttgtgcatccaacacccatgtggctactgagcacctgaaatgtaatagttttaaatcagatgtattataagaataaaatacataccagatttcaagtatgaaagaatagtatctcaataatcttaaaagttgattatatgttgagatgatattttagatatattgggttaaataaaatgtattattacaattaattttaactgtttgactttttaaaatacggctactagaaaatttaaaattgcatatgtgacacttgatcccttatgtagtagtccttgcggttgattcctcaacaactacttcaccccaagcatttaaaccagaagtgattacttctcctgccagcaactggtgtagaaatgggcacatgaccaacccaacccaggcttataaattgagggaaagatagctggaggggttcctggtacagatgtctttgcccaggacacaagaagatcagctctctccttctggatgtggttatactgcacacaacacagagaactcctgtggctatctttctgagtcagaggatgaagtggaggatgtcagagctaagaaatgggaataacctgagtccttgctgacatcattgagctgctttatcaaccaaccctggagctcacccttcctttgaacttcctgttatgtgagataatgaggttcgttattatttaagccaatatgagtcaggttttctgttacttgtagccaaaagcatcctggctgatacactccattagaccataattacctcaagggcaagggaatacagatactatcacttaagaccatctcgtactgcaaaagctctgtacatagtctacaatcaatatattattgttgtgataatgtatattggggtaatatgtgggaaggctttccctttcttagttctaaaatatcattagttgtaagacattacagcctaatgactcaggcgaggagaattttaattaatcagagaataacctacaagcagaacttaatcaaaactagaatactcattagatttgtaaattgttacacttcatgaatgtcctttcattaagaggcctgacttgaatcctagtcaaagcatacacattggaaacaattcagcttaattttactaatctggacataaacccttaaaggtgatttagcaaatatacaactgctagagtttatacctcattattctgagaactaagcaaaataatgtacggagagcctagcacatatgtatatgtatgtatacggtaaacatactacatatagatttggttcttgcttattttctcttgtagaattggatttttattcaaaatacaaatggttcccaacttacaatgattcaacttatgattttttgactttaaaatggtgatacacattcagaaggaactgcatttccaattttgaacttcctgggctagtaatatgcataccatactctcttgagatgctgggtggcagcagcaaactgcaccttccagtcagccacttgatcatgaggaaaaacaactaatgaggtaggctaagctaaactaaactatgatattcagtaggttaggtgcattaaatccattttctacttataatattttcaatttagatgggttgaagagcatttgtaatatatgaaatatgcagtcatttactctatgtggtaatcttgcttttgttgactagaagtcagattacagtaaatactaatatacatatgttaaacttcattggctagttaatgcttggttaggtggttgatttactaattcattctttcatgtatatgaagcaagtaagctcaagatctaacctcaacacaataaggcaggcagcaataaaactatcaactagaaattagaagctatagtgtttttactaagctacatctacttacccaatctttgtgagatttggtgatattgacaatgcaatcagaatgaagatgaataaaaaggaaacaaagatagggaaggaagtttatgactttggggctgtaattagaaggtgactaatgtaattaaaggagacaggaaaagatacttagtaacatctaaaagtgatgaggaaacatatagaaagggtgtcatgacagagtcaagaataatacttagtgagttatatcaagctaggagattacaaaaccctcctgaactatcactaagtatgttgcttttaataacatacactaaccaatacaaccaacttccaaataggatatgctgaagaatattgagcaaaaccctcaccagctcaatcttaaaaaataaatgactgacaagttcaaaatttcataagacaattggctcagcaattgtaaatcagtgacctttgtatgcactagtgtctaaaggagtattcctacatacagttattcacagttagctcatgtttgctgagaaatctgtatctgaaaatttaagctatgtttttgttctggacaattgaactaatttgagtgtgaatttctaatatcatatttgttgtgatgaataaggtaaacatgagaatgtcaaaacattctctccaagacatcacgaggacctccaggcaaacccagcctgaatgactgcccactgtctggatgagaattcagggtttcaggatgggaaactctggcctacagacgtcttcgctaaagccagacaggagtgggcttagaccactttttgtagactgataattactttaagaagtctgggccaggtgcagtggctcacacctgtaatcctagcactttgggaggccaaggcgcacagatcacgaggtcaggagttcgagaccagtctgcccaacatggtgaaaccccgtctctactaaaaatacaaaaattagtcaggtgtggtggcgtgcacctgtaatcccagctactcaggaggctgaggcaggagaatcacttgaacccgggaagtggaggttgcagtgagccgaaatcacgccactgcactccagcctgggtgacagagcaagactttgtctccaaaaaaaaaaaaaaaaaaaaaaagaaaagtctgaagcaggccttaactaatcactggcatttggagaagctctaaaccaggctatgggttaaatttagtgcattccaaggtggagccaacacaccaagagagcacaggagaggcaagaggatggcatccacattttctcagaatcaggactgcatacgagtacgtgataaagcaatgaatctggctgtttttttaacattaggcttaatctagtattatctatatacagtaaaatttaccctttttagagtgtagttcagtgaatttgacaaacgcagtcatgtttctaccaccacaattaagatgtaacacatttccattacctcccaaaactccctcatgatactttgtagttaatccctctccatacccccagcccctgcaaccactcatctgttttctatccctatagttttgatttttccagaatgtcatataaatggaatctatagtatgtagcctttcgaatggtttctttcaccaaccatcatgtaactgacaacaaggccagtgagactcggacacaactgatgaactggaaagtgggaggaattgaagttggataagtggagggggccaaatcataggagtttgtgtgccatagctaaattttttgcattttataggaggtgtgatgggaagccactggaaggttttgtgtagttgagtcaggtaatcagattaatttttcacacctataatcccagcactttgggacgctgaggtgggaggattgcctgagcccaggaggctgaggctacaatgagttgtgattgtgccactgcactccagcctgggtgacagagcaaaactctgtctcaaaataatatgtgaaagagagactacagtggagcaaaggtagaaaaaatgaggctaatttagagactgctgcagtcatctgggttaaaaatgatagggacttaaactagaatggtaaaattggaggtggtgagaagcagtcaggtcagagacataatttagaggaagagatgctgggacaaggtgtagcatgtgacggggactaggggttcaaggaaagctccaaggatggtctgagcaacaaggtaatgatggtaacattcactgggacagaggaaaggacagaagaggtaggagcaggcatggtagggggacgcagggaacaaagagttccataaatttgggcatcatcagcatatagatggtattgaatctttcccctgatcattttgcatatccgtatcaacttctgatagagaaatttcacttaacagtctctgtcctgttaccctttaatacagcaaatgaatgcaccaggtaatgtattcaatttccacttcactaagttcctagagttacatttttaaaaaataagaagataagctataaaggctcaagtctagagagctcttccatttcttgcctttgttttccacacaggtaagaacaacctgtgtttcataagaaggaccacttccaaatttcacatatactttttttctcagaataccaattctgtttggtcaactgcattgggccaaatggattatgaatagaaactttaaaaaaatgattacaatttttcttgctttaaaatgtttccctatttactagcatttacaaattaatgggtgaaaaagcatttagtggtccaagttttccaccttatgagatcaagttgatgctgctacggtgaaggagtaccttttgcttagacagaccctcaggttggggagagggtaacggcaacataatgtagaaaagccagagggtgtgaagtggggatttactttgtgtctcctttccccagggagcccaaatatccaagaacaagagaggagcagtgatcacaccccctactttctacctcctaggccactacaatagtgtttgatgtacaggatgattattcctgtccaacatttattccagtcatttattcatctaccaatgtgaccatcatcaacacatttcctgaaagtttctatcttaaaatttcatgcaaatttgtcatctataaaatagttgtatttgctttaatataaaaatgtcttaatttatcattgagtgcaattgacattcagttagatatagtgagaccactatgtacagtcgtgcaggtgtacactgcacacctcaatggggtgcattcacaccgcagttattgtagacttattacaaaaattttctgtcagatggcagtaaaatgccttgaggaagaggcactttttttttctaatttgtaaaggtgtcatatgggtgaacagtagccctgaactttgagtaccttggcataggaacttggcacaagcccaaactagcctcattatcttatatatgaagaagccaagtccccaagaggtgaagaaacaaggtcccaaagctagttcaaggcaaaattgcatttgatcccagtctgcactctcactccagtgttacagcaacatgccacctctgtgaacagtgggttgctcttttcagaggtgtgggttactgatgtgctttttcatttctttgctcagccttagaagagacctttccaagagaggtatcccacgctgcttttgacatttgcctctaccatgagtggatacatagatagatataaagttagctacactgtacttgcccagtattcaaaaaggtggagttgctagactgtaagctccatgagagcaagaaccatgtctgacattctcctcatgtatccttagcacctagcatacagtcaatttgtagtttacacaaggaaacataatactcttctgtaagctaatttaggccatgcccctcaggttcctactgcactctcttctacagctagggcatatgtcaatgtaaaaccctgagaagcactggagtggtctctaagctgctttccatattaatatgctacaactgtttatttttggttgggctcattcaacctggatcaggaagatcagttacagaatcataacagcactggaatggatcttgtaagtcatctaacccaactccttcatttaacataaccaggaaacagagttgcaaggaagtaacagaatccatccaggtagctgcagcaaacctatactatggtccattcctaaaactcagattttctgaccaccaattacatgatcttccctaaatatcacaatacttccccaccaatgaatgaataatgattggaaacaaacaatgtcagaggcattgtgaactagaaaggtatgtccttaagaatgttttccaaagtcttgtttgagttggacaatgataaatcatgagtttgagaagatagactctttattctttccaagcaagaagtactagtgagatagaagaaaagaagattagttaggtaagactattagaagtcctcaaatttactgaaaaacggatataaagctggattatagttgttctgtacatgaatggctaatttagaaagcataactggttagtcatacagaaaacatgtatgtctacttactctgactccaagccagaaattctgtgatttaggacattagtttagtctaaagtgattattttaatgaaaaatatgtattctgttgtaaacaggatgtattctcaagctgctatctaaacaataaaaggaatttgtttattaagaaacaatacacttttcagatttttagctttatttcagaaataaacctttaaaagtaaaaacaatactggaactttatttcaataatatcccaagttatgggactaagttgatggttctgaaagtttacacagttgttctacatacagtcacatgctgcattatgacgttttggtcaataacagaccacaaatataatggtgctcccagaaggttacaataccatatttttactgtacattttctatgtttaaatatacagataccattgcattacaattgcctatggtattcagcaaagtaacatgctgtacacgtttgtagtgggagcaggaggctctaccacatagcctaggtgtgtggtaggctctagtatttaggtttgtgtaagtacattctgtgatgcttgcacagcaacaaaatcacctgatgatgcatttctcacaacatatccttgtcattaagtgacgcatcactgtacattctataatacaaaactctttttaacagaaccaaatgagtatactacagcgagactccagtgttatctatattgttttgttgacccttcctctcatatataactattaaagataaaaataacctgtgggacaactatttttcatataaaataattccatatttaaaataataatgaactgcaaacaagaagtctaaaataatttaaatctactatgatatcaatttcccaacacaaacaattttgatttttcaagtctagcagatggtgctagcagataatgtattaaggaaagcaaagctgcatgtgcgcacatagcttccattttgatggccttccatttccgagctgggccataacacagcaaaatggcagtggcatattatacctgatcatggctggcttcaatggagcttccaatagcatggaaagtcatctgcacaggggctaatgtcagacaggtcacacactctttgccactttgtctatcacagtagtgaacctataacagaacacacgcaatccactgaacaccattttcagaggggacaagatgcaaataggtccttttgcaaagggtctagatttcacagaacacactttaaatatttaaaaccttattgaacccctccaatatctgggacttgaattgaatctattaattccatcttaagtctttttgaggatttaagggagtttaggaaatgctatgcaaagtgcttttacattatagctagtagaaaaattcacaactaaatgctatacctatctttcaagtccagctttttataatacatgatccataaagggctcaagcataagcgtaagtcaaagttcatctgattctaatgtaactttgtcaacctgaattttctctcttctttgactccatgtgtatgtgactgccacataattggtactgacactcttctatttctacagtatagtccctacaaaaccactgttgaatatatatcactatatcatgttctgtttgaaattgtgacattacaatcaaattgaattaaattgaaatgatttgtaatgtgcagaccaaaataaagtggtcacaatattatctttcatttagttaaatacaactaaccattattaaagccacatgtaagacactccacatcagaggtaaggtacatggggaagggggaagagtttgagtccgtcttcccattaagaaaatttccatccttccatttatccactgtcaaaaacttccaggtttttaaaattgtaagctaataaagtaaaaagagcatcactttcgtaataaaattaatgaaaatatgcttatagaataaattagggattcctatttattatattagagagaaaattggttttattagctataacttgctcaatttgttaaatgtgtatagatttaggataaaggcttaagtgaaaattttgaatttgtgaggaagaaaattaaaacacatacctgagttagttccttgtcttggtttttattgtatacctgagttattcccttgtcttgggttttattctaattgctgcataatgtccatatatttttattgcagaatatggcctacgtttatttaatcatgtataatatggatctgactgaaaattacaatatgagccctagtctaatggcttaataattcaagttttttaaaccagtagggttgttaagaatggccatcattttccctggaggtagggaaacttcttcctgggaatctataaaagtagtttagagctcaaatcaagtcaacataaaagccttattcccaaagtactataaagattttgttataaaaaatatttttaccaagttaaccttggggaaaaaggtttgacaacagttctaattcaccatcctacacttcctgagcaaattaaaagctcagtcaatgtatacgagttcaagaatgtggaagtgttgtttactacacagcaactaggtataaggggaaaaatgaaacttatcacataataggtttatgtaaaagccaataaatgctggcactaaaataatagcaacagttcacaaccatttatggcatggttaaactattatgtctgatatagtgctattataaaacatgctcttttaaaatttaataaaatataattaccctttcgacaccaactgaaagtctgtatgaaagacatgacaatctcctaaatatacagtgacagtaaacacacttctatgtcagctgacttaatgtagctctattctttctcttagagaaatgaaaattagaaaggacaaaaataggacaattgcagtcaaaaaaataaactttaaacttcgtttccatcagtgactcagataccattaatgagacatataatttttctcccaactgtatacaattcactgtgaagcctgcaagtactaataaaacattgtgccttacagacattcaatattagtgtgtttacatatataactcatatatgaaagataaatgtaaaggtgcaagttagcacacagctccaaagatgtcacagcacccaatgatgtgacagagactgctagttgtcctccaagattcttccaccgtaattcttagccaggcacttggaagctcaaaataaaaaaccatattttccaggctcccttgcaactggccatataactaagtagactgtaaaagaaagaattatgtggcagcttcctgaaaacttttaaaagagatttcaagtgcgtgccttttgcttttttacccatttagccaacctgctgtttggagtatagatattatcatcttgactgcgaggacaaaggccaaaacctagatgagagtagtgagttggaagggaactgggtccatgaggacttcatggaacagaaccatcatgccagctgtagcctgcaagcttatggacctttaagtgacaaaaaaataatctctatattgtttaagccactgggctttttatcactcacaaaagaacctaatctcagtgagattttctcctattggcccataactgacaccaagactcatggccaaaccaaaagaagctctagagagctgccaacatttagggctaggctttcccctgaacccccttgtaaaagtcagtacaactggtccaatcacaaagaacacacaaaggaacaaaggatgggggagtacaacaggagggaatcatctggattgtcagcctgatgagaaatacagtatttccagctagtgggtagctctaagagaatagctgatacagagtgggaatacctgcatgaaggggaggctgacatatcactccctggtgggaggcttgctgagaactgaaactgtaggccctttttgaatagaaattttgactgagtttgctgtatatccctggcagtttagaagcacatgaaaatacagaaattgggcttggaggtatctgagagcttattgaaggagtcctaggtaggtagtgtacctgaaaaaacaaaaagataaaggaagatatgatcactgcctacctccatggcctttgaacagcatgagagaatcccagcagaagccaaggggctactcaggccagccaaagtaacactcaccaacagaggaggtcagagcacaaaccactggtaaagccaaaagaaaacgtggctgtccctcagggccagagggggccactgactcaagacacatggacatggtgtacatggaaaagcacaatggaggccaccaggagtggatgaaaccaggatgagtagcagcttcctctaccctagtcaccctctaaccctccagagcagtaagcccatgaaatagacgtaaagtgtgcaggaaggtgtctcagagccaggttaagctctgaccccaccaatctcaaatacatatgcttgagtgagatgaggagtgaaagagatcagtgtacactgtccctcctctaagtctctggagccaaaatgaatggcttgcaatggaagggtatgaacttggagttctacactgatgcattagatttttaaaaactaaaagctagccagaaaactatggaatttgccaaagatatcacaaaggaacatgaatgggagatgtggcaaggcacggaggaagggggtgactggagaaatataaaatcattctgtgttatatccccactgcattgagactgctcagtaaaccagataaaaatatgtagggaaaaacatgaaactcttgcttgaggacccaatttcaaattaaacgtaataatatgctgataaaaggccttaagaaaaagtcacattttacatactcaaccaatgactcataaagacaagttaaatatggctttcttcaggtatatattttcttcctggaaataaaaatatcagtgttcatgaaactgtgaattaaaaaaaatatgtaaatgacattttgaaattcactcttctaagtctaaaaatgcttcttatgattcaaagcatttgcaggaaccaggaatcttagaacactatattaaaataattagggcaacaaaattccattcattgtgtctgtaacacacaaatcttcagaactgactgggtaaactctttctgctagaacaaagcagtgcgtttctacaaacgtggcctgaaaaattccaatacacaatgtcataggaccttgattttgatgaaagaaaaatgaataaagataattatagaaaattacaaaagagtcatcaccctatgttttgtaaaccaacaataaaatcctaaggcccctgcagccaacttaatagaccccctctgagtcaaggggacctcagagaaacctgaaaaactgaattcccagccatgacagaaagggaggttggatatgcgcagtcattttaggcataactaaccaacattaacattgaaatagaggtcataagactgatgaaacatgttatttgtggcaataagattctaagttccaacctgactctaagtttcaaccatagcatcacatgacagatagcagtccctgaaggaaattaaaatattttaccccaatatatatttaaatgacatgccttgaaatggccctgcaaagcagtaccttgtgcggggaacgtgcacctgtacagaaactccattaagcctcccctttttaggcctttcctgggtctaagagattaaatgagagtctgggatgagcatggtggctcacacctgtaatcccagtgctttcggaggccaacaggggaggatcccttgagcctaggagtttgagaccaacctgggcaacacaggagaccccatctctacaaaaaaaattagacaggtgtggtgtgcccaggagtttgaggttgcagtgagccataactgcaccactgtactccagcctcagtgacagagcgagaccctgtctcaaaaatataaaaaattttaaaaatgagagtctggcaactttaagctctgaaaagagacatttaccatctattctctctaaaggctgtcacctatgaggcttcatctacataacaagaaccttggcctccacaaccactccctttatcttaagcatttatttctaaactgacttcaagtctttagacaaagcttaatactttcaaccaattgccaatcagaaaatctttgaatccacctatgacctgtaagccacgcacctcctccactccccacccagccccttccacagcttcaagatattctgcctccttaggttgaaccaatatgcaccttccatgtattgatttgattttacctacaattcctgtctccctaaaatgtaactccaacacccagtgcacactttctcaggacctcttgagactgctccttgggctatggtcactcattggcttagaataaacctctttaaaaatacttcagagtttggtttatcaacagtttaagatttattatttataaattaaatcattttgctgcctttggtactctaaaatgtgagcaaccaatcttgatttttataatgttatagagcttcttctggatttataacaccatcaactactataaattgatattttgtttctttctcatgaatttacaaaaactattccactgaaaggtgagttataaatttcaatatatcaattaaataagacggctttctttgaaatttgcaaatctataacttttaagataagtttcctagtttgatttgtaatctcataaacccagatgagatactatacttgagatggtatactaagtttcctagtttgatatgtactcttctaaacccagatgagatactatacttttgcattctgatattgactttgccagtctaaagacttccttttttctgaagggaaaatcaggaagtattcatagaatcacttgaaatattcatagaatttaagaaatagacaaggcactgtggttcacacctgtaatcccagcactttacaaggccaaggtgtgaaaactgcttgaggccaggagtttgagaccagcatgagcaacagagagagatgagaccctgtttctgtctgaatgaatgaatgaatgtcttaaattacataaaatgctaggtgtgtgaatttttttcatgctgttttgaaaatatgaggggccatccaaataaaaatttaaatttcctacccccagctccgaaaagaagttgagtcaaactacttcctgcagagctaaaagtccttgatgttgcatgactactaattttactaatctcagcagggaactgggttaactgcttgtctgtcggatgtttttaatggccaccccctatggaacaaaaatgaggagggtataaaaaagacctatgtttaaagaaagttgcctgttagatcattaaggtatgtgatacatagcacaatcactgtgttaagaaaacatgtatttgattagtacacctcagatccattaactgtggagttgacttcacagcagtaggtagcaattccactgtagctactgcacagaagccttgcacagaagagtacaggcagcaaggagctgaagagtgacagttgaacactaaaccttaggagattcaaaacatgcttgattttcgcaacgtctgcacctcagttgtacaaagttgtacaaataaagacccaaatcttaagacaaaatagcatgttcttggcaaggcacaaagcagctttctttcataaatattgacctaaataagtagattaagttggtttcaaaactttactactttttttgatcacttgatgacatgtaaattattgtatttatttaactacagtcaacagtacaaatctacatgttagttctatttataactaatgaattaatgtataagtaaacaaaattaatttaggcatgaaaagtatacagaactgtagctagctcatgattagcattaataataactatcagatagtcttataacacatccactcataatgtaataaaataaattacaagatatataattattgaaagtaatattaaagagaataatatctgttactgtctcttcagttttttcccagtcctttccataactaacaaacatcacatccactcctttgtaacaaaaatatgaacatacatttaacatgcttggtcatgtaccagtgttttagttgatgcataatgtttcactctaaatgcaatatgcttgtcacattaatgcctctaaagggacatggataaataaatgaatgaaattacattacacagactgagacacaacttggaattatcttttctctcttttaaaaatcctatgttttagataagctttgaaaattacatgcttatatttgataatcaaaatctggcagtaatgtataaagatttttttgtgcaagccacggataaaaattgtctaacaaatgaaacagatgtgttgtcagcgttgtttagggggataataacattcttactgtaagtgacaagcatgtacatgacaaaaatcctaaacatttgatctttgcttttttttttgagacggagtctcactctgtcgcccaggctgaagtgcagtggcgtgatcttggctcactgcaagctccacctcccgggttcacgccattctcctgcctcagcctcccaagtaactgggactacaggcgcccaccaccacgcctggctaattttttgtatttttagtagagatggggtttcaccgtgatagccaggatggtctcgatctcctgacctcgtgatccgcccacctcggcctcccaaagtgctgggattacaggcatgagccaccgcccctggccgttctttgctttttagtttccattaactatgccagtgaaggtctagggagacagctagttaggacataaattacacttacacacacacaaacaattattttagttttacatttccatcgaaagaaaacactaagtgattctttaacagtttcatgtctaccagaaaaggcacttccctattttgcagtgtgcacccatgttttgacatacctatatacatcatttacatacgtaaaagaagccacattaaacggcagagggctttgtaaagaattaaccttttaataagaaaaattattttcaacattaaaggaaaattgtggttacacaggcagtcagtataccatcaaactaatacaaactcttctctctatggggcaaactctactatttctaatgtattacaattctattgtattgaatatcacttcaaaaaataggtatcaaacacaggaccttacaaatcttattatatactgacttaattcataatggcatttaatttttttaaaaaaaatattttaacatggtgctttctactcaggaattacagattttcaaaatgtataatatatacttgaatttaaaatagttacatttatgatgacagaccatttatgatttccacatccagacaagatgagatagattaactttttcttatttttcctgcttaactacaaaaagctctggacgctatatataaaataagcataattccaaaatgtggagagaaggaggaagactgactagggtctttgggacccaaggaataatacagtagtgaattcctaagttttctttttgctttacatatccttggctgggtaccagaaaagccagcaacttgagaatgccaatgggtacaggtggggaaaaaaagccctaagaaagtctgctctttctaaccaaaggaccaaaaaaataataatataacaacatataaatcttttaggcaataactgccctactccagggaaacaccatggaaaaaatggcagatccacctccatccccaacagcaaaagtcaatttggaagcctacactttcaccttaccagactgtaatgaggcgacccaatttccttgctaaagttgtgacagagaaggccaaatggggagttaggattttcatccctgttggatccctggacagtcacctatacctagtgatgatggggcgtcgtactcctccttgccagggtggtgtcaatagaggcatggtggaaggtcaggactttcacccccacccagctgtaacaatatccctcctcccaagaagatgtcaacagaggctaggtggaaaatgtgaacttccagtaacaaggcagcacccctattccctaactggtacaatgtcagaggagccttactgaaacagaaattttaggaacatagtactcaaaatgtccaaaattcagtagaaaatcacccttataccaagaaccagaataatctcaacttgaatgagaaaaggcaatcatcagatgccaacaagatgtcacagatgatagacttatctgacaaatattttaaagtagccatcataaaaatgtttcaataagcaattacatacacactcttgaaacagattttaaaaaatagtctcacgaaagaaatacaaggtaactcagtagaagggcttcatagcaaaatggaaagaacagaagaaagtatcactgaacttgaagatagaaaaatataagctccccaatctgaaaaacagagaaaaaaagactgagaaaaaaacaaatagtgcttcaagggtctgtgagatcataacatctaatctgatgacttgtgtcatcagagtcccagaaggaaaagagatgagtgggactgaaaaaaattcaaaaaagtaacagcttaaaatttacccagttttggtaaaagataaacctatacctttaagaagctgggtaagccccaacaggataaaaacaaacaaatcaacagacaatcaagcttctaaaaattaaagcctaagaaaaatcttgaaagaagtgagagagaaacagctcatgacctacagaagtaaaagaaagacagcagtttctcaacagaaaccacggatgccagaaggaacaggcataacgttttccaagtgctgaaagaactgtcagcccagacttttatatctagaaaaaatatccctgaggaagaaaggaaaacccaaaacattctcaaatacaaggaaacagtctgtcaccagcatacctaccctgaaacaatggctaaaattaagttattgaaacagaacggaaatgataaaagcaggaagaacaaacatgaaaaagagtatgaatattggtaaatacaacaggtttcctttctctttttgaagtttctaaattatatttgacatttgaagtaaacactatagcactgtctaatgtggttctaaaagcatgtagaggaaacatgttataaagagtcacatgaagagcactaagatgggcacagtatcacttctgtgatagtcttaccaaaaatgcacaacctcaatctaatcatttgaaaacatcaggaaaactcaaattcaagaacattttacaaaataagtaactgattttcttcaaaagggttaagattgtgaaagaccaaagaactgatacttgattggaagagacttgagagacttgacaactaaatgcaatgtggatcctagactggattctggaccagaaaaaggacattagtaggaaaactggcaaaatttgaataaaatctgtacattagttaagagttttatatcattttaaatttcctggtagtgataattatactatggtaatataaccagtaacaataaagtcagtactattttttttacttttctgaaagtttaaaatccctttttaagggccatttacaatacgaaataaaatcattagtgctatgaattaaggagaattgaaagtagccaagagcctattaagaatagataataaacttaagtgtttctttgcatgccagaattttatatttaaagagtcttcaatcaatgaaagaagggaatctgtggggactaaattttctcttaattagaaaaacaaagtcagtggggcaatgtggtactgtctacctctgatatggaaaggaaaaagggtacagaaaaaatttctagtataaaggcctggagacttgtaatattgaaagcttcatgaaaaagaagagtaaaagctttctccttaagtcagagttttagaaaaaaaaaaaaaatagtaacataggcctatgcatgagaatcatagtaatggggaccaagaaacttaaaccaagaaacatcaatacttgctacttgatttgcaaaagataagaagaaataagttggtgcttaaactacaaatccaaattggtagcaaataccactacttatgacaggttcttttttagatagtcctatttttactctaagaaagcatttctaccactacctcaactttctcccctatcattcacttcaatgaaaaaagtttgcactaaagacaccctaacagggaacagtaaccacataaataccaactctattaggtttttctgtgcagcatttgacacagaatttgatggagagtcaggagaggctactgccccagaaactaagagaaaagaaagtccaagaagaaagaagtttggatttgagtccagccagattaagtgcctcagaaaataaaacgcaaaactattcagaggactgtaaacagaatccaaagtctctataatgtattattcacaaatgttaggatgcaatccaacattacttgccatagaataaacagaaaaaggtgatttatactcaaaagaaaaggcaatcaatagacaccaaactcaatacatctctgatgttgaaattatggggataaaaacggtgtttaatgcacctatgctaactatatttgagcatgtaaaggaaaatacatctgcaattaatgaatggatataaaatctctgcagagaaacagaaactaatgaaaaggaccatatataaattctagaaatgaaaaatataattacgcaaaataaaaaaaaatttactggattaaggagacaggagtcactgaacttataggtcaatagaaattgtacaatctgggccaggtgtggtggctcatgcctgtaatcccagcactttgggaggccaaggcaggtggatctcttgagctgaggagttcgagaccagcctgaccaatatggtgaaaccccatctctactaacaatacaaaaattagccaggtgttatggtgggtgcctgtagtcccagctattcaggaggctgaggcaagataatcgcttgaacctgggaggcggaggctgcagtgggctgaaattgcaccactgcactccagccctgggcgacagagtgaaattccatccccatccaaaaaaaaaaaaaaaaattgtacaatctgaaactaagaggaaaaaaatgaataacgcctcaaggaatctgtgggacaatatctaaaatgcatgtaaatgaagtcccagaaggaaaaagagagaaaaaaggagacagaaattatttagggaaaaaaatggccgaaaatttcccaaatttgattaaaataataaatatacagattaaaggaaaaaagagatatacagtgagatgaacagtgtaccctaaaagatatatccaagtgtgtagccctagtacctttgaatgtaaccttatttgaaaataaagtctttgcagatgtaattaaagacctgggaataagatcattctgaattttgggtagactcgaaatctaataacaagtccccttataagagacagcaaagaagaatacacatacacaaaggagaaggccatgtgaagatggaggcagaaactggaatgatgaatctacaagccaaggaaaaccaagaattgccagcagccacaaaaagctagaaaagaggcacagaacagattcttcttcagagcctctagaaggaaccaaccctgctgacactttgatttcagacttctggcctccacaactgtgagagaataaatttcttttgttcaatccattgtgtttttatgtaaccaattatgtaatgaatatcttacatttagagattttcccaaattttgaattattttatttgaacagatgtcaagtttaccagttagtaattaattagtcaattcaatgaatattttaaaagaattggtagagttccagcttctgacaacaggagaatgaattcactggacaaagtcttttgcagatatcaaagtaaaatatagacaaaataaaaaatatttgaagacactagaatgttaccaaaatcaagcagataccaccagggcagagatttccctggaaagatcaaaatgtatgcagtaagaattatgagttttgacttttttttttccatctgtgcttcttatagttctactggtggaaaactgcagtcttacccactggaggacgcagaggaaagagtttagggttggcaaatgagctagacattttgggaagaaatcccaggagaaagctgcagaagtggcacaactctaaatctgaatcttttacccaaattccagctgactgctaaacttcacatgcacaagggagatcttggaaggcccaatggaaaagtaggcagaaaccagtgagaactggttgagatttgaaagtctgctactttttgaatagagtgcagtccctaatctgaatgcagctcaaatgattgaacgctaaagctttataggcctgtagtatcagtgggtgtgtggctggcagatcagctagaaatttagaggaggaaatgccagaaagaagaaaaggcaaaaaaagtgggccccaaaatataagcataaactcagcccaaataattggctttcactatatgatgcaggcacagaggagaccataagagaaaatgctgcagttataaggtagaaatactgagtagactgtatcagctgagggataccaccatggagaagataaagcttgcagttttagcttaagcaacttaatcaaaaaccaaaaccaaaataaaaatattaatctggggaagaaatgatgatccacagttgcaatatgttatccacaatgtccatttttcaaacagaaactaaagacatgcaaaaatcaggaaaaaggtaaatcacactcatgaataaggcagtcaacagaaattgactcctaatgggcccagctgttggatttagttgacaaaaaacttcaaagcaggtatgatatagatgttcaaagaattaaatgaaaatacaatctcagtaactatacagatatggaatctcaacagagaaaaggaactacaaaaaacaaccaaatggaaatgtcagatgtgaaaaatacaacaaaatgaaaaatttattataggggctcaagagcaaactggagaggatggagggaagaatctgtaagaatccaaaacttcaaggtagatcaatagaaattacataatccaaaagactaaagaaaaataaatagagcctctgaagcctgtgggagaataacaggagatttaacacatgtgcaactggagctctaaaaggaaaggagaaaaaggtagaaaacttttttggaaaaaatagtggtccaaaacattccaaaaatggttaataaaaaacaccattttttaaccattattttacagttctaagaagctaaatgtatcccaaactagattaaaaacactcctacatgtaccataatcaaatcggtgaaaaacaaagatatacaaagtatcttaatgctttaagtattaagaggagagattccttgcttaagcctagacaaaacacaacatgacatacatggtcctgtaacaactggctatcctatgaggaaaaaaataaatttcaactcttaccccataccatacattaaaaattaactttaagtgggtcttagcattaaatataaaagctaaaagcattaaatgtccataagaaaacttaagataaaaagtctttgtgatcttaggggtagtcaaaagattcctcagattagactaagaaggcataaaccttaagggggaaaactgaaaattttacttcattgaaatggaaaaacctctgtttttcaaaggatcacgttaagataacaaaaagacaagtcatagggagggagataatatttgtaatgcaaatgacttatggccaggatacaaagaacttgtgtaaatcaataattatgggggaaaatcccaattagaaactgagtaaaagatgtggacacttcgcaaagatacacaaatgaccaataagcacatgaaatgaagctcatatcatttgtcctcagtgaaatacaaactaagatatcaatgagacaccattatactctcaataaaataagactgaccatattaacgtgtacaaccctcacacattgctggtaggaatgtaatgtatgtaatacattaaaatagaatctgaaagtttcttataacattgtatgtacacttaccatgtgatccagcaattcactctaaggtattttcccaagagaactggaaacatatgtctgcacaaaatattgtaaatcaatgttcataaacagctttatttataatggccccaaagtgaaaacaacccaaatgtccatcaacaggcaaactgaaacaatttgtggtatatatacataaaataaactaattcttagcaataaaaactactgatacatggaacatgcgtgaatttcaaaatatactgagtgaaagatgccagatacaaaactgtgaatactgtgtaattccacctatatgaaatcagtgaaaagacaaaactaatttttagtgccagaaaggattttgtggttgtctggaggtgaggaaaatcggcggcaagggcggaggcaaatcttttgcaataaagagtcccatcttgattatggtggtagtatacattttggtgactatatacatttttcaaaactcatcaaactgtacaatatgggtgtgttttatcacatgtaaattatacatcaataaggttgattaaaacacttaagtgtagttatctctgacacaactgaagacactaagtcatggtttatattttgcataatcataagtaacctcacaattaactaatttccaagcaactgttacattaggagcttaacaccatttgaatttattgtatgtgttcagatgtgtttatctgcccttgcacctacaccaaaccctcccctcttccacactaccattctgatgttagctcattgagggcagaaaccctggctatcactttcatgttatatactcagtgccaagtcgtgtacctggtccatggcaggtgctcaatacacactggttgaattcatgaataaatgaatcccttacatgttagtatgcttctggaatctcttgtaggcctttgtccattctccctgggcaatattaactgtttctatggcttcagttatatctatacactgatgactctcaaatctgtatgtaccatgttctcttactgatcaccagaccgatttcaactgcctactggacaaatccatgtgaatgtcccacaagcaattcgaattccacgtttaaaatggaacttgttaagttcctctaagtttattcatctcatccatagtaaaaataaaactttgcctaaacatctcacactcatactatctcacttactcctaaaatggtctctacttacttttcaacatatgtaaatccagcttccaccctaaccaggccagtgaaagcatcctctctgaagtcagcacaagagatcatttaattttctcaattgaaccttagacaactgtaccctagatccactcctccatgcccaacagctttgtcttaactcaatctttattctttctttcctggattcatgaaaaaccattctaattggtctttctattatcaagtctgtctctttcttgtctagttcatcttgtacactgctgacagaattatctttctgttaaccaatcatgtcacatctcttttaaagataagtcagtggtctttgtctaatggctaaaaaaattctaactcccaacaatacacacacatttttttcagcctcctcactagccacttccactttaaattattttctaaaacaccatgcccttttatgtcttcagtgctttgatgcttctgcctataattccttttcttatccaccttaaaatctgaagtattctttaaaacatatttcaaatattccctctgctatgaactcttccctaattccttcagccagaaatgttcatttccattcacaattcttgacatcactaaccacacttcgagttaacatttatcaggttatacttactatgtcatttattatgtggggtaggcattacaaacattatttcttgcaccatgctacaaacatttaactatttttataagaccattgtgtaatgtttgaacactgatcccaggagacaggatttgtggccgtgggttatcttcttctgcatattgattttatttgcctgtcagtctccaacttgaccataactccccgagtccaaagtttagcatgtttagcaagtttagcatgctacccagcatttgtaggcctttaatgagtactgcccagtgtgagcaaacaaatgttccatgtcctgtgcttcagctgaatcagttccaatgttcaacgggatggcattctatgggcagattaacttcatatccatctaattcttcatatacatgctgaaattatggaaacctcttcacaatatactatctaccacctatctttcccttagtaagagtttttcaaactgtaaacctagtactgttttccagcaatggttcaaatgttccattttaggacttgattctagactttattttgagacagagtcttgctctgtctgttgtccaggttgtattacaggtgtgagccacctcatccagcctgtacttttcttatgcttttaaaaaaatagataatactacagataaaaaaaaaatttggaagtttttcaagtatgtgttttctctgacagttaaatctgctttttgatgtgactatattaagatggcagaactttctagaacctaaaatctgtcagggtttaaaatcaagtaaaaacaagtaaactacattactaatatgatgtttgatgtatgtattcccaaatgtgtttacatataaaattttacattagaataaaatctaaagtcccttccatctcaaaggagtcagaattcttttttttttttttttaatatatattttttgagacagagtctcacactgtcgcccaggctggagtccagtggtgcaatcttggctcactgcaagctccgcctcttgggttcacaccattctgttgcctcagcctccctagtagctgggactccaggcgcccgccaccatgcctggctaattttttgtatttttagtagagacggggtttcaccgtgttagccaggatggtttcgatctcctgacctcgtgatccgcccgccttggcctcccaaagtgcagggattacaggcatgagccaccacacctggccctattgatttttttgaaacagggtcttgctctgtcatccaagctggagtgcagtggtggggtcttggctcactgcacttccgcctccctggttcaagcacttctcctgcctcagtctcccagtagctgggattacaggtgcctgccaccatgcctggctaatttttgtttggttttctttttttttttttttttttttttggtagagacagagtttcaccatgttggccaggttggtctcaaactcctgacctcaagtgatctggctgccttggcctcccaaagtactgggattacaggcatgagccaccatgcccagccaaggagtcagaattcttaaatggcttactcagttgtatatatagttgagggcagaaataaatttattaatgaaatctatgacaaaaacaaaccaatatccagaagactatgggccaccaccacacattagtcctacttacagggactggtcttcaaacattatacaatagctttcttcaaaatcaaataaaagatttgtaggcaaaaacataccaggtattctgaaataatatatgtaatgcctacttcactatgggatatgtgagtccatcaataactgtcagtttcctccctagtttatccatatatcccctaaatgcatgcccctgttatgtcagagcaattttttgagtatgcaaaaatcttttacatgcaacattccacatactgttctttcttaagagttgccttgggtgagaagagaacaatacatatgaaatttcagccactgtcatttgtggggaaaaaaaaatctccttagatatagctggatgctggagaaagggaaatgctggactcacttcaacatgacttggaatgagtgtaggtatacagctgccatccacctgaagagtaccataattaattatatgtcaggaaaaattacatcattgtcaatcgtttctagcaaaaggaaatgtaatgcatctttagatgaaaaataattttttccttcaaatacttgatttttcaaataattccaagtagtagaattttcatgttgagttgaaatctcttctgatacaaacagaaaaggttatcagatagttctacttggaaaggacacgaaatgataatcatctttttctgtatcatgatggctcatttcagatctacattaaagtttctttggttggaaaagctcttacagtgtttgtatattacttagattttgttgaactatcttgtgtgtcttactatgtatgtgctggtgcataaaggctcaaaataagtatcatagcaacatagtttacgcagtaataatggactgttttgctcaaggcctgcttgattcttacctgtattactgttactcattgtagtttttatatgcaccaggatttctttcttcaaacatagtattttttttttacagggtttaaaatttcagtaaaatgagctgatctacaattctgctggtttttatggaagtacaggtgtgtgttatgtttgcatatcccttggactttggcctgcatatcaaagtctaaggacaccagacacaacaggtcagtttgcatgaactggggctgcccactggaataacaaacctgagtgttaatgtcactaaaggaagaccaagccttcaagagagttctaacacatacttaagtctttccaaggtccttggaaggtagtagaggtcaaattcaagagagctttttaagaatttttaagattttaatggcaaatcagagcagtatctgctgaccaaacccacaaatgtgttttgctcattgtagtctaagtaatttattatggttttatacatttgtttaatagcctacatgaacatttggtctcagaggcaacacagtaagttatgtttcaatgacaaattaaaaataagggaaaacacacagttgggccctccatatccatgggctatgcatccaaatatcaaaaatattaaaaaagaattgaaaaaaaaccacaaaaaagcaatatggtataaccattatttatatagcatttacattatattaggtattataaggcatctagacatgatttaaagtataagggaggatgtgtgtaggttatatgtaaatactacaacattttatataagggacttgagcgtccatgaactttggtatctttgggggtcctagaaccaatccttcctgcagataccaagagacaactatattcctaaatgtgggtgtgtatgtacatgcattatttctttctccatattctcctaagaggaatttacaaaattgtacttgtattgatctcctaacaaaaatgaataccttattctaaaaaaaaaaaaaaagctgctgcaaatagccaccttgatgataactatatggattggaaaacatgaggtataggagagataagaataaataggtgaaaggttgattctcagattctcagggagaccagccaccacccccccacttccaccagccccatcccaatataacctatactaagtcatattgttaaaaaataaatacttaaaagaagcctgtggctataaaaacctgctatcatcatattaaactccacaaaaggaggcatatgagttgaaatgtattcagcgtgaattatatttgaaaaggaagattttaatttaagtggacaatctcatcttgctggaaatggcatgattatgatcaataatgaaatgcccctccataaaacactccctgattttggacaataaactaattatagtttaactaaaacaccaactaagtgtttctttatattatttatgtgagggaaaaaacctagtttgttacactatactcggaaggtttcacaaacaacactgttacagtggatgatgctcacaggagaggcacagaatagcaaactgaaatgaaatccatctagaagggacgatttgctaaaataatccactttcattttcaacctaatttttaatgactagtttaaacaaagaaaccacttatatttatagatttctaatataattagcatagaaaagcatattaaagatgtgaaaacttaaaataatgcaaagtacaacatgaaacaaattctttcacttcagctcaaatgcacagcatttcaagagtgtcttttgcataataagtttctttaaaaagctgaatgattttgaaacattttgccattatagtaaaagtgtacacaacaaggaaccctgaaacactatggtaggactacaactttgaatgagttcttataaaatgtgtagaagttacagaagcatacgattaggctgaacaacaaagtctgaagttcacagaactactgaataaaacatttaaaagaatataaataaaacgtattaatacttgataaaacttgaaagaaataaacattcatttctgacagagatccaaaaggttcgattctaaaatacgataaaaactttaggtgagaccaaacaagaataacagaactgctgagaatgtgtaagtgttcggtcacattctgctctcttaagtcagttttattaataactttaattgtataataattttacctattttgtaggtttaaaagaatttgagcttggatacctacattcagttgatcaaagtagctttttgtaatttataaattcaaattaaagactgggtgatgaaacaaaattaaaagttaaaacaactttgttttcaatacactcatatatttttactttgtaatacaatatagctgtcacatacaatggctctagtaggcttaaatcaaattgcaatgggcaaggaaagccaaagaagggtttacacaatattcaataagcaacagtatctgttcagtgtgcaataaaataaaaaagttctaacctagaaacacagaaaaagaatttattgtttttaagtttcagaaataaaagtaacagaatagtgtataatctgtaacaagctggtcctgtaatttctaaactacagtccaattaaaacatttaagtaatagaaacaatctacatgtttttctaccaggtaaatatacctgagagggttacctataaagaaataggctttaaaacttttaaccacaaagaaccttctgctgcgacattatgaagatgggctatgcatgtggccagactaagtcatttcccggagattctgctcactgcttagctgcaggtagtggtccatcaatgacagagtattttacatcaataccagctcattcaaccaaagaagcacagtaatattttaaaatcacctgtttatattcattagtatgtaaaaatcacaatacacagatttggaaacatataacgtgtccataaaaaagagtatattatgtaagcataagctttttaaaaaggccttagcaatgcaataatgagggaagcagactctacatgttgactacagtgaagatatgttaaaattataattattgtcattgccaagagcttagaaataaaaacaaatttaaaaaattaagacattctggtagcaaaattacagctactgtaacaacagctccaagcaaaaaatcaattcagagcttgaatgcaatttgtgctttgtttctataagaatgcagtgttactctcagacatttctaaatgattagattcataaataagcagttaatttcttttcatcacaatttatttctaattcatcctacggagattatagatagaactaaaaattacttagcttttttccagtactttatataaattgagatcttttttaaacagtgatttattgtgtttcttaaggtaaaacaacaaaaacaaattctaaaattgtaactttaaattaagtggttaaaatttcagatgacagagccgataactggtaacagcttcttgaagttcatattaagagtccaattagaaacactaacaactacctggcaatagtttgaaagaatcagaagggttcggtgaagtgaaaaaaaaatccgaacatgcaaaataccccccaaaacacatgaccttctttttcattttataatctaaacttgtaaaatatttataaatacatgatcattctacacaatacagatcttctagagcatttctaaaggatattacagtttttggtcttaaggaataaagactaagatggaaaaggagatgaaaacagtgaaatctgaggaagcaatacactctctacacacaagcaaactagttcatccagtcaagttagcggttacagttcagtacatgattttcaaggcaactaagaaatcaagacacagatatttccccttcctagagtttacaattctttcaaaagctccaatgtatccataaaggagtgctgatttttgtggggttttttcccagaaggaaacaaagaataaataggggaaaaaaagtttccatccctaaattcacatacacaacaagttaagttaaactataagctagttttagactacccagtgaaacagaattgttggtactatctgaggcaggtgctaccctccctagtcagttcaaaacatgatccagtaaaacaaatacacattgttatgcctcaaacaactataaagcatttcattattcttcaaatatcatgtttaattaactcctaaggtaatagacttctagaatgttgtatcttaatggtgtacctgaatcaatactagcaatagaatgcaaaattcaaaattgctataaaggtaaaatcatcataaaaagaaactcaatccttatgtaaaaaaagggagaactgagtgtgaaatactaacaccaaatgtctgaaggcagaatttttgtttgtggaagacagagcgaagagatagatgcacctaatcaagaccaaatagaagacagtgaagaatatgaaaaatgcttaaaaaagaagaaggaaaatggagaagagacaggcagcaaaagaattactagatagatcaaaaataagagaaaatgaggcatgtgcatatggcttttttgtctgtcctttgtgttcctaaataacttaaaacgtaagtggcatgtaggccatactagcaggcaagaatgagccttgtgatgtatacagatgaagaatctgaggctaatgaattgttttgttttttgtttttgcttttaattcatacctgaaagccttgaatccttgctaaatattccagttgttttgaaggttgtactggagaacaagggggagtaggagaacttccttttaaacctatggcttcagctgtagaagatgttccattcataaggagttccctggcaattgtagctgaactattcgatgtgggagatatactgaagaaagagcttgaaggttggttcatatctttgggtgacaaatagcctagagtagtgccagagattactttgtggcggctggcttccatctcttgataaacatcaggagacaaatgaagaattccttttggagctataaataaaatgaagaacactgttattacacttaaaataaccgaaatagaaacatagcattattaactcaatggctttacttggtgtagtaacaaagaaatgagaaacactgccaaacaagtatctttgtcatactgtagaggcagttgcagcttctattgaaaggtgaataatgtctatttcaattttcctaaaattagaggtttaaaaacatccaaaaaaagtggtttcaatgggacttatgtgtagtagtgaagctataaagggacaagggaaactgaatgtgtggaagtataatggggcagaaaatcaggaatgtgcagtgtcttcaccctgcaatttaatattttatatctcataaaagaggcatgaaaccccaacacatacagcaattgaggcacatcaggtaaaataaaggctgaatcagtccaaatttctttggaggtacaaacgcatgtattcaacagcctagtgatcctctcacctccacaaggatgtcccacagacaactctaactcacgaacacataaaaaagcaaatgggtatcatctcaaaactagcactgtctctaacttgctttgctcatactaccatgtggctgctcatgacccaacctagactcctggcaaccatctctgatttactcataagcaagtagttatcgtgttgctcaaacatctcaagaatatgaccattgtagggattatctagtgcattaattcaagccaggccatggacaggttctgaaatcaagaggagtgggggctatgtcattagttgatggagcttaaaccatattagagaagcactttcctttgactatcatttgtctcagagaagtttcaaaccacatttcaaactgcttattcttatcttttgatcaggtatcaataactctcaaatgatattatcttttaaaattattggtaagtcaccactcataaagaatgtgctctgagagacacaacttaatttcctgttcttgccccttcctctcctgatgctaaccttctgattcaagctttcaatgtttctctgctgctagtattctcagtgtccatttcccaaaatgtgttctataacatggtccccaaataaaatggttccataaataaaaactgaaaataatgcaaattacataatacaaatgccttttgtgaaattaaaaatacacattagcatagtgaagaatcagaaaactcaaagaacaaaaatctattcgacttggtttaactcaggattcctgagtttactttttgtccaagcctttaacatagcatgaataaaacagctaacactttgggaaatgctggaggctagcccaactctcctctgactcagtcatttccaatgacctgtctttgagattgatgaccttttcttctgcttgacattgtctgctattgaatccctctggtaactttttcagtttatggtattttttagctccatgctttctgcttgctactttttaaagttttctttttgttgaaattctcactttttttcatgcattgttcaccagacctcagtgggaatgtttgtaaggattactttgaattctctgtcaggtaaatcacatatctccatttcattagggtcagtttctggagctttatctcattcctttatttaggaaatgttttcctgtttcttcatttttccttgattctctgtgtttgtgtctgcacaaactggcctcatactggagaagatcctaaccaatcagcctggacagagattctggaggcctctcaaacttttatgctagtctaatccactttctttgttcttggcagtccccaggcatcagtcccttgcttgtctcagtcccatcagagctctgagacaagcaagactgaagccaattcttcaggcaactcccagataagttgggtcattggatacatggtgctcctctttgcctctccaggaaaaagctgaaagctgaagcttttcaacagttagctttgtgctgggctgagcaggggatggttacagtgaccaccaccaccagccacctctttcttcattggccccggggttgctaaaatatgccatgtcctgtcagcactctgagactggccagacagaagccagtcctctgggtagccccagaaaagctaaggcattggatgcgtggtatacatctttccccttctaggcagaaagaagctgggagctgggggtggagggtggttgtcctgattgtatggccctgcactgtgaggagggattatggcatgagggtatcttaaatttccctgccaattaagatctggctggtttcatgctcacccggcatacaggagcctcttaactggtttctggatttctcacaaagaaaaattgcctataaattattgttgaattgctgtgttccagggcttcctattctaccatcttgccaaggctagaacattctcttacttaaaggtctttcaccagtttatcagttacactatagaacccaaactccttaggataacctaggaagcccttaataatctggctcctacttatcgctctatcttcatctacgaaatatttcatgaagatcccatgctccagttacacagatatatccaatactccaggctgtttgatcccaacacatctttatttctattgttcggttacacacatgcacatactctcttagttaagctccaactgctattgtgctagttaagcttcaggcatcgcaccaaccaatactgtcctgacctcaagtcatgctcagtctatcaggagaggaacgaaaatggataatacaatgtgataggggtctcactagagacaggtgtatagagcagtgggaatgggaaaggagaagtgctaaaagctcagggaaggcttgctggagatgacgatgacagtaaatttcaaaggatgaggagaatacagtccaggaggaagaggactgagagcagatggccagcaggagcaagggcagggacctggagggtttgtgttctaggaaacctcaggccatgccttatcacaagagcatacagagtcagaattgcaaatgcaggtggaggcacgcaggggccaaggtccagggaactttatcctgatgccattaagtataaaagagttttgtaagtttttttaaaaacactttaaatagcttaaaataatacagacagtcctccgcatgcatgagtcccatatccctggattcaaccaactgtggatagaaaacatttgcaaagagaaacaacaacaacaaaaacaacaacaaaaaaccccacacacaataaaaaataatgcaacaataaaaaaaaatacaaaatttaaaactaatacaatataataactatttacatagcatttatataatatttgatgttgtgtaatctagagaagatttaagtatactggaatatgtgcataggttatatgcaaatatgatgccattgccattttctatcacggacttgagcatctgtggattttggtatctataaggtgtcctgaaaccaattcttcacggatatcaagggatgactgtatatcaatcctattttatgtattttctttattcctttatgttagctttcaaattctctacattaacatgtgttagtttttttataatcaggaaaaaatttcaataaatttttttacaagaaaacattatgtactgaaaaaagttaagataaatctcatcagccagaggacattactttcaacattttgctttaaagatatgtttttaatcctgttttatctatgcactttttagttgttgtttacttgaaaaaacaagttaaatacataggaataaaatatgatcctgtcactgtttataaaacaatatatttctacaactaatactaaaagtataaaatttcattatatgaactgtttcttaaaacaattccatattatcagacatctaatttatctccagttttttgcaattataaacacagtgatgaacattcttgtaactcaatccttattcacatgaaaatttatttcctcaagttagaagcggaattgctagttgaaaggatattttagagtttttgacacttaacaaattgccctccaaagaagctgtaccaatatcagacgcccacagagatatatgaaagtatcttgtttcctattttggtattggaaattactataaaaaatcttaaggctgggtgctgtggctcatgcctgtaatcccagcactttgggaggccgaagctggcaaatcacgaggtcaggagttcgagaccagcctggccaacatgttgaaaccccgtctctactaaaaatacaaaaaattagctggacgtagtggcaggcgcctgaaatcccagctacttgggaggctgaggcaggagaatcgcttgaacccgggaggtggaggttccagtgagccaagatcacgccactgcactacagcccaggcaactgtctcaaaaaaaaatctttgccagttatcaacagtaacagaaagcaggtcagtggttgtctggggagtggagctggtgggagtgacagattgcaaaagggcatgagaaatcttttggtgagatgaaaatgtcaagactgattaaactgtagacattatgtgcagtttattatacttcaattatacctcaataaagttgtaaaaaaaaattgccaatttgacaaatggagtgtcatattactgatttttgttttttactatctgcataaacattatatatattttagtttaaagaataacttaaatgttataattctaacttctatactcaatttaaaaaatcaagaaacttaacagcattacttcagtattgttattatacaggactaatgggtttgccaatagcaatattataaagcaacaaaaatgctctccacactcaagagaggcattacctcacagcataagaacgtggagttcaggctctcctattctacagtaaagcctaagtggacttttcttcacaaataaagattactttctacagagttcaactaacagactagtcatagaaatagcataaaaacatagatttatgtggtcaagaactgaatgacttttaacttgaacatcagtaacagtatttggatgggtgttaattcacttaggatcttcctgttgtaaatttaagtcgcttttcaatagtataaagatctaaaagtagaatcaaagagtaatttagggtatgcatatttaaggaccttattttgctaattaggtttctcccaaaaaactaccccagttcatacttctattagtaggatgtgactgttttcccacacttctcccacaacacgtttcagttactctaaataatcattgccactctacaataattcattgttaatttatttttgtttggttactgctcaggataaactttttctcatgtagctactttaggtctgtgccttctttgacctcaattttgctcatggacttcaaccactacacttccctcgctcaggcttgtaacatccattatattcattcaccctttatctgaagaggtcctgaacccattctgccatcatctatcttttgtccctggttttgcctttgatgctcccatcttggtacagtctataactacagtacacagttacaatgcagatacaacatgggcactgttctagtactttacttctcatttaattcccataacaaccatatgaaatgggcattattattttcctatattagagatgaaaaaaactgaagcatggagaagatatgaaactctcccaaggtcatatggataataagcagcaatgctagaatttgactccaggcagtctgcctctagagtttgaatacttaaccattaccttaaatagcctcctaaaagaacaggtaggaaactaaatgcaacatctcaccagctccaaacccctaaggcttaaatccagtaagtaaatgcccggggtttgcccagattggttccaaggatgacccatgtcatgatggttgtccctagatgttccagagatgagctcaccaaaatctcactgaagtatacagagtttatacatgattttaaaggtctaaagttgccagggactgtgatatcttaacaccaggctattgtacccacttgacatgtttttgctcagtagatctgtgcttctttcagatgggtatatgaatcctctggcacacaaatcttcctggagcatctttatggagctccagttcttactgaagagttgaagagggacttttgaattggagagctcttaaaaggttttataagcgaacttaggagaaccttgcctttcaatgatcactgatgtcatgattctttcagagatgctgaagaagataagtgtttgtgagtagcaagtggtatcagaggtattaaaacacagcaagccaggcagcaagaaagataatgccactgatccaaatggttactgccactccactggaactcccagtttctctggaagtccttggaatgggcatagctatttcacaacaaataatttcttttcatttttcacagaaaagctttgaaaaaaaaaactttgtttccattgccagcttgaatttacgcctcaacaatgttggactataaatttgtttataaatacccaaatatccaataatactcaggcccactttgctacagtgagtttttcacaataaaaaattataattaaaaattcttaagaactagaaacaggggcttctggttcaaaacaggaaatgtgagaaaattatgaacaacagcatgattatctgtctctagtgatttttaaaaatcatttatatgagaactggtaggctctaagtaaggtctgtagtctagttcattgtattatgacaatttcctagttttgaaaatgtactatagttatataagacatcaccactggaagaagctgagtgacgggtacatgcaacctctttgtaccattcttataacttcttgtgagtctatcattattacacttttaaaagtttttttgaaagcaccgttttatgctgctttgggcctctccctcaacatagagaccccagaacagggtggtgatggggacaccaaagtgggaaggactggtggcagcaccattcctagatatagctctgaggataagcagggctggcactggcaatgcctgctccttgacaactttgctcacggcctttgcctaatgcacaggccctggctccccaggctctgggtgcttgacttttagctacatgaaagcaagggagatcctgatgacagtgtgggcctcatagccgggaccttgttctctcccagggtagcctgaggccacgtattagttaagagtacatgtgacccaagggagcctactggaccaccatggtcatgtccctgaaggtcagggacaggtggaatgcatccttggcatgatctttagctactagactgatgtgagctacagaaatcccccttcctgctgccctgttgttgggatcaaatcgaacaggtagtatttgtaagtgactccacctcttcttttacacacagctcactgcaaatctggtcttccagataaggccctcagacccttagttctgcctaatttttaagccaaatatatactacttatgaaatcaaaaatcaacaatgcaaaatataaactcttgtggaaaactaaaaagagaaaatgttagctaacagcaaaacaatgaaaaaataaaaaaataggtaaataatttgttagaggtttcttcttaagatcagtttcagaatcaccttggaaacgaaaaagacacactaaaaaaagagtcattactgaacagatttttttttttttttttttttttgagacagagtctcgctctgtcccccaggctggagtgcagtggcgccatctcggctcactgcaagctctgcctcccgggttcacgccattctcctgactcagcctcccgagtagctgggactacaggctcccaccaccatgcctggctaattttttatatttttagtagagacggggtttcaccgtgtcagccaggatgttctcgatctcctgacctcgtgatccgcccacctcggcctcccaaagtgctgggattacaggcgtgagccaccacgcctggccaaaatgatgtattttaatgtgctcaaaaagcataacctgaacagtggtgaaaatcaaccttgctcttacccttagagttgaacggaagcactgattttattaatttgtgcattttattggtcctttttttcctgctacatttaacataatgatgtatgtgaagggttcttaatttggtgaatgtttatgaataaaattactgacaaagaacttttcaggaagatgtttgccttttggtgaacacagtaccaacgggaaaatgcacttagtccagtcttgcccccaaaaaggcagaatcccaggtcatgacatagcatccagcacacctccaagaggaagaaggaggaatacaaaatagtaaataatacatattcctcaaaacaccaataatgaacagaaataacagcaataaaggtttttcaaaaatgttttaaagatcaatttatgatgaactgggaaatgcctttggaaagcttgtaccttagtcaaataaaagtgcgagtgagttttcaaattcaggactggctgctattttttctttaaaacaggcaaatggaaagtatttaataacaaagaatataaacctgggtatggtgaataaattcatcattcatcttttttttttaaaccttacacaaatgcagtaacttatacttttgccagaaattttctttaacaagaagattctggagcccaaagtgagtcatgcaaatcaaagaacagtctggcacaggggttattaatagtgatccaagggcccctaaatagtttgaaataggttgacttcacaacaagggcagtgcacattgtatatgactcagagtcagtgtggtgcagggaagtgattggggagttcaggaattccccagaagcgcattcaccactcatcttaataataaggaagatttcacttagttggcttatttagaagaaatttttttcaaggctcagcttttcaataaagacacaactgtgactatttctaccaagtaagacaaaatagttgctgtgaaaatgatgtttgagagcaccttgtgaggataatgagtcatcttcaatttttagtttatttaagtggggttaaaatgttgctcgtaaaataaagatcgttcttcttggttatgattcttctcagaaaaactccattagttatgatttccctacgacagaaaaacaccaaaaaatggattatataagtctgacatatgacaaaagtgacctgatctctcagcaggaagaaacacatactgaaatgtctaccgcagcagcttccaaacactgcaccacaatactcctctgccaggattcctattgcttcctagtcaatacctgcaaacggctcacaatacaataatagtacaatacaataacaataataattctggctaaaactcatagagtccttactagatatcaggcttgttccaaatgctttgcatatattagtttagtaatcctcacaatgaccctcaagaagtagggactatgaatattcccattttacacttgaaggccctaagacacaggtgatatgactggcttaaagtcacagccagtaagtggcaggtgttggggcagtatccaggcatctggctacagtcagcaagtataactacctttcagtagtaaaacaaataaaccaagaactactgttcttatatctatacatttaagaagttctgggcatttagattcttgaaatattctaacaccatgatagagacaagaaactgtcaagatattgaacttcatttcttcatttcagacctattttctaggctcaatgaacctcagtctcccctctcatagtaaaagaaaagatggaggtcagtgcagtggctcacacctgtgatcccaacactttgggaggccaaggcaggaggatcacttgaggccacaagttcaaaaccagcctgggctatacagcaaggtgctgtctccataaaaaattaaaactttagctgggcatggtggcatgcacctgtagtcccagctactcaggaggctgaggtaggaggatcccttgagcagaggagttcaaggctgcagtgagctataatggcaactctgcactccagcctggacacactgtctctttaaaaaagatagagagagagagagactgagatttttctcactgtaaaaccacccattgggaaaaatgtaaaaataatgcacttggctattttcacaattttgtttgtgggaagaaaataaattcaaatattaggttcacacaaagaaaaacttaagcacagccttaggatgaaagaacttaacccacaaaacactttcttacaattctccttatatgatctaattatgatttaacaatttactacacattagtctattattcagtctattatatattattcagaaacttatggaagaatccacaatattattaataaaaacaactaactggaactgtataaatattaagtactgggctgggtgcagtggctcacacctataatcagcactttggaaggctaaggcaaaagggctgcttgagctcaggagtttaagaccagcctgggcaacacagcaaaacctcatctcaaaaactgtatttttaaaataatatatatatataaagtacttatccaatttttaaattttcttgtaaaaataacaaattcactttttagaaccaggaaagaagcagcctagcaagaaataaaatttagacaaaacacaccttagtccagccaaatacacacaaaaaaacctgttctcccacttttatctatgtatcaaaggcagagagggactttcacccttgcaaagctgtaacaactctccccaacttccctgatgtggtagtgtcagaaaaaactgagtaggcagcttggactttcatcctagccccgtggtgtcagtggagatcatgtagggacactaaacttctacccccacctagcagtaataggatgccccccacctccgtgctggagtggtgtcaggagagaataaaggagaatcagaactagtgggaacaaggtcacctcactatggtgtcagtggagaccatatggggaccagaatttccactcaatccagggctgggggtaggggaaagggtatggctataacagcacaacatgaggaactctcatggtgacagaactgttctgtatcatatttatattaataccttagttgtgatattgtactatagttctgcaaggtgttaccagagataaacaaggcaaagggtccataggatctctttgtattaattcttacaactgcatgtgcatctacaattttctcaaaataaaatttttattaattattttaaaatttattgtagagacaggatcttgctatgttgcccaggctggtcttaagctcctggcctcccacttcaacctcccaaagcattgggattacatgcatgagctaccatgcctggccatcaaaataaaaagtttaataaaaaagaagtcttgggtgacaccagcaagatggtagaacaggaagtcccagcccttattcctaactcatacattgatttaacaatgatatacagaccaaaatacctttttgagaattccagaatccagttaagaagttgcagtatcccagatgagcacaaagccaagaatggccacactgaaacatgtaagaacaatttcactttacccacaccacccccctaagtcagcatagcttagtgccacatagcttagtgccgggagagagcattccagatcacaacttctcccttggggtaaaggtgagtggaatgtgcatccaacattttacgttttcagagggcttcccaagggactaatttttgtcttgcttcacttggagtgccgacagagccagcatattttggatacctgggatatttagttttcccggcaccatttgttgaaaatgtggtacacatacagcatggaatactatgcagccataaaaaagaatgagatcatgtcctttgcagggacatggatggagctggaggccattttccttagcaaactaacacaggaacagatattaaatactgcatgttctcacttacaagtaggagctacattatgagaccacatgaacacatagaggggaataacacacactggagcctatcgaagggtgaagggtggagggtggagggtggaaggtggaaggaggtagaggatcaggaaaaataactaacaggtactaggcttcatatctggatgatgaaataatctgtatgacaagcccccatgacacagtttacctacataacaaacctgcatgtgtacccctgaacttaaaaaatgaaagttaaaaaaaaaagaaaatatactcagtgggtcctcaaataatgttgttttgttcaacatcattttgttataatattgatgagaaaaaaaatcaaatcccacctgggccactgtcttatgtggagttctcatgttctgcccatatctgcactggttttctccaggtcctccagtttcatcccacatttaaaagatatgcatattaggttcactggcaggtctaagttgtcccagtatgggtgtcgtgtgtgtgtgtgtgcgcacacgcgtgtgcacatgtgtcctggaatggaatgacatcctgtccagagttggttcttgcctttgctccctaagctgctaggataggctctgaccaacctcaatcctgaactggaataagtgggttagaaaatgaatgactgaatgtatacaaatgaatgtaaaattaaaatctgtaaaatgcacaataatcatataatatggtttggctctgagtctgcacccaaatctcatgtggaattggagtcccagtgttggaggaggggcctggtgggaggtgattgaatcatgggggcagacttcccccttgctgttctcctgatagagtgttcacaagatttgcctgtttgaaagtgtgtagcacctcccctgcttgctctctctctcctgctggccatgtgaagatgtgcttgcttcccctttgccatctgccatgactgtaagcttcctgaggccttcccagaagcaaaatcctgaacagcctgcagaactattatccaattaaacctcttttctttataaattactcagtctcaggtatctctttacagccctgcaaaaacagactaatacattacacaaatgcacaacaataaacaatgcagtataaaagtgttcagtgagcccaccatatttgttattgtttgttttttaattgtgtggtggtaggaagtactgcttacaattttcactttgcaaacatttatactttgatttaacccaccaccaccatgactgctatcactcacttattcaccccacattgagtaaacaattatcttgtttttattaaactttcttaattgtacatgtaagctcatatttatttcaatgtttaatattacaatttgggtctttattgagaagtctggtgatatttctctaaccacaaatatgttgtgagaacttaactcttgtttatatcaatcagcctatgataaaactgatttcgttatatgtcatttcacttaaagtagtagtttccaagaacctatcaatgatgttaagtaagaacttactggatttaatttttttagtggtaaagcaaaaaaaagaagtctaatgttctgtattaacacaaaatgtaataaagtaaaaacaacaatagtacattggtaaatgcaccagactggagcccagctatctgggtttgagttgaggcagcagatattctccttatcatgctttcttcatctgtaagatgaattagtcttaaggaacttttcatttctttcagccctaataatctatgaatcatcttaacacaaaccagaaagcttggaataaaagaacacacttgaataacatcacccaaaaagcctgttgagtgttttttaaatttgactattactaaagtttttttaaatcttaagaaaaatcaagtaatgtagatggctgtgtcactgatgtaataatagttaaaacaaacatttcacatagtttctcagccatttagtgtttttacatgatccacccaaatatcaatctggtatctgaaacaatagtttgaacattttccatgtaataaaacatcttaaatgttttataaaaaaagattctggtacatgatatataaaacattctttcaaaaaaatgcgtacttaattttaatggaatttcttaaaaacactattctctttttttcctttaattatcagcaaatgatatatctagaaataaaggtgctgtctagtggcaactgcagagaccctggagtcagaagacatgagttcaagtcttcactacctttaactaagagtgtctttagacccgttataaaatcaactgagcctcaattttcctgtatgtaaaacatgtgaggttggacattctccaaccttttcacacttaagcctccttatgttgtttttcttctatgtataccatgcttaaaggatctgtctttcagacagactgcatttattaagtaataataaatcatctttcaaagactgccaacctgagattcagaacatcttgaggtctgaattcaaataaaattctaatccaaagcaaagcaatctactaagagtaactgtattacttccattaggttgctgaaatactaattatgccaaccattattatattgaatccaacaataccacgctgagaatctcaggtctggatcacacctaaattcctagaattctaattgttatatgttataaactactcaaaagatcattaatacagtggggaaaaaagtgaaaatgcaattcttgcatttgctcaaatactgagcaccaacaatgccagacactgtgctatgtgatttactttttaagattaaaaaaaaggccgggcgcagtggttcacgcttgtaatcccagcaccttgggaggccgaggcgggcagatcacctcaggttgggagtttgagactagcctgaccaacatggagaaactccatctctactaaaaatacaaaattagccaggtgtggtggcatatgcctgtaatcccagctactcaggaggctgaggcagaagaatcacttgaatccgtgaggtggaggtggcagtgagccaagattacaccactgcactccagcctgggcaacaagaaaacgattaaaaaacgattaaaaaaattgatttttttttcaaataatatttgtctctctctcttttttttttttaagatgaagtctcactcattctgtggtccaggctgcagtggcacaatctgtgctcactgcaacctccacctcccaggttcaagcaattctcccaccttggcctcctgagtaattggaattataggcatgtgccacaccatgcctggcaaatttttgtatttttagcagagatggagtttcaccgtgttggccaggctggtctcaaactcctgacctcaagtgatctacccacctcagcccctgaagtgctgggattacaggcatcccaccttttcttactcgctgggggggaggggggagttgggcaggatggtggtgtttatcttaaatatggactcgtctttcaataagcaatttcatctttaaaaactactgaaatcatcaataataccaaaaagggtacattataataaacaaatactttctaaaaaaatgaaagaatgaatgatgcattaacattatacaaagaagttttagggaaactatctgcactgccttcctgaaccttaatagttttcaaccatacagttagttccctgttgcttattttagtgcttcataattgatgctttgactactctcacatctcttatttctgttgccaaggaaggagatttttgtcttttcaattacttgtactccatgtagtacgtgcaagaagattacagaccaagtacatctttattcacatttgtttaaaacacacattactttaaactgactcatgttaaaacacaagaaagactcaatgattaagctgggtgcagtggctcatgcctataatcctaacactttgggaagccaaggcaggatgacttcaggccaggagtttgagacaagcctgggcaactccacaagaccttgtctctagtcgggggagtgggggcaaagctgggtgtggtgccacgtgcctgtaaaattagctacttgaaaggctgaggcaagaggatcccttgagcccaggagttcaagtctgcaatgagctatgatcatgccactgcacaactgacagaattttgctaacagagtgagaccctatctcaaaaaaaaaaagacaacgattaaaactggcacatagatagttagatgaacagaggagaacagaaagtctggaataataccaaattcataatcttagtatatggtaacagtgaactctcaatgcagtggggaataaagttgggtccatactttcagtataagtaacagatggatcaagacttcaagatttcaaaaaatgaaactataagagttccagaagataacttaaaagaaatgttttgattggaggttccaagatggccagataggaacagctccatgctgcagctcccagtgtgagcgatgcagaagacgggtgatttctgcattccaactgaggtaccaggttcatctcactggggcttgtcggacagtgggtgcagcacacggagcagggtggggcatcatctcacctgggaagcgcaaggggtcggggaattccctttcctagacaagggaagctgtgacagatggtacctggaaaatcaggacaccgccaccctaatactgcgcttttccaacggtcttagcaaacggcacaccaagagattatatcctgcgcctggctcagagggtcccatgcctacagagcctcgctcactgctagcacagcagtctgagatcagactgcaaagtggcagtgaggctgggggagggccgtccgccattgctgaggcttgagtaggtaaacaaagcagccgggaagctcgaactgggtggagcccaccacagctcaaggaggcctgcccgcctctgtagactccacctccgggggcagggcatagctgaacaaaagtcagcagaaacttctgcagacttaaacgtccctgtctgacagctttgaagagagtagtggttctcccagcatggagtctgagatctgagaacagacagactgccacctcaagtgggtccctgacccccgagaagcctaactgggagacaccttccagtaggggctgactgacacctcatacagctgggtgcccctctgagacgacgcttccacaggaacgatcaggcagcaatatttgtcattctgcaatatttgctgttctgcagcctccactggtgatacccaggcaaacaggatctggagtggacctccagcaaactccaacagacctgcagctaagggtcctgactgttggaaggaaaactaacaaacagaaaggacatccacaccaaaaccccatctgtacgtcaccatcatcaaagaccaaaggtagataaaaccacaaagatggggagaaaccagagcaggaaagctgaaaattctaaaaatcagaatgcctcttctcctccaaaggaatacagctcctcgccagcaacggaaaaaagctggatggagaacgacttctacaagttgagagaagaaggcttcagatgattggtaacaacaaacttctccaagctaaaggaggatgttcaaacccattgcaaaggagctaaaaaccttgaaaaaagattcgacaaacggctaactagaataaacagtgtagagaagactttaaatgacctgatggagctgaaaaccatggcacaagaactacgtgacgcatgcacaagcttcagtactgatttgatcaagtggaagtaagggtatcagtgattaaagattaaactaatgaaataaagcgagaagtttagagaaaaaaagagtaaaaagaaatgaacaaagcctccaagaaatatgggactatgtgaaaagaccaaatctacgtctgattggtgtacctgaaagtgacggggggaatggaaccaagttggaaaacactctgcaggatattatccaggagaacttccccaatctagaaagcctccaagaaatagcagactatgtgaatagaccaaatctacgtctgactggtgtacctgaaagtgacgggaagaacggaaccaagttggaaaacactctgcagtatattatcccagagaacttccccaacctagcaaggcaggccaacattcaaattcaggaaatacagagaacgccacaaagatgctcctcaagaagagcaaccccaagacacgtaattgtcagattcaccaaagctgaaatgaaggaaaaaattttaagggcagccagagagaaaggtcatgttacccataaagggaagcccatcagactaacagcggatctctcggcagaaactctacaagccagaagagagtgggggccaatattcaccattcttaaagaaaagaattttcaacccagaatttcatatctagccaaactaagcttcataagtgaaggagaaataaaatcctttacagacaagcaaatgctgagagattttagtaaatgggctaaatgctccaattaaaagacagactggcagtttggataaagagtcaagacccatcagtgtgctgtattcaggagacccatctcacatgcagagacacacataggctcaaaataaagggatggaggaagatctaccaagcaaatgggaaacaaaaaaaagcaggggttgcaatcctagtctctgacaaaacagactttaaaccaacaaagatcaaaagagacaaagaaggccattacataatggtaaagggatcaattcaacaagaagagctaactatcctaaatatatatgcacccaatacaggagcacccagattcataaagcaagaccttagagacctacaaagagacttagactcccacacaataataatgggagactttaaacaccccactgtcaacattagacagatcaacgagacagaaagttaacacggaaatccaggaattgaattcagctctgcaccaagtggacctaatagacatctacagaactctccaccccaaatcaacagaatatacattcttctcagcaccacatcgcacttattccaaaattgatcacagagttggaagtaaagcactcctcagcaaatgtaaaagaacagaaattataacaaactgtctctcagaccacagtgcaatcaaactagaactcaggattaagaaactcactcaaaaccacacaactacatggaaactgaacaacctgctgctgaatgactactgggtacataacgaaatgaaggcagaaataaagatgttctttgaaaccaatgagaacaaagacacaacataccagaatctctgggacatatttaaagcagtgtatagagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactaagggagatagagacacaaaaaacccttcaaaaaaaatcaatgaatccaggaagcggttttttgaaaagatcaacaaaattgatagaccgctagcaagactaataaagatgaaaagacagaagaatcaaatagacgcaataaaaaatgataaaggggatatcaccacccatcccacagaaatacaaactaccatcagagaatactataaacacctctacgcaaataaactagaaaatctagaagaaatggatagatttctggacacatacaccctcctaagactaaaccaggaagaacttgaatccctgaatagaccaataacaggctctgaaattgaggcaataattaacagctaccaatcaaaaaaattccaggaccagatggattcacagctgaattctaccagaggtacaaagagaagctgataccattccttctgaaactattccaatcaatggaaaaagagggaatcctccctaactcattttttgaggccaacatcatcctgataccaaagcctggcagagatacaacaaaaaaagagaattttagaccagtatccctactgaacattgatgcaaaaatcctcaataaaatactggcaaaccgaatccagcaacacatcaaaaagcttatccaccacgatcaagttggcttcatccctgggatgcaaggctggttcaacaaatgcaaatcaataaatgtaatccagcatataaagagaaccaaagacgaaaaccacgattatctcaatagatgcagaaaaggcctttgacaaaattcaacagcccttcatgctaaaaactctgaaaaaactaggtattgatgggatgtatctcaaaataataagagctatttatgacaaacccacagccaatatcatactgaatgggcaaaaactggaagcattccctttgaaaactggctcaagacagggatgccctctctcaccactcctattcaacatagtgttggaagtcctggccatggcaatcaggcaggagagagaaagaaagaaagggtatttcattaggaaaagaggaagtcaaattgtccctgtttgcagatgacatgattgtatatttagaaaacctcattgtctcagcccaaaatccccttaagctgataagcaacttcagcaatgtctcaggatacaaaatcaatgtgcaaaaatcacaagcattcctatacaccagtaacagacaaacagagagccaaatcatgagtgaactcccattcacaattgcttcaaagagaatacaatacctaggaatccaacttataagggatgtgaaggacctcttcaaggagaactacaaaccagtgctcaacaacataaaagaggacacaaacaaatggaaggacattccatgctcatggataggaagaatcaatatcgtgaaaatgggcatactgcccaaggtaatttatagattcaatgccattcccatcaagctaccaatgactttcttcacagaattggaaaaacctacgttaaagttcatatggaaccaaaaaagagcctgcattgccaagtcaatcctaagccaaaagaacaaagctggaggcatcatgctacctgacttcaaactatactaccgagctacagtaaccaaaacagcagcgtactggtaccaaaacagagatatagaccaatggaacagaacagagccctcagaaataataccacacatttataaccatctgatctttgacaaacctgccaaaaacagaaatggggagaggattccctattcaacaaatggtgctgggaaaactggctagccatatgtagaaagctgaaactggatcccttccttacaccttatacaaaaaaattaattcaagatggattaaacactgaaatgttagacctaaaaccacaaaaaccctaaaagaaaacctaggcaataccattcaggacataggcatgggcaaggagttcatgactaaaacaccaaaaacaatggcaacaaaagccaaaattgacaaatgggatctaattaaactaaagagcttctgcacagcaaaagaaactaccatcagagtgaacaggcaacctacagaataggagaaaatttttgcaatctacccatctgacaaagggctgatatccagaatctacaaagaacttaaacaaatttacaagaaaaaaatcaagcaaccccatcaaaaagtgggcaaagaatatgaacagacacttctcaaaagaagacatttatgcagccaaaagacacatgaaaaaatgctcatcatcactggccatcagagaaatgcaaatcaaaaccacaatgagataccatctcataccagttagaatggcgataattaaaaagtcaggaaacaacaggtgctggagaggatgtggagaaacaggaacacttttacactgtaggtgggactgtaaactagttcaaccattgtgcaagacagtgtggccactcgtcaagagtctagaactagaaataccatttgacccagccatcccattactgggtatatacccaaaggattataaatcatgctgctataaagacacatgcacatgtatgcttattgcagcactattcacaatagcaaagacttggaaccaacccaaaagtccatcaatgatagactggattaagaaaatgtggcacatatacaccatggaatactatgcagtcataaaaaaaggatgacttcatgtcctttgtagggacatggataaagctggaaaccatcattctgagcaaactatcgcaaggacagaaaaccaaacactgcatgttctcactcataggtgggaactgaacaatgagaatacttggacacagggtgaggaacatcacacactggggcctgtcatggggtagggggctgagggagggatagcattaggagatatacctaatgtaaatgacgagttaatgggtacagcacaccaacatggcacatgtatacatatgtaacaaacctgcacattgtgcacatgtaccctagaacttaaagtataataaaataaataaataaataaaataaaataaaaataaagaaatgtttttaatttcagagtcggaaaggtattatttattatacccaacttacacatgctataaaagaaaagactattttaaaatgtcattcaaatatattaaaaagaaaaaccaaactttaaaagaaaacagagaagaattttcatgtcataaaggcacacagatgcacacagtcctaccaagtaaaaaaaaaaaaaaagagagaaaaagactaaccaatctaatgtccaaagggacatcagatatggttatgtcattcacagaaaaagtatagaaatggctcatagatctaccaaatacatagtctcattcttaataagagaaatgcaaaataaaactatactgaataccatatttcaactatcaaattggcaaagattcaaaactttgatagcacactgtgttcctgaagctgtagggaaacaggaaatctcctacactgatggtagagacgtaaactgctgtctattgacagtactctggcaacatccatcaaaattaaaaggatacatactctgtaatggagtaattccatttgtaggaatttctccaacaaatatgctaccacatacgtaaaattacttatgtatgaggtttttacatggcagataataggaaaatactataaacaatctaaatatccatctgtgaaaaattgattaaataataataaatccctatacatatcaataggaaaggatcttcaggacatactgttaagctaaaataaaatgggtagaacagcatgttcaaaaggctaggggattgaataatatatatttgaatttgtgtgtgtatatatgtgtgtataaaatgtatatacatttatacatatgtatataaatcatatatataaattctgggacaatacacacacaaaaaaccacaagttacctgcttgaaggtcagggtggccactgcactaatgaggacaaaaaatacggagagctgttttgcatttttaatttttccccatttaaaaaccccagtaaaaatagaaaatgaaaaataaaattaatgaaatagtggaatttgaactaaacttcaactaaattcatcatcaaaaatgaaattgaaggtaaaaaacgataaaagatttctacttgttacagcatggaaaattagatactttgaagggccctcccactatgaaacaactggtatttcttgtaaatttgaacttacacatattatattccactcccagaaactcttatacatgtgcacccatagaaatgttcaaaaatgttcataataatattgtttataatcacaaaatcctgaaaatatcccaactgtggaccaacagatgaatggataaatcattatgggatattcacatagtggatgaaatactttatgtaacaaaacaaaataatcttaaattgcaatcttaagtggggggcgggagagggcagaattccagagggcaatataccatacgacgctatttttctaaagtttaaaaaaaaaagcaaaattaaataagtactgataaggactcatttatttgatgaaattatgaggaataaagggtggggcgactacatataaaattcagagatagtggctacttctgctgggggaggcatagccaatgggggatatgaaagaggagaacaaaggtgaaggtaaatatattggtaatgtctagttcttaaattgggcggtgggttcatgggtgttcattatcttgcttcataagttatataagtgttaaatacgttatgcatcaaatattgcctatttttctttaaaaataatagcagttaatgtttcttcacaaattgtaatacactttaagattttataaaactccatctttctagacaaactgaatgagtaattaggagcattacctttattttctccttatgcttactgtaaagtttctttgctaacagagaaaagcaattaagtagttcttaatacttcaactttgaatttctgcaagatatttatctgtgttatcattacagtctgctcctaattttgaaaagactaattttaaacaccttttgatccccatagacctcttagaatacacagtacatattctaaatttcagcatacatttcagaaattgaaatttcattcagactctagaaaactgtttcttcttctttaccttcagaaaagtttcctcaagacttcagtatacagataattctgcttccctagctgtttaaatataatatttatggccgggtacactggctcacgcctgtaatcccagcactttgggaggccaaggtgggcagatcacaaggtcaggagatcgagaccatcctggctaacacaatgaaaccccgtctctactaaaaatacaaaaaattagccgggcgtggtggcaggcgcctatagtcccagctactgggaaggctgaggcaggagagggcatgaacccgggaggcgaagcttgcagtgagccaagattgcgccactgcactccagcctgggcgacagagcaagactccatctcaaaaaaaaaaaaaattatatatatatatatacacacacatatatataatatttatgtttaaatgcagtcagattgtgtatttcaggccaaagtttgtaaatgtaagtgttttaaatattcatttttttctgattataaaaccagtatatgttcattatggaaaactaatctatttttccgtatgttttagccaagccctacaaagaaatgggcctaagctctgtatacttatggctaattcccttcagaatgacaataagtcagagtcccatcagcagcatgtgacagtctgtttccccaacagttggaagtatcatttttaaatccctgacaatttgcgtggatcagaaatttcataacatttatttttaatccccattttcctgattgctaaacattttttcatgatttcttatctgctctttttaaatgtcttcttaagacctttggccattggggtgtttgcctttttttaaaaaattgacttttatgtgtcctttgcatatattcaatttgttgctatgctgcaatttatactgtcatttgcctttttattttcttatgcggctccttgaacttgtttttagcatttacgtatataaatccatcttttttactttatggtttcatccgttgctcttatgcttagaaaaactatcatactgcaatgaataaatgcatcctaaaaatgctcatattatttccatttttaaaaaaaatgtatctgatatctttttacatgtaaaaatgagccaagcgagtttttaaaatcacaatttaaattcattaaatctttccggagaatattgcagaaaaacatgttatctgtgctaatctgattaaaaacttactctctaatttcagattctttttcctttaaatcaatggatcttcagagacagactcaactggtatgactaaaacagaggcaagcttaacattacctctaatcttccttcctagcttcagtaggcaagaaaggagaattcttgtcaatgtaattttttaaagactatagcttctcaccactcaggtaggtctaatatacagtcatcaatgtaaaagaaggatgatatcattctgaaatatttggatctttcctcctgtgttcagaggagaagcagcaattctacctgcaggctcaaatggacagcaatgagaatatgtatgttcccattgctcccaattgcttcagatagccctctatttacgggacctttgtttgaaaacaaccagatattcagggactgggctgcccagtacaagtaacccaccaatccttctaaataagatcactaaaagctggctacattcttacatttctaacacagtatttatgtctaaagaaataattaagttggatcactcagctttatatttacatccaattggctccaactgttttaactgtctcactacaaagtggtttctactatgggaaccccaaagggaatttgttcagggagctctctcaaaacactattaaagaaagtatatattaatctgtcaccttaaaagtccaacacttatatacctcccttctatctcccacccctacccacccccccaaaaaaaccaaaaaaacactagaggttctaaatatagtacatagcatttgggaaaccagcaggcaatctacccaatgtcatatcactgggacagtgtagcctcctggtttcaggatgttcagtgtttaataatacatgcatatgaaacaaaagtgacaaaaatattggtaagtcaactaagatcctaaagaggtcaataagaatgctatctcattccacaagtatttgtctttggtcatctctaatgaacctacaagtgccagcatatttcacaggggctaaataaaactttttaaaaggttaacggaaaaatatttatgtgaaaaatgcctccgaataatcttttagtgggtggatttggcacataccagtgaatacctttgagcttagtccaatcttgaattaagctacagttcaccttcaagaaactatgaacctgcttttaagtaaaagcctgtattaataagaaacatggaatgtgaatacaaaaagagatgttatcagctgaactgtatctaaatattttacaaagttttccaagagccgtgagctgtcagtagatctttaaaattcatgatctttttttaaaaaagttattcattcatctgtaaaaatctagttttttatgtgtacaccaagcataaaattgccctatgctaaacttaacataaacctcacattacagagttatgtgtttttattcttcaacataactattacagtgattcaaaggataaaaacacacttagaatagtctaccttctgctgcatttcagtacaatgaagaaagcctgagcagcacccaaaaactaggtccatattttaaatctgcaggcaatcaagcaaggaaaataaattgaggaaccaggctatgtaatcacaatcacttgcaaaaccatttaaactattttctagttgtaattgttagcagtttcctatgactgtaatcttttaaaaaatatcttccacttaaaaaattaaatgcacatgtacattaatgttttttgtctacttatagttaggtgctatgccagattaaaattcccctctttcccctttccaattctacattcccttttcatttttgtacattatggttccaagctaatttcgtattatttatccaaataatgggtggctaaaaatttgatctttaaaactacaattttgaagcaatgtagagtttaacaaaacataacaaacaaaaaaccatagtgagttagccatttcatgatgacagtgtttttcacaaagtaatatgttaccttttcagatgttattcaaggatgggtaatcattttataaatgttacataattaaagattctcaacattataaattagtatgcataactcttaacagagaaaattgaataataagatgtaaattgagttgttcaaggtcagacagtatgtcagtgaggcagccagcactggcaatctcaaattcctgtcttcccccacatgtgccatcccacaagatccctgctctaacctttgcctgcaaaatgctaactctggtattcttcacaggacagaaaccatttagaatagaatttcaaacttaagaaactgattaagaagttaacctaaatattaccataatatatgaatttaaattaattttcagctaattggtccatcatctgaatgatcaattcctaagcacagtccaacttcttcctaatgttgtatttaagtgccaatgagctggctcaaggggactcaggtttcacttgtgagaactaacccttggggaatgaaacagctacttttcagagctgggctgcccttatcctctatcgtaatccaaggaagggacaatccagtgttcattcaaagaactcttagagcagctttctcacctccttacagctgggaagagataacagaacattcttatttcaaagccttaatctgaaccattgtagaccatgaattcctaaagcattaaccgtctggttaagatttaagctggcttcaaatagttttctcacttctaactttatgtctcaagcaaacccgttatgcattcttacacatttctgatcacttaaactcactggcctctttgtgatattccttcccatgtctgcacaggacagaagtatcccccacttgtcatcccatgagatgtatcccttagcaagttaaaaaaaaacaaacacataaagctaggggccaaaacatcattgtttaatgatggagcctgcaggttatctataaagtgatttcacgttaaaattgtcaagttaataactatttgatctttatattaaaatacataaagtttatattctttgaaaaaaaagtttagtgcctgaatgtaactattcaataataagctatatattcttggtcaccatatgtatgcacaaaccatctgacagacaaaagtataagaatggaatttctggcacgcctacatagaatagtatcatttttataaaagacaagagggaggaggcatggaaggaaatcaacattcattacgtgcttactaggaaacaggtactgtgctaagtactttacataaaactgcaatcaatttcatgtttattacattccctcaccaaatcattataaaccaatatattcaaacatcaaaggaactgaacacaaactctaggaatcctgaactgattccattttttccttgggctatgtgctaaggccatcatattcatcacccctatttatacaggccaagggctcagaagcacattaatttaaattattcccagaaagcagccccaaaatgccattacctcactgaaataattcttttcaagaggctagttttgataatccaagaattcaattcttatgagcatactttgataagaatttgttactaatttcattatacatcaagagacgagccactaatatcaaagactaaaaccatggattacgataatttacagatttaagctttttcagtgcccagaggttgtaaagaagatagatagggttggaaatgggatagactgggtgtttttactagccaaatgttttgattcactgatttacagtaaaatgttaacttcagtgaaatagatacttttcaggaagtgagggagagtattaaggaaaaatgtctaaacgtccaatgtaaaatatcttgatcatatacatttgaaaaaaattagtaaactgaaattgttttttaagtgtttgacaatactgtaagtggaacaaagcagcaattttattcttacacttctgacatttcacttagtgactttaataaaatattaaaattctaatgactcagcaaaacgcaaaaaatgcttaggcaatgttaagtgaaaacaataaaattttatgtatatcataattatataaaaatttgtgtgcataaaaaataattggaactttgaaagttgatttgacagtataatcagcttatagataattacttctttatttttattataaaaattatttttatattatttaaattattttttatatttttatattttttataatgttgtttcaataaaaatggcaactttaaaaaagcatgtgatcactacatgtattaaatggcagtctgtctgcaatggcttaactgtgttaagtgtatctgtgtcttagttttccagctattctgtcagttccaggaaagcaaacaccaggactcctttgtaccctccaaaatacttaacacagcctctcagacccagacagacccaaccaatcccagtgacagctagtcactgagccactgatgaacaccaagtgcagacaacataaaaatgagaacttactattatttgttggttcaggaaacccaggctttggaccactccatcctttgttttcccctgtctgaaagattaaatcaatcgttcaaatccagagaaacaagcttattcaaaaagaaaaaaaaaaaggtgaccaattaagcaaaggcaaagtcctctcacatggttattctgcatattatctctatctttgaccctgggatgatggctacaaaagaaactaacatgaagggtatcatttattccttttctgcacctaaatctacttatgtccttctacttttgtctgatcatgtaaatttataattcaaggcataaagccaatattcaatatatgtattattagaatgtaagctctagctaggtggtgaaaaaaataaatctttttttttttttttgagacagagtctcattctgtcgcccaggctggaatgtaatggcttggtctcagctcatcgcaacctccacctcctagattcaaggattctcctgcctcagcctcccgagtagctgggattagaagtgcctgccaccacgcccggctaatttttgtatttttagtagagatggggtttcgccatgttagccaggctggtctcaaactactgacctcaaatgatccacccactttggcctcccaaagtgctgggattataagtgtgagccactaagcctggccaaaaagtaaatcttattaaaatagtaaataataatcatcaccacaaatgcttaagtgaccaaaagagcttttgtatgattcccgaggtcaaattaacaacctaacaatcaaacatttctgtagacaaaaatgttactatgtccatctagaaaagtcctatggtaagggtcaccaaatactgctataatgacatatacaaaaaatacaaatataaaaaaaataaaaaaataaaaaaatgacatatacaaaaaaattgaaaactaagtcctaactttaagtcctaactttaagcaaactaagtcctaactttaagcaaaacatgtaatattctgacttttgccaaatgattagtgtttggtataaaatacattctgaaatgtagatgctttgaagtagtaagtattcaaatcaaattaataagtgactttagttatattatctttctgtacagctggtaacttatctcttatgatgatcagcattttatatttatgttaacggtcaaaggtcaaatagataattaagcctagatataaacacaaaatacaattgctgcaaatagtttacccatgttcatttttaaaaaaaagttgttcttattgaattcattcctttttaatcatacatcttagggtgacaaggaaatatatagtggcagacagcagaagcaaaactgaaaataaagaatcctgaagagtaagttgacagtatgttagaaacaaccagcagcttcatatgaactagggagcatctctttctctctctaattagctcttttatctctttaaaacacaaattcctgtcttcatcaacatttaccatcctgagagattgctgctataacctttgactgcaaaatgctaacacaggcatccttcacaagagagaaattactatgtaataaaatagactgatagtagtaatagctaatagctaacactgaagatttaaaagtggggttgctaatgcgctaagtgttttgcataaatatggattatctcattttcatcctcacaaaaatttggtaagataagtgatattaacattcaattttacagacaagcaaacagggttagagttcctgtaattactctaaggtcacacagataatatgcacaggtgccaggacatcaaactacatcttctaactagaggagagtaatcatgctacctttgtactgccattatcaggagagaaaaaagaagctaaagaaaggaatgagcaaaaaagttacagattaagtaaaactgtgccatctaagaatgaaaagaaaaacagtgagatgaagaacagagtttggaactattaagaagaatgctctaaaggtacggccaggatggaaaggactactgcaaaaacaaatgagagaaaacagaagtagaccagttccaagggatgaaagaaatttaaaagattttgaaaagcagctaaaataattattcacatgaaaacctggtgaacagaaagaaacaaagtatgttcaatttttcttttacattcctaccatacttttaattttattcatacctccaaaacatagcctgtacttatcaaagtgctgacaactgtttaggttcttagagaaataattacgtttccagaatcctggagcagttctacaattagccacaggattctagtctttctaaacaagtttttcatttttaataagtggaattaataaaatctgttttatttgactaaactaatttcttctattcttaccttatgttacctcaatactatacaattggctggatgtggtggctcaagcctgtaatcccagcactttgggaggccgaggcgagcggctcacctgaggtcgggagttcaagaccagcctgaccaacatggagaaaccccgtctctactaaaactacaaaattagccaggcatggtggcccatgccggtaatcccagatactcaggaggctgaggcaggagaatcgcttgaacccgggaggcggaggttgcagtgagctgagatcgtgccattgcacaccagcctggacaacgagagtgaaactccgtctcaaaacatgtatatattatacaatttatccagtaggtaacatatgattttcatctgagagctatgcctaacttcaaaatttctttcttttaaagatcattgtttgaagagtaaggggaagaggtcaggagagatgaggtcaaagtaattactacgagaacttctctcttgaaaaggagaaacccagcaagcacaaagtacagttcatctcccaatccttactttctgtatttcttctactgtacccctcagacacaaacgagaaatataaaaggagatgatatggtttggctctgtgtccccaccaaaatctcacctttaattgtaataatccccacgtctcaagggtggaaccaggtagagataactgaatcaagtgggtggttccctcatgttgctctcttgatggtgaatgagtctgacaagatctgatggctttataaggggtttccccttttactcggtattcatttctctttcctgctgccctataaagaggtgccttttggcacaattttaagtttcctgaggcctccccagccagccctgcagaactgtgagtcaattaaacctcttcctttataaattacccaatctctagcagttctttatagcaaacaaatataggaggcaacagcaggaggtaagtcaaagtctggaaagtggaaagcagatgaagaagttgtagctagcttagcagatgtgagtaactgaaacctaacctgcagaggaagaagccaacaaagagctcacagtaaggtgatgtgtcacccagaaccctagaaagcctccagaattaggagtacacctggtacatttaaagatgaatcctggaaggggctgaaacagaaagatttgtctggaagtcttttcaaggtattatgaaatctccctatcaactctttgaccccatgcagtcaggtgcctaccccttcctaataggggtttcctgttgggagaggctaaaacagagaggctctggataccaggcatagttgagggtgaaatccatgtgtcaccctgcaaataaggagatgggagttccaaggtttcatactgaaaaataagattccaagactcttttctcatttgcccctcagaagacacatccagggttccaaaccacaggaacagaaagataatgaggagaacagaagaaaaaaaatgcaaaaaaaaaaaaaaaaaaaaatcctcaggcacataagagaaagactacacccattaaacaagaataggaaggcttaaaaggaatattctgagaatgaggaagaactctgggaaatcaaaaataaaatagctgatgtgaaaatgtcagagagggactagaaaacaaacttgaggaaatcttcctagaaaacagaacaacaacaaaaacagaaagagggggagaaaagaaaaaccacaagaccatccataagattggcatctcagaaataaataacagcaaaaataaaagtaaagaaattattaaagaaataagaaatttctcagtttaaagtatatgaatttctagattaaaactcaaatgtccaacacaatttatcaaatacacatataaaatacacatatctcagaacccctgagaaaatagaaaagcatcgagagggaagagaagggtaaaagtttcatatacaggctgaagaatcaggtgttgaaattttaacagcaatgctgggaggtacaagacaagggtgcgatgccttcccaactccgtgaaaatttacttccaatttagaattacagcttagaaaaaaactatcaagtgtgtggcaaatataaaaaaatttcagaccacaagatctcaaaaaaaaagtttacttcccatgtatccttcacagggaaggccctaaagtatgtactccattaaaacaagaaagtaaaccaagaacaagggaaactgtccagaaaatagtcaactcaacaaaggacagaggccagagaaattttcaggataatggtgaagagaagaaccttaacagcagctctgcagcaggcatatcgatcaatctgcaatacaagaggaggataaagagctctaagggttgggtagggtgtacgttgggaaaggaacgaaaaaaactgcatgatgtgcttgactggtaaagactttggggacagaaagatgtagaaaagtgtatgtgtggagtatgtaccagagttaaaccctcattttccatagcagaaagtacatttaatttttttacttttatattacttctcataatatttaaacatgagaaaccaagagatagcacaaactacccatagtggtaagtaataaaataaatagttacaataggtggtaaagtggttgcctctggcaaaggggaagcagaaatggccagtggcagggaaggagaacaggatattttggtattttaaattataaaccttgagtttttatactattaatcttgtataaattctgcctttttatatatgtattattttgagtatgagtactactttgatgaatataatgatcaaatacaaaaaagagtagtcatgtcttgacttcaacaaactccaagatattaagaaaaactctaagatatctgaatgaagaaaatcaagatgcaagaatggcatataaaaaagaggtgaagagagtattccacttttccttagaatctggaaacataacaatgacaaacagccaatctgaaaaagacaattgcaacttttcttgaaccctttagagacctgagattacaaggtaaacaagcaaaatgaattctagtgagtgataaatccttctgggagagataggactcacaaaaatgttaacagctttggcagggcagggatagcagagatgactgccatgaatgtaagtaagaagaaagtagatgaaatgttaaattcttaaagcctgagtatgagctagcatgatagtttagaaaaactgggagctccagacagcagctcttttccattgtcctgccctggattctcagaaggacaactggggctacagctgcagaccagagagagcccaacttggtgcaggaatgcagctggttaatggctgcactgagggataagcacagaaccttgccacttctctaggccattctccaatacaaaacaaaaaatttaagccaccgggggaagggtagaaacaaatcctatatgccgttggggcaaaggcaggaaattctctggtcctaagagctcagtaaagcttcattgcttctgaagaggattgaaagcaaaagctatatgctcctggggaaaaaaaaagatagaaaacctacttgagagtaagacactacaccagtataaagcagaggtctgcaaatgctgggaaatgtacaggaaactctctcatgcccaaactgcccaaaaatccaagataaaatttggttaccacagagaagacagcaaaaacagaaagatccacctctgacatccaggctcacagaatctgccagaaaatgaagctggacaaaaaaatcaagaactatgacacccaccacaatcccaggattaaataataaatagcagcagtctactacagagcctgaagagagataaccccatgccatgacacagcaaagaagagacctctaaacctgagggctgagcagagaaactgtgaaaaaatcctctcaaaacctcacattacacaaagcatgggtaacagcatatcactattgaaggaatttgtagttaacagtgactatggcaataacaaaacccaaaatgaattcagttaataactagactgatgcaaccctcgatccaaaaagtctgagagagagacatatgctgatttctcaacaaatactatttgacttagcctctactatttttctgttgcaaggtccaacactcattcaaaaattatgagatacccaaaactgcaagaagaaataaaccactgccaaaacacagggaagtcaacaaaacagggcccagggatgaccctgatgctagacctttcagaaaggtattttacaacacctatgattcataggttgaaagaccaactggaaaaagcagataacatacatgagcatatggggaatttcagcacaccaatagaaaccacagaacaaaaacataaggaaatcctaaacgaaaaatattagagatcaaaacattgatgtcattattaataatgcattaattcagactgcacacagctgaagaaatattgttgaacttgtagacaaatcaacagaaattactcaaactgtttaataaagaaaatcctataagacaataccaatggtctaatgaatgtataaatggaaactccaaggaaaagagggagaaaacaaggaataaaatatattttaaaagataatagctaagaacttgtcaaaataactgattccatgacatcaaatcacagatccaaaatgctcagagaaccctataaggacaaggaggatgacaaagatgaggatgaggatgaggaaggaagagaagcaggaggaggaagaggaagaggaggaggataaagaagacaaggaaaaggagaagggaagaagaaagaggagggaggaggagaaggaagagggaagaggagagaagaagaacaatagggaaggaggaagagaagaaagaataaagaggagatagaagaaagaggagaaggaagtagggggagaaggaagtaggaggagaagaaaaaacgagagaagaaatgagaagaaggaaggaagaggataagaaggagaagaagaaaaggtggaggaaaaggagaaggaagaaaaatagaaagaagggaggaagaagggtgggaaaagagtacaggggcagaggagaaaggaagaaacaaaaaaaatcaattagatacatcacaaccaaattgttggaaaataaagaaaagaaatatattaaaggctgagagaggaaaaaaaatacatcaacaagaacaagtaagaattacaacagactttacattgaaaattatgcctatcaggagacaagggagcaagatctttaaagtactaaaagaaacaggaaacccagaatcctatatccagaaaaaaataactttcaaaaatgaaggtgattcattggaggcttaaaaaagaaaaaataacgtgaaattttctgctagagcagtcactgaagagcagcagccatagttctgcattaccccatgcccatgggcctcaaccagggcccaaggtgaacaagaatatgagcaagctgaggcagggctgccaccctggacaccttaccaagcacacaaagcttgtgtaagacatcatctgggaggtgtgtggcttccccctgaaagtggcatgccatgaagctgctcaaagtctccaaggacaagcgggccctcaagttcattaagaaaaggatgaaaacacacatatgcaccaacaggaagcaagaggagctgaggcaatatcctgactgccatgaggaaagcagctgccaagaaggtctgagcccccaccccactttgtgtataataaaacctgcaaagaaaaaaaatgaaagtgaaataaagacttttttggcaaacaaaagctgagagaatgcactgcctacagatctgctaaaataagtaatattaaaggaagtccttcaagcaaggaaggggtataataccagaaagaaatttgaatttacacaaataaatgaaggatattgaaaataatcaaaatgagagtaaatataaaaggcattttctgctgattttaatcacttaaaaagataactgactatataaagcaaaattagtaacagtgaattgtacggtttgaaaaatatagaaaactaaaatgtatagccacaataggaggtcagagaaacttagagaagtaacctatgtgaccacaatagaggtcaaaaaagaaaaaaagtaaacagagtaagtgcggggaaaaaaaaaggcaactaataaaatggtgtgtttaaatacaacaatctcaataacttcagtaagtgcaaatggtctaatcaccctaactaaagggcaaagtttgtcaaattaaattttaaagaacaagacccaattatatgctttctaaaagaaaccaatttaaagataggttaaaagtaagcacagggaaaaaaatatcccatgcaaacaccagtcaaaataaaactggagtagctatattaatatcaaacaaaacagatttcagaacaaggaataaagggaaatatccaatagaagtggtcaagtcaacaaagacacaacactaactgtatacatatataacaacaaagtttcaaaatgcataaaacaaaaactaataaaactgtaagaagtagaagtaggaaaatccaaacttatagttggaaactttaacactggacaaaacaagtaatcataacagatacagggcctgaaagaagaaatcaagagggaaatcagaacatattttgagttgaatgaaagtaaaaacccatacagcgtgtatcccagaggtaaaaaaaaaaaaaaaaaaaaaaaaaaaaaaaacaagagagagacaagaaaaacccaacttgtcaaaatgtgtagggcagagctaaatcagtacttaaagaaaaattcacagcattaaatgcttatattagaaaaaagaaagttctcagatgtatagcctaagcttctacctcacaaaattagaaaagaacaaaaaattaaaaacaaaaacaagtgaaggataaaataaagagcagaaatcaaaaaaactgaaaatagaaaaacagagaaaaatcaatgcaactaaaacctaattgtttgaaaagacttaaaattttataaaccccctagctaaactgaacagaagaaaaagagaaaagaaataaatgatcaatatcagaaatgaaagtgagtatcattacagattctgctactactaaaagagtaaagaaatgttatttagattttgccactattaaaagaaaaagggaatgttataaacaattttatactagtaaattcaacaacttagatgaaatcaactaattctttgaaagactaaaactgccaaagttcattcaagcagaagtaggtaacctaagtaaccctatctatttttaaaatctgagtttgtagttaaaaaaccctttccacagagaaaattctaagcccaaaagccttcactggtaacttctaccaaataattaagaaataccaaccaggtgaggtgcctcacgcctgtaatcccagcaccttgggaagccaaggcaggcggatcatttgaggtcaggagagcaagaccagcccagccaacaaggtgaaaccgcttctttactaaaaatacaaaaaatcagccaggcatggtggtgcacactgtaataccagctactcgggaggctgaggagggagaatcgcttgaacctgagaggcggaggttgcagtaagccaagatcgcaccactgcactccagcctgggtgacagagctagactccgtctcaaaaaaacaacaaaaaaatcctgtttttgctggttttaaatattgcttttgccacactcatcaaaagtcttattgataaatcaatatattcagtcctcttatttgatctctctgcagcatctgactaccacctagcagtcattctctattcctttttgcaggtagtctttcctcctcttttttcctgtaccttgcatgcatcttatctactattcaaatcttacccattacatttgtgaaatatctctggagtctttccattcctcctctctaccttcactgtctcagttcagaccctcaatatctctcacctaaacaactctggttgcctcctgactggcctttctgcctttggtttcactctgctcaaatccatgctccccattacttagagttatcttttgaagaatgcaaaccagatcaattcacattcatgttcaaatcttaaataagcatttcttcaaaccttctacttcgcataataacagtgacctcagcttttcctgactttccaggttcatcctctagttttgttatatggttaaaattcctcactccctgcacttaaagaacgatcagctccttgagtgcagagaccaagtctcagtcatcttattaaaatcagtcattttaagtgtctggcatttagtgagtgtgatgattaactttacatgtcaacttctctgggccacagtgccaaatggtcaaacattattctgagtgtttctgcaagagtgtttttgggtgagatttacatttaaagtggtgaactctgagtaaagcagatcaccctccacaatgtgggtagtcctcatctaatcagctgaagggcctgaacagaacaaaacgctgacctccctgggcaagtgggaattttccagtagactgtttttggactgaaatttcaactctttcctgagtctccatcctgtcaggctgtcccatcagattttacactagccaagcctccacaatcacatgggccaattccttaatatatatacacagacagacacacacatacacacacacacacacacacacacacgttgatggttctttttctttggagaaccctgacttatacagtggttatgcaaaaaatgtttttcaaattaatgaaattaattaatgctggttttttgttgtgtttgctttcacttaatttacaaatacatgtctgtgaggagatttattttgacatatttttatagatcactcaccagttttaagtcaatataaatgtgttaagttaaaacaacatatatacaatataaggactatagaaactggaacacatgttaggtttcacgttacaaatacttttaaaagaagaaaaagtgttgactagccaggttataaaaacagaattgaaatctctagcaataatacacagacaaagattttttaaaatcattcaaaagaattgcctagaaaacaaaaaagtacatctaagtgtctttatatatttttgtttctaattctaaacttttaaaatgtgttcctgtagaaactaaaaaaatctctgaaacagaattcttgtgtgagaagatggcctggtctaaagcatattacttttgataaaagtaattagtaagcctgttttgtgaatgttcacataaataaaatgtttggtagaaataatgtctacatatccacagataacaaaatgatacttaatacaaaatggaaataagccaatttctgccaagttatctgccaagttctgaattcagggttctctgcttcccttgtaacagatgtaggtgttaatgatgtcattaactgttgcagaaaaaataggggaccatgaacacaggtcttggcagaaaataaacaacctatgagttcacctttaaatttaaagtaaatagaaaaattagtttatagagtgtctgtccaatacagttcctgccctaaagggataagtcagaatttttatttccagtgttttcagctgtattccaaaaataaaggctaacaacctgtgttcttaaaaggcacaaattaagactgtgtctatatggcaaaaacaaccagtcaacaagttaaaaatgttaaattggtattacataaaatatgtacaaccatacaacaaactttttgtattttctaatcataagattataaatactcattaatatctcatcttactccatatgttattttgtgcttggatcatctatctttgtattgcctcagaaaagttaaaattgacatttactttaatatcagttaagatcaaaatttattaatcactttgatattatgacagataggatacatacatgtaaacttaactcttaccttctcaagttgatcctgaagattagtggatgctttataaccaagttgtaacagcattgcttctgcagcattttttttggctatctttttattaggtcctgttcctgtagcaacttcattgcctaccttcacctgataagattaaagaaataaattaaagaaatacatttatgataaatttaaacaggaagtccttacatcataaagcaattctactctctagcatttgaaaacataaagttcagtccaaagtaaaaatggcaactaagataacatttatgtaatgttgtatatgtacatgaaaaaatggtccttaaagtatcaatggaggattatctcaggatggtagaattttatagaatttttacttccatatatatttatatgctatttgattttttaaacactaaatttatattatttatataagcagaaaaataaaatttacattttaacagcgttcatgttggttatgactacattttagcattcttatatttcaattaataaactgaaaaggctaaaattcatattggtgccatttaaaataatgttcaaattgcaatattatgtaaacattcaagtttacaaagatttatattaaatagttcctgaagagaattaatatacaagtgttcctacaacattatgattaaaaacaaggcttctggccaggcgcagtggctcacagctgtaatcccactttgggaggccaaggcaggaggatcacaaggtcaggagtttgagaccagcctggccaatatggtgaaaccccgtctctactaaaaatacaaaaattagccaggtgtgatggaacacacctgtagtcctagctactcaggaggctgaggcaagagaatcgcttgaacccagtaagtagaggttgcagtgagccacgattgcgccactgcactccagcctggggccacagagcaatactccatctttaaaaaaaaaaaaaaaggcttccaagtcagattgggatatgaaactcaactctattatttcctagctgtacgaactggtacaaattatttaatatctctaagcctcaggtttttcatcagtaaagccggggtaataccaactactgcacaatgttgctttgaaaattaaacaagataatgtatgtaaaccacagcatttaatccatcacaattgctccaaaaaaaagatttttatcattagaactattctacagttatcttctgtgagcaatttatacatgtacttaaatacacatcaaccatacaactataaaaagtaaagtagatagcaaaaaaggatagaattacaaggagaaatagaaaatacacaactatagttgaatttctttttacacagtggtctcagtaagtgattgaagaagtagttaaatagttaatcacaactttggaaattaaacagtgtaattctggtcaggtgtggtggcttatacctgtaattccaacactaggaggattgtttgaggccaggagtttgagacccgcctgggcaatatagtgagaccccatttttacaaaaaaaattttaattagctaggcatgatggtgcatggctgtagtcccagctacttgggaggctgaggtgggaagactgcttgagcccaggagttcagggctgcagtgaaccgtgatcacatcaccacactgcaccctgggcaacagagtaagaccacatctctaaaaaaattaaaattaaaaattaaaaattttataaacaatgtaattccaaattacctaagggcaaaagaagaaattccagtgaaaactagaaaatattttaaataatccatggacatatatcaaaacttgaaggacacagcaaaaggagggtctagaagaaaatgcatagccgttaacagcttacaggagggcaaaaaagtaatgagctaaacatccacctcaagaagtcccaaacatatcagcaaaacaaacccagagaaaatagaagaataaaaagcaaaaaggaaatacaaaacaaagtacaataaagttagaaaagccaaaagttggttctctaataagactaataaaacaataaaccaaaagtaagactgatcaagaaaaaaaatacgagttcttctctgagatgggtatttttaaaaaagaaaagaagaagagaagacacaaataagaaatgaaataattaaaaagggagattaccatcacttctgtagcattacaaaataataaggattactgaggccgggtggagtagctcactacctgtaatctcagcactttgggaggccaaggcaggtggatcacttgaggtcaggagttggaggccaggttggccaacatggtgaaaccctgtcttactaaaaatacaaaaataaaaaaaaaaaaaaaattagccaggcatgatggcaagtgcctgtaatcccagctacttgaaaggctgatgcaggagaattgcctggacccaggagaaagaggctgcagtgagccgagatcatgctactgcactccagcctgggcgatagagtgagtctctgtctcaaaaaaaaaaaaaaaaaaaaaaaaaggaatactgagagcaatttcatgctaaaatttaaaaacatatttagatacaatggaaaaattcctagacaatacagattaccaaattgccacagaataagcctaaagaatatgactaaaactactaatgaaatcaaaccataattaaaaacttcgcaaaaaggactcttcagatcttctccataaagttctactcaatatttaaggaagaattatgctattcttttcatccaaattcatccataaaacacgaaatgagaaatcagtccccaattattttatgagctctcattttgattccaaatcccaacaagaacagtataagaaaatttacagaacagtttcactcatgaacatagatgcaaaagttttaaacagtataatgaataaagcaatatagaaaaagaaaaagattcatgacaaagttaggtttattgcaggaatgcaagtttggtttaacatttgaaattcaaactagaaatcgacatttattcataatgaaaattattagcaaactaggaaaagaagaaaactttttttttttttttttttgggatggagtctcactctgtcacccaggctggagtgcagtggcacaatctcggctcactgcaacctccaccttccgggttcacgccattctcctgcctcagcctcctgagtagctggaactataggtgcccgccaccatgcccggctaattttttgtatttacagtacagatggggtttcaccgtgttagccaggatggtttcgatctcctgacctcgtgatccgcccacctcggcctcccaaagtgctgggattacaggtgtgagccaccacgcccagtagaagaaaaccttttaaatatgataaagggcattttacaaaacacctacagcaaacctcaggaaacactgtacttaatgttgaacgaaactaattagaaacaagacaaggatgttccctattattactactgtttaacagtttacacaaatcctagacagagaaataaggcaaggaaaagtaaaaaaagaagcagaagggaaaagaactcattatttatagatgtgatttcatatataaggaatctaagaaactccacagatgaattataagaattgattagattgtaataagctcagtatgaaaaagaggactgcatttctacattccatccacattcaagtagaagatgaaaaatattaaaaagataacatttacattaaatgaaaatcaaatacctatgatgtgcaaatcttctacatagaaaacaaagtcttattgagaaactttaagaaaaacctcataaacagagcaaaatgccatgttcatggattgaagacaatactaatgtaatagtatcagttctcttcaaattgacctaaactcaattaattgaactcaatgaaaactcaatcaaaattccatatatctttttacaatacttgaacaagatgattccaaaatttacatggaaatgtgaagtgctaagaacagccaaaatccttttgaggaagagcaaggtgtgggacacttatttgtctggatatctagacttattatgaagttaatataaagaaaaaatttaaatttgactacactaaaaattactcttgttcttctaaaagcattatttagaaaggaaagtcacaacacaagaggaggtatttaaaatgccatataactgcaaagggcttgcatccagaatatacaggaggttcccatatatcagtttttttaaaaaacgagcagaaaaatgagcaagaaaagtgggcaatccatatctgaaaagttgaattgttttaccagttatcattttacttaaaaaaaagttagaaagtttcaataatagtttcatgccactttaatacatttcacaatgacaacaaaattcagttttcagctatacagcatgatactctaaccatacttttcttttttgtctattgtgtaaaatcataatattggctgtttcatctgtcccagaacatacagattcccatttggtatccacacttgagtactgttcatcatttattcttacatccttatttacagtttttatttgtgttattatttccaacagtactttttttttttttgagacggagtctcgctctgtcacccaggttctggagtgcagtggcgcaaactcggctcactgcaagctccgcctcccgggttcatgccattctcctgcctcagcctcccgagtagctaggactacaggtgcccaccaccatgtccggctaatttttttgtatttttagtagagacggggtttcactgtgttagccaggatagtctcgatctcctgacctcgtgatccacctgcctcggcctcccaaagtgctgggattacaggcgtgagccaccacgcccagcctccaacagtacttttaagcttcagtgaaccacccaattttaaggaactgggagaatatacaacaaaatggtaagaaaatacaaacttaaacataaacaatgtacaaatgatataaaaaaggtgctgtactctcttttaacagagtttcagtaaagacaaactaaatgacagttcatacagcacatgaaacgctgaaaacatattcattacagaatttctgtaacaactatcacaaattgcatagtttaaacctgtgaaatattttttaaatatttcattgcctttttttctgaaactggaaaccactatgtcgtgacaaatcagaagcagtctttggacctcactctgagaaggacaaatctagtacagtcagaccaggtactcagagccagatgaatacacaccacctgccgtaacagtgtctgcctcaacatggcaggccctatggataatctactcaaatccctggctagagtacctctgctccctgttattttttccaatgctttgtttgttcccccagcttcatcagtccctatgttgctgctggaatccttgctggtgaaaagattaggccagttatgtcagaagcttcctctactgctctgaggcctggtcttggacttgtcagctgtaatgctgttcccattcctgtattcaccttgtctctccgtctgctagatttccatctggcctattctgataccttcaagacttacttcttctaaaacaagtgcttcccagattcatttacccattcacccagcccttgcctcatgcaaattttaataatcgcatggttgaatagtttgtaagcagttatcctaatttgttaatataaaaagaccacattgccaaaggactttcattccctgctaataaacacaatggtcactcaaaacatcactttattataaaagttaagtaagtttataaatttcacaagtcatcttccttgagaagtcacaaattttataactattgtaaatatggtctctacatttaaatgttaatttctatctgtaaagaagctcaattattttaccatgcagtaaatttaagactgccaaatgtttgtctttaaatttaacagctcattcacatgaatcaaatcctcaaaaacctaagaaactaaaaagttctgaaataggatttaccaaaaacttaatttttatttattttttaacaacctggtgatctcaatcacaggctgaaaagttagtaatacagtgtgctgatatgcaatttggtttagttatcattattttctgtttgaaagattaaaatactcctcaccaaaaaaatgaaaagctttaagaaatctgctctggaataaaatacccaaataatgtcatcggagattttctttcgtttatctagtaatcaacataagtaactgcatccattttttaatatatagactttttctttggtaacagataaaaatgagcatctcatctctagatattttgctgccacattcaattataacaaatgataacattgcctaagtagtttatacaaaggccgttactttgataaaattgctgcaatactgtaatgaatccactggggcttccagaaggggaaaaaacaatatgaattcagtgcgaaaacatttaaaagcacagccaaatgtccccatttgactagaatgtttatgaatacccataaaatggaagctggcctaagatatgctaaattcctctttcaaaaggggtactcaatatactctgtagaaaaggatttgtttaataaagccaaagccagtttatattcccaatacatgtctaaaattcaggcgatttttttcttcaagctttggcattcaaagtatatgttccagaattcttcaaagttaagaatgttaaggaaaaaaatagtgaacatattttaccagtgaaaataatgaaacaatcatgtgctggatcctaataacatcttgacaataatgtgattactaaccagagaattcccctctttttggatatctgggttcccaggagtgacttatctatgactacattataagttaacatctccaaaaaaaaaccatacaggcagaaaggcaggcagcaaatatctatcaaatgtttattaaggtcctactatttacaaaccactgtattgggtactgaaagataaagaaacatggagattataaattgggagggaaggcacaacttagctatacacttaaacttaatcaatatgagacactgtatttgagtgccaaaatgtctaccacatggtcagcacttaatatttgttgattttatctaagttacataaaatgtgagatccttggatttgactaaaaagtttctgtgactaaccaattatttaaaaaacagtttgagactaagcacagtggctcacgcctgtaatcctaacactttgagaggctgaagcaggaggatcacttgaagccaggagtttaagactagcctgggctacatagtaagatcctgttgctataaacaacaacaataaaacaacatttaattagctggccatggtagtgtatgcgtgtaatcctaggctactcaggaggctgaaaagggaggatctcttgagcccaggaaatcaaggctgcagtgagccatgatcatgccaccgtactccagcctggctgacagaacaagaccctgttgccccaccaaaaaaaaaaaaaaacaaaaaattaaaaaacagcttggggaaaataataatttaaatatagactgggtattagatgattctaatgaatcatgtctaatgtaagaaaagctttcatatttcttagaaacatacactgaatatgtaaggctgaaatgacatgtagttagaaattatctttgaaatacttcagtaaaagaagagagaaaggaagaaagagagggagaagagaaaaattaatagctgaatcaagtgtggcaaaaatcttaataactgttgtgtttgagtgatgggcatattaatggtccattattattctctccccacctttggatatgtttgaaattgtaataaaaaagtaaaagaaaaatttcttaagactggagtttgagctggcaaatgaagatgaataggtaggggttgaaaaggagagcattttaggcattctacttcattcctagcccatctgccaatacactagcagccattccttgattttcttggctccacaatgcagcagtcagatctcagcaatcctgagtgcctcagcccccaccatggttagctagcctgcttactctctttttctaactttcctgacagcccacaagctcaggattttggccctgatccatctactacatccatccttctaaattttgtttctaattccatgtgtctccaattcccagtagttaacagactccggctacaaaatgtaacacaaaaagttaaaagataggcattaaatgataaactccatggtaaataacctgtgtgaactcagagtcccttggaaaactcatgttgtctattgtaacatgtccttgacacttgaatgtttccaccaagttggtaggtgagcctggacagaatgaatgctttaactggaaacagttttactttctgctcttaagtcctagtttgcctttcgcccaaatgcctattccatcctggggatttctaaatcttttcaatagttttaaaaggttagaaatacctgcatcacaaattctcgacgtcgaggcattcctctttctgaaagcaaaacataatccggctccttttcctttttggcctgttgaatttgcgccaggcggctaatagggttcatcccttggccatattctggtccggcctaaaaattaatttaagaaaaagttttaaaatatgcttgtgaaacctgttattgaatccttaaagaaacagtgcttcttccctccacccccacaccccaaaactgtgactagaaaagataaatgagtcatttatgaatatttataaaggaaaatcataaaatagacctgtaaccaaggcttctatgggacttggggcttagatgtattaatggcaaggtgtcaactatgctttttaaattgggcacactcttcagtataccagaggtgcttcacaacttctgttcatcaagaaacatcaaaaagaacagaagaagaccaaccatgaactgggaggagatctctgcaacacattatcattttattttattttatttatttttttgagacagagtttcattctgtcgcccaggctggagtgtggtagtgcaatttcagctcaccacaaactccacctgccgggttcaagcgattctcgtgcctcagcctcccaaatagctggaactacaggcgcgcccacaccatgcccagctaatttttatatttttagtagagatggggtttcatcatgttggccaacctgatcttgaactcctgacctcaggtgatcccactggccttggcctcccaaagtgctgggattacaggtgtgagccgcagcacccggccacaacacacataattttaaaaagacgtatccggtatccaaaatatattttttaagacccctaaaaagtactaagaaaaagagaatataaaagggaaatgggcaaaagagataaatacttcacataaggaaaaactcaatatatgaaatgataactaacctctaggacacagaaaatacatattaaaaacctcagtgagttactatttcacatccaccaaattagcaaaaattaagaagtctaacagccccaagtggtgagaatggggagtaacagaaactcttataaaacactgggagtactataaatcggaaaacaacctggcaatgtctagtaaagcctgagatggtacatcctaccccaattagcctattcctaggcacatataaaccctagaaaaccgtaacccatgcacagtagctcatatgtacaggaatatccacagatgcattatttgaaataggaaaaaaaaactagaatattcatcaataaaagaacagataaattacagcatgttcatataatggaatggtatatagcagtgaaaatgaattaattattgctacatgcatcaagatgaatgattttcagaaagaatagtaagtaaaaaaggcaagctacagaataatatatatatagtatattttatgtaaagcctgctaaaactacaaaatactgctgaaattaagatctaaatagtcaatacatcatgttcatcgatcagaagactcaacaataagatgtcaattctcctcaaaatcccagtaggcttttttcctttttttttttttttttttttggcagagtctcactctgttgcccaggctggagtgcagtggcatgatctcagctaacagcaacctctgtatcctgggttcaagcgattctcttgcctaagcttcctgagtagctgggactacaggcgcacgccaccatgcctggttaatctctgtatttttcatagagacagggtttcaccatgttggccaggctggtctcaaactcgtgacctcaagtgatccttccacctcggcctcccaaagtgctcagattacgggcatgagccaccgcacctggcccccagttggctttttaaaatttaatgtgtaagctgatactaaaattcatatggaaatgcaaaggacaaagaaccaaaattttgggggaaaaaaaaagactcagactacctaatttcaagattataaaactatggcattcaagacagtgtgtgtagtattggtataaagacagacaaagggaccaatgaaacagaataagtgcccagacacagatatatatacacacatacacatacacacacacacacacacacacacacacacacacatacacacacacacacacacacacacacacacacacacacacggtcacatgattttcaacaaaggcacaaaaggaattcagtggggtagtcttttcagccaatagtgttgggacaattggctattcatatgtaaaaagaaaaagaaaaagaaaaaaaaatcttcaagccaaacctcataacatttataaaaataattaactcaaaatgcctcacagacgtaaatgtaatttctaaaactataagatttccagaagaaaaatttttgtaacttggttaggtaacaatttcttagatataacaccaaaatcacgttccatgtaaaaaaactaataataataaaatgaaacaatataaataataataaaataaacataataaatcttcaaaattaataacttctgctctttgaaaaagacaagtcacagacttgaagaaaatatttgcaaagtacatatgtaataaagcacctgtatccagagtatataaagacctctaaaaattcaataataaatttattattatttgaaataagcaattaaaatttgttaagctggcaaaaaatttaaataaacacttcatcaggcctcatgtgacagtaaacacataaaaaattcttgatatcatctgccacagaggaaatgtaaattaaaaccaaaatgagatatcaatacccatctacatgaacatctgaaattttaaaaactatgctaggtgttagcaaggatgtgaaacaattggagttatcacacactgctgatgagaatgtaaaagtgcacagctgctacaactttgaaaaactaaagttgactatatacctactaaatgaccaagccattccactttgaaggatttacccaagagaaatgaaagcatatgctcttaagatacacacacaaatattcatagctgctttatgagtaacaatcaaaaattagaaacagcccaaatatccactgacaggtgaatggataaacaagtggtggtatatcaattcaatgaaatattacctgcaaaaaaacagaactaccaattcatgcatgcaacaataaggatgaatctcaaaataattatgctgggttaaagaagccagccaaaaaaaagagtggtttctcggcaaattaaggtagaagattacaaaggggcataaggaaaattctgggaggaatggatgggttcattatcttgatggtggttatagttttacacatgcaaacaaatacgaaaacatatcaaacagtgcactttaaacatgtacaagtcactctatgtcaattatacctcaataaagttgtttaaaggaactaaacaaataactttagaaaaacaaacatagtaaaactataaggtaggaaatggtcatacaaaactagtgatagaggttgcctagggaaggttgcatgaggacgtgatggaagaagagcatacagagagcttcaaagcttattgagaaatgttttatactcaagttgggcagtaggtctttctcacacttacttagtatgctttttaacttatacacaagtttatatatagctttttgtatgtattataacataaaagcaaaaattcaggccgggcgtgatggctcatgcctgtaatctcagcactttgggaggccgaggcgggcagatcacctgaggtcgggagttcgagaccagcctaaccaacacagagaaaccccatctctactaaaaaaaaacatacaaaaaattagccgggcatggtggcacatgtctgtaatcccagctactagggaggctgaggcaggagaatcactttaacctgggaggaggaggttgcggtgagccaagatcacaccattgcactccagcctgggcaacaagagcgaaactccgtctcaaaaaaaaaaaaaaaagcaaaaattcttggaaaccaaattatctttctgcatatgaactttcttcatgtatttttcctagaaataaaagtctgcgtatatcatacggtcaaaactttatttccacctatgaaaatttattcttgtctctactatctgtagagacatggagacatggataatcactctgttacagattacacgttacactaaacttatgtaagagccactatgcagtcttagctcttccggatgattgctgccatttcatcttgacaatctgtagtttggtgctccaggtacagcatccaggcagatccctcatggtctttcaaactatgtttaggattttggactttatccaaagagtaagaaaattactaagaggttttaagcagaggcatgatatgattagacaggtgtctctaaaagatcatactttttaaacgatcatttggtgtcaagagtacttgtagccagttaaaaccttaactgtagtagttcaggttaatagatgtctgtgagttggacaaaagagtggcagaagggatggaaaaaaaggaaccaacttaaaaaacattaggtgacaaggccaagcacagtggctcactcctgtaatcccagcactttgagaggccaaggcagggcggatcacaaggtcaggagttcgagaccagcctgaccaacatggtgaaagcccgtctctactaaaaaaacaaaaattagccacgcgtggtggcgcacgcctgtaatcccagctactcaggaggctgaggaaggcaggagaattgcttgaacccaggaggcggaggttacagtgagccaagatcatgccactgcactccagcttgggtgacagagcaagactccgtcccataaaaaaaaaaaaagaaaaagaaaaaaaagaaatattagctaacagagtaataggacttaatgactgataggacgtaaggggtaagagagaagttaaacgtcgggcgcagtggctcacgcctgtaatcccagcactttgggaggctgaggtgggtggatcacaaggtcaggagttcaagaccagcctggccgacatggtgaaaccccatctctactaaaaatacaaaaattagtcgggcatggtggtgggcacctgtaatcccagctgaggcatgagaatcgcttgaacccaggaggcagaggttgcagtgagccgagacagtgccattgcactccagcctgggcaacaagagcaaaactccatcttcaaaaaaaaagagaagttaaaaatgacccccagcagtttcagcagctggatgtttgtgccagtcactgagataaagaatgctgcaggagaaagaggtttagaagggaaaatgatgaatttgggcccaaaacttgaggcacctgtgaaatactaagtggggatgtctaataggtagtgcagagcatacggtattcaggaatcatctatttaaagatgaaattgaacccccagaagtagaagaacagcttagggaaagaggaggaaaaagactgagaacttcactgttgcaatggttagatgaagggaaaggaaagagcaaaggaaacttttagcttttgataaaatactggtttcaacttccacttatatcctgaaaaaaaaaattaaataaagggccgggcgcggtggctcatgtctgtaattccagcactttgggaggccgaggcaggtggaacatgaggtcaggagatcaagaccagcctggccaacatggttaaacactgtctctactaaaaatacaaaaaaattagctgagcatggtggtgtgcacctgtaatcccagctactcgggaggctgaggcaggagaatcgattgaacccaggaggtggaggttgcagtgagccgagatcatgccattgcactccagcctggcaacagagcgagaccctgtctcaattaaaaaaaaattaaattaattataaggggaatgaagagggactgatgagaaaagacaaatccacataataatttataagtctaagattgaaatcccaatgaaaaggtaaagagaagctctgagtctagcactagaagtagtatgcccagttcatgaagatgttaaataagtaggaatgtgtttccagtggcatactgtctttatttctgtttaatttgactcaaagaatgtctctgagttccaaggaaattattgttgatatagattgcaatgaaaagaatcagatacataaatccaatttagataatgatggagttcagtgtacattaagaattgcttggggctgggcacagtggctcatgcctttaatcgcagcactttgggaggccaaggtaggcagatcacttgagcccaggagtttgagacctgcctgcacaacgttgcaaaaccctgtctctacaaaaaatacaaaaaattagctgtgcatggtggtgttgtgcctgtagtcccaactacttgggaggtgggaggatcactcgagaccagaaaaatcaaagctgcagtgagctgagatcctaccattgcactccagcctgggcaacaagtgagaccctgtttaaaaaaaaaaaaaacaactctgggtggcaaaggcaggcagatcactttaggtcaggagttcaagaccagcctggccaacacagtgaaaccccatctctaccaaaaaataccaaaattagctaggtatggtggcacatgcctagtcccagctactctggaggttgacatgggagaatcgtttgaacccaggaggcagaagttgcagccagccaagatcatggtgccactgcactccagcttgggagacagagttagaccccgtctcaaaaaaaaaaaaaaaaaaaaggcagcgggggaggggatgacttggtttcttgctctgattgaaatgaactaccagcacccttgacaattaagttattccttggacagcaaatcttaaatcatcattctatataccaataaggacagtcttgtaataattgtgtccagaacatttgatctctaagattagaaagccttctttgtagtctcgtcttatagaggagaattacatttaaaaacagaatgtaaacacaaagacattatcagggcagttttacatgttaacaggataaccctatacagtgactctgaaaatccaaaagttcacaattaaccaatatcaaatgggcactggagtcagatgtgacaactggatctgaaagctgattctgctacaggatcttggataggtttcttaaatataaagggcctcatctgtaagatggaaatgaatgctgcatcacagagtgattaagtgatcaaatgagacaatgtgattattttattactttaaataaaaccaaggcaaataatcatagatattttacctgcttccattgagtgtaacaaactatagaccctcaatgtataagccatacaaggaagtgaggaatatgctaaaaatcaggatactattccaagctgatccatttactgacatattataaggtatgaacatacttaaaattatctagattccaactcattatacacatgttgttctctcaaaataatcttacatttcagagggtatctacaagctttattttaacataagacagacatggcaaaagtaactccaagtgtgatgtatatgaggaaaaatgcaggaggctaacctagtctgggagtaggagaggaccagaggagttcctaaaaaagtcaagtttatgctgagatctgaatgatgcataggagggaagttctgggataatattacttatatactggaagcagtagcaaataactgagaattcaaaatgtttctcctgtctcccacctctggggaataacatttaaataataatcttgcttttaatagctatagttaaaacaagagttagatttatatcctactatagaaatgtacagatcttttccagcctaacagtttattatgatgattattattatgattattattattattatcattttgagatggaatctcattctgtcaccaaggctggagtgcagtggcagtgatcttggctcacctcaacctctgcctcctaggttcaagcgattctcatgcctcagcctcctgagctgtagctgggattagagacgcatgccaccacaaccgactaatttttgtatttttagtagagaccaagtttcgccatgttggccatgctggtctcgaactcctagcctcaaatgatccacccgcctcagcctcccaaaagtgctgggattacaggcatgagccaccgtgcccagcctggtttgcctggtttattattcttaatttatcaagataaaacttagtttaatagagcagacagaagttatgtgaccagttttgtgccaccattccaacataaaatgctgttcctccatcacagaaaagccatagattttatatattaatagatttaagaaaacagttcatggatatattcacataaacataaaatgtgaataggtagtattagatacaaaataccaatagttaatatgtgttatttattatagtatttgcattatcattaataacaatgaatacttaataattactaatgcattttgtgcattgtttcagttaatacttataacaatcccatacagcaaggtcagttactattcccactttataaatgaagaaatatttttaaagttaggtaacttgctcaggccacagggattcatactcagaactgactccaaagttcattctcttaatagctatattctactcctgactgtgtaggaggagcatatgaatgaaagtgccagtcctctttggaaccactatgactcatgataagtggatctatttgtatttatttttagtctaccttacatataacatataattccagttcagggaatgcattacctactacatcttctaagtgaagtcatgtcagtattcattaaaaacaaatatttaagtagttatttttgtatatatgtatatatgtattttaaataaaggtacaaaggtataaaacctgtaaaaatacctaaattgtgccattgtgcaatcaaaagaaatccattgagattaaatatatttcttatctgtaatccttcatttgtatagcctgatcagaagaaggctgctaaatcagtgaggctgagccagcaactaaaatgctggcaatttaaggctttctctggaaacacagaactctagctccagacatgtcatacgtgtcaagcattcacaggcactgtcctgtactaaatgctgattcatctcattcctctgatatttaccttgcttctcttattaatgtaaataaattctgacccaataaaagagtcacaatatcttgaaaagctgtgtgctctatattcttctttggcaaggtatacacatctgaacgaatggcaacaaaataacaccatctacttcatatggttgctatgtggattaaatgtgattaaagcatgcaaagtgttgggacaaagtctggcacatagactgctttatgatttccagctgctgtagctatcattgttagtattagtcacatgatttttttgtgtgtatcctgttaccatttcatgatatcctaagaagttactatgcaacagccatgtgtgcagaaagaacactggattagagatcagagcggttcaggaggtttgacatgattgctgaataaaaatgggcaaactctttgaacacgttttgtaaaatcttatttgtaaaatgagggctaacatcatctaccttatacggtcatgagggggattatagtaaaggtgacatgaatggtaaagcactttttaaacaacaaagaaatacataaatacctaaggtattatgattatttgatgtacaaatgcaggtgcacaggtatttaaaaagcaaaatagaattgtcattaatttatagtcacatgtcctgccctcatttcaggactgtatatagtccataagttcagggatctgccttatagaaaaatgcttatctatagctactataatatttatttagtaaaactgactgatgttcacaaatataaacttacctttactattgttttagggcgttttttaaaaaatagttttggcttttccaccacaggaagaggtggaagttttttaagctcctgtaagacggtggtcgcagcgcgcttcttggagagttttttgctatttccttctccttctgcagagaactctcctactgacactcgagtaacaaagcttttcatatgtggtggtccactttctttaataacctattaaatacaagtaaaatattaaataatggataggcacttgagatgtattcttaaagtatgacttaatattcatatcaaaaccaaaattagtattatgccaaaattatagtatttctttaagaaagctattatgaaggtattatactgggactatttatgacacttgatgcttaatgcaattgaaacaaaagaaatctaaataaacacatttgattcatagtcaaaatgatttattactttaaaacagatcattctaattacagtttctccatgtcttatggaacacaaatttaagaacatcaaagataccattagattagataccatattagattggtcatctagaatgataatttgtatataattacatacctaacttcctcctatgtacgagtaagttgctggagaaacgagtagttctataaaccacaaggcactgtgcctgtggaagcctctcaaaaacagtcaatggataaaaataagctgtttttgatagggatgtcaaaagctgttttacagaaagggatatttattcttgtgacacgattttaaaaaggtaagtaggtatgccaaaaaaattcctagctttctagagtaatgagttatggacctgtcaactatgaatgtaatgttcctaaaccttgtttaatctgcaatactaaatatttaacctttaattgttcacattagatcatcattataaacatcagatatcctacatcataatatattgatgttcccaagaacacctaagaataataaaactgtctgttcttactcattgtagcctttaaaaaaaatcccaataattttttagtataagcaattactttttacaggttttccaaattttccgtatcatttcttgctggaccaataggatctcaagtacattctctccctgacttcctcattttgctgcttttaacaagctgtggaccgagaactgagataatgcaacttgtaagaatgtgtccaagagaaagcaaacagtttctcagtccaactcagatgatcctgccaatgagtaagatgtgggagctttctagtaggtgaatgtcatacaatgtgagggaagaatctccacaactctttcagcttatttcctggttcttgtctactttccagacatgagttgtaaaattagtgacctcttaataaaagaagtattataataattatttttttaagttttcttttttgaaatttcatacaattttatgaatatatttgcaatatatttatctagctgttaagtcaagagttgcttcattacatcttacttcttggtgattttgttagttgaggttaaagtgaaacatattttggcctccacacaattgaaaaaaaaattggatattaacatgtatgtcactaaatcttaacttgaataaatttaatttaatcctatttaaaatgccaaatcttataggataccacaaattatctatacccagaaaataacttttataataaaaattgaaataccatgtatacaaaaggcttaatacagaaaagaaaaaaatcagaaggaatctgtgttatcatcatgatttctattttcaccagggcctagatcatttcataatactgggtttgaacatatagaagcacactaactcttgcaggatactaatacaccagttaatttgatttgtttgtttaaaataaccacagcaagggaaaaaatgggaagatctctaccgagtacatacctcaaaactgacaggcatatttcgcttcagagcaatttcaaacactaagctgatctcagacttatttgcatctttgtcatcatccacatcctttcctgattcaccattctaaatcacaaaaaataggataacactgaatcttgacattataacaaactttacttttattctacagtcaagatggcctatttaaattacaagaagaaacaacaaactatatagactgtatctgctgcattctcctgtaaccacagcggtcaagggctttgctgccaggctttttgttactcgatttttagcttgttttccttgaaggaaaagcatttaatgcagactttggaaatcttttactcaaccatacactaatttgagtttagcctacatccctaaacctggcactcttgttttagagttctctacccacccaacccccaacacccaggaattcccccactggtgttctaatgtgatctatgaggatgaagttacagaaagagtacaggatgcaaaccaggagcatcctaattggagatctatgtctggcacaggcattggtttactttattcacttatttaacacatacttctggaaggcctcatatatgctgaacttactataactattagaaagagacagtattccttgctgtcaagaactgggagagaatgatctagtgggaaaacagatcaagaaatagataggagctctcatgaaagagtacaagcagaaaaacacctaagtctgccattaagataaatatcaaaggagaaagaaacaattggtttggggaaaggaaaactgtagaggttgaactgtagggtaagtaagaagctcactatgctgccgggcatggtggctcacgcctgtaatcccagcattttaggaggccgaggcaggcaaatcacgaggtcaagagatcgagaacatcctggttaacacagtgaaaccccatctctgctaaaaatacaaaaaattagctgggcgtggtagcatgagcctatggtcccagctactcaagaggctgaggcaggagaatcgcttgaacccgggaggcagaggttgcagtgagctgagatcctgccactgcattccagcctgggcaacagagcgaggctccatctcaaaaaaaaaaggaagctcactatgctatgtataggacatgcctgagctagagatactattttgaagtcaatcaagaaagtagctgaagccatgagaatgagtgagattacttaagaacagcctcaatgtcatttgtaaaacaaaagaggactgaaaaatccataaaatctcttccactttaaatccttgattctagattcacacaatgtaatctatattcaataaacatagtatgaaatataagccaaatcaatgttatttctcatcctcatatacatccccaaatccccagttgcctgggaagtgaactcaagggaagaaccaaagctctgaaaggtagtcaccctgcaggaacacatgaagcaagactgtcaggtcttcactctagtattcttccctatcagaacagattatttattttaattataaaatgctctgatttgtttcactgggaaagtagaaagaacagactgtcacatgcagcagcaccacacctgaggagatctttctggaataggttcattctgcagtgcttggagggctttcattgcagcattgtgtctagcagcttgtcgagtctttccttccccaaaaaattcattatttcctacagtgagctgaacataaaagatcttaggcactgggcaatgatacctaaaataagaaaataaaaacattaaagttagcttaataaaaccactctataatcattcataagatttgtttaaaatgataccaattatataatgtgctatactcttaataaaactttaacctcaaaaacatacttttttgataaaatgtgagtcaatacatctatagataatagcttatactgatctccatgaaaaacatatatagaatacaacattaaacataaaacaatacagtaaaaattatttaattatatcacaggatacttcctggtgagaagttttcggtcagattttgacagaagtaagagaacagtctgatgaagctacaacagaggctgggtcaggcaagactgttcaggcgacaacatgtagattaccgtgctttttgcagaagataattacgattagaaatatagattagaaatggaccgactacaatgcaaagtaataaggagagcagattcagcataagaataaggagtttaggccagttcttaagcaggaagtgttatattcatacattttacggtgcctgaggtaatgaggctaatgaggtgtgactaaaaagctgcaataatgcagatatgaagagataacagagaatgtaagaagaaacaaaaaaaccaaaagaaattaagcagaaaaaattaagatatgtaataaaatccattaattcaacaattatttatggagcgtcttctatttgacaggggactatgacaatgaacaacaacacttagagtggggaagataaacaataagaaaaatatgtagaatacctagtatgttagatgtagatgtaagaaaaagtaaagaggaaagggttcagaagtgtcagggaggtaggttttagatagggtggccaagagaagtttcattgagaaaatatcaattgtgtaaagacatgaaataagttagggaacaagccatgcagatctctgggacagtgcatctgaagcagagagtataccagcagcaagggcagcgaggcgggagtgtgccacacatgttcaagtaactcggaggaagcctgtctggcaaaagtttagggagacaggaaaagctagatgagaagaggtggcaagattccatagggccttccctacaaattgctgtaggcatttttaacccaagtgaaatgaccagccactggaaggttctgcacagagaagtgacaaaatctgacttatctcttggaataaccatctgactactattttgaggacacactgtaggggaacaatgctggaagcaaggatatctaataggctactgggataatcaaggggaaaggtgacagtggcctgaactagggtgtagcaatggaagtaacgagaagtcattgtttctagatgaattttgaaagtagagatgatgggtttacccaaagactggctatggaatatgagaggggagtcagggatgacatcacggtttcggaactaaacaactggaaaatggagtacccatctattgagacagtgaagattgcaaaagaaatgggtttgctgggggtggatttcaacagctctgttttggggatattcaattattagacctattagatatccaagtgtagatgtcaactggacaactgaatttattagtctggacttcaggaaagaggtccaagatagaaataatatttgggaatcatcagtatataggtggtatttaaaggcataatataatgagaactctgtgggagggtgtgatgggagaaaagccaagcaagcacgatgtccttcctgaaagtcaaacaggaaaaaagtctatcaaggagaagggagggattaactggatctaatgctactaacaggtcaagtaaaatgatgactgagaaatatgaccactgaattgagcaacttagcaaaataaacagaatcgattttgatggaatggtggatttacaactgcaatgctgaaaaaaatgagttaaaaatcactccagtcctaaaaaatgtttgtttccaagcaaaaagaagtccaattgaggtcctactatattttagataattactgcacatccaagtagtgacgctctatgtccaacctgagataaactggatagagcgcatcatgtaagcattcaccaggcagatgggactaatcaatgaaggtttactgaaggtgaagaactagaaatgttgattggtactgaagatgcagatttgtgaggcaataattgaaaccatgcaagtggataagcacctggaaagggtaagtgtaaaggaatcaaaaaagagcctaaggctcggaactgattaatgcctgtgatcaaagtgcaagggaaacaatagacagcagtgaaagagatgaaaaagggtcaaagttagaagaaaaattacaacacaatgtcagggacaggagtaattaacagtgtcaaatgaaggagaggaattcagagtatgaaaaaaaagaaaaagttgctgttttaaatgcttaacctaaaatcaattttcttgaactacagttttctattaatttaagataacgcattttaaatgtttttattataaacaaagattaaaaagcattaaaaaactataatcttttttgctttttggttacaacaattaaatattgtgtactgaagtgcacaatttcctatcatctattttattttaatccctttaatgcagaaatttattttaattccttaatgcagaaatctgacagactaatatgaataacgccggtcatcttcacttcatatttctcaaaattcaattttcccacctccacataactttgtttatttttaactggtggtactataaaactttaaaacagacaacttgaaatcagaaatttactcctgaagtgagatctcatatggcaaactttcaccatagagcaaatgtttacaattaattataaacttctgaaaatagaaggtccacaactgaaatgctaacagacctttaactacagtagagggagtgggcgccactataatcactaaggcctgctgacaattacaaaactcattttggtttgccacagagacaaacaaaatttctgttcattgtaactttactggaatatgatgtcataacacataaccatactgaaacaatctgctgattttctggccaaaatattaattgcacaccaaagagcccttggggcctctccctttttggtcatcaaatatggctcaatgtatgtgtatgtgcatgcatgtggatatatatgtatatataaattatattgtgtaagtatcagaggaaaaattaagtatgttgcatttttaacataaaaggtaaaaattctagcactaacaacaggaaataccaagactggatgcctgacttatttcattctgtttcacttcatcctcttacttaacaatgattcttaataatataccccacatggtttgaataccttatatatcacatctcctcataccatcatgacaatcaagattagccagagcactctcattaattgcatccagattgaattacaggggagatgatgcagaatggtttttgtgtgataggtctggtctcaaaatacttacttcctttggtaaagaaatacccaaagtttattaattataaagatcgatatgttctatttagtggatttccttctactttcacttatttcaagtattaagctcacttttagtaaggtatttgatatggtttggctgtgtccccactcaaaatctcatcttgaattgtaatccaaattgtaatctccatgtgtcgtgggagggacctggttggaggttaagtgaatcatgggggcggtttcccccatggtattctcatgatagggagtgagttctcacaagatctgacggttttataagcgtctggcatttcccctgctggcattcatttcctctcctgctgtcctgtgaagaggtgccttctgccatcctgaggcctccccagccatgcagaactgtcagtcaattaaacctcttttctttataaatcacccagttcagtctcgggtatttcttcacagcaacatgagatcagactaacacagtaggtataataagtgatgtacatatttttacaaattagtatatttacctaagcagacatagctattcttgaatgatttttctcaagtagaattctgtggtcaatgtttagatccccataatgattactgttaaaagatgaaccacgaaaactcccccatccaagttatttaagtttcagggtcaaatggttgcatttcttttaaatcccaaaaaagtcttgggatttgaaagatcctactttcatcagaattatcttccatgcttgttaaaaatgaagattcctgtgatccaagcctgatctgctgcatcagagtttctgaggatggaaccataattttaagctgccctgctgactctctgcacgataaaggtccaggattatcaccacatcccacaatgtggcccatgtgacttggcaattgcttcagagtccattcaaggagaccacacacaatgcttactgcacaatggttaggtctttctctcttttttttttttttttttttcctgagacgaagtctcgctctgctgcccaggctagagtgcagtggctagatctcggctccccgcaagctccgcctcccgggttctcgccattctcctgcctcagcctcccgagtagctgggactacaggcgcccgccaccatgcccagctaattttttttttttttttttttttgagacggagtctcgctgtcgcccaggctggaatgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcactgtgttagccaggatcgtctcaatctccgaccttgtgatccgcccgcctcggcctctcaaagtgctgagattacgggcgtgagccaccacgcctggccaggtctttcatatctctttttcatttaatcctcactacagcctggtgaggcaggagatgtccccaaggtcaccttaagaggtaacaaatgtccccaaaagagttgctgggaaccaaatttaagtctgcctaactgcagagtccaggaaattccgtatggagcttcctaaaaatctgctttatcttcttccatttttgttaatttttgtttattaaattgtctatcttcatggaaggccagagaacctaatgcaagggatctaaagtaaggcccactgatagacttcagagatgttttattgagtgaatggctgctgaaacaaacagacaaccatgatgaaacactgtgtttctgcagcatgtcagatcaaatagacacaagtgcatgacgtaaaatcaaagtgaaacatcaaaatgaacagcgttgtgtgccacattacttaacagactaaatctgacaaatgctgcttgcaaggcctttttatccccatgtctccttgccttctaactgctggaagtcttgcaaaaaataaataaaattgtaaataaaataaaatagaatcttcctttcctttagatcccaaacaagtcttgagattcagcctatcttcaagataccacaagtcaatacaacagtaagaaagaatgtatactggttcctttgatttaatacttgatattccttacagtttttttgagtaaaggaaagattttacattcacttatatctgactgttagttgtagcaactttttataccacatatccttgccaacctccctaaagttacttcatttaatgccctctttatggactcattttgtattatctttctaaacaactaaaatcccgtatgtcctccctaccattctgtgactgttttattctccaacatctccactttcctgagtatcatttttacaaggtgagaaagacatatcccaaataacattaggatttttacaaattgaaaaataattacctcattctatttgatagcattattcataaatctcaacacagcttaaacattcatatctcccctacagacttacatcttaaaatatatgaaaatgctatcttccgatctaataaggagaggctttggatttctgtgtttatttctaacattgactggaaacagaaatgtcacttaacctttctatctcagtttacttatctacaaaatatttgtagaatttatgtttaaaggaccctaaaggccaaaactaagaattcaaatgacatgtcgattattttgactctttgtacactttttggcactgctaagcattctttttcttgctgtagaaaaacagcaggtttttatcatagagctataaaatagtccttggcacattttcaaacttgtatgtatataaaatatctagatagaagacagttctttctctattcatatctacaaattttgaaaaatatatcttttatgagatctaactgttaattcttgaggaatttcaaatattaggactgattagaaaagattcacaggtcagatgaaaatatgctttaaaagaggtgtatggatattctatttgtagaattactgtaagtatgttttaaatgcctagaggaaatatagaaagatatgcactaaaagctaggatagggtgttttgaaatgatagcattataaatgatgttctttcctctcataatttcaagttttaaaaaataatacggtacactagaataaaaatggaaaaaaaaatacttaattgaaggaagtctagtccctatccaaacaaaggtaaatctgtgtttgaaattaaatttgataaactagtggaatgatttatggaatacagaacacaaatcaagagaataagtaacttgtactgtatcactgacagtagtgccataatcaggactatgcaaagcacagcacgttatcaaagagccccattattgtaaacacacaatcaccaccctcaatctcatacttggaaccaacataaacttgttcttgccccttctctaaatggatatatagataaatcattatcacatcaccattatcataattagagctaaaacatacaaagcacttactatgtgccaggcactattccaagcatttagatactaatctcactgaatcctcacaaccccacttcattttacagatgaggaaactgaagaatagagatattcactaaccttcccagggccacccgacttgagctcacatttgagcccaggcagtctcactccagaacccatgctcataactgctataccatgctgcctctgaatgaactggatagatgaacactataaactgcagaagtactaactataaactctgaagaagtcatgctggactgggaatatcaaagcaacttaagtctctctagatgtatgagatctggcagattctgaagatctctgtacgccaaaagtcaggtgcaggatatcagctgccaaaggcaatgatggggacactgtaagtctagaagaccaagttgactgcaaagtcctatttcctctctgctcattttttgtctcctcttaacccacccatctggagcccaggtttaaatgttctcattagggaaatgcaaatccaaaccacaataagacactacttcacacacccactaggatggctatagtttaaaaaaaaaaagtcataaagacatggcaaattggaaccctcatacattctggtgggaatgtaaaatggtgcagttgctatggaaaatagtttaccagttcctcaaaaaattaaaagcagaattaccacttgacccagcagtttcacttctaaatatatacccaagagaaatgaaaactggggttcaaacaaaaactcgtaggtaaatgtttacagcagcattattcctaatagtcagaaagtggaaataacccaaatgtcccgatgaataaataaaatgtggtatgtccccacaatggagtgttttacagtcgtacaaaggaatgaagtataattacatgctacaacataaacgaacttacattatgctaagtgaaagaagctagatacaaaagagtatatactctatgattccatttagacaaaatatccagaataggcaaacccatagagacagaaagtagattagtggttgccaggagctgggaggatggagtttgaggagtaactgttaacaggtatggggtttcttttaggagtgatagatatgttttgaaattagaccacggtgatggctgtacaacactgtgaatgtactaaatgcacaatgaattgtatactttaaaatagttaatcttgtgttacgtaaattttatttcaatacaaatcatttttttaaaaaatgttgatactccctagggttctattttgtttctcactgacaagacagtttttgtaggtgatctcacctactctcattcacattcttggcagactcccacaaactagcctaccaaattttgtaaagggaagtgtaaaagacctcccttttgcactctaggatgttactgacctggtcttcttcctactcttgtctaattgctaggggggtatgtgaattacattaataattcaacatatacttattaaaggcctacttcatgctgggatggagttttagtttctagagatggaggactgccctcaggaaactatcaatcaagtaagtacacatacacacacacacacacacacacacacacagacacatacacatcaacaaatgagatgagctaggaagaaaaataaagcatggtatagaaaaagattaacaggggctcctttaggaggtgacatttgaacacagatttgaataaagtgagaattctaggcatggaaatgccagaaagaaaaagtgctctaagcaaataagacagcaagtgcaaaggccctgcagaaataacatgttggttggtccatttttgagaaagggcaagtgttccttgtacctgacaagccctgagtcaaggaatgattagtaggaaactaggtctgagaagtcaccaggcagcaaatcagaacttaattccacatgatggaagccactggaaagttttaagcaggaaagtggcacaatctgacatgatttaaaaggatcttgttgctatttacccgaggagaggcaagaagagaataggtgacaagccattccatagtgcaggaaaagtcatctctaaaaataggagactgaactgctcaagaaaatataggattgcaggcagtgctacaatttcacttaaggattgtggtcattatatcaaggtggactagtcagcatagatgtttttctgtagcttcctaggagcaactgcagcagagtcagaggagctggaattaaccagttacagttttgccaagcatcgctgctcattccaactgggaggcagtagaacacacaggaattaggtagccataggactagtgaaaaatgggtgatcaactctagtgaaaagcagccacgctgaatctggcaggtgaggaaagggtgcacccagcctggaggttctgctcaaagtcttcaggtgctaaaggacaccaccctatttcttgccctcctggtggtcagacagtgtgtggcagaagcagtaagatgtgcctcccctgtggtggctgacaagcaaagcagtgctggaagtgttcctactttgcaactgtgaagaagggtccctggcaaggcgatctgggggcctcttcttccagtgtgctgccactgtgttcccctgggtgctgcagcaggcctgtctgagaggtaaatggctagcactgtggaaaccagcagaattgtggagtgatgctgcaggaatacggcggggggggggggggaggggggggcaggagggcgggttccctggagtagtatttctcaagtgggtcccacatagaaaacactggagtcttcctaatggggtctagaaacacttgctaaaaagcagattcagggctgaccaaagggattcaggatggagtccaggaatgcgcacattacctaacagcctaggtggtttgcacacatgctacagattgagaagggcctcgtcacaggggccttcttccctgtttgtgaatacaaaggcttctgattcctgaatatcaactttgtactcatctgccttacagagtgctcttcctgtctttaatgggattttagttaattctctcaccatttgtttcataagaaaaaattaggattttcctattatttccagaatttgtttttcctatttatttccacaatttattttgctaattttgttgatccaaacttccaaaagaatactaaatagcagctgataaagaatattcttatttcttacttgaatgggaacacggctagtaaatactcattaaaccttgttaaaaaaaaaaaaaaaacactgacagtgtggacagaggaaaatatttttaggtttagaataagatctactggatttaagttccagctactagatctataaagactttgggcaagaagccttatgttctctaagagccatcagtaataagaacaattttgtctgtatcaactttcagctttattcaagtgacaaaccagttgaaaattattatacttttcatgaaatatagcatatctgtgtactgagggacaattttcaaatagatatatatgttcacacatatactctgcagttcaaaaacatacaattttttttaaaatgtaagttttttttttttgaaacagggtctcgttctgtcacccaggctggagtgcagagcatgattatggttaactgcggcctcaacctgctgggctcaagcaatcctcccatctcagtctctcaagtagctgggaccacaagcatgtgccatcatgcctggctaattttttttttttgtagagacaggcactccctatgttgcctaggctggtcttgaattcctgggctaaagcaatcctcccaactcgggcgcccaaagtgctgagattataggcatgagtcactgtgcccagccacttttaacttttcaatatatattcactaaatactgcatgctagtaatctaatagcagaatcttacgtactaaaaacttatggaaaatatggcttattgtttctttgagttgtaagaatattcctattatttaattccagcagcagatatcatctttggttaagggttctctgagaatgcactttgaaaacaactagtgtagaaaatctctcaagtccttcccaccaacaaaaggattcacgaaacgagctctagaaaatacttataaaacttctatctctccattaagtccacaagcatatgtttttgaaaagtttgttagaagtataaaaagcatgaaagtataaaagatacaaacatactggattttttaaaagagggtttacactctttttcgataaattaattttataatgtctataataaaagattcaaatggatgattacgtttgcactaaaatcttccaagaagtttaaaaactgtttgctttattacaacgtccagcccaggcatctactccagtgcttttgctgatcagaattaactatcaactttggatgtttgcccacttcacatactcccaaaagtaacatggagacattacatcagcggtattgcagaaagattaatgtgctttgtttggagatgcaaactaattatacttactgcatacttctagtattctgtctctttcactcaaatctaaatgaatttagtcatacatttgcatacagtttaatgataacaataatgtatagttaatagatactcactggaacagaaaaaatttacttggcattttcccagctaattgtttttacagcttgacttcactttatacattaggtgcattcataaaaaggtttacataaagcaaatattttcatactaaatcccattttcccactgttgcccaatattaaatcttgagttatatttctacaggaaaatgctggctccaacacatcataaaaattataattaaaaatctaaacatacatgccaaggaataggtatgtttaatacattattttacaaaacactttatcctctcacctgcgataagaattaatctaaaagataatcattttgtttcatagtctcacaatcattagaaggacacgtatgttttaaaaaaattgcagggttttaaagtagcttcgtagaaactaaaagtagaaatataatttattagctggaactgccacatggagatctcctgtcagattttaggcaatgcaaatagtctcagattattgacagtaatcatttaagggtcttagaaatttcttcggctatgagtaacacactttggggggttcattacaatccaaaccagatgatttactggaattatacagatgctctggagccaataccactgtctgactcgaagcccacttttcttttttgaggcagggtctccctctgtcacccaggctgaagtgtagtcgtgcgattatgcctcactgcagcctcaactttcaaggctcaagcaatcctcccaagtaacaggaaccacaggcgtgcactaccacacttggctaatttttttttatttttatgttttatagagatgcttttcaaagaaataggaaaatgaactttgctcaactacctggatcctttcatactgtttaatattaaaagtgtaaaaaaagcaacatttgctaaaatagtacagtacttggaactttaagaaaactcttccacttttaaagtaccttggattaacgttaaacaatttataattttcagtcattttaaattaatttgtaaaatttttcctgcacaaatcctctggggaatgcactatgtggatttcaattacctatgctctccttttcctgcattgctgcagatacgcaaggtatgcttttacatcggttagtcagtgtgaactgtctcttattccaggatgcacactaagctgagaactatccaatcctctttatctttgccatgtaccctgaggtaaaacacagcaacaaataagggagatgatattggtagagacaatattgatatccagtctgactaccacacataggaagaggctgaagtaatacttagagctttgaaaggctaacagttttggcctcgggttatgatggtttactcctgttcacaatacagatacgtgtattttagtcacactaaatacaaagtgtggccaaagacattcttttctgtggacaaaatagtttttgaagatattctgaaataactcagtcatcatgacatcctactattcccaaagagtggatgttgacatgagttagtgtagcatagcagaaaaagcacgagctttgatgacatattactcctgggctggagggccagctcagccctttactagctgtgtcaccctatgcaagatacatgctgtgtcagaacatagtagccccaggaaatcatagttgttggcctctttccctcttgacaactaatccatcagccttctttgatattctacaatgtttctatgaagctgcagcatctctaaagcttttggttattccctgtaaagaatacccttagctgtggttatgctggcagaatctctagactttcatttcacacgctcagtggcacccctagtttcccattagcgcttgtaccatacccgggagaacatcacttcatgcctgtctaggagatctgacatttggttcattggtcactcaagaatgccaatctaggccaggcacagtggctcacacctataatcccagcactttaggaggccaaggcaggaggatcacttgaggccaggagtttgagaccagccttgccaaaatagcaagactgtctctacaaaaaacataaaaaattatctgggcatggtggtacacccttgtagttccagctactcagaagcggaggcaggagcattgcttgagcccaggaattcaagggtacagtgagctcagcatcaaatgtacccttgcggtttgagtaccactgcactccagcctaggcaatagagtgagacctcatctcttaaaaaaaaaaaaaagaggaataaaaaatgaacaccaatgcagttcaaaacaccaagcagtgtgcagaagataagctgataaattcagatactataaaaaccagtagaaatcaactaaataagcctctggaagaatttaatgtaaaataataaataacattactacaatttttaaaaattgtaaaggccatttatttacatgtttggggttctgttctacacagactgttctgtatagactgttctgtgacctgtcagtcaattacagtacaggagtctagtaactcatttatctttaaagaagtgcatcttgaccagagaacatgagaatgtcaacaaatcataaggaaataaataaagcaagttggtcaaggtccttgtaactgaagccaagaaaaagcctgggaaattaatgaataataagctcccaggaaactcaaactgagaaaagcagtaagccatgatgagaataatacctgagatgattaaatatatagtccaaatattactgcctacgatcctaaatcttacccacccgcaaaagagaacagccaaaaagctgaagttgctcatttttatctcaatgagagagaggagggataaggacgaggcaagaaggggggaggagagggagggagggagggaggaagacagagggaggaaaggagagagagacagcacacgaacacgagcaagagaacaagggcaaaaaatacttgctgacagtaggtatgatattaagaatattgtattatattgcattagaaatatagacgattgaaagctgacataaagaactgatttggatttagaaaagatcagaatataagatagttttatttccattttaaaatgagtatgtaaacaactattaagttcagtacattaaaaaaaaaaaaagtcttgctgcctttattgatttggagaaagcctgccacatactcttacaaagacaggatgtcaagcaaaccaataagtcattcaaacccagtgtatataaggttccttaagtatttgaggaatcaacatggagaattctgaaaatctgagacccacatgggagtaaagaaagaatgcatcttaagcaaattttacttattgttctctttgttatcctgaaaaagtcactcaagagaacaaaaaagggtttgcaaataagaccatataatcctatttgcagaggatgacacttcttatgagacttagaaacctgcaatacaatctgagcttataagactgagaactccaaagcaggagagtgatcaagactgacaagagtatgaccatggtgatctctcaggaagctaaaatcaccccagttatgcataagaaattctggccagaaactgaacacttcagagctggtgaactcatgataaaatcaaacagatgaagagctaaacttataatcttagttgtcacttgactcttgtttaatcaaaatgtaattctaatataatcaaaataagtatatcctgttacttctcaaatttagaaaggccagactcccctgcaaatgcttgagaaccctgtattagacctcatagttcctcaacaaagggaaaagtttagagtaaatgatacgcatgctattccaggaatagtgttctaggaaggctacaaaagggacaatttctgcttatacacagggaaaaagggagttgtattcactgcagccctagtgtatggtatccagcatgatacctagcacttaaaaggagtccactacatatctgttaaatgaaggagaggttatagctaacaattactgagtggtttactatatgccggcactgagcatgcagtaactcatctaatcctcacaatagcctgataaggcaaatacatattgttatcatttccattttacagttgaggaaactgaaaaacagagaagataagttgcttggcctaggcggaaccaggtttcaaatgaagatagagtggctccacagcaccccctaacctcaatactacattactatattcctctcaacttaaaagtgaatgattgcaagggagagacaggaccagcaagggccaggttctcagctatgtgggagtaaagcaatcaggactagcagaaggacaagttcaaagtgaaaggatgcatgtgagatctgaatggggaagtgctgggagtgaatgtactttgtgactatagactccaagtacctcttaacattgggcatgatctgaccttgaggcggctacaagatgaggatgggctagatcagtggtttcatctttgcctatataccggaagtacatgaggagctttaaaaaatactgaggacaagtcagtaagaaaaagaccactgaggccaggcacggtggctcatgcttgtaatcccaacactttgggaggccgaggcggctggatcacctgaggccaggagttcaagaccagtctggacaacatggtgaaaccccatttctactaaaaatacaaaaattagccaggcgtggtggtgggtgcctgtaatcccagctactcaggaggctgaggcagaactgcttgatcccaagagacagaagttgcagtgagccgagatcatgccacggaactccagcctgagtgacaaagcgagactccatctcaaaaaaaagaaaaagactactgaatcagcacaaaaactagcacaggttatacacttacagaccacagaaaaggaaatataaatgattttatgcatatgagaagatgtttgacctcattcataatcaaagaaatgcaaattaaaatgccaaagaggtatcattcttcacctaattatattggtaaaaaactccaaaacattcaaaacagcctcgtctctagtctagattattgtaataacctcccaactgctctcttaatcagcaaaacggtttttatttatttatttatttattttttgctcaaaacctgcgttggccggggtgggcggatcacgaggtcaagagattgagaccatcctggtcaacatggtgaaaccccatctccactaaaaatacaaaaattagctgggtgtggtggcacacacctgtaatcccagctccttgggaggctgaggcaggagaatcatttgaacctgggaggcagaagacatagtaagctgagattgcgccactgcactccagcctggcaacagagtgagacaccgtctcaaaaaaacaaaaaataaaaaaacctacattggttttgcatttcattcatagtagccagaatctttacaatggcctacaaggccttacataaatcaggctcccagtcacatctctggcttcttctaccactcacctcttcacttactcttctctagccacactagtctcctttctgctcctcaaactcaccatataagcctccacgttagggcctttacaatggctgatctcctgcttctccctcagacatcctcaaggctcactctctcaccttcttaaagtcttcgctcaaatctcacctctcagcaagacctaattcaaattgtgattcccatccttttactcaaacagggctctattcttcctatataagcacttttcactttctaatctactatacaatgtacttgtatttattttttattttctatctcccccaactagaatgtacacttcatgaggacagaaatgtctgttgatgtactccaagtacccataagaatgtctcaccacgtgtatgtataaagatacattctgcaacactgataacatcagaagattcaaaacaactaaatgtccatgaatacaggactaagaagttaaataaattacagagaaatcacacagtgggatactaaaccgttcttaaataaataaagcagtaaccctatttccagtatggccaagtaaactctcactgaactgattctcctgcaggaaacaataaattctgaacaaactgtaaaaaaacaatcatctaaaggtaccaaaaagtcaatgaaacaggtggacactggaggcaagttaacatctggaaaaaaagaacagcataggatgcatttctctcccttttttttcttttaatagcttgaatttgaaggcaagcccatctattccatgtgaaatagctaaaatgccactggaaaatagtcatactggtttgaagacccagcgataagggctcatattccaaagcccctggaatatggaggaggaaatattagaaataaaaatctgaggccgagggcggtggctcatgcctgtaatcccagcacttttggaggccaaggtgggtggatcatgaggtcaggagtttgagaccagcctggccaatatggtgaaaccccatctctattaaaaatttaaaaattagccaggcatggtggcaggcaactgtaatcccagctactcgggaggctgaggcagaagaattgcttgaacccaggaggcagaggttgcagtgagccgagaccgcgccactgcactccagcttgggcaacagagtaaggctccgtctaaataaataaataaataatctggagagagagggagcttcatattctatgtataaaactgttcgaatctctatctgacccctgaaccacacacacacacacacacacacacacacacacacacacacacccctggaaccaattcaaagaaatttagctacgagattagaatttgaggtgcctgccacccaatgcagaaaagttttgttgagaccccagccaactaactgcctgcctaaaaaatttttttggccaggcatagtggctcacgcctataatcctaacacctttgggaggccaaggcgggaagattgcttgaacccaggagttagagaccaggctgggcaacatagcaaaaccccatatctataaagataagacaacaaaaccccatatctacaaaaaattagctgggcatggcagcatgtgcctatagtcctagctactcaggaggcggaggtggggggatcacctgagcctgggaggtggaggttgcagtgagccaagattgcaccactgcactccagcctgggtgacagagtgagggcctgtctaaaacatacacacacacacatacacacacttcacaggaacataatagaatctaggttctacaacatataattttacaatgtccagaatacaatccaaaattattcaacatatgaaacaggaaaaaatgatccattctcaagagaaaaaaaactgtaagcagaaaactaccctgaaatgaccgagatgttagaattagcagcaaagggccgggtgtggtggctcatgcctgtaatcccagcactttggtaggctggggtgggtgggtcacttgaggctatgagttcgagaccagcctcaccaacatggcaaaatcctgtctctactaaaaatataagaattagccgagtgtggtggcacacagctgtaatcccagctactcaggaggctgaggcatgagaatcgcttgaacctgggaggcagaggttacagtgagccaagatcacaccaccgcactccagcctgggtgacagaggagactctgtattcaaaaaaaaaaaaaaaggaactaacagcaaagttatactatgttcaaagagatcaaagaaaatatgcttttaatgaataaatgtatggagaatttcagcagagaacagtaattataaaaagtagccaaacaaattctagaatatgatattcaaatttaaaattcactggatagacataatagccaaaaggagatgaccaaggaattaagattaatcaacagaaattatactacctaactattagaaaaaaagaagttaaaaaaatgaactgaagcttagggacctgttagacaaaattaaaaataattaaaattaaaaaaaaggtctaacagaaggagaggaggaaaaggggggaacagaaaaatattaaaagacctaagacccaaaaatttcctttggtaaaaggcatatttacatattcaagaagctcagtgaactagattaatataaagaaaaccacacaagatatgttatagtttaactgctaaaagctaaaaagacatattatttatggggagcaacaattcaaatgatggatgacttctcaagagaaaaaatctgaggccaggagacaagtggaacaacatctttaaagtctttataaagtgctgaaagtaaaaaaaaaaaaaaaaaaaaaaaaaaaagaaaagaaaaaaaagaaaaactgtcaactccgaattctatattcaatgaaaatatcttcaaaactgaaggcaaaataaagatgttttcagtaaacaaaaattcagagaaatcattgccagaagacctgcactacaggaaatactaaagggtgttcaaactgaagagaagtaaagccagacagaaatctggatcttcagagaaaacaaaaacaaaaacaaacacaaacacaaaaacaaaacaaaaaaagggaaatgatagatatgtgggcaaataaattcaagacctttttctcttaatttctttaagatatagactaaagcaaaaaatcataacattgtggaagttatgatctatataaatgtaatacaaatgacatctatatatggggtgggagttaaatagacctatatggttgcagggtttctaaaattttcataatcagtttagaaaaaataatgcagcttcttacatactgacatggaatgctgtttaaggtatttttcaaaggaaaaaaaaacagattcggaatactattacagaatgatactttcttaaagtaaatacatatacatatacatatccagagaatatcctgaaaggataatacatgaaactggcaggggcaggggcaaaattgggtaactggaatgcaggggtggcatagtatttacattaatatttgaattttttatattttatactgtataaaataaatacaaaaaattaaatacccacaaaaataaaaaagtaaaggctctgagaacttctacaataagaaaacgtttaaattttccttgatccagcattttacaaacctatatgactataggaaactgactcctctccctttttcaaataatagctatttctatcccaacagtgactgtgtattgcttacaccatattaaaaaacacttatttttttaaatcaattttttactagttgtaccaactaaatctagtaagaatataacccaggtcatttgaaatattcttttttttttttttttttaaaaagagtccatcagagtaacttcaaatataattgcaatttcactggcagtctaataaaattccacccactaaagttctagacttaatattttccaagacattcttaaattcagtcactgtcccatgcttacctgtttttaaaaactcattaggtacctctgttattactgtccaaactgaatgatatcaactatttctgaaaacataaaaaattgcttgttgaacatacaaatgattccataagaagatgccacaatatattttagttgctaaagattaatatgaaatgatcacatgacctgagtcatattcttactagatttagttggtacaagtagtaaaaaattgatttaaaaaaatgtgttttttaatatggtgtaagcaataccagtcagtgttgcaacagaaatagttgattaatatgaaatgatatcaactatttctgaaaacataaaaaactgcttgttgaacatacaaatgattccataagaagatgccacaatatattttagttgctaaagattaatatgaaatataaccattattttgatacaaaaaagaaaaacaaacccacaaattcttgttaaagttcaacagatattatttaaattgtagtatcttgtttttaacaatttaacagtttaatagtgaaaattttttctatgatacattaatttcactggttcgagtttctaaatccacttgaaaattttctttaatagtatattttattcaatttatctttgtacctacactaacaaaggaaaaagaatacaatttgtgaatacccagaaattccttaatcatggagaatgtatacaattgtttctatgctctttgaagggaggacatgatcctagtttcatttgtgctaacaaggagaatttattaccaaaacatctgggagatgaatgagatgctaaaacgaaagacatggaagcctagcaacatattctagtctagctaacccttcctaagaaaaaaagatagtactaatagtaaggtgctaatgagccgtacttggtaccctcatgctcgacaaccttctcagatcactcaggttgaaaataaacttctgtattacaactgaaactaaaaattacactgaaaaggacgtgtttagcaccgtagaggctcctacatatttaaagctacttctttaaaattccatgttttagatgtttgaacaagacatcaataattccattatccttgttctggtttgatattatttttatctctcccaaaccataaaatttgcaaaagaaaaaattcaactgcaaaattattcaatatttggaaacgaaaatttaacaaaccctcttaagaaccaataaaagctatcaaatagaatacaaatagatacataaaattttatacactggtaacagcattcaaatcaaagaggtgaagtattctaagaatatttactccagttgtgttaggaacaaactaaattatgacttcctcgggccaactaaatccagtaagaataacattctgttgctaatatgatcatatgaaataattatttttaaaaagaacttagcctatcaaagtcaacttcaaatataaaaagtgttccccatcaatcaactgtatagaaacaatataaaattattcaagatttattttacaaagatacttctcaaacccaagtgcttcctataataatacacatcatatactgtttactgatcaataggaaaaaagaaaaaaatgaaacaaaattagaataaaatatacaacttctaccagaaaaaaaaagagactagaaccagcagggacaaataagtggaactgattagaagacactgacttaaagaattggttatatataaaacatagcttcctatattggatatacctaaacttataatcccatacactctattattcattaatacagactagaggtccacaaacgttctgaaaagagccaaatagtaaatattttaggctttgcaggccataaggtttctaacacaccttctcaatactgctgttgtattgagaaagcagtcatagacaatacatcaacaaatgagggtggtggtgctccaataaaattttgtttttatggacactgaaatctgaatttcatataatttctacacatcacaaaccaatcttctactaattttttcaatgatttttaaatatacaaccttagatcatgggacatacataaaaagaaagctgtgggctctagactgccaacccctgcctcatctagaaatacatgaaaagtagttactagaaatactttccaaacattctttctaataactgaatatcaataatgttgcatttttactatgccattatttttaccatatgtaagttctaaaacagtataatctgccaaaataatgacggaatcaaagctaagaaagctaaaatgaagtattcttaatatttcaaagccacaaaaaagaagcaataaaaaaaacagaaaagtgttgtttcattacacattcctaggtcataaatttcacgtagacttaaactaactctatataatacttgcccactgagtgatacaaagttattagttatattatgccaaatttagaatttcattaattccaaatgtaatatagtattaaaatgtggccaaaagaatcctggagcctgggtgacatggtgaaacctcgtctctacaaaagacacaaaaattagccaggcatagtggcccttggaccacctggtctatattaacgagctactagggaggctgaggtgggaggatggcttgaccccagaaagtggtggttgcagtgagccaagatggtgccactgcactccagcttgggcaacagaatgagacccctgtcctcctacccttgcaaaaaaaaaaagaatcctggtagtttcatagttaacactgtttcatatggtaatactgaaatgtcttagaaaactcaaaggacaaagttgtgaaaactgtattttaattatagcttaccctttaactagttgttaagatcttcagcaaatcatgtcagccagcatttcctaaagtttgccctgtatccacagatcattcattaatgtaacaggatctatggccaattgagtctgagaaatgctacacattatatacatctctagaagatttataatgtacttaagcagatcataaattctgagaagttccgcagtaaagaaaactgttggtttaatctggtattgtccaaacttaaccactttttgtgtgtcatacttattaacatccaaaaaaacctaaaatttcttaaaacatactttagaaaattttctaatctctagtcgaaatcagataaacatccctttgggttctaaattttagaattctgtgagactaattctaagtggtaattttgtgaaagctgttcaactattaagttcaggtttacaaacctggaacctctggatcaaatgtactcttttatactcccacaacactatgaacttcctctactagagcacttatctttaagtagacatcatttctctaactttctagacttactccttaagtgggagatggaaccatcctagtttcttcaacacttaggagaatgcttggatcactcactaaatgtgtttcggttttggttttgtttctattttattgcaataatctcccacttgatctacccataaccactcttgcctttctcctactgcttctctatgcaaacatggtcaggtctcccccactcaaaaactttcatctttgccaggtgcggtggctcacgcctgtaatcccagcactttatgaggccaaggtgggtggatcatgaggtcaggagatcaagaccatcctggccaacatggtgaaaccccatctctactaaaaatacaaaaattagctgggcgtggtggcatgtgcctgtaatcccagctactcacgaggctgaggtaggagaatctcttgaacccgggaggcggaggtcacagtgagccaagatcgcgccactgcactccagcgtggcgacagagcaagactccgtccaaaaataaaaaaaaaaaactttcatcttccactcttctgaaaatgaagaccaaatttcgtaaaatagccctggaggatctagtctctgcctaccctctcctgctttacctcttttatcactgcttttctttattttatctgctttagccatacaaagctaataaagatgaaactagacggcatagagaaaaaagcaaggcaggggcctggggaatgtcagggtaggacagggtggagtgggttggggtgaaatgaaaggcaagactgaaaaggttacattagaccttggcaaatgagagagaacagaaaataaatacctctaaaatgggagtatacctgacttgtttggaaactgcagccagtgtggctggagtgaagttggaacagcagggagcagcaggtgggttagagaagtaataaaggtctgaaaaagcagggctttgtagggtgatgtatatgcaatcaactcccatagttacctctctcatctagatctctcctgagtccagtctcctacatgaaacacatatttgacaactcctcttggatgtcttacagacatgtctatccccgaagtcttaactgcactccaaatctgtttcttctccattctttcccatctcagtaaatggcagtaacctctatccactggcaaaagcaagaatcctaaaaggttctcccactaaatttagaatagacatgaaattccaattaaacatcctccacactaggcagctatagcctttaattaatatagcaaatatggtaaagaccctaatcccatacatacagtactccgttaagtattaccacccagtcacatattacacacatacaagaaggaaatcacttgcatctgagtcccaatcaaggagttcacattcctatgggggcagagactaggtgaagtgggacagtgaatctgcatatcctctgaaatgcccaatgtccatctaagacaaaatggtacctgtacccagagggttagcccaaatagtataatagcttcgagctaagaggtagccatcatggaggaagaggtccttatggcctctgacaatatcaatttaaaaacaggaggtccagtgagcccatcaagcaagatcaacataccatatacctgtacttttatactctaaaaagagatgggaacacagactaggaactactgccgtgtttgaaaatgcccccatgtttgttttctgtgctactgtctgttacttcatagtgactagaaacaaactctacaacaaaaatgacaatacattatggtgtattactacagcagaatactatgtaaatttattaaatagttgtacacttagttacatggaaactcataacacattctgaagtgaaagcatagtatataatttgcataaatagatacactcatataaaatgctacagctgcacctctggtaagccaaaggtttgtatggacttgtcctagaaagcaggaaagtgaggaactaagaaggcaaaatgaaaaattagaaatagattttgaaaagtaagttttacaaacttacctgacaaatttaagagaagtgaaattatacatagtgtattcactgaccacaatggaatcagactaaacatcaataacaaagataacaggaaaaatctccaaacacttggaaactacacttctaaaataatccaggggtcaatgaattaacaagggaaatttttaaactgaacgaaaataaaatacaatatatcaaaatttgtgagatgcagaagtgagaaaaattcataacactaaatacatagatcagaattagccaggtgtgcacctgtagtcctagccactcaggaggctgaagcagaaggatcacttgagcccaggagtttggggctgcagtgaactatgattatgccactgcactccagcctaggcaacagagtaagatcctgtctcttaaaaaaaaaaaaatgttatgaagaatggtctgagaaaaaaaagaaagaaaagacgaaacgtttcaaataaataatctaagcccacacctcaagaacaaagaacaagaaggggaaagtaaatctaaagaaagcagaaggtagtaaatctaagaagagaaatcaataaaactggaaacagaaaaaaactatacataaaagcaattaaacaaaatcttggttctttgaaaaggataataaaactgacaaacttccagcaacactgacaaagaaaaaagaagacacaaatcatcaatatcagaaaagaatcagggattatcactagagatcctgtagacatcaaaagaataagggaatactaagatcaattctacacacagaaatttgacaattagacaaaatgagccaaatcctcaaaaagcacaagctatcacaacttacccaatatgaagatgacttgaaaagccctataagtattcaataaattgaactcatacatttaaaactcctaaaaaagaaaatctccagttgtgggtgttttcaggaagaattctgccaaacttttaaagatgtaatgtctactctataaaatctcttccagaaaacagaagaggagagaatgtctcccaactctttttatgagtacaatagtatcctgatataaaaatcagaaaaagaatgccaaaggggttatggtggggggaactacagacaaatatcgtccatgactatagagacaaaaaaccttaatagaatattagcaagtagaatttagcaacatacataaagaatcttagaccatgaccaagtatcgtttattgcaagcatacaaggctggttcaatgtttaaaattcaatcaatgtaatctatcacattaacaggtcaaaaatgagaaatcatatgatcagttaattgatgcagcaaaacatttaacaaaattcaacacccattcacgataaaaaaaattctcaaaaaactaggaagaagaacatgtccagttggatttaaaatatttactaaaaatctacacctaaaatcagacttaatggtgaaagactgaatgttttgtacatgaagaatgaggcaaggaggtccactcccactactcttacacaacacagtgcttgaagatctagccagtgcaataaggtaagaaatgaaacacgtattagtccgttctcacattgctataaagaaatacctgagaccaggtaaattataagaagagttttaattggcttatggttctgcaggctgtacagggagcattgaggcttctgcttctgggaggcctcaggaaatgtacaatcatggtggaaggcaaaggggaagcaggcacatcttacatggccaaagcaggaggaagagagaaaggagggaggtgctacaattttaaacaaccagatctcatgataagtcactcattatcacgagaacagcaccaaggggatggtgctaaaccattcatgagaaaccatccccatgatccaatcacctcccaccccacccaacctccaacattggtacaattgaatatgagatttgtgtggggacacagatccaaaccttatcaaaatgaaaggcaagcagatcagaaacaaagaaataaaaatgtccctatttaaagatgaaataattgtctgtgtagaaagaaacatatttttaattacctagaactaataagtgaattagcaagtttataggacacaagatcaaaatacaaaaattgaaatgtaggtctacataccagcaataaatgcatggaaggtgaaagtaaaaatacaagaaaagatttactctaaaatttacatggaaaggcaaagaaagcagagtattcaattttgaaaaagaataaagcataagaaaccactctatattattttaacacttattatgtaacttcagtaataacactgtgaggagttggcagagacacagagttcaacagaacgtaatagagaacccagaaacagacccacactagtgtggccaactgtctttacacaaaggtgaaaaagcaattcaatggaggaaggagagctatccaacaaatggtgctgaacaactggataaccacaggcaaaaaaccgaaacaaaaacctttgacctaaacatgacacctgataaaaagaagctaattcaaaatgtacatttaaatgtaaaccataaaacctttaaaagaaaacctaggagaacacctttggggatctagatttggtgaggagatttagacttgatacccaaagcacactcacaaaaaaaactgataaactggacttcatcaaaataaaaaacttctgctctatgaaaaactatgttaagaggatggaaagacaaactatgaacagggagaaaagatttgcaaaccacatatctaacaaaggatttatatctaaaatatatacaaaactctcaaaactcaacagtaaaaaaaaaacaattttatagaaaatgtgcataagacagagatatttcaccaaagacacacagccagacacacacacacacacacacacacacacacacacacgaaaagatgttcaacatccctaaccattatggaaatgtcaaattaaagccataatgatatataactacacatcagaatgaccaaaataaaaatagtgacaaccacaaatgctgtggaggatgagaagaaactgaatctctcatacattcctgattgtgatgccagacagttcagcaactctggaaaatagtgtagcagtttcctagaacactaaacatatatttactacacaactgaggtatcacactcctgtgtatttatcccaaagaaataaacatttatgtccatacaaaacccatacatagatattcacagcagctttatatgtatagctaaaaactgaagaaaaacaaaacatccctcaataggtgaagggttcaacaaactgtggtacacagaacactactcaaaaacatagaatactattcaaaaagtcacatactatgattccatttatgtaatattcttgaaatgacaaaagcatagagatggagaacacattcatggttgccaagggctagagatagtagggtagcagaggtgaagagaagagtagttaagggacaacataaggaagagctttgtggtgacagaataattctgcatcttttttttttttttttggagacagtctcactctgttgcccaggctggagtgcagtggtgtgatcatggctcgtagtagcctcaaattcctggtatcaagcaaccctcccacctcagcctcccaagtagccaggacaacacacatgtaccaccatgtctggctaatttatttttatttttgtagagataggatctcactatgttgcccaggctggtctcacactcctggtctcaagctatctgtcccacctgggcctttcaaaagagctaagattataggcatgagtcaccatgcctggccgagttctgcatcttgtttgctgcagtgcttgcatgaatctacatgtgacaaaatgaaacagaactacaacacatacatttaccaatgtcagtatactggtttgaaatattgtcctacaagtctgtaaaatgtaaccaatgggggagactgagtgcagagtacatgggcttctgtgtgccatttttacaactttcagtgaatctctaattatttctaaataaaaagatttttcaaaaggaagacagaataactaaatcaatagtaattagcagtatctacattctcaagtttccaaatacgtatcttgaaaatttacatcccacatatactatcattcctagtattttcttgaatgattttatttcatggtgatttttattctagaaaaaatacgttctgaagtgaggcttcgagtgttttacttcacagtatccaaaatacccaataacaaaattattttgtaaaatgggtttgagtcttgcagaaatagatttataatccaattctataacttacttcataaatgatactgagcaaattaaacttgagtctctgtttcttcgtaactaaaacagggataaaatatatataccttggagaaccaccacgtctgtgtataaagaaactggcagtgttctacacacagtagactacataacttttactgttatcatcttatctccctgaaggtaacacacattcctatgggcaggaacaatttcatgtatttcccttgaatcaccttactgctgtcagcatggtgataagtatacaaaaaatacccaacatgcaattttctttgaacttttaacttctgccattaaaattaccctttttctttactgtaaatggttatcctctgattttctgaaaagggttaggtttggagtctttcagttgtgtcttgtttttcaaatgcgagttttcttgtttttgttttttagagacacagtctctctctgttacacaggctggagtacagtggtaccatcatagctcactgcagcctcaaacttgttggctcaggcgatcctcctgcctcagcctccctagtagctgggactacaggcctgcaccacatgcccaacttattttttaattttttgtagagactaagtcttgctatgttgcccaggctggtctcaaactcctggcctcaagcaatcctcccaccttgccctcccaaagtgctgggccaccaggccagcctccaataagagctttttgatgaagctaatatgtagtttctaaaggcatcaagccaagaaagagtagttcaatggtgtaatagttcagagatgcaaaacaaagaccgagatttccaaacattctgcacatcccatattcttgtttctaactcagccagttaaaaatatttttttgatatccaataagtggcatttttccaacgtctcatcacttcatacagatcattattcttgcttaccatttaagtaaagacttctatttgtatttaaattgactaacactgctccccattacccctttctcaacacagaggtccaggttgccgaccctgatctttgcaattttctagaaattatctctaaactcacctattcctcattatatttgttccatcacaatagaaattataaaaaagataataccagcccccactctgtaatttggtatcttctctgaagaatttattctactaattcttctcctagttctaaactcctaaaaggaactgtcaagtaactatcaaataggattaacaaactcaactttaatactgctcactaagcttctttctcttacttataaaagtcatattaaaatgtactatgatggacagggcagtttgtatgatattatcatcaatatatcacaacaaaagttccaaacacaacgctttagatgtctttgagaaggttttagatatctttgagagcacactactcaaagatgctcttctatatttaattttttataagttagtatatatgtcttctatataattttatatatatatatatatatatatatatatatatatatatggtgcaaagatagcacagagttcccacacacccttcatctagctttccctaacattagcaactgacaaaaacacagtaacactggtcaaaactggaaactgaacattgatacaacagtattaagtaaatcgcagattttattcaaagattctgtactttttgagtaactggtgacactggacttccagatatgatggggataactgaatatccagatgtcttgggagaatttctattatcattcctaatttaacatggtcccagctgctctatgatgagctttgattctctatgagagcatagagtcatgctaacatagaatcttatgttggatgaaaccttggaaatcatttaaattttttttaagtataaattatgacccattaacaggtcatgaaataaatttaataaaccacaactataattttttaataaaacaaaatagaaaatattagagtataatacagatgttatcgtatcataaattttttgttttagtgatatatgtaaaaatgtatatgtgtgtggatgtaggtatgtatttatatactgggtcacattatttttaaaaattccttagcaaaggtcagagtcaaaaatgttttaaaagtcactcatctatatcaaaccaaagaaagttctctttaatattcctgacaaatgataacccccatctctaactaaacactattaaaggtagaatatttgctacttatacatcagacggtaatacgtattaggacatttttaatgtggaaccaacatttctctgttgacttttgatctacaactcacaaaaagggtgggttttttccttctaaagaaaaatactgtgcaatcctatttctttttttccatcaaattagtgaacagaagttcttacacctagaaatcaaaagttccaaaagaaagtttccttttcagttcccaagaagagactctgaaaataaagggcaataatagaagaacagaaaaatatatatgtaaggactctaaatgggagaatagaagtaatgccaagcaaaaacgtcaagtcgataaaggaacatctttgaggaaatgatataaatattggatcctgcccctggccagccctgcccggccatgcgtccctcctcctccccaccttgtggcgggcagcagccctctagctttggctccgtggactggctctcccaaagcagctgctcagggccgacccacacccccaggcctgccgaggtctccctggggagcctccctggcccggaccaggcatcgggccccgaggagccccctcaggccgtcagcatcaaggaggctaggtcctcaaatctgcctccgccagagagggctatggctgggttgaggaaagggccaaacgcctggcgggccccactgtgtccacacagccttcaccacggagcaggtccgtggcttggagggcatcttccagcaccaccagtacctgggccctctggagtggaagaggctggccagggaaatgcagctgtcggaggtccagataaaaacctggtttcaaaatcgccgcatgaaacacgaacggcaaatgcaggactcccagctgaacagcctcttctcggagtcactgcacgcacccctggctttccactcaccgtcttctggccttgccaatggcctgcacctgctgtgcccttgggcacccctgcctgggccccagactctgatgctgtcccctggctccttctggggtctctgcaagtggaacaagaggccctggcctctgagtgggcctgctgctgtgggcagcctctggcgtaccaccccccaaagcccaggaagtggcatgcatacgctgggaccagccctgtccacggggccctggggcctggtgtgctctgccggagacgggatgcattttgaggaaatgcctctgactccaggcctcccatacaggtctgtgcagattgcacctggcacctacccagagaactcagctgttctgtttacattgtggaggcacctctcaccctgacccacgcaaaggttctggagatttctggagaatatatttattaaagccacctcttcaccaaaagttaccaaaagggttggtttaggaagtaaatgaagggtcagtgtagagtcaaacgcagaagtgggcttgttatagggagggctttcagcatatgataaaagggtaatttgttttttaaaaagtgttggaaaaactggttttccagttggaaaaagtaaaggttgtaggctttgtgtgtaaaaaagaaaaccatgaaggattggaagggggaaaaaaaagaaattatataaataaaattatcaaactcaggcagataatttcatagaagtatgcattacttactagcaaatcttctcattttggaaaatgtttcactttttaatttttttagacacacaaataagaagaaaaacttccacattcaaaagaaagactaaaccatgcacaaatgaaccctttctgtttcctttaacatacaagaaagtgatttcatgaaatttattaaaactgttatttctggccaggcgcggtggctcacgcctgtaatcccagcactttgggaggccaaggcacacagatcacgagatcaggagttccaagaccagcctggccaacatagtgaaaccccatctctactaaaaatacaaaaaaaaaaattagccaggcgtgctggcgggcatgctggcaggcgcctgcaatcccagctactcgggaggctgcggcaggagaatcacttgaacctgggaggtggaagttgcagtgagcagagatcgcgccattgcactccagcctaggtgacagagcaagactctgtcccaaaaaaaaaaaaaaactgttatttctgtccaattccaagcaaccaaagtacttcatgtcattaaatatgtatgtgtaacacacatacacatacatatatacatatagatattcaccaaaccattattcaactatctggccacttcattctactcaaaatgcagatccttagcaaaatttatgacagaaaaaaataaattctgaagtaaaaaaattcaccaactagataaaactcgatgttttccacagttaaggggacatcttagggcgtaattaaagccctgctactcttactttgccccaaattcaaacaataatatcggttttcaagataatagcaattgaaaagcatcaaagaaaggagcaagcaatatgcaaaggtgcactgacaaaaacaagaaataagatgacaatctgactgacaacaatgatttggaaagtaactaaaagcacacttgggtactctagaaacagatgtctaggattatctggtataaggacaaaccatgtacatatctcatgaggcttgtaatacttattgtttataaggttgataatgagtcaacagcaaggattcttcatgctaagaattgtggcattttctatttaaggatataaaaaatatatgccataacttttagaaatatttctatccaaaattactgaactaagtaaagttttaggttccaaaaaaaagtgaaccctcagcaatgtggggaagctagctgtccagaacaattatccttaaggagtgtggttaactgtaattcttcccttcttctttacttctttcaaaagttctatgactattcaaaccatctcataatctttgatgttaatagagggtaatgtgttttgggttgtggggaccagtatttaaatgactggacatagaattacttggggaagttttaaaaaacagtgcggttcaagctctgcaaccagaaattctgatttaattagtccacataaagtctgggcatcagaatttttaaagctgcccaggaaagcctgatgttcagtcagtgttaggaaccacttaggtaaacagttttcttcatgacacctttaggagtcttcaagagagatacagtatgcagcatttccaaaatttgtcttcaaatcccttttaccatggaacatcttataacactgacttaggtaactcttcatctgaaaatcaaggtaaatattaagtttagaatcaagttgtatagcttttcaaactttgtaaaagttctaatgtggttaggaagagggaaggggagggaaaaaataaaaggatgacttacttttatcttgctaccacattttttatattacaaaaattccaaatgaaatattttaattttaacttaaaatttcatagtttattttaatcatgcttatattaagcctgtgactcaaaagcatttacatgttgtgaaagctaatttcaaagataaaaccgtgctgccctctaatggttcaagataaatatttttacctatacatagtagtaaggtgataaatacaattttattattttataaatgggaggattacattatataccagaaaagaaaaataagatttcaatttttggtataactgagcccaaaaacttaactatgactgctatgttcaagctcaagacccttttaactgtccaggcacactggctgacccctgtaatcccaacactttgggaggccaaggcgggaggattgtttgagcccaggagtttgagaccagcctgagcaacatagtgagaccccatctctacaaaaaataaaaaattagccagacatcatggtgtcccaactactagagagactgaggtggaaggatcacttgagaccagaaggtcatggctgcactgagccgtgatcatgccactgtactccagcctagatgacagaacaagattgtctcaaaaaaaaaaaaaaaaaaaaaaaagaactcttttaattatcaaacctttttttttttttttttttttgagacggagtttcgctctgtcgcccaggctggagtgcagtggcacgatctcgactcactgcaagctccgcctcccgggttcacgccattctcctgcctcagcctcctgtgtagctgggactacaggcgcgcgccaccatgcccggctaatttttgtatttttagtagagacggggtttcaccgtgttagccaggatggtctcgatctcctgacctcgtgatctgcccgtctcggcctcccaaagtgatgggattacaggcgtgagccaccgcgcccggcccaaaccatttcttaaaccaccacatttgcctatgcatgtgtaaatcaggataaaaatgtacacctcttctgcattctgcaatagccatctctaacttagcttctttttcaaataaatctatggcagtagtgttcaaacttgaatgcttgtaccctacaaaaacattttagaaagttacacatattcttgcatatttcttcttacagctaaagttttaattcacatttttaaaatttcattaagtacttgcaaaggatgtagtttctaatttactgtaaatatttacattttaaaataaaattatgtcactcttttaagtgtatccaaaaactgaactatcatagcaagctgacatccacctttatctactcaaaaaatacataaattctgttaaatacaacagaaattttacaccagctgtatcttgtttaacttgcattttactgcactctctccatttcatcctaatttcatattttataactaaaagtcttttattcctcattctaccataattctatgcaacaaaaatagatatattaattaaaattataggagtttgtacttccatgtaagttagaaaatattttgtgcaatgagccattattgaaattattagcagataatgaaacaaatattataattttaatacatcttttttttttttttttttttttttttggagacagagtcttgctctgtcgcccaggctggagtgcagtggcgcgatctcggctcactgcaagctccacctcctgggttcacgccattctcctgcctcagcctcccgagtagctgggactacaggtgcctgccaccacacccggctaattttttgtatttttagtagagacagggtttcaccgtgttagccaggatagtctcaatctcctgacctcgtgattcgcccgcctcggcctcccaaagtgctgggattacaggcatgagccactgcgctgggctaatttttttgtatttttagtagagatggggtttcaccgtgttagccaggatggtctcaatctcctgaccttgtgatccgcccgcctcagtctcccgaagtgctgggattacaggcatgagtcaccgtgccaggccacataatttttaaacaaaaagtaaaatattaatggacatgaaactcactgacatttacagagctttttttctttatattgatgtatctaagaaagaatatttcttactgctaaaatgagataagttctcaattctactcttatttcacttatttcaggtataatcactaagaaatgtaattcacattaaaaactaaatcactctgagttttgttataacaaggtcactcaattttttctatgccaaaacacacactgtgatctaccatcagaaattatttttaatgacgtggcaattgatgttaagtcctctcacaatttgctgaaagcaagtaaccagaaactacctgacttacaaaggatgcattacacatttgctacaattattcagattctccatttctgggaaatattccaaaacagtattactatgacttatcaaatgattatgaattatacctgctattgtttcccttagcagtttaattttatatagtccaaaagggtagaaaacatcaaaatattgttaattccaatatccttttgctgaaataacatttgttttataaaatgttttgatcttatcatacacttcaaatatattttacccaaatggtagagctgcaaacagctcatttaatttatggtaaacacccgctgtcaaccaaatgccaaatcaaaatctgcctttatttctcaactcaaatacatttcaggcttaaacaaaaaagattttaaatttgtctcataaaacaaggcccaaatatacactacatacaagagacaccaaaaacagagaaaagctaaaaagttgtactagcttaatgaaaacggaaagcagtgattgttatgctgatatcagacaaagcagagttcaagcaaaaaggtattaatggcgaacactaggtattaatgctaaaacctgcaattcttcagtgatatataacagttatgaatacctatgcaccaaataatgcagcagccacctgaagccaaaaactacaggagatgcaaggagatataaacagaagcacacaaatactaagagattttaacacatcactctcagtacaacacagatcaagtggacaaaaaaacatataaaagaccaaagcaacaaactcttacagaagatgttatgctgtatatgtgtgtacatatgatcctccatttgatctcaaagaaagcataaggaagtgccacaaggtggagatattacagtctcaaatcaaaatataacaaactagaaattaataacaaaattttaaaaagcaaagggcccttctacttgaaaaataaaccttttattaagtaatttgtacatgaaagggaaaatacaaactagaaaatcaatactgaaagaataataaaaatactacatagcagaaactatagtacaaatgtaaaacaatggtcgaaggagaattcataaccttcaacagttatagcaataaacgtattcaaatgaatgaattaaattcaacataaatttttagaaggtatatattattactaatttcatattagattttatttgctcatttttttcttctatatttatattggtattagactgcaacttccttttctgtactgtctttaccaggtttaggtgtcaatgacaactttatttgctaaaaagaattcagaggccgggtacagtggttcatgcctgtaatcccagcactttgggaggccgaggtaggcagatcacctgaggtcaggagttcaaaaccagccaggccaaaatagtgaaaccttgtctctactaaaaatacaaaaattagctgggtgtggtggcgcacacctgtaatcccagctactagggaagctgaggcacaaggatcgcttgaacccaggaggcggaggttgcagtgaaccaagattgcaccactgcactccagcttggcgacagagcaacactccattaaaaaaaaaaaatatttaaaaggcacaatagtcacactcagtaacacggggttttaagaactatcttgggggactgggcacggtggctcacgcctgtaatcccagcactctgagaggctgaggtgggcgaatcacctgaggtcaggagttcaagaccagcctgaccaacatggtgaaaccccatctctactaaaaaaaaattaaaaaattagccgggcgtggtggcccacgcctgtagtcccagctacttgggagggtgaggcatgagaatctcttgaacccaggtaggggaagttacagtgagcgaagatcgtgctattgcattccagcctgggcaacagagcaacactccatctcaattaaaaaaaaaaattatcttgggaagttcaccaccatttatcacaatgtttctatgagaaaatacattccaagtttccagtaatcaacataaaaacaaagtttggaacaaggcctatttgatgatcacccaaaatcttacccagaatttattagacacaatattacatttccaagaaattatgttattgcagaaacttctataaacatgtaacataaaccctcattaatagtcaaagcaaatttgttttaaaaaccatacttatgccgggcatggtggctcatgcctgtaatcccagcactttgggagcccgaggcgggtgaatcacgaggtcaggagttcaagaccagcctggccaacatggtgaaaccccgtcttcactacaaatacaaaaattagctgggcatggtggcacgtgcctgtagtcccagctactctggaggctgaggcagaagaatcgcttgaacctgggaggcggaggttgcagtgagccaagatcaagccactgtactccagcctgggcgacagagagaaactccgtctcaaaaaacaacaacaacaacaacaaaaacaacaaaaaaaaaaaaccaaccatacttaaattgctttctaaatccaacggacactaaaacttcacaaaaccttcactgaaaatcagtatttgaagaaaatgcataaaaagtgattgagcattaaggagaaacagctggtggataacgttttttgattcataaaggaaccctccaaaacaaagcagaaaaaaaagcttcaaaagtttttcggaatttttagagcaatgactggcaacctatataaacctttcagaattctgaatactgaaagcccacgtatttatatgtcacatgacatattaaaaagagcttcatggcctagcttggtggctcatgcctgtaatcccagcactttgggaggctgaggcgggcagatcacctgaggtcgggagttcgagaccagcctgaccaacatggagaaaacctgtctctactaaaaacacaaaattagcctggcatggtggcacatgcctgttgtcccagctactcaggaggctgaggcaggagaattgcttgaacccgggaggcggaggttgcagtgagctgagatcgcgccattgcactccagcctgggcaacaagagcgaaactctgtctcaaaaaaagaagagcttcataatttaaactgtcattgtacccagatttttttttaaacacaagtaaataaacattgctaagcaagattttgctcaactgaacaaaaaaataaagatattggtgaaagagcattgcttcaaacacaaaataaaccaagtatttttcagagcttgagcaacagattaataaaactagcctcaaataaaagaatagagaatgctatttatttctccctttctagacaaaagttgttaaaatttttaaataactttaggactagaaagatagaccccttgttgtaaaaacattacgaattcagtattaatcagatttaagtcatggctatattttcctaaataatcgcaacaaacttgaggggagaaaaacttacggtaattatctttttgttgccactttgtttatattcacttttgtagagaataatgcttaaacttttagcataaagaactcaaaaaggatttcaatagcattaaaaaaaagtgaccaaatgaaaatcagactaaggtcaacccaaaattatagacattttttaatttaagaattggctctgtttacttatgcttttgtttttgtctaaaggggatatgaaaaatgttaaacttgtgtgacatatcctgtaatcccagcactttgggaggctgaggtgggcggatcacaaggtcaggagttcaagaccagcctgaccaacatggtgaaaccctgtctctactaaaaacacaaaaattagctgggcatggtggtgcatgcctgtaatcccagctactcaggaggctgaggcaggagaatcacttgaacccgaaggcgaaggctgcagtgagctgagatcgcatcattgcactccagcctgggtgacagagcgagacaccggctcaggaccaagattaagtggtgatccctgggcctgcctggctgcctctaaaaacagaacaaaggagcatggagtcctgaagttctatcatggtaaatgtattaccaagttattagtacttgaatactaactctgtggcaagaaaacagaccagatattccttgggaatgaacgctgagaaagctgaaagaccagcttgaatggctatcaagctagacaaggcagaagaggtatgtgtataaaatgctgcatataattacacaaaggccacagattttccaaagctcatgtttaaatcctaacttaataactcctgatatgcgcagttttctaagggagaaatgattctctgggtaacattattccagggtcaagtaaattttaacacgggccaaaaatatccatatgcaatagagaatcagccattcctcctataaagcatacacccagaaataataacagaatcacagcctgatttaatttttttaattaagcagatgtaaattcttttaaatctcccacagtaacaatgtccagtacaaatacactgatatttagattcttttaaaggaactcaaaacactacagtaaagtaaggtaaagggtcatgcatggtcactgaattactttattaaaacctgaaaacaacactgtaaggaagcgttatttattctcctaacttacaggtgaattaaccgagaattagaagtcgaataacctgctcaaatccacataactatgattccaactccagagtttgtacttgtaactaaacaagctaaaatgcaataaaggctaacaattataataacaatcagtgcacaaaggcagaagctaagcaactgaaccagcctatcattctgtcctcaaacaccctataaggtaaatattattttaacctctagaaaaacatttacaatgtttttggccaaatgcttgagaagcaaaaatctggcgctttcttataaatatttttagcctcaaagaaaatggaggattacaaaatgttattttttaaatcaatgttattgaggtaaaatttacatttaatgaaatgtgcctattttaggctcagagtttgatgaattttgacatacactcatattaacaatcaccaaaatgaaaatacagaacatttctatcacccccaaaactttccttgtataggaaattcccagccccaaatctagacaatcaaagaacctctttctgtcactacggattagtttcgcctattctagaattccacaaaaatagaatcttacagtacctacactatgtatctgtcctgtcttcttttgctcagcatattgtttctgagattcatgcatatcattggatgaatcacaagttttgctgttgaatagtatgccaagtcatggttacattacagtgtaaccatttacctagtggtagatatttgggttgtttccaatttggggctattataaagaaaaatgctacaaactttcatgtataagtctttgaatggccatatattttcatttatcttaggtaaataccacatggaattgctgggtggtaagataagtactacatgcttaacttcataagaacatcataaactctgacaaggtgcctgtaccattttatatccccagcagcaatatatgagacttccagttgccccaccatgacactaggtgttgtcagtctttttaaactttagctatggttttaatttgcatttccctgatgactaatcactttgagcatcttttcatgtgtttattagccattcttatctctattgtctattcaaaaatattgtccatttttgccttattaatgagttgtaggtattcctttatatattctgaagtcctctttcaaatatatgtattacgaatgtttccttctaatatatgtcttgctttttcattttgtaaaaagtgtctttctagtaccagaagtttaaattttgatgacttataatttctcaattttttcatgatccatgtttaaattttgatgacatgtaatttctcaattgttgcatgatccgtgctttttgtgttctaagaaatctttgtctatttccaaagtagcaaagtattttcttctggaaattttactttaacttttacatatatgtctatgacccatttctgatttatttttgtctgtggtgtgaagtcaaggttcaggggtttttgttgttgttgttgttgttgttgttgttgtttttgagacagagtttcactcctgttgccaggctggagtgcaatggcacaatctcagctcaccacaacctctgcctcccgggttcaagcaattctcctgcctcagcctcctgagtagctggggttacaggcatgcgccaccatgccaggctaattttgtatttttagtagagacaggttttctccatgttggtcaggctggtctcgaactcctgacctcaggtaatccacctgcctcagcctcccaaagtgctgggattacaggcatgagccaccgcgcccagcccaggttcttttttttttctgtcagaaaggccaattattttactattatttgttggaaagagtatcctttccccattagcaccttcactggaattaattttgaaagaattaaattgttcatatatggattgatctatttcttgcctccatattccagagatcagcaaacttctgtaaagggcccaatataaaatattttgggctttgcaggccatatgatctattacatctattcgactctgctgttgtaacacaaaagcagactataaataagcaagtatatacaacacataagcaagtgactgtggctgtgttccaatgacactttactgacacacactagaatttcaatttcatctaaatgtcatgtgttgtaaaatatcattttatttttgatgtttttccaaccacttgcaaatgtaaaaaacattacttagcttgcaagccatacaaaaacaggcaagccagacgtgacccatgggctatagtttgccaactgctgttttattctgttccactgatccatatatctgtccctatgttaattttctgctgtcttgattattgtagctttatagcaaatcttgaagtcaggtagtgtgggccagccaattttgttcttttcaaaattgctttggctactgcaaaaacaatttgcagtagccaaattgtttttttgcatctccaaatgtcagcactactttattaattttaccaaaaaaaaaaaaactctactatgatttttgttacaactgcattgcatcttcacatcaactttgagagaactgaaatcttaaataatagagtcttctttaatttgagcagtattttatagccttcattatacaggttgtgtacctattttattaaatttatctctgaatatgttttcacgctatttaattccccaactgctcattactatttactagaaataccactgatttttgtatactaaccttgcaacttgtggccttactaaattcacttattcagtagcttttcagtacttttgatttattattttctacatacagaatcatggtgtctatgaagatagttttatatctcctattccaatattcccccatttgtttcttcttattgttgcacttgatagaactcaagtataatgtggggttctttgttgtttttttgaggtggggtctcactgcgttgcctaggctggaatgcagtggcgatcacagctcactgaagccttgacttcccaggcccaggcaatcctcccacctcagtctcccaagtagctgggactagaggcacacgccaacagagatggggtttggtcatgtttcccaggctggcctcaaactcctaagctcaagcaatctgcccacctcgacctcccaaagtgctgggattacaggcatgagccaccgtaccagtccttaagtataatgttgaacagaagtgataacagtgtgtattactgccttgttcctgatcttacaagtattcagtctttcactataaagcataatgttatctggaggttgtttgaagaagccctttatcagattaagaaagttctcttccattcctagtttgctgagtctatatcattagtgagcgctgacttctgtcaaatgttttttctgcacctaatgagatactgatatggttgttctcctttattctattaattgggttaattactttgattactgaatactaaattcatcttgctttcctagaataaacttcatttaatcataatgttatttaaattcggctgaatttaatttgctgatattttgttaagaatttttatctggctgggcatggtggctcatgcctgtaatcccagcactttgggaggacgaggtgggcagatcacttgaggtctgcagatcaagaccagcctgggcaacatgttgaaaccctgtctctaccaaaaatgcaaaaaattagccaggtgtggtggcatgcgcctgtagtcccaggtactcgggaaattgaggcatgagaatcgctcgaacctgggaagcaaaagttgcagtgagccaagatcaggccactatactccagcctgggcaacagagcaagactgtctcaaaaaataataataataatttttatatctgtgaccatgggggatactgatcttaagttcactcttcctcatccttgctttggtaacttgttcaaattttcttctctggtttatgagagttttaaaaagacatttctaatgcgtctttgttatgggtttaggttaatttctcccaaataaaaaaaaatcctaatttaacattaatgttaataatttaacattatttttaacaaaatatttaaaaagttaccttgctgcctatctttcagttctacatctattctataaagtgatatctacatgaagtagaatcagtttaagagttctgacacacattccatgtgtaaagcatatgagaaaagagaaaagaatatattccccaaaccaagggatgtagtatacaaaaggcaaagttctatatctattgaaacaaattgggcttttcaccactttatgcttacttcatttatccaagagaatttaatgttgtatacttggatgactttttcctattgggttgaacatatgaaactgacatatttgtaggtcaaagaaacgtcaaatattggcagtttcatacggtttaacctctaatttaatggccttggaatagtaaccaaagtgagctcacccagtctgtatgttgtttgatcagtatacaagcaccatctggtggcagaaaccaaaactgtaggtttgtaactgttcatatcactgctggtacaaatacagtcatccctaggttatctgtggggaattgtttccaggaccttcacccttaccccctacagataccaaaatccatggctgctcaagcccctgatataaaatgctcaagtccctgatataaaatattaatattttaatatttgcatataacctatgcacatcctcccatatacattaagtcatctctagattacttataatatctaatacaatgtaaatgctatgaaaatagtagttacactgcgttgtttaggaaataatgacaagaaaaaaatgtctgtacatgttcaatacagatgcaaccaccctttttttcctgaatattttcaatccacaattggctggatccatgaatgctgagcccatggatacagaacccagggatacgaggggccaactgaatattcaacatcaactgttgtactttccaatatgctttttaagagggtgttacaaatgagtgaaaaatcttatatgcaaagtttgaacaacctcagaataaatagcacaccaacatcacaatacttagcaacaaatcatcagcctatataacataaactgaaatgtaataaacaagctgttttcataaatcagaatcttggctattattaattttactgataattaacataatgcaatcaagtcaatttggatgtttcaaaaaacttctttcgccctatcaaatttccactgatagccatcactatctgtaaaatgatttccgtgtctcacagatttatttcacaggggtacaatgaaaaaccaagaagccttaagtaagtgtctaattctggccatagaaacaagtaacattcaggcaaaatagtccaaattgttttcttcttgtttaacttgctatgactcaacatatattaaaagaaaataacttgaccaacctagctataagagattgggccaagaactggatacattagctaaaggtaaccttgacataaaatatactaaacacatctaatgagaatgtaggccataaacttgttccaaactgagtgttaacaaataaacaaaccctttggggaagaaaggatacaccttcaatgaacaaagagctgataggtcactcaaacttgggttgaatcctaaactgccattttcttaagatatattacacaaacctattctgaaagctctagatgttatactacctcttgccacgtctacttccaacaagtctttaaagtcaaagataatctttgctacccttcattgtggccataaagagtgataaaatgactcctaaatacttcgtaggcaatttaaatgcaacatagtgcaaattaaactcttcatctttccaaaaacctgctccaactactcttgtggtgaacagtattactagccatccaaatatctgaagttatccttaataccccaaatgcaatcaagtctaccttctaaatatctatagacactgtcccctcctctccatctgcactattccaggcctgcatcacattatgcctgaattacaacaacattgtcgtaattctttatcccttcaagttttaggaatattgccaaagcaatattcctaaaacatatatccaattattttatccctcagcttaaaatccttcaatgactcccaatcaccttcagaataaaatccaaacctcgtggcatggacaattcaggacattcaaatcggggccctgcctagacttcactcttctcattccagacttaccgaactgtttctaagtccatgaatgaactaaacttctcaggattcctagcctttgttgccaaaatctgtattacttttccttgccctcctcacctggctaaatcctagttaaccttgaagattcagttcatccctcctggaaggcttctttggtgccccaatctggatggggtgcttagttccttcctaatgtttccatagcaccatcggggcacatctatcattctgttctttcgttttcctcttctactaaacttaagtctattagactgcctgtctttcctcaaagtctctactcaaacacaacatgtggcaatgagtaggcatgcaataaatgtctgctgaatgaagatgacctcacgaaagtccttcatttgctattactatctctgttttgcaaatgaggaaattaatggaggtccagagccttgtgcaagatcacttaactaaaagcatcagaactaggaactgaaccaaatgttctgactgtaatggaaataattttctctaaaaatctttgcttttgaggaaccgctccataaaataattgtaccctgcggagtagtttggatggggctaacctgtttctccaggttggacatataacccaggcttggctaaagtaaagtatgtccctacccccaaccaagtttgaatgattaattccaggatggacagtttactccaagtgtttgtggggacttttctaatgactatcaaaaaaaaaacttcaccttcttcactacaagtctacagactatacagtgtatgaagtatagcaaatgggaattggcttatttgaaaacaaagtagagaaaaaaagaaacaagagctagaaagagagaaatagaaaatgaggaagaacaacactaaagccctacatccaactatgcctgtacatctccccaagagatatcccagttacatagctcaaaaattcccatttgcacataacctagtttgagttttggccccatggaaatctacaccagcagatcaaggggccatttggtctgctggtctgccattttggccatttgctaagcaataatatttttttatctgtgaatatacaaaattgaaaaactgtctaaattcagccattctatttctctaatgtacataatttttataagaaagatgggagaacaaaagcacgaagtgttctccaagctttaccttgtactttgtcaaatgaatttttatatgctttctgcttcataatatatctgttagtgaaaagtgcctcaaatgataaagaaaaatacataaccggatgtaattattgtcaaacatcttgggcataataaaaggagacaggtacttcagaatccaagttgtatctacagagtttgctcatggataaatgtttttttctccactcatcattaaaaaagaagaaaaattcagttcttcttaggcctttgaataagttcaagtggagaaacatcatcagtagagggtggtaaaacagcataggtaatacctaattttgcttaatattactttaagtagaaaataaaaggaccttttcaaaaatccctctaaatgatacctgtttcttggacttcacctttcattccctgccttaagaagctaatgattaatctgggttctgacaaggaaaagacatctccttggatctttggctccagagtccctgtaatccattcaagtgttgccatctataaattaaaataaatatgagaaatcatggttgtaacagcctactgagtaatggttaggtctgcgcttctgtgagcagaaagagcttttcagttgaaacatggcttggtagcttactagtactttccgatattctttttacctttttgtgatctgcagaatatcataaaataaagacactccaaaaaaggaaaagtccatattatctattcatggaatggcctaaggcacatcctttatttatgactttggagaaatcataaataaaattattgtacccctcacaacaaccataagaattagatcttggaactagaaactgccaacaaagaaaaaatgccgacattcttaacagaaaatttagaaaagaaaaaaagaaaatcaaaatcacatgatccctgtctaatttcacatactaactcctctctcccttggttcactctgatcaagccacattggcctcttgaggccaatgccaggcacacttctactgcggggagtacttgctatttcttgagcctggaattctctctctctctctctctctctctctctctctcaacattcacactgctttttctctctcttcctttgaggtctttatcaaaagcaaccttctcagtgactaaccacttcttattgactgactacctcccctacaagaacatgagctccataaggacagggattagtgtctgacttttcattgctttagcaccagactttttaaaagtaataaatttagaagtaataaaagtagtttatttccatttaaaagtaataaattcactagtcagaactgtagcaaaatttcaataaaggaccacagataccaaaataaaacaaatataaagatgtaatactctcataaatctatttactagagtacattagcaataaaattagtatataataggctaggtgttccttactcaggtgactaaagatatctactgtgttgaagtgggcaactagctttatttatttacattggggaacgtcagattaaacataaaggcaatgcgtatattatacagagaaagagaaaataaaacaactacaagagaaatgtgttgtcccttgtgcctcctatgcggtgtggacaccaagctgagggctgggaagcctgccattgtatgcatcacaattagaagcagagatgttacaggagagaatgaaatataccaaggaagccaagaaaagctgagggtttaggcccattagcaaggggaagatagtagatacactctggaagcattacctaagggagaaaaagacggactagatgccaccaactgcaagtttccacacctcgtggacaaggcacacgaccacaaagaaaagaggaactaaaggacaacacaagatgcctctacagaggtgaggtatatagatgcctctcccttcctagcatagagaaagctcccccaggcatacctgagaggaaaagggaagggcagaagtctaatacagtgtgcaaattcttcttagagaacctaaacaataatatttaaaggaactatttacaattgaatagaactaagttttaaatggatacaattaaagataatttttcccctagcaagcaagaaaccaaaaagtatcagattatttatggactaaataaatatcttccctacacatctaagttatggtatcagtaaatacataaaaccataacaaaagcaccagcaaatatctgatcaaatataggaaagaatttctcaggcataaaagaagtgagagaaataaagaaaaatcaatagataagaccacataaaattttaaaactacaggatattaaaaacaaatacacaattaaaagccaaattttttaaagcaggaaaattacaacaaacaaaatagactgaaggttaacatcctcaacacataaacatttgaaaactggtgaagcaatggaataaaaatcagcaaattaaaatagacaaatcaaaaaggataacaaatatctaaaaaaaaaactgttcagcctcactagtaatcaataaaattgaattttaaaaactactacttgatggccacgtgaggtggctcatgtctgcaatcctaacactttgagaggctgagagaggcggataacttgaggtcaggagtttgagatcagccttgctaacatggtaaaaccctgtttctactaaaaatacaaaaattagccggaaatcgcttgaacccaggaggcggagggtgcagtgagctgagaccacaccatggcactccaacctgggtgacagagtgagacttcatctaaaaaacaaacaaacaaacaaaaaaaaacaaaaaaaacactactttttaactaccaaagaagacaaaaacctttttaactcagtgttctcagaatagaataagcattctcatatactgtaagaaattagtacaaactttagtgcaattgggcaatgctttattctttttaaagaatattccccttatagtaatataaggaaggaaataatcagtgatgtgaacaaagatttacatagtgattatttactgcagcaatcttaacaaaaaagagggcataaacaacctagataaaaaaatagacatacatttatataccttatgaagccatatgaagcattatgtagccatcaaaatcattttgtgccaggcacaggggctaacgcctgtaatcccagcactttgggaggccgaggcggacagatcacttaaggtcagaagttcaagacccccagcctggccaacatagtgaaaccccatctctactaaaatacaaaaattagccaggcatggtggcaggtgcctgtaatcccagctactcaggaggctgacacacaagaatcacttgaacccgggaggctgtgggtgcagtgagacaagatcacaccactgtactccagcctgggtgacagagtgagactgcgtctcaaaaaaaaagaaagaaaagaaaaaaaaattcttaaatatatgacaaatggccactatattaagtgaaaagagagtgcttgttttgcatatacaagatacacaaattatgatatatccatacaaagtacactaaccagcaataaaaaagggcaaaacccagatataagcaacatggatgaatccccaaacaagaaaatcattatacaaagtaaaagaagccagatgcacataaatactgtatgagtctagatataaaaagttcaacaacaggcaaaaactagtctatgataataaaatagtgattatttctgggagaaggatgtgtcaaagacaaagaggtctgaggaaactctcagaggtgattgggaacattctgtatctcgatctgagtggtgatcacgtgaggctatacgtatgtaaaaagtcatcaaataaagtataaatacatatatacatacataaaataaagtcatcaagaggtatacttaagatttgtacattttactgtatgtctatcataccttcataaagtactacaaaaactgcatataaaggacaacttcaacttggttaaatatatttaaatgcaaagaaaaaaagaatgtaaagtacatgaaaatataaaaggtggcaaattctgggattacattatttacattttttcttttttccctataaattacaaacattcatgttcactaatgtatttagacaaatcaagaaaaaaactgagctctgcttggtaaatgaatgagaaagtcaacactataaactgtgaaatgactttaagacttggtcttccctgcaacaaatacagggccctcatgacacaataaaaactagttccttcagatcttttacgtttgtggggtaggggaaaaaaaaaaaaaactagttcctgaaaactgggtttctttaagttattaatttaaatattccttgtgaacctgctttatctaaattccatgcacaatgcccaaggtcaattagatttacaatgaaaatactcttttgagtgtgagaaacttttataacatggataaaataataattaagaacaaaaccaaaaaagacatacaaacctctgattgtacatgccccgaaagttgtaattagctctataatttgggaatggctttggatctaatggcctgtagatggcaggctctccccttttcatagcaagcccattcagttccacagttggagttatactgcctgtttaaaaaaaaaacattaaaggcacacaagtgaaatatcttcacaattaaacatgcaagctatatttatacaacgcttaaataccatggaagaaggtaagaatggatggaccacctgtatgattttctaaggaactgcgaaaacaaagtaaaaaaccaagaaaatagttcctaataaaatcttgggattttgcaatgttttctgtacattaatgacaaaaaatctgagtgtgcaatcattactatcaaaacatagtaaacagatgattcttagattgctaaccgtgaatattattttttaaagtactgcatttcatcattacttaccccagaaagcttgcatgtatttaatcattaaaaacatcatctgtgaatatttttatttatactttggtaattaaataactaagcattggcaagaaagtcatcagtggttcttggacttatctaatgaaaaaagttttttgaattttttctataaccaacaaaacagagtaaatataagcaatgtttcctgaaactaaaatgtcatcgaatatattcctagcaaatattaaagatacgtacaagtagcattatcgataaaaacaaaagactgaaaacaacctaaacaaccatcaatgcagcatcagttatataaatgtccatagcataaaacactgaacagctataaaaggaggaagactactacacaccttgcttcttttattttacttaatatacctcggaggttataccttagcagtgtagggtataatgttaaacgaaaaaaagcaaggtaccaaatagtgtgtgctttatattatcttttgtctaagaaaggtgaaaatgaaaatataaatatatatttgcttactttttttaaagaataaacccaaaactaaaaaaaaaaaaaaaaaacttacttaggaatggaagctgtatgtctctgaatgtacactgtttcatagattttattttgaaaacatgaattttttgcataattacagaaatcaaaatttcatccaaaaggggtgggggagcaatctctaaaatcgaaagaaaactggaactaaatctatctacagtgacttaaccacaaagagaattatttcaaaagacttaaaaaactgtaaaatagccatgagatcctaaagagaaaaaaaaatcttaaattgttttcagtaatcacattgttagtaacaagtaatatgcttttacttaagtcaaacaaaattaaataaaaatggagacaaagtaatctctataaagaaaacaaagcaattaaaacctaattgattggtggccctaatcatacgaagaacagttatttcaaataactttaaaatatagtcaaataaccacatattctaaagatttttttaaaccctgcaaataaatcataaactatttttagtaatcatgctgttagtaatattggcgtccctgtctcactgcaattgctattataaaattattttatatatatataaaatatacataaaatagactaaagaattaatgtcagaaacaaaggtttttagcataaagagacacaaatataaaatcaaacacactacctaaaaccctgtagttttaaatcctaactgaaatcctaactgaaaatatagtcttaaatcctaactgaaaatatcacaatgaattcatgatgtattttctcttaaggaaaaaaaaaagtactaggtatttcctagcttaagtatccacttaagaggcctaaaagccataacccaacaactgcaaaatgcacattgtattcatcaacacatggaacatattccaagacagaccacataagccacaaaacaagtcacagtacatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacgatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacatacatgtatacacacacacacacacacacacacacacacacaggctcaaaatgtctcctcagaaaatacttattacttactattcaacaacaaaacatacggattaattaactttacagcaaagaagcctggcatactcctcaccgcatgacaaaagtcgtcactgatgggacaagtcaatctcaggcgtctcctcatagaaagcactaaggtaagtccaagtcatttttctggtattcatgctaaaatgcataaatcatgaggaaacaccagacaaactcaattgaggggcattctaaaaactctgtggtcccatactcttcataaatattatggtcataaaaggtaagaaagactgaggaactgtttgttacagattgaagtggaatgaagagaaatgttaagtacatgtaacacatggtcttgattagctcctggagctgtaaaggtttgggatgattagtgaaatctgaaatggagtctgtggattaaatggtaatatggatcaaagttaacttcccgatagaacggtgtccgtgtccttaagaaatatacattgaaatattaaggggtaatgggacatcatgtctacaacttattcccagatggttcagaaatgctatcaatggggaataaaggtgaaggatacatgggaagtctatgtactatttccacaaattgtatataaatctgaaattacttccatagtttaaaaaaaaataaaagggagaaagcaaaacagttctataatatattcccaattactaacagatcaaccatgctgcaaatgaacttaactcctcattaggatataacttctttttaagacccatctacacactgtggagtcaagactggatctttcctccacagacctattacttctcaatactgagttacagtcaccaggtttataacaaaggtgccactacactgcagaggggaatggactatcttttcaataaatggtgctggattaaatgaatgtccatatattttttaaatgaagaaaaatattgaactctacctcacatcatacattaaactcgattcctgacagactgtagatctaaactgtaaagatctaataatactgcttctaaaactaacatgaggttatcttcacaaacttgtaagagacacaggtgtattaaatggcacaccaaaaaagcgctaactataaaggaaaagactaataaattagcttccactaaacaagaattttgtttttgttttgttttgttttttgtttttgagacggagtctcgctctcacccaggctagagtgcagtggtgcaatctcagctcattgcaacctccgcctcccaggttcaagcgattctcctgcttcagcctcctgagtagctgggattacaggtgcacaccatcacgcccagctaatttttgtatttttagtaaagttggggtttcaccatgttggccaggctggtctcaaactcctgacctcaagtgatccacccaccttggcctcccaaagtgctgggattacaggtgtgagctaccgtacctggtctcattgaaaagaatttctattcatcaaaatgtacccttaggagtatagaaagatatttgcaatatacatatctgataaattatatgaatccagaatatgtaagaaccctgtaagccagtaaaaagtagaaaaaattttaaaacagacaatgcagatttttaagtgggaaaaacattccaaccagcactttacaacagagcctagcctaatgccaacaggcatatggaaagatgctcacctgcatttgttattagagaaatgcaaattaaaaacacaatgaattactattatacctctcagcataatagctaaaattttgaaagctggagatatcaaatgttgatgaggatgtggacagctctcataccgctggtgggaaggtaaactgacattctttgacattatgtattaataccaaatacattcataactatgacccaacagttccaatcctagatatattcccaagagaaatgtatgcattttaagaatactgttcacagcagtattatttctaatagctcaaaactggaaacaattcaaatacgtataatagtacaatgaataatatgtaaattatgtatacttatgcaatagaatactacatagcaatgaaatactataccattaaatgcaacatagatgactctcacacacaatattgagaaaaatgagctatcacaagagtctactgtctgattccaacaagaaggcacaactaatctggtagaaatcagaatattggtttcctttagagttgtttaaccaactgaagtgggcatgagggaagcttccatagcactagtaaaacatgtggtgaagtgttcacagcataaaaattcatcaagctctataactgtaatgtgcccttgtctgtatacagtattagactttattttaaaagtttacaccaaataatcgattcattctctcagcttactataacactcaaccatggaaattcttatctccactggggcctttcagacactctcctgtttccttcctctgactcttgctggtttacttcctgctataatcctctaaatatggacttgacccagagctcagcacacaattaactgctcttgctttacattatatgcctttgctttacattatatgccttagacagcttgttctgttccattccaaatgccactctcaacactcctgcagagcgggaggcatacagtactcaatgcacgtgagtctctttctttcttcacccataaactatgacaatggttttttagtgtctcccaccttccctttacatgtcaaactgagcttcctaaaatactcctttaaatgcatcatgcactgctcatgaatattaattcctcccagctacgtataaaacttaatctcgtaaagctggcattcaagtcgtcccaattcactcactaactacatctccagtcttacctcctactagtcatttacctgctctaattaaaaaccatctataaaattttttttttaccaaatccattgtccagattcctacttcaaagcctttcctcatagtattccctctggctaaaatattctttcctctcatctataactgcctacttttcggtcaaggcctgtatcttacttcaactacttcagtccatgtttatcattacctgtaatactgatggctgttattgtctacttggcacttaatctttaccatcaaattacgtgttcatatataagactgtaagacactcactgaaagggacaatgttttatttctcttagatatgtaaaaagcaagtgttaaatatatcatggtggtggtatgctactaatgatcaaccagtattctgaagaggcttttaaaaattaaagaaatggacaatcttttaggaacttcaaaatgaagagaataagttttttttctattgtaataatattttggcttatttaagcttaataaatactgcaatcagttgaacagaagcagagacttgcaatcagaaagccatggattctgcagagtagtccttgaaagagcagagaatgtcaacctagcacagaccacatgagaatgaaacaagtgtctatgtgatttgattatgaatataaccaagtagagaatgattaaatacattttagagttattgttgacaggcacaaaatctttcttaacctccataacaaaaatatctaaggcgaaattaatattgactagaaggtaaccacttgaattaatcagttaacaaatgaatgagtaaatggatatatggctggtactaaagttatagtaattccattaacctaatgttatcaattaatacactatgtccaaaatacaggtttgcctttcccaatagataacgggacatatagattcactgaggtcacccggagaaaatgatggatatcaggcaggactaacttgaggctcccactcaggacaaaacagcatgtggagactcacagtgtaaactctgctccaagaaccaccacaagaacataccaggaaaactgaaagaattcacagaccctttgaaagaagcagcttgccgctgcaaactccatgagacagccaaaacaccgtgagtgcccaaagtgtgagagggggaaagtctgcctccaaacacacatcctcactggggaacctgaaaatccagatcacagaagaatttaaccttacctaggactgaaacaaatttagagagctgagcgaaatataaaagtagaagaagcaggccaggaatggtgggtcatgcctgtaatcccaacactttgggaggccaaggtgagtggatcgcttgagcccagtttgagacaagcctggctaatatggtgaaaccctgtttctactaaaaatacaaaaaaaaaaaaaattagctgggcaaggtggtgcacacctgtaatcccagctacttgggaggctgaggcaggagaattgcttgagcccaggaggcggaggctgcagtaagccaagatcaacgccactgcactccaacctgggtgacagactgagactccacctaaaaaaaaaaacaaaacaaaaacaaaaacaaaaactagaagcagcagcgataagagacccctgtagacactcccagtccctagggaagccattttttttttttttttttttttttttactttcatctcacagtggtccttggggaaggcagtcagtggaactagggaagtaccacagtgagaaagacttctagctgaacgctgtcataattttgactgaatgcaaattttcctgggcagaatctgggtggggggtgggggaggaggtgggaatagggggccggcgggaatagggggccaatggaaagtacagatatgagaacagaagccactgcaggcatggaagggcaaggcctgaaagccctgcttgctttcttagcaggaagacttctagcctagggcaaatgctttttctgcagacactccccaataccagcctggagtccagtagctccactgggtagctagacccagaagaaaaataaccatcgctgcagttcagctctcaggaagccccattcatagggaaacggggagagaaccacatcaagggatcatcccgtgggataaaagaatctgaacagcagattcaagatcttgcctctgacacagtatatccaaatgagaagaaaccagaaaaacaattctggtaatatgacaaaacaaggttctataacaccctcaaaagatcacactagttcaccagcgatggatccaaaccaggaagaaatatctgaattaccagaaaaagaattcagtaggtcggttattaagcagctcaaggaggcactagagaaaggtgaaaggcaacttaaagaaatttttaaaataatacaagacatggatgaaaaaatttccagagaaatagaatcataaataaaaaagagtcacaacttctgaaaatgaaagacacacttagaggcatgcaaaatatactgcaaagtttcaacaatagaatcaaacaagcagaagaaagaacttcagagctcaaagacaaggcctaatcaaattaacccaatctgacacagacaaaggaaaaagaattttaaaaaatgaacaaagcctccaagaagtttgggattatgttaaatgaccaaacctaagaataagtggtgttcctgaggaagaagaaaaatctaaaagtttggaaaacttagagggaataatcaaggaaaacttcctggccttgctggagatctagacatccaaatacaagaaggtcaaggaacacccagggaattcattgcaaaaagatcatcacctaggcacacagtcaatcaggttatctaaagtcaagtcaaaggaaataatcttaagatctgtgaggcaaaagcaccaggtaacctataaagaaaaacctatccgataaatagcagatttctcagcataaaatctacaagccagatggaattgaggtcctatctttagcctccttaaataaaataattatcagtcaagaattttatgtccagtgaaactaagcttcattaatgacggaaagataaaagtctttttcaggcaaacaaatgctgagagaatttgccactatcaagtcagcactaaagaagtaataaaatgaattattaaatcttgaaacaaagcctcagaatacaccaaaacagaacctccttaaagcataaatctcacagggcctataaaacaataacacaatgagaaaaaacagacaaaaggtattggggcaacaactagcacaatggatagaatagtacctcacatcttaatactaatgttgaatgtaaatggcctaaatgctccacttaaaagatacagaatggcagaatggataagaattcaccaaccaagtatctgctgttttcaagggactcacctaacacataaggactcacataaactgaaggtaaaggggtagaaagagatatttcatgcaaacagacaccaaaagccagcaggagtagctattcttacatcagataaaacagactttaaagcaacaacagttaaaaatgacaaagagggacattacataatgataaacggactagtccaacaggaaaatatcacaatcctaaatataaatgcacctaacactggagttcccaatttataaaacaattactactagaccttaataaatgagacagagggcaaaataataatagtgagggacttcaatattccactgacagcactagacaggtcgttaagacagaaagtcaacaaaaaaacaatggacttaaactataccctacaacaaatggatttaacagatatatacagaacattctacccaacaactgcaaaatgcacattgtattcatcaacacatggaacatattccaagacagaccacataagccacaaaacaagtcacagtatatttaagaaaatcaaaattatatcaactactctctcagaccacagtggcataaaattggacatcaactgcaaaaggaacactcaaaaagcatgcaaatacatggaaattaaataacctgctcctgaatgattgttgggtcaacaatgaaatcaaaatggaaatttaagaatttgaactgaatgataatagtgacacaacttatcaaaacctctgggatacagaaaaagtggtgctaagagcaaagtttacagcactgaatgcctgcatgaaaaagtctgaaagagcacaaataagacaatctagggtcacacctcaagaactagagaaacaagaacaaaccaaacccagcagaagaaaagaaataacaaagatgagagcagaactaaatgaaattgaaacaaaagaaatacaaaagataaataaaacaaaaagttggttctttgaaaagataaacaaaattgatagaacattagcaagattaaccaaaaaaagaagacagaagatccaaataagctcaattagaaacaaacaggagatataacaactgataccagagaaatacaaaatatcattcaaggctactatgaacacctttacacacacaaactagaaaacctagaggagctggataaattcctggaaatatacaacccttctaggttaaaccaggaagaaacagaaactctgaactgaccacagcaagactgaaatggtaattttaaaactgacaacaacaataaaaaaagcccaggaccagacggattcacagctgaattctaacagactttcaaaaaaagaactggtattaatcctattggcactattccaaaagacagagaaagagggaatcctccctaaatcattcaatgaagccattatcaccctaataccaaaaacagggaagtacataacaaaaaaagaaagccacagaccaatatccctgatgaacatagatgcaaaaaatcctcaacaaaatataagctaactgaatccaacagcgtatcgaaaaggtaattcaccatgaacaagtgggtttcataccagggatgcagggatagtttaacgtccacaagtcaataaatgtgatacaccacagaaacagaattaaaaacaaaaatcacatgacatctcaacaaagaaaaagcattttacaaaatccagcatccctatatgattaaaaccctcagcaaaatcggcatagaagggacataccttaaggtaataaaagcatctataacaaacccatagccaacgttatactgaacagggaacaagttgaaagcattccccctgagaactggaacaagacaaagatgcccactttcaccacttctattcaacacagtactggaagtcctagccggagcaatcgacaagagaaagaaataaagggcatccaaatcgataaagaggaagtcaaactgttgctgtttgctgatgatatgatcgtatacctagaaaaccctaaagactcaaccaaaaagctcctagatctgataaatgaattcagtaaagtttcaagatacaaaataaacgtacacaagtcagtagctctgctatacaccaacagcgaccaagctgagaatcaaatcaagaactcaaaccctttcacaatagctgcaaaaaaatgaaatacttaggaatgtacctaatgaagaaggtggaaagaactctacgacaaaaactacaaaacactgctgaaagaaatcatagaggatacaaacaaatggaagcacatcccaaactcttggatgggcagaatcaatattgtggaaatagcatactgccaaaagctatctacaaattctatgcaattcgcatcaaaataccatcatcatttttcacactactagaaaaaacaatgctaaaattcatatggaaccaaaaaagagcccacataactaaagcaagactaagcataatgagcaaatctggaggcatcacattacctgacttcatactacattataaggctatagtctccaaaacagcacgatactgctataaaaataggcacatagaccaatggcacagaatagagaacccagaaataaagcccaatacttagagcaaactgattttcatcacagcacacaaaaaatataaagtggggaaaggacatcctattcaacaaatggtgctgggataattggcaagtcacatggagaagaatgaaactggatcctcatctctcacttgatataaaaattaactcaagatggatcaaagacttaaatcaaggcctgaaaccataaaaattctagaagataacattggaaaaactcttctagacattggcttaggcaaaggcttcatgaccaagaacccaaaagcaaatgcaacaaaaacaaagataaacagatgggacttaattaaactaaaaagcttctgcacagttaaataaataatcagcaaagtaaacacacaacccatagagtaggagaaaatcttcacaaactatgtatctgacaaaggactaatatccagaatctacaaggaactcaaatcagcaagaaaaaaataatgccatcaaaaagtcagctaaggacacgaatagataattctcaaaagaaaatatacaaatggccaacaaacatgaaaaaatgttcaacatcatgaattatcagagtaatgcaaatcaaaaccacaatgcaataccaactgatatggtttggctgtgtccccacccaaatctcatcttgaattgtaatccccataatctccatgtgtcaagggagagacaaagtggaggtaatttgaatcatgggggcggtttcccccttgctgttcccatgatagtgactgagttctcacaagatctgatagttttgtaagggtttggcaagttcctccttcagtctttttctctcttgccaccttatgaagaagatgcctgcctcccattcacctttaaccatgactgtaagtttcctgaggcctctcaagccatatagaactgtgagtcaattaaacttcctcctttccttcataaattacccagaatcaggaagttctttatagcagtgtgagaacagactaacacaccaccttactcctgcaagaatggccataatttaaaaataaaaaaataaaggatgttggcgtggatgtggtgaaaagaaacactttttttttcttttttttttttttgagatggagcctcgctctgtcaccaggctggagtgcagtggtgcgatctcagctcactgcaacctccgcctcccgggttcacaccattctcctgcctcagcctcccaagtagctgggactacaggggcccgccactgcccggctaattatttttgtatttttagtagagacagggtttcaccgtgttagccaggatggtctcgatctcctaacctcgtgatctgcccacctcagtctcccaaagtgctgggattacaggcatgagccactgcgcccagccaaaaagaaacacttttacaccactggtgggaatgtcaactagtaaaaccactatggaaaacagtatggagattccttaaagaactaaaagtagaactaccatttgatccagcaatcccactactgggtatctacccagaggaaaataagtcattatatgaaagagacacttgtatacacatgtttatagcagcacaattcacaattgcgaaaacataaaaccagcccaaatgcccaccaatcaacgaacggataaagaaaatgtggtgtacatatataccatagaatactactcagccataaaaaggaatgaaataatggcatttacagctaactggatggagttggagaccattattctaagtaaagtcacacaggaatggaaaaccaaatgtagtatgttctcataaatgggaggtaagctacaaggacacaaaggcattgagaatgatacaatgggccgggcccggtggctcacgcctgtaatcccaacactttgggaggccaaagcagatggatcacgaagtcaggagatggagaccatcctggctaacatggtgaaaccctgtctctactaaaaatacaaaaaaattaggccaggcacagtggctcacacctgtaatcccagcactttgggaggccggggtgggcagatcatgaggtcaggagatcgagaccatcctggctaacacagtgaaaccccgtctctactaaaaatacaaaaaattagtcaggcgtggtggcacatgcctgtagtcccagctacttgggaggctgagggagaagaattgcttgaacccgggaggcagaggttacagtgagccgagattgcaccactgcactccagcctggtgacagagcgagactccccctcaaaaaaaaaaaaaaacaatggattttggggatctgggagaaggttgggaggggaatgaggggtaaagactacacattgggtacagcatacactgcatgggtgatgggtgcaacaaaatctcagaaatcatcacggaagaatttatcaatgtaaccgaataccacctgttccccaaaaactattgaaataaaaaaaaaaagataatgacatataatgttgttcgtattgtatgcaattagaacaactctttaaaattattcttaggagcttaaaattagaacagtaatttacttagcagtattttacatgcaggtggtttgcggaatttgtgatggggtttctttcttttttttttttcttttgagacagagtcttgctctgtcgcccaggctggagtgtagtggcgtgatctcggctcactgaaacctccgcctgccaggttcaagcaattctcctgcctcaacctcctaagtagtggggactacaggcacgcgccaccatgcccagccaatttttgtatttttagtagagacggggtttcaccatgctggccaggctatatataaatatatagttttatatattatataaatttatataaattatatttatataattatgtataattatataatatatacaatatattataaattttttaatttaaatataaacttaaatataaattaatttaaatataaattaatttatatttctattaatttacatttataaaaatttatatttatatttataaatataatttatatttatatttataaatataatttatatttataatttatataatataaatataatttataatttatatttataaaaataatatatttatatttaaattaatttaaatataaatatatatttataatatataaatatataatatataaaataaaatatatataattatataatatataaaatatagttttttatatatataactatatatttaaactatatatttaaaaagagaaattaatcattttttgtaattttttttttgcaggggtagaaacaaggtcttgctatattgcccaggctgctctcaaattcttgggttcaagcaatcctcttacccaggcctcccaaagtgctaggattacaggtgggagccactgcaccaagccactatcatttttgtttgtttgttttttgagacagagtctcgctctgtcgcccaggctggagtgcagtggcacgatcttggctcactgcaacctctgcctcccgggttcacgccattctcctgcctcggcctcctgagtagctgggactacaggcacccgccaccatgtccagctaatttttttgtatttttttagtagagacagggtttcactgtgttagccaggatggtctcaatctcctgacctcgtgatccacctgcctcggcctcccaaagtgctgggatgacaggcgtgagccaccgcgcccggcctactatctttactttaaaaaaaaaaaactcagtcaaattttctgtgctttgtattcaaatatgtttttgccaacattaaaaaagtaaacaatgcacttttatagtatccactaaagcaaattttaaaaacaattacaattactttcttcatcctctcaccttcattttttttttttttttgagatggagtttcgctcttgttgcccaggctggagtgcaatggcgcgatcttggctcactgcaacctccatctcccagattcaagcaattctcccgcctcagcctcctgggtagctgggattataggcacctggctaattttttatatttttagtagagacagggtttcaccatgttggccaggatggtctcgaactaattacctaacatgatccacccgcctcggcctcccaaagtgctgggattacaggcgtgagccaacgcaccaagcctccttcagttatttttatgctaccgtgtgtgtgtgtgtgtgtgtgtgtgtgtgtgtgtgtgtgtgtaggtatgggcatatgtgtactattaatacttgctcactctgttactagcctactataaatgaaacatacaacaagcagaacacacatagcagacaacataacagaaggagtcactgccatacctgggttattgttaacattacttttgggtggcttctgaactggtttgggaagcgtagattcagtcaaagctttattggcaacagcctgctgagccttctttatactgctgccttcggattcccatgtctgctcaccaagactcagctgcactgagaacatcttagaaaaacataaatagacaaagaaaacattaagacttttccaagaaataaaattggctgtctgagagaaaaataaacatcatagaatcagaattttagagctagaggtgaccttacctacagatcatctgcaacaaaatcttactctacctagtgaagaaattttaagagagtaccaaattctgttctatcctatccaaaagcttagtagcagatctaggtgtacattctgggtagaataaatcaagaagcaatctttcctctaaatggaatcacaatgttaatgtcattcaaatggtcctcacaaaagcagaataagtagaaataataagagaaactgtaagagaagccaaaagaccatgtgtctataatactttcataaaatctaattccttgaatgttacatttagcacaatctaggcaatgagtcaggcaattctattaaatattatactaccaaaaaactctgaatctccacaacaaacattgagccaatcactaaattctgtccattttaacatcataaatatttctcaaatcttcttcctctctctgccaactggatccagcctttcatcatctttagcttggacataatattcttccagctgatcactgctaaaactatctttctaaaacacaaatccaacttcatcaccccaatcaacatcaggttaaaacccttcaactgttcctgttttagcatggcacaaaggctctacctgtgcatcctcatctcacacacatccttccactaacatgctctgaattccattctcactgtatttccatatgagcccccaaacctattcttcacctttaaaattcagaatcaagttacatgatatgcgcataattggtttcactccagactgcatattactttctaggaatactaagtattaacttaaaattacttattacaaaaaaatatatattattgtagaaaggagatcagatagaaaataccttcactaagttagcatcaccaataatcatacaaattgacgtcatgtgccccctgatacaatccagtgagaagtatatatcaacaaccatgtacaattcttggccaaaaatgtttaatctgaatctaatcacagggaaacaaccagagagatctagattatgggacattctataaaacaaatggcctaggctccaaaaatgtcaatgtcataaaaggaaaaaaaaaacaaagaatgcagggaggacactaaagagacatgaaggccgtgcacagtggctcacgcctgtaatcccagcactttgggaggctgagatgggcggatcacaaggtcaggagattgagaccatcctggctaacacagtgaatccccatccctactaaaaatacaaaaaatttagccagacgtggtggcgggtgcctgtagtcccagctactcgggaggctgaggcaggagaatggcatgaacccaggaagcggagcttgcagtgagccgagattgcgccactgcactccagcctgggtgacagagcgagactctgtctcaaaaaaaaaaaaaaaaaaggaaaagaaaagagacatgaaaagacatgataaataccatgcatgatccttcattatatctaaaatgggaaggggaaaaaagctgtaaaggacattcagaggacaactggggaaatgtgactatgaactatacattaagtaataggtttagccaggattaaatttcttgtgtgattaacagtattgtgattatgaagaacgtctttagtcttacaagatagatatgtaagtatttaagagtgaagtgtcatggtagctgaaatttactttcaaattgttcaaggaaaaattatatgtcaatatagagggagcaagaaataaagtaatgtggcaaataaattaacgatcggtgaatctaaaccatacatgagtgtctattacaccactctttccattttttctgtagatttttaattaatcaaaatagagaattgggatttgtcatttgaaattcacaacataaacatacctgtttaaagtgattaaattttcttttattctaattcagtttaaaatatatacctaaaatgtatctttaatactctctctggtttcagaatgatttttcaatgactagctctttttcttcaaattttggtatttaacaaagaactttgccacaaagtaagaaagttcaaaggtttcacatgatatatataatatacataatcttgcatatagctcatatgcttgaaaacagaaatacccacataaatgaccttgagattcctgattgcatcaggaaagcatattaaatttactctgcatgtctccagacctgacctctcctaaacaacaatcacataaatctaactgtctacttggtatttccacaaactcaagaggtaaaaggtcaaacaaaacactgcctcctccactctaccccctccaaatcagttcataccccaaaatgtttaatccattatctcccaatagttcaggttcaaacctcattagtttcgtttatccttgccttcctaaggcttatttaacatctcataactcttcgttgtaatttatattgtcacctccttggtctaaggtttctataaactcagactcagtatacttcatttagctcctatctctaatctttcctgcctcctaatcatccagatgtcaccattttcccaatctcatgagccagacacctttgagaggtcttcccttctctcctgcttgcaattaacaactactgactcaacttaaatgtttttcagacctggcctcctctctttatactaagatatatacatgcaccaatgtctttatactaagatatatacatgcaccaatgatatgtggacaatatcagtatctctcccctaaactaccacaacaccacctgtggtatataagaaatatgtatttggtctccggccctggttcctaacacagagctcccaaaaccttgtaatttccggaaggacaggagaactaggagcatttttgttctaatatttggtctttgatcccaatttctaacacagagctcttaaattccttggaatttcctgggtgataggaaatttttattctaatgagccaactcttggcaggcccctggatagagagctagtctgagggccagtcaccagaaaaactaagccatggttagaaacttcatttttagccccatcccattcctatccaccacggaggaaagaggggctggagactgagttaataatcgatcatgcctatgtgacagagcctccataaatatccctaaaagatagggtacaaaaagcttgcaggctggtgaacacactgaggtgctgcagggtggcacacccagacagggcttggaagctccatttcccttctcacacacttcatcctacgtacttcttttttttttttttccccggagatggagtcttgctctgtcgccaaggttggagtgcatggcacaatctcgtctcattgcaacctccgcctcccaagttcaagtgattctcctacctcagccccccaagtagctggcatcacaggcacaagccaccatgccgggctaatttttgtatttttagtagagacggggtttcactatgttggccaggctggtctcgaactcttgacctcgtgatccacccacctcagcctcccaaagtgctgggattacaggcgtgagccaccacgccggccctcctatgtactctttatctggctgttcacctatatactttagaatatcctttataataaactagtaaatataagtatgtgttcccctgagtcttgtgagctgttttaacaaattatggaacctgagaagagggtgctgagagcccccggtttatagccagttggtcacaagtttagaagacccagatttgtgactgtcatgtgaggtgagagcagtgttgtgggactgagcccttaacctgcagggtctgcactaaccgtgggcagttagtgtcagaatttagttaaatagtaggacatccagtcaatgtatggggacaattgcagaattcgctggcgtggaaaaaaaccccacatatttagtgtcagaaatgaagtgttacagccaggtgtggtggcttatgcctggaatcccagcactttgggaggccaaggtgggaggatcacttgagctcagaagttcgagaccagcctgggcaacacagggagacctcagcactaccacaaatgtaaaaaattatccaggcatggtggtgcgcacctatagtcccagctactgaggaagctgaagcagggggatcccttgagcccaggagatgaacgctgcagtgagctatgactgcacaactgcactccagcctaggcaacacagcaagaccctatctcggaaacaaattttttaatttaaaaaaaagtgggctgggtgcggtggctcacgcctgtaatcccagcactttgggaggccgaggcgggcggatcacgaggtcaggagatcgagaccatcttggctaacacggtgaaaccccatctctactaaaaatacaaaaaaaattagccgggcgtggtagcaggtgcctgtagtcccagctactcgggaggctgaggcaggagaatggcgtgaacccgggaggtggagcttgcagtgagccaagacagcgccactgcagtccagcctgggcgaaagagtgagactccgtctcaaaaaaaaaaaaaaaaaagtgttggaagtatagaaaaaaatttctttttactatcttaaagcagttcccttaatatgaccttcccattcaaactaccattcttaccaccatcgacatgaacattctgtaaaaccatcaacatgaacattctgtaaaatataagtatttccaaggcaatcctatgcttttctacaatctctcttaagattcctactacagtaaaaagtgtagtagttttaagacggaatgctggagacacactgtttatgaatttaagccttggcttcgccatttactatgtacaacactgggaagttaattattctttctaactctcagcttcttacctctttagtgaaatgaggctaataagaacacatggttagttgtgaaaattagaacaaaatggtgtaaacacccccacttgaaagtcagagattgtcaaactagataaaaatgcaaaatcaaactacatgctacctacaaaaactgtacttcaaatataaaagcacatatagttttaaagtaatgagaaaaacatatactgacataaatcaaggagaaattagaatggctatattaatatcagactaagtggattccagagtaaagactattaccagtggtaacgaaggtcatttcatatgaataaagaaagcaattaagaagacattgatatcctaaacatttaggcacctaataacacagcttaaataaatgaagcaaaaactgacaaaacttaaactataaaattgacaattaaagtcagattcaatactccttatcaaaaactgatataacaagcaaaaaaaatcaccaagaatatagtacagttgaacaacactatcagccaacacaatcttatcaacactgttagaatactccaaccaagaaaagcagaatatacacttgctctcaattgttcacaggacatttaccaagacagaccatattctgggccataaaataagtctcaataaatacaaagaattcagaccacacacaaagtatgttcattgggtaaagttacagaagagggtagagtaaaattacagaggagggtagagcaagatggtggaacaaaagcctatatatcattcatcacccccagtggaacaccaaattttaacaactatggacacaaaaaagcaccgttacaagaaacaaaaatcaggtgaacaatcacagtgtctggctttaacttcatattgccaaaagaggcattgaggagggtaggagagtcttgaatcaccaacatcaaccctctcccacactcccagcagcagccatgtggcgtggagagaaaatctgtacactttgagggaggagagcacggctattggaaaacagtacattaaactcagtgctgccctgtcacagcagacaatgaaaatgtgctggactcagccagcacctgcacagggagggaggatttggaccagcactagctggaggggaattgcccatcatagcagttggaacttgaatttcttggcaagacttgccaccacaggctgaagtgctccggggtcctagataaatctgaaaggcagtctaggacacgagactgtgcttcctaggcaactcctagtgtgaggctgggcttagagccagtgaactaggatggcacgcaacctagggagacaccagctggaatggctaagggagtgcttatgccatccctcccctaaccccaggaagtgcaacttgtagcaacgaaagtatctacttccttctgcttaaggagaggagagtgaagaaaaaagagaactttgtcttgcattttggatatcagctaagccaccataggataaggcaccaggcagagccgtgaggcccccattccaggccctagctccaagataacatttgtagacacaccctgggccagaaaggaacccactgccttgaaggtaaggactcaatcctggcaggattcattacctgctgaccaaagaaccaatgggtcctgaataatcaccactgatacccaaggagtatgcagtgggccctgggctctgacatgtactggcttcaggggtgacccagcacattcccagctgtggtggctattgtgaaagactcctgtttaagaaaagcagacagaaaagtaaagggaacattgtcttgtgccctaggtaccagctcagccacagcaggaagagcaaaaagcaggctcttggggtccctgagtccacacctacgctggacagcatttccggatctacttcagggagcccactgccctgaagaatgagcccatggaccagtggtggtgttggtggccacacaaggagaggttcctctgcctgtggaaaggggagggaagagtgggagggattttgtattatggattgagtgccagcttagccacaatagaagaaaacatcaggtaaattgctaaggtttttgactccaatccctggctctcagacagcacctctggacacacctggaacccagggaaaaacccgccaccctgaagggaagggccttgggcaaggccagtgctgtgctggcttcaggtctgacccagagcaatcccagggatgatgaccacagaggtgcctgcatcaccacacccccaattccaagtggcttagcactccatttgtttgggagaaagtaaagaaaaagaacaacaatctctgcctggtaatcctgagaattcttccggatcttatccaaggctgccaaggctgtacctctaacaagtctccaaaagccacagcattgttgggcttggggcccaagtcccttcaaattcctgggaaagccttcccaaggacaggcataaacaaactcagactctgaagactacaataaatacctaactgtttaaagcccagacaccaacaagtatctacaaccatcgacaccattcaggaaaacatgacctaaccaaatgaactaatataaagcacaagggatcaatcctggaaaaacagagatacatgacctttcaggcagagaattcaaaatagctgttttgaggaaactcaaagaaattcaagacaacacagaaagggaatttggaattcttatcagataaatttaaccaagagatcaaaattaaaaagaatcaagctgatattccagagtttaaaaatgcaactgacatgatgaggactacatcaaagtctcttaacaacagaaatgattaagaagaattagtgagcttgaagacaggctatttgaaattacacagttagaaaagacaaaagaaaaaaattaaaaagcaatgaggcacaccaaaaacatctagaaaatagcctcaaaggggcaaatgtaagacttactggccttaaagaaaaggtagaaaaagagataacagtagaaagtttattcaaagggataataacagagaatttcccaaacgagaaagataacattcaaatacaagaaggttatagaacaccaagcagatttaacccaatgatgactacctcaaagcatttaagaatctaattccctaaggtcaaatataaagaaaggatcctaaaaacagccagaaaaaaagaaataaataacatacaatagagctccaatacaactggcagcagacttttgttgttttgttttgttttgttttgttttgaaacagagtctcactctgtcacccaggctggaatgcagtgatgcgatcttgcctcactgcaacctccacctcccaggttcaggcaattatcctgcctcagcctcctgagtagctgagattacaggcgtgcaccaccatacccagctaattggcagcagacttttcagtggaaactttaaaggtgaggagagtgtggcaagacatattttaagtgctgaaggaaaaaaactttcacctagaatagtatatctggtgaaaatatcctttaattatgaaggagagataaagtctttcccagacaaacaaaagccgaaggatttcatcaacaccagacttgttctacaagaaatcctgaagggagttcttcaatctgaaagaaaaggatattaatgaaagaagaaatcatctgaaggtacaaaatgcactggtaacggtaagcatacagaaaaatacagaagagtataacactgtacctgtggtgtataaactactcttaactgaagtagaaagactaaataatgaaccaatcaaaaataatagctacaacaacttttcaagaaatagtgtaataagacataaagagaaacaacaaaaagttaaaaagctggcagcggggacaaagttaaagtgtagagttttaattaactttctttttgcaagtttgtttctgcaattgtgttaagctgtcatcagtttaaaataatgcgttataagtattagtatttgcaccggcgcagtggctcacacttgtaatcccagtactttgggaggccaaggcaggtagactgcttgaggtcagaagtttgagaccagccttgccatcacggtgaaaccccatctctactaaaaatacaaaaattagccaggtgtggtggtgcacacatgtaatcccagctacttgggaggctgaggcatgagaatcgcttgaacctgggaggcagagattgcagtgagccaagatcacgccactgtactccagcctgagagacagagcaatactctgtctcaaaaaaaagaaaattaatttaaaaaagatagtatttgcaagcctcatagtaacctcaaatcaaaaaacatacaacagatacacaaaaaaataaaatgcaagaaattaaagcataccaccacagaaaatcactttcactaaaaggaagacaggaagaaaggaaagaaggaagaaaagactgaaaaccaccagaaaacaaataacaaaatggcaggagaaagttcctatttagcaataataacactgaatgtaaatgaactaaattccccagtcaaaagacatagagtggctgaatggagaaacaaacaagatccaatgatctaaacacaccccacctatgaagacacacacagacagaaaagagagggatggagaaacatattccatggcaacggaaaccaaaaaagagcagacacagctatactcatatcagaaaaagtagtatagatttcaagacaaaaactgtaaggagagacaaaaaaggtcattatataatgataaaggggtcaattcagcaagaggatataataattgtaaatatatatgcaaccaacactggagcactcagatacataaagcaaatattattagacctaaagagaaagacagaccccaatacaataacagctggagacttcaacaccccgctttcagcattgcacagatctcccagaaagaaaatcaacaaagaaacatcagagttattctgcactatagacaaaatggatctagtagatatttacacatttcatccaatggctgcagaatacacatttttctcctcgacacatggatcattctcaaggataaaccatgttaggtcacaaaacgagtcttaaaacattaaaaaaaaaaaaagagagagagagagaaaaagaaaaaagaaagaaaacctaaaataatatcaagcatcttcactgaccacaatggaataaaactacaaatcaataacaagaggaattttggaaactacacaaacacatgagaattaaacaatatgctcctgaatgaccatttcaatgaagaaattaagaagggaattgaaaaattccttgaaacgaatggtaaaccaaagcctatgggatacagcaaaagcagtactcagagggaggcttatagctacacacacctacatcaaaaaagtggaaaaatttcaaacaaacaatctaacaatgcaccttaaagaactagaaaaataagagcaaactaaactcaaaattagtagaagaaaagaaataataaagatcagagcagaaataaatgaatttgaaatgaaaaaattatacgagatcactagaacaaaaagttggtgtttgagaagataaacaaaattgacaaacgatttagccagactaagaaaaaaagaaagaaggcccaagtaaataaaaccagagatgaaaaaggagacattacaatggatacaacagaaattcaaaggatcgttagtgactaccgtgagcaactatatgccaaaaaattgaaaaatcttgaagaaacagacaaattcctagacacatacaccctacaaagattgaacccggaagaaatccaaaacctgagcagaccaataacaagtgaggagatcaaagcagtaatgaaaagcttcccagtaaagaaaaggccaggacccaacagctttactgctgaattctaccaaatatttaaagtggaactaataccaatcctactcaaactattctgaaaaatagaggaggacggaatgcttccaaactcattctgtgaggccagtattaccctgataccaaaaaccaaacacacatcaaaaaaaaaaaaaaaaaaacctacagaccaatacctctgatgaatattgatgcaaaaaccctcaacaaaatactagcaaacctaatccaacaatacatttaaaagatcattcatcatgaccaagtgggatttatcacagtgatgcaaggatggctcaacacacacaaaccaatcaatgtgatacatcacatcaacaaaatgaaggacaaaaaccatacatttcaattggtgccaaaaaagcatctgataaagttcaacatcactttgtgataaaaaccctcaaataactgggcataaaaggaacatgcctgaacataataaaagccatatatgacagatccacaactagtatcataatgaatggggaaaaactgaaagcctttcctcttaggtctgtaacacaacaaagatgcccactttcaccactgttattcaacataatactgaaagtactagctagagcaatcaggcaagagaaagaaagaaagggcatccaaattggaaaagaagaagtcaaattatcattgtttgcagatgatatgatcttatatttaaaaaaacctaaagactccaacaaaaaactattagaacagataaacaaatttagtaaagttgcaggatacaaaataaatatactaaatcagtagcatttctatatgccaacagtaaacaatctgaaaaagaaatcaaaaaagtaatcccatttataatagccttaaataaaatttaatacctaggaattaactcaaccaaggaagtgaacgatctctacaatgaaaactataaaacactgatgaaagaaactgaagaggacatgaaaaaataaattggaagaatcaaagcaacctacagactcaacgcattccctatcaaaatatcaatgacattcttcagagaaataggaaaaacaattctaaaatttatatggaatcacaaaagaaccagaatagccaaagctatcctgagcaaaaagaacataactggagggaccacattatctgacttcaaattatactacagagctatagaaaccaaaacaacagggtactacataaaaataaacacacagaccaatggaacagaagagagaatccagaaacaaatccacacacctacgatgaactcatttttgacaatagtgtcaagaacatacactggggaaaagacagtctcttcaataaatggtactgggaaagctagatatccatatgcagaaaaatgaaactagacccctatctcttgccatacacaaaaaaaatcaaatcaaaatggattaaaggcttaaatctaagacctcaaactatgaaactattacaagacgacattaaggaaaattttcaggatgctggagtgggcaaacatttcttgagtaataccccacaggcagaggcaaccaaagcaacaatggacaaatgggatcacatcaagttaaaaaccttctgcacagcaaaggaaacagtcaacaaagtgaagaaacaacccacagaatgggagagaaatatgtgcaaactatccatctgacaaggtattaataatcaaaatatataagaagctcaaataactctataggaaaaaaatctaataatccaatttaaacaacaaacaggtatatgaaaaggtgctcaacatcactgatcatcagagaaatgcaaatcaaaactacactgagatatcatcttgctcaagttaaaatggcttttatccaaaagtcaggcaataataaatgctggcaaggttgtggagaaaagggtaccctcatacgttgttagcaagaatgtaaattagtacaaccactatggagaacagtttggaggttcctcaaaaaactaaaaatagaactaccatgcaatccagcaatcccgctgctgggtatattcccaaaagaaaagaaatcagtatgttgaaaagatatctacactcccatgttttttaggagtgcttacaatagctaagatttcgaatcaacctaagtgtccatcaatagatgaatggataaagagtggtatttatacacaatggagtactattcagccataaaaaagaatgagatcctgtcatttgcaataacatggatagaactggacgtcactatgttaagtgaaataagccaggtacagagagacaaacatcacatgttgtcacttatttgtgaggtctaaaaatcaaaacaattgaattcacagagatagagaatagaaggatggttactagagattgggaaaggtagcaggaaggttgaggggatgggaagatggttaatgggtaccaaaaaaaaattagttagaaagaatggataagacctagtatttgacagcacatagggggactacagtcaataataatttaattttacactttaaaataactaaaagagtataagtagattgttcgtaacacaaaggataaatgcttgaggctttggatacccaatttccattatgtgattattatgcattgcgtgtctaatctatgtgaaaaaaagattagtagctgcctggggtctcaggtacaaagagagatgattacaacaaggaatgagaaaattttgtgggacaatggaaatgtttgttctttttcttcacatagatattttggtacatgcaacataccaaatacgttgtatgcattgggtataccaaaatatctcatgtacttcataaatatatatacctcataaatatatatacctactatgtacccacaaaaattaaaaataattttttaattaaaaaagagacaaagaatattattattgataaaagggttaattcatcaagaagataaaacaattataaacatatgcaccaaacaacagaataaagaacttctcaaaactgaacaataaaacaaacccaataaaaaataatgggcaaagatctgaacagacacttcactaaaggtatacactgatgacaaacacacaaaaagatagccagcattatcagtcactacggaagtgcaaactgaaaccacaatgagattccaccacatacctattagaatggctaaaattagaaaggctgactatataacctgtaggcaagggggcagaaaaactagaactctcatacaccgctgaggggaatgtaaaatggtacaactatattttgcaaaaaaatttggcaatgtcttaaaaagttaaacatgcacctgctatacattcctgacactcttattaccaaagaaatagagaaaataaaatagagaaagagaaaaggtaatatatgtctgatatggtttggatccgtgtccccacccaaatttcatgttggattgtaatccccaatgttggaggtggggtctggggactggatcatgggggtggatttctcatgaatggtttagcgccatcccttggtactgtcctcacaatagtgagttatcatgagatctggtcatataaaagtgtgtgggacccccccaatccccacattgctcctgcttttaccatatgacatgccttttacttccaccatgattggaagcatcctgaggcccccccaaaagcagatgctgctatgcttcctgtagagcctgcagaaccatgagctaactaaacctcttttcttataaattagccagtctcaactatttatagcaatacaagaatggactaatacaatgtctatatgaagacttgtatatagatgttcaaattagctttattataatagcaaaaagctaaaaacaaccaaaatatccatcaacagatgaatgtccaaaaaacaaagtgtgctatatacacataatggactactcctcaataataaaaaggaagaaatactgacacacacaaaacatgagcaaactcaaaataactatgctaagtgaaaatagtctggtaggagtacataccactatatgattacatttatatagttttagaaactgcaaactcatctatagtcacagaaagcagattagtagctgtgtggggtcccaggtacaaagagagatgattacgacaaggaacgaaaaaatgttgtaggacactggaaatgtttgttctttttttcccacacagatataaagcagaaacaatacttttggcatgggttaaattatgaaagaagtcagtttgcattgcttcaaaaaatgttctcccatctttttagtattttctctctcatgactctttactacatttcccttccactatcctcactctcttatcctatacttccactgcaaatgtacatagaaagaaaatgatgatttcatcatgcctgaaaattatgtattcaagaggcacatcctacagctcaaaatctctgctctagcccaatactcatcaactgatgaaatcccctcatataacaatcactacatacaatcagccaaattcaagatgtagaacattttataggacaaattactctatttctccaacaaatcaatgtcataggaaaagaggggatggggataaaaggagtgttagtattaataaataaaagagaccaaagagacatagccaccaaatgtaatacatgatccttgtttggaccctatttgaacaaaccaaatgtaaaaagacatctctaagtctaattaaaaaaaagatggatacagaccatgtattacataatatttgggcttcttaatctagtcataatgacggtgtagtgcgctatttttttaaaggtccttatcagttacagatgcataccaaagcacttatgaatgaacagacatagttcttttaaaaactttagttcaaaaaagtgggtaggggatggtaaataaatttatcttggcaaaatattcaacgttggtatctatttcaaatttttcataataaattaaaagtaagatttttgtttgttttttgagatggagtctccctctgtcgccaggctggagtgcagtggcgcgatctcagctcacggcaacctccgcctcccaggttcaagcaattctcctgcctcagcctcccgagcagctgggactaaaggctcgtgccaccacgcctggctaatttttgtagttttagtagagacagggtttcgccattttgaccaggatgatctcaatctcctgatctcataatctgcccaccttggcctcccaaagtgctgggattacaggcaaaagtaagatcttaagatgttgtgggtttcataatgaatgttatgagacaaaactcctaacagcatgatatgcaccttatttattttcagtgcaggaacagtgcctgccacatagtaaatactcaacagaccttttactaaggggttgttttagtcctatatatgactaataagcaatgatataattatttgggtacctccatcatcaacacaatgcttaagaacttataaatcgtcactccattataccactttatgaggtattatattactccatttacagataagaaaactgagactttaaattagttgttcaaggtcacataagctcggcaatgaagggcaaagatcaagctgggcaactctagcgaagatttttttttaaagactacttggcttaagggccagtggatgacattgcctccctcagtgatacccattccaaagtaaaccatctcaaagtatcagcactagtacaatttacttgaaacttagccaggcttaccaacaaattatcagaataggaaaataatggaaaagaagaaaataccattttatgttattcatggctctcttcctcatattctaattaaaacagccttctttcgagatttgagcaaaccaaaacaataatctgtagaaaaaataactgtatacaggtacctaggaaataaactaatattacaataactcccattattataaggtatactaacttgtttcagagttcaattaaaaactgagcagaaaaataaaagaagacaaggcaaagactaaaataattattattttaatagtcacatattacaagttgttcagaatttgtgatactcatgggggaaggaggaaatcatgtaaacgtaagataggtcactacctgtcagcatgatataagagaagacaattccataccatactgaagacattaacctctgtcctgtgtttccaaactctggctgtacttttgagtcatttcagagctttaaaaaattcctgatgtgtgtgcttcacccaagaccgattaaattaacgggatgagactcaggcataagtattttttaaagctcctgaaatgattccaattaacagccaaagttgagaaccacttctcacctatgtcagcatatgtgtagtatgtgtgtgaattgccatataattaatgtaccaagaaaaaaaattttttttttgagaccgagtctcactctgtagcccaaactggagtgcagtggtgcaatcttggctcactgcaacctctacctcccaggttcaagcaattctcctgcctcagcctcccgagtaggtgggattatagtcacgcaccaccacaccccggctaatttttgtatttttagtagagaagggtttcaccatgttggccaggctgttctcaaactcctgacctcaagtgatcctcccgcctcggcctcctgaagttctgggattacaggcatgagtcaccatgcccagccccaagaaaattaatgagttgaaactaggtttaaatttttcttaccagagattatcattaatttcattaaaatacattttatgtctcacctaaaggccactgatagacatacatgaatgaaaatgattttgcttttcacaaaaaggatccagacttagccaattaggattaatattaactatattattatgtgaacttatcaatatcatgtttcactcaacaacatgccaattattctagtactctttttaaaaataagcaagctacaggctaaggggggtggtgtatcaccaaagcacctacagcaactggcacaggttggcaaaagggatctccaaatctccttaaaaccaagggaatcctgggactattgagaaataagaagagacccactgtcatctactttcatcacaaccaacctgtttagcctttaaaaccccagcagtgagacaaggagatagataaaaggtcagttcataaacccttccaaaaattacaatggattcctaaagaatcttaatgaaaaccaaatcctcctaagagtcctccagaaacttcccaggtaggctgaccttcctttaccatatatagaggatagggatgatgtcactaactgttaaaggcagtctagctcttcactcttgggagaagaaggcagaagaagcaaaactggagaaatggccttgaagaggtgaaacaggttgggatccaggacacaatggaggagctgggcaagtcagctgagggtacctacataaaaggcacacaacatttaagcaggttaaagagctatgtgaggattggggaaagaaaggaatagtaaaatggtggcagaatcaatggatctgcagtatgaaaggactgtggaagtcaaattactagacggaatgaactagaaagttaagaggcaagtgtcacagaaagatgaaagactgaaattaacattatgcagttattggtaatgataaggtcaagaatgtgattataggcatgagtggctgaaggacagtagagaacaagatcaccggagatgttaaagaaactaaaaggtcaacatgctggaacaatcatctatttaagtgttgaaatcaccaaaaattaaaatggggaatgctaaagagagtgaaagtgagccataagaaatgtgatggaatcacccagatgtaaatgacaatcatgagggaatgtgggaagtgtgtctgctaatatgaaactcaaaactgggggactgtctcaaggaagaatacctggaattggcaatgaggagcaaagagtatatactacagggaccaagaaatgtaaacgagtaaaatacacacccaaaaacaagctcagtctagcacaaaactaatgaccaacatatattactgtactataacacagtaacggctaccacagagaactataggtcccactggaggcccagtagaggaatcagaggtttcacaaacgtgtggaagatgtaacatggagctgagtgctcaacaatgagtaagggcaaaagcaccttcaaggcagaaagacactacaacttaggcaaaggcagagagatgtgaaaagaacataaagcgttctgagaaatgcaaacagttcaacatgattaagggcagaatgagtcagaaagagagtcaggacatatagctggaaaggtagaccaaggctacaactattttttctgttaaagcaagaacaaaagatatgaacaaattaaattgttgcccctaaatccttcataaaaaccattaatagaaaacaaaattgacaaattgtagtttcctcttattttccttagtttgtaggagatgccaggatgcaaataacctaatagccagttgctttaagaagattaatcaacccttagagaacaaatgctgccacattatatacaaattttatgatcattatgataatctccaatagccaagatataaatgtgccatagaaaattatgcacaactaagatattgtaagcaactgaatagagctcaaacataaatgcattagttgtagatttgtaacatgtatatatgcaaacataaatgtatacagctatatataaataaaaattgctttccatttaaaaaaacaatataagtgaatgcagagataataagaacagtggtatatacaacttttataaatgattaatgttagaattaaatatcacattggaaaagatgtctcactaggtaactgttggtatatttactctgtctccatttctactttagcagctgtgatttaatggaaagcacaccatatttgggagccaaagaaaatatattcaagtactggcactggcacttatgaactattaagcaagtcacttaactttcctgtgcctgagtttaaattacaaaatggaaatcaaaaatccatatatcatgtggttttattaagatttatatgaagtactatatctaaaagagctttgtaaaccacagtgagctacaaaatagtttagttacatactttgaaatattattaatgtagaactaaaagccttcaagccatctgctgaacccccactccccaaaataaagcacgattaaaatctgagatgataaatctgttagtctgataagtatgtctcaccacctctcttcataaccttacctttgaatgagcaggccctctttcattcagaagtttatactggggttggactctattgaaacgggctaactcatttaccagacacattgcagttttctcttttgggtttgccattttatcttggagagaagctgtaaataaaaaggctataaagtttttgtgaagaatgactttacaaaatggaagaaaaactagttttgactttgaaggtagattgtatatttaaattattttcatgaattttgtattttaaaaattcaaattacctaatgtcttccattacatgcaacagaaatatgtatcacattttaaacaataaattaaggtaaaatttttcctaagtacctaagttgttctatgtatataacagcatgcttaaagattttaaagtaaaattataataattttttatcttaaaaactttcctttcccctcaaaaaatttactagaaacacatacgtttcctggttcttattactatgaaactaaattttgtctaccttcttgatcgtttcatctcaatttttttccttctcattatgaggcagtgtgttagaaaaagctctagtcttgggaatcaggtcctaagtttaagtactagctcttccaactacaatttttcggtaactctaaacaaattaactcccctttctgtttttttaaataaattttcaaagttgtaaaaagaataatttaacaagtgcccatgtacctaacacccagtgcttattaaccatgttccatgtttaactcttattaaaaaaaaaataagtggtattccattcctgttaagttccttattatcttttacagagtattgatgtatgtggttctagactcacataaatggtattatagcattataataaacattctcacagtttactttcttcactcttcattgtgttctcaagacttttacttatataaatctagcacattaattttaactaccatagaatttcttttacaatattgcaccagtttttttatccactcctctactgagacactgggttgtttccaattcttcactcttaaagagagcatgctgtcaaatagctctcaaaatgactgtaccaaattaccttcccctaccgtttctcctcaagctcaaaaacatggaatataatcaaatattttaatttctgataatttgatatttgacaaacagtatcccattattgttctttgcatatttttctccactactattttatgtttgtttgggttttttcttgttcagagacagtctcactatgttgcccaggctggactctaaccctgggttcaagctattttccctactcagcctcccaagtagctgaattacaggcttctatccttttttttttttttttgtattatagttaccaacttttccttttatggtctgtgctttttacgtcttgtttaggaagtcctctctaactgtcaagatctcaatgattttacttaaactcactaagccttctattctttctataaaatgagagaaataaatctatcccgcttaagtcccaaagttgttgtgagattaagagttgtaaatgtatgatatggttttctaaactatatcgcaaatacaaggtactattatagcttcagaatatttttctaataccacattattttaacctatatttttcctttctctcatttatagacacatttaattacttttttctttcacttcccataaaaaatgccaaaatatattttaaaatctaagcataaaacatgcaagtggattacttcctgctcatttaaactatagtcacaataaatacagttcaattgtagccacaagaatacttaaaatgaatgaaaatggctggctttaggaacttcatctacaaacttcctaggccaaagtttaatattaaaaataatattcttttacatttctaatactcttaacaggcccaataatttgtacaatggcttgattgtgataattatgattaagaaactattttataagaaaactacgtaagcacctggtaagacctaagtaaaaagaaggaatctaagcaaccaattgtagggccaagacagctgacagtagattctacaattaagccattgtaagtggcttgcaaaaaaaaaaaaaaaaaaaaaaaaaactagtaattattacttttgggaaaagtacaaaaaagacaaaagtcaagacagttttgagaaaacctgcattttacctattccattgcatgtcacacaaattttataaaacatcctgttcaatttggaaagtcagtcgttataagaaaatacaaggtaacctgagacgataatcagttttggcctttgcataccattgcatgaattcaagtgcaacagacagcacagccaatttaatatcaaaaagcaaaagcagaataattggttaaaatgagaaaatattaaagtctgataaaaatcagccaattttgcataacacaaatagcatttataccaccactgtgtaattttcataattcagtaatgctgcatattcatctgttacaatgcaaaacatattagaagcatacaaacatagtgtgaaaattttatactatgaaaattgctaatagcataggttctacacatattaaacagcgatttaaatggttcatttataatgaacccgtttggtatgaaaacctaatctaaatcctctaaaggaaaatgttaacaaataacatggtataaaacttatattccattaattctgacttcctgcttcataaaagttaacatgaatccaataacacattttaatgggtgactgaagttttagtgtgagaagggtccaagatcccactttgataaagcttcaaaattaaaatcaaaatgtttaaagttgataacttaggaaataattagtcatagttgttttattttaaaaagggattaaaacaaatagttgttcctttatttaatgagaaatcttaataggattcttacttgacagagagctcagtaatacagcaataacttttaaattacaccaaaatttagatagagcatctataaaaacaaactggtctataaaatctgagacacataaaaaagttatataaatcttttttagagaagtcaatagtgcaaaaaagtgagaaatgcacataatgttacacaggtatgcattttcaaagacctatagatgttatcactgaagatagtttgaaatagtcttcaagtccatttggtggctggaatagtagagacctacttagaagtaaataaaattaataaaaatggattcacaatctcagactctgccactttgaaagaacaactgccacatgatggttaagagcctgttttggatatctctgtcacttactaatatctgtgtgaccttgagaaagtacttaaatctcactttcccacaaagtaaaatagagataatagttgttcttatctcactagataattgcatggattgaatgagataataccaaacactgttaacaatgattaaaaattcattattattctgatttaaacatttgttaaaacaattacactatcatcaaatattaaaacagtgacataaaaagtcatgaaaaaagtttataaaactaagtaaaaatattcttagccaaaatattctgttacgataaattgattttactcatacaaatatacttcttggctgggcatagtggctcacatctgtaatcccagtacattgggaggcagaggcgggaggatcgcttaaggccaggggtttgagaacagcctggacaacatagcgagacctcatctctacaaaaaaataaaaatattagccatatgtcatggcacatgcctgtactccttgacactcagaaggctgagatagaaggattgcttgagcccaggagttccagactgcaatccagcctgggtgacagagtgagatcctctctcaaaacaaaacaaaacaaaaaacaagtatatttctgtagtagtctgtgaaaagcatgtatttgttattattttttccactgacttataaacccataagttcgtttccactgaaaaattctcaaatatgatataaattatattaaaggtttacatgtgctaggaaatattctaccttcactgatacgaaacttggttagatataacttacaactttgataagaaacactggtaaaatacatatttataataacagtatttgcatatccaacaaaaacataaatatactctatttttagattcactctatttttatgtcttcacaaaatgtcctggactctggaatttgaatcttcattttgcctgttcatttgtatgtgtaggaaccagtgaagaaacacagcaactgtgttcaagtcactgaacaagctacaaaataatgtagctcacaggcaaaatgatctgtccccaaaggagttcacagtctgatagaagaaacagacacagacaatagacaaacacaataaatcacaatataagtactataataaggctgttacaaaaactccttagacaaagggtgtatggaaaggcaagttttaagaggtggtgattagataaggaaagcaaaaattcacttaggtaacaagggaacgtgagagacagtccaagcttttcaaggagtatagacacaggagaaagcacataaaacaacataactttctggcaaatgcaagcagaaaactggcagaatacagaacgcatgagaaaaaacagcagaataaaactatgtgaccagaattcactagaacaccaaaagtttcctaaaccagaacttaaagtagcattttttaaagtagctatattccagccagaactgttgctactaaggtcacagactacctcgcttcgcaaggcaaatcattccaaagaatcctttccatccttggtcccagaaatgacttaaacacggtttctttccttttttttttgagacagagtttcactcttgttgcccaggctgtagtgcaagggcgcgatctcggctcactgcaacctccacctcctggattcaggtgattctcctgcctcagcctcccgagtagctggaattacaggcatgcaccaccacgcccagctaattttgtttttttagtagagacggggtttctccatattggtcacgctggtctcgaactcccgacctcaggtgatccgcccacctcagcctcccgaagtggtgggattacaggcgtgagccaccacgcccggccttaaacacagtttctatgtctctttactggttcccctttctctattctctgctattggagggaactcatcctaattcccaagtaaaataagaaagaaaaaagtcaaaagagcaaaggaccctttcatgggctcttgccttctaggagcaatctgacagatatgtccccagctattaactaaaacaaaccctctattttcaaattagaccctaacataaggctgtccaagcaaaattatcgacaaactacccaggcatcaaactgctccatttttaacagtctgtccattaggaaaaaatttaagttcctctctcacataaacacaaagataaatttcagaaatattaaaatgcaaaatacaaaaatttcacaaaaactaacggaaattagctaaatatctgtcatactcctgtaacacagaaggccttcctagatatgaaaaggaacctagaagccataaaggcaaaaactgatagttaacaacataaaaataataaaacttctctaaagcaaaacataccacatatgacactaaagtctaagccattttgagttactttttgtatacagaagaaatacttgcaatatgtgaagaaaggccaggcgtggtggctcacgtctggaatcccagcactttgggaggtcaaggcgggcagatcacctgaggtcaggagttccagaccagcctggccaacatggtgaaaccccgtctctacaaaaatatacaaattagccaggcatgatggcgggtgcctgtaatcccagctactcaggaggctgaggcgagagaatcacttgaacccgggaggtggtggttgcaagtggaaccaagatcgcaccactgcactccaccctaagcaacagagcgagactccgtctcaaaaaaaaaaaaaaaagtgaagacaaactgttaacattcataaaataaaaagatactataaatcaatttttttaaagccaataggaaaaaagggcaaagttacacacaattcacataatttcttgagtaaatatacctgttcaaaagaatgttaaagagcctggccaacatggtgaaagcctggccaacatggtgaaaccctgtctctattaaaaatacaaaaatcagccaggcatggtggcacatgcctgtagtccgagctattcgggaggctgaggcaccagaatcgcttgaacctgggaggtggaagttgcagtgaaccgagatggcaccactacactctagcctgggcaacagagtgagactgtcaaaaaaaaaaaaaaagaaagaaagaaagaaaaattcaaattccagtgatatataattttcccctattagactgataaagattttttttaataatcatttaagtattaacaagtatgtggggaaaatgggtgagaattctgttggtgcaaatacaaattagtacaaaatttctgatgggcaacattgattaaagtttcaattgtacctatctttaaaacagcaattattaatctgaggattcatactacaggaagacatttgcaatgataatctggaaaacaagactataatagcaaaaactataaatgagataaatattattatttaccaaaaattggttaaactacatgaatcatgcagctttgaaaagagaaagaggtacagagcttatgaatcaacatgggaaaactttgcaaactggtgaatgacaaaagttacagcagcttactgtgtgatcgtatatttatcttcttttttttttgagacggagtctcactctgtcacccaggctacagtgcagtggcgcaatctcggctcactgcaagctccgcctcccaagctcaagcgattcttctgcctcagcctcctgagtagctgggattacaggcatgcgccaccatgcccagctaatttttttttcttttttttttttttgagacaagagtctcgctctgtcacccaggctggagtgcagtggtgtgatcttggctcactgcaagctccgcctcccgggttcacgccattctcctgcctcagcctcccaagtagctgggactacaggcgcccgccaccacgcccagctaattttttgtatttttagtagagacggggtttctccatgttggacaggccagtctcgaactcctgaccccaggtgatccacccgcctcggcctcccaaagtgctgggattacaggcgtgagccactgcgcccggccagagtaagttctttctagtcttgacagtgccaccatggtcctgaaaaacagaaaaataatgctcaaggatctgatttaaagcaggccatgttgtgcctccatctccaacttttccagtgaagctatctagagatttaaacaggacaaaaacacagtgtgtccttaccagtatttagtttggtcagtcttcttaacttcagtcattctaaatatgtgtataatgatacctcgtgattttaatttgcatctccctaatgaatactgttaattaacttttttcatttgcttatatgtcatctgtatctcctgtggtgaagtgtctgaatattttacttttgatttttttttcttattgctgaatttgaagagttctttacacatcctacatacaagttactgattagacatatgcttggtaaagattttcttctaggccaggcgcggtggctcacgcctgtaatcccagtactttgggaggccaaggcaggtggatcgttttaggtcaggagttcaaaaccagtctgggcaacatggtaccccgcctctattaaaaatacaaaaagtagctgggcacggtagtgtgcgcctgtgatcccacctactcaggaggctgaggcacaagaatcacttgagcccaagaggtgaggggctgcagtgagccaagaaggtaccactgcactccagcctggggaacagagcaagactctgtctccaaaaaaaataaataaagtagtaggaaaaagatgaattgctaacaaagttggagcaaatggacagtcatcttagaaaataataaagaggaatcactacgaaaaaaataaaaatttttttcccaaactgtggcttttctctttattctcttaccagtgtcttttaaagagcagattttaatagtctaatttatcaatttttatagtttgtacttttaatgtatatctaaaaaattattacctaactgaggtctaaaaatttttttctcctgttttcttccacgaacattatagttttaggttttacatttaagtccagaagccattttgagttagttttcctatacagcgcaaggtatgaatccattttttgtatatcaatatccaattgtttccaactgtggaaaaggctacatttctcccactacattgcctttatgtctttgtcaaaattattagttatctacatataaggagtttatttctggactaccaattctgtttccactgatctatttgtcttttgttgttgttgttgttgttgttgttgttgttgttgttgttttgagacggagtctcgctctgtcgcccaggctggagtgcagtggcgcgatctcagctcactgcaacctccacctcctgggttcaagcgattctgccgcctatttacctatttttacgccaaactattttacagcttttaattcttgaaatcaggtagtgttggctcccacactgttctttttcacagttgtttaaagttctttaaatttccacatgaattttagaatcaccctgtgcagttctataaaaaagcctgcaaagattgaaatataagtctcttaaatctataatttggtgaaaatcaacattttaacaaagttgagtattccaacccatgaaaaggatacacagtcacttctcattattgagataataatatgtcaatgactgttatgtgaatcagcaattatagagccattgctcccaggggaactaacgtattaggttcttgcaagcttctgctgacatttttgtgaactgatcatatgtcatgttttatgtgtttctgtttagagacttcttgtttagtatgtattactaatatatgttactgattcattaacattgaactcatgtccaatagtactgtttaactcctgcctgaataaagcttatctaatgcacatatattctccgtaaggcatatcagagcctcctggtacttagaaacactatatggcacttaaacattacactttaaacattttaaacatcaaaataaccatctttgtaaacatcaaaataaccaacaaaaagcacaaacatgcaaaaaatgcagcactaaataaaccaagaaagggctacttgcttacagtatgaaacccaaaataagaaagcagagcattgtcttgtttgatcccagctgggtatatacatgtgcactgggtgattcaaaatgttttgcccctgcaagtgtctgagaatgaccacaaaagcactgcaagtattggttttggggttacaaataaaaattagtgagtaagccaattcctaggtaaagaatccatgaataatgagaatcaactgtatcttattcaggtatcctttaatttcttgcagcagtattttgtagttctcattttctttaacatattttgttagacttatctctaagtagttcatatttttgatgcttttgaaaatgctactcttttattttcatttatgattgttctctgctaatgtatagaaacacaattggtttttgcatactgctcttctatcctgcaactctgctatagtaatttattagttctagtaggattccatcagattttctacatagacaatcaggtcatctgtgaataaggacagttttattcatttctttccaatctgaacaccatgcatttccttctcttgcatgatggcatgggctagaacctccacggcaacgtcaaacggaactggttaaagtggacatcccgtcttctttttttaaaataagtgtccagttttggccaggtgtggtggctcacgcctgtaatcccagcactttgggaggccgaggcaggtggatcacaaggtcaggagatcgagaccatcttggccaacctggtgaaaccccgtctctactaaaaaatacaaaaaaattagccagacatagtggcgggtgtctgtagtcccagctactacagaggctgaggcaggagaatggcacgaactcacaagggggagctttcagtgagccgagatcgtgccacttcagcctgggcaacagagcgagactgtctcaaaaaaaaaggtgtccagtttttcaccaataagtacaaggtcagctaataaggtttttcatagaagcacattagcaggctgggaaagttcacttccacttctagtttgctgagagtctttatgatactgaatattagattttatcaaatgatttttctgcatctattgagatgatcatgtgatttttgctttttagttcattaatatgttaaattacactactgattttttggaacactaaaccaaccccacattcctgggataaaccccacatggttatgacatattatccttttaataaactgttgaattagatttgctgaaactttgtttagatttttgcaattatatttatgagacatactggtctgtaatttccttaaaatgtatttgtctgattctggtatcccagtaatgctggcatcatgagccttgtaaaaaattccttccacttcaatatttttaaaagcatataaaattgatattattttttccttaacttgtataattcaccagtgaaactatccggacctagagttttctttttaagtagacttttactacaatttttatttctttagcatataaaaagctactcagggctaggcatgatagctcatgtctgtaaccctaccacttcaggccaaagcaagaggatcacttgagcccaggagttggagaccagtcagtacaacatggtgaaaccttatctctacaaacattaaaaataaaaaaattagccaggcatggtagcatgtgcctgaagtcccagctaggaggctgaagtgggaagatcacttgaggtcaaggccacagtgagctatcatcggaccactgctctccagcctgggcgacagagtgagaccctgtctcaaaaaaaaagctattcaggttatccattttcttcttcttcctttgggattaatttgttcttctttttctagtcttttaagatggaagctgaagtcaaatatttgagctatttgagttcattcttctttcaaaatatatacatttggagctataaatttctccctaaatactgttttagcaatatctcctaatgttgtattgctgttgtcatttagtttaaaatactttcttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacagggtttcaccttgttaaccaggatggtctcgatctcctgacctcatgatccacccgcctcggcctcccaaagtgctgggattacaggcgtgagccaccgcgcccggcctagtttaaaatactttctaatttacctttccttctttttaaaccatagattacttatattttttaatttccaaatatttagagatttcccaagaatctttctgttaatgattcctaattccactgtaatcagatacaattttttaatgacttgaatccttttgaattcatttaagacttgtttcatggccaggcaccatggctcacgcatgcaatcctaggagtttgggaggcagaggcaggaggatcacctgaacccaggagttctagaccaacctgggcaacacagtaagatcccaacactacaaaaaaaaaaaaaaaaaaagaatattagctgggtgtggcggcacacatttatagtcctagatactcggggagcagaaatgggaggattgtttgagcccaggaggtcaaggctgcagtcagccatggtggtaccacttcactacagcgtgaacaaagcaaaaccccacctccaaaaaaaaaaaaaaaaaaaaaaaaaaaagtcctttatggcccaaaatacagtttatcgttgcaaatgttttggataaacttgtgaacaaatacgtattctactctttttaggtagagtgttctataaatgcaattaggtcaagttgcttaacagttactcaagtctactatatctttgatgattttctgtccacttctatcaattattgacaggggttactaaaatctccaattatgactggatttctcaatttctccttgcatttctatcaggttttgtttcatgtgttttgaagctctgttattaggtgcataaacatgtaacatcattatgtcctcttaactgacctctttaccattataaatgaaatgaccttctttatccctggaaatattccttgctctcaaatatactttaatattaatatagccactccaagttgcttttgactaggttaccatattatatcttttcccattctttcacttttaacctgtttgtttacaaactatttcttgtaggcaagcatatagttggatcttgcttttatatccaatctgacaaattcagcctttaaactggagtgtttagacaatttacatttagtgtgactattcatatggttaggtttgattctatcatcttgctatttattttatatttttcccatttggtgtttgttccttttttcttctttttggacttctgttgaattattttgtgtgactccattttatctcctttttattggcttattagttgtaactctctattttgctattttaggggctagagtttacagtatacatttttaacttaccacagtctatcttccagtgatattatcacctcacacagagcaaaagaatcttataacagtatacctccatttctccctccctgccttttagctattgttatcatgcattttacttttagataagttataaaccccacaacagcttgttaatatttttgctttaagcagtcacttatcttttaaggagatttaactgataagaaaaaaaatctcatgtatttacccaagtagttaccatttctagtgttctttctttcatgtaactccatatttgcatctggtatcattttcctgctgtctgaagaattgcttttaaattttcttccagaggggaaatgttagcaataaattctttctgcttctgtgttgtaaacatctttatctcatctttattttagaaacatatttttgtcagatacagaattatagattgacatttttcatctttcagtactttaaagatgcttccccagtttgcttgcttatatcgtttctgataaatctattaagataatcatctttatctttcttcctctacacacaaaatgaccatatctctttctctgactgcttttcagattttctctttatcatttgctttcaacaatttgattataatgtacagtaagtcctcacttaacatcatcaataggtccttggaagctgcaacttcaagtgaaacaaagtagaacagaacccaatttaccatggtccaatcgacataaacaagtgttaagttcctacagtgtatttctagttacaaaaacatcaccgaacttctaataccaaaacacttctaatattaaacaatgaaatgaatgtgagctacacatacacttaagaaagattaataaaaacaagtaagataattattcacccaatttttctagttcagggtcacaggtggtcagagcgtatcctagccgctcagggcacaaggcagaaaccagccttagacagaatgctattccacactagagtgcgtgcgtgcccacacacccacacacacacacacacatacacacacacacacaacagactaactcatactggaacaatctagagaagccaattaacctaatgctcacatctccctaatgtgggaggaaactgaagtcccaaagaaaacccatgcagacatgggaagaacatgaaaacatcacaccaatactggccccagccaggaatcaattctttttctctcatcaacattatgacaaaatgatgttgaaagaaacattatttgaggacctgctataccttggtgtagttttatgtttcttatacttaaaactcattcaacttctttatctgtagatttatggcttaagtctaaaacatttttggccattatttcttaaaatatattcttctgtatattatgtcccttgagaactacaattattcatctatttggctgcttgagtgtgtcccacagctcactgacttttttttcttctttctctatgcttcattctggatggtttctattgctctgccttcaagttcattcataattttttctgcaatgtctaatttaccattaatctcataccgtatatttttcatctcagttgtagttttcatcactgtaagtctgatatgggtctttttgtctcttctgtatctctaactttttgaatacatggaatacagttataatgttttaatgccctctgctaattctatcatctgtgtcagttctgtgtcaattttgacggaagattctcataattatgggtcatatttcatgcttctttgcatacatggtaatctttaactgaatgacataccttgttaattttaccttgctatatgactcctataaatctttttggactttgtccaggcatacagttgagtaatttggaaatagtttgttcctttcaagtcttgtttttataatttactagttcgctccagagcagcaacatcttctcaactcagagtctgccagactccacatctcagtttctactctctatgtcacatcctggaaaatctctcagtgcagtaggcctggggcaattgtaggactcaccttgtttgtttcttctctctcaagaatcacttgattcttgagattaagacctgaatgtcttaatcattgttgtttctacatattttgtttttttggagaagaggggtaggattgtttcaagaggacagtaaacacgatccttgttacaccacatggaccagaggcaaaagtccccatccgtccttcttatttaatctatctgtatctatttgagtttcttgtaaacatcataaatataccgtccctgacttacgatggttcaccttatgattcaactttaccatagtgacaaagtgatatgcactcagtagaaaccatactgaagtacctatataagcattctatttttcactttcagtatcacattcaataaattataatgagatatttaacactttattataaaatagggtgtatttagatgattttgcccaactgtagtctaacttaagtgttctgagcacatttaaggtaggctaggctaagctatgatgttcagtaggttgtgtgtgtgtgtgtgtgtgtgtatatatatatatatattttttttttttttctgagtcaaggtcccactctgtcacccagactagaatgcaatgaagactataactcactgcagccttgacctcctgggctcaagcaaccctcacacttcagcctcccaagtagctaggactacaggtgcacaccaccacatccagctaatttttgtattttttgtagagatgggttttcaccatgttgtccaggctggtcttgaactcctaggttcaaattatctgccagccttggcctcccaaagtgctgggatacaggcatgagccaccatgcccagttaattatgtgtatgaaatacatttttgactttcaatattttcatcttacaatgggtttatcaggacctaacaccatcataagtcaaggagcatctgtacttgagtcttgctcttctatacaatctgacaatctttgccatttaaattgagcatttaagtcatttacatttagtatagttgtcaatattactagatttatatctactgttttgttatgtttttgtccttttatttgttcctttcttcaactttatcttcttttagactgattatttttagtacccattttatatcctacataggcttactatttttattttgtcgtataggaattgttctaaaacatacacagcctaccttcaaatatcattccacttcatgtttgatatcagcacctaaaaattctatacttccctttcccttatccctttctttatgctactgacatcaattaatttctatgtataagccctcaaggcactgttagtatttttgttttagtcaattatctttttaaaagttaaaaatgggccaggcatggtggctcacacctgtaatcccaacactttgggaggccaaggtgggcggatcactggaggtcaggagttcaagaccagcctggccaacatggcaaaaccccatctctactaaaaataaaaaaattaactgagcatagtggctcatgcctgtaatcccagccctttgggaggccgaggcaggtgaatcacttgagtccaggagttgggagaccaacctgagcaacatggcaaaacaccttctcaacaaaatatataaaaattagccggatatagtggtgcatgcctgtaatcccagctacttgagaggctgaggtgggaggactgcttcagcctgggaggtcgaggctgcagtgagccatcatcgtgccactgcactccagcctgggaaacctgtctcaagacctgtctcaacaacaacaacaacaaaatttttatttcaataccaccaattttcagctatttgattatgatgtgcgtggttaggttttttttttttttaatatttcttctactttaggttgacttcttaccatcatctacaggtttatagtttctactaaacagagaacagaggtttaaagtcattatttcttaatgtcattcgcagcaacctggatggaactggagacttattctaactgaaataactctggaatggaaaaccaaacgtcatatattctcactcataagtgggagctaaatttgtgaggatgtaaaggtgtaagaatgatacaatggactttggggacttggggaaagggtgaaagtggtatgaggtataaaagactacacattgagtacagtgtacactgcttgggtgatgggtgcaccaaagtctcagaaatcaccactaaagaacttattcatgtaaccaaacaccacctgtttcccaaaaactgttgaaataaaaaataaataaaagtcattatttcttataatattttctgttgcccctcccttctcctaggattctaattacacgtcttaggccactcgatatttcccacagctcactgatgctgtttttttctttagtccttccaccctgtgcttcattttggatagtcactattgttatctattcaagcccactgatgtgtgtcttatctgctattaatcccatccaatatatattttatttcagatactgcattcttcatctctatttttatattttctatgtatttccacatcatctttctgttttcccctcgtgtcttgaacatttagagcatattagtaagaactgtttctatatctttgtctgctaaaccatctttatcatttctgggtctctttcttttcagaaaatgtttaaatcctggctatgggtcatattttcattcttctttgtaagcattttaatattttattgaggtagaattgacataatatctaattaatccattcaaagtgaacgttcggctgggcacggtggctcactcctgtaatcccagcactttgggaggccgaggcaggtggatcacttgaggtcaggagttcaagaccagcctggccaacatggtgaaaccccgtctctactaaaaatacaaaatttagctgggcgtggcggcaggtgcctgtaatcccagctactgaggaggctgaggcaggagaatcccttgaacccgggaggcagaggttgcagtgagctgagatcacaccactgcactccagactgagcgacagagggagactacatctcaaaaaaataaataaataaaaaataaactgaatattccagtggtatttagtccactcacagtgttgtacaactaccacctatacctagttccaaaacactgttatgaccccaaaagggaattcaacacccattaggcagttgcttctcattcacccttaatcccaggccctggcaagcaacaatctacattctgtctcatagattacctattgtggatatttcacataaatggaatcatacaatatgtgaccatttgtgtgtgtcttctttcacttaatatgttttctaggttcatctgcatcgtagcatgtatctgtacttcatttctttactgctagacaatttatggaatacagactactgcaatttgtttactcattcatccactgatggacatttgggttgtttccaccatttagctattgcaaatagtaatgctatgaacatgtgtggtcatatatttgtttgagtacctgctttcaattcttcagggtatatacctaggagtggaattgctgggtcatatgacaagtctatgtgttcctttgaggaattgtcaaactcttttttccacagaggctgaaccatttaacattcccaccagcaacatacgagggttccagtttctccacatcgtcctcaaaaccagttactgcccgtcttttgattctggccatcctagtaggtgagaagtggtatcttactgtggttttcatttgcatctccctgatcactaatgatgttgagtattaatgatgtgtttatcttctcagagtaactgtctattccaagtcctttgcccattttttagttgagcttttttttgctgttgagttgtaagttttcgttcttgtattttggccattggtccattatgagttaatttttatacatggcatgaagtaggggtccaactttattgttttgcatgtgcatctccaggggtccccaaaccatttgaagagattattctttccccactgaatcatcctggcatgtttgttaaaaatcaattgcctacatatatattaattctggactctcaattctattagtctatacatctatccttatgccagtaccacactattttgatcattgtagctttgcagtaagtttcttaattgggaaatatgagtcctctggctttattcttcctttttcaagatggttttggctatttggatctgttgcaattccatatgaatatgaggatcagctttccaacttttgcaaaaaaaaaaaaaaaaggccaatggaattttgatagagattgcattgaatctggagattgctttggacagtattgccatcctaacggcaatgtaaagtcttccaattcatgaacacaaaatgtctttccacttatttaggtcttctttatttcaacatgttttatagtttacagtgcacaagtctttcataagcaagtcaactcctttaggcttttggatgctattataaatgcaatcttttaaaatttctttttgtattgttcattccgagtacacagaaacacaaatgctttttgtgtgttaccttgtacctacaactttgctcaagttatttattagctttagtggaggtttttctggattctttgggattttctatatataggaccatgtcatctgcaaacagagacagttttatttcttccttccaaatctgtatgtctttgtttctttttcttgtcacactgctctggctataacttccactacaacttgaataactggtgagaatgggtatccgtgccttgttcctgatcataagggcaaggatttcagtcttttactattgagttggatgttagctgtgggttttttcataaacgctgaatgttgaggaaatgtttaaaaaaaaagttccctactattcctgattttgagcctttctatcaagaacagctgttgaattttgtcaactgcctactgtatcaattgaaacaatcacgtgggggttttccccgcttcattctattaatgtgttgtactacaccacccttgcaatcctgggaataagtcccacttggccatggtgcatattcctttaaatatgctgctagattcagtttgctagtattttgttgaagatttttgcatctttattaataaggaatattggtctgtaattttcgcattacgtctttgtttggctttggtatcagggtaataatactggcctcaaagagtgagttaggaagtattcttactctctcctctccaattttttggaagagtttgagagcgattctcatactctttaaatatttaaatatttggtattcttctttaaatatttggtagaatccaccagagaagcaatatggtactggacttctgattgggagtttttgttttgttttgagatagggtctcactctatcacccaggttggagtgcaatggcataatcatggatcactgcagtctcaacctcccaggctcaagtaatcttagtttgggaggttttttaactaattcaatctgttcacttgtaagtctgttatattttctgtttcttctgagtcagttttagtaatgcgtatttctaaaactgtgtccatttcatgtaggttatctaatctgtgcataaaattgctcacagtattctctttaatcctttttgtttaaggtcagtagtaatgtccccacactcacgtctagttttagttatacctatctgtgttttttctttgtcagtctagcaaaaggtttgtcaatttcattgatcttttcaaagaatcaaacttttggtttcactaattctctatattattttcctattctctatttcatttatctccactctaatctttatttacttccttttttctggtagctttgcattttctagtttctttaaaatgtaaagtaagattatttatttgaggcctttcttattctttaatgtagatgtttattgctaataatttccctctcaggactgttttcactgcatcatttaagtcacatatattgtttccattttaatttatttctaagtattctctaattcccacatatttgtaaatttccatatatttgtaaattttccagtattccttctgttaatgattactaacttcattccactgtgactggagaagatacatagcatgatttcaatctttttaaatttactgaaacttgttttgtggcctaatacagcctggagaatgtttcatgtatactttaaaagaatatatattttggcagggtgcagtggctcacgcctataatccctgcactttgggaggccgaggagggtggatcacctgaggtcaggagtctgagaccagtctggccaacatggcaaaaccccgtctctactaaaaatacaaaaattagctgggtgtggtggtggacacctgtaatcctagctactcaggaggctgaggcaggagaatcacttgaaccccggaggcagaggttgcggtgagccaagatggagacattgcactctgggctgggtaacagagcaagactacgtctttcaaaaaaaaaaaaaaaaaaaagacaaaaaaaaaagaatacatattttgctgttgctgaatgttctgtatatgtctgttaggtctagttgattaatactgttgttgaggtcctctagtcccttactgatattctgtctagatgttctatccattgctaacgtcaaagcaagcattttttgactgaatgacaaaaactaaattttacattgttgggttctgaattttgttgtattcctctaaatagtgttctggtgcagttaagttacttggaatcatttggagccttctgaggactcttcccagtgccccatgtattctacaacatactttactctgcatagtaggaacacgactatttgaagccttattgtgaactctggaaattgtttttcttagtgctttccaagtgttttcttctctggcctcaggtagggcctgtcaagcatctacgaaatcagaactcagcaaaagactccaggagaaccctctggagatctccaaaatgcatgctcacttgttcatgctctcttgctttttagtttatgcctccccaacgccaatcccaacccccttagctcttttttctctggtactctgccctgtaattctaatcgccttgatcttcccaaatttttatctttgtctttttatctcagtaggactgctgggctctgttttggttcctccacaccttgcactgcagccaataaactgcctctaggctctgcagtaagctgttacaattgaagggctttaccttcacttgttcctattctctcagggatcacagtctggtgctgcctgtcatcaatgtctaaaagctattgtttatatattttataaattctcaagttatttaaagaggaagagtagatttttgctacataacaaattacctccaattttgtggctttaaaaatcaagcattggccaggcacggtgactcacgcctgtaattccagcactttgggaggccaaggcaggaggatcacctgaggtcaggaatttgagaccagcctgcccaacatgatgaaaccccatctctactaaaaatacaaaaaattagccaggtgcggtggtgcacgtctgtagtcccagctactcaggaggctgaggcaggagaatcacctgaacctgggagacagaggttgcagtgagctgagatcgtaccactgcactctagcctgggtgacagaccaagacttcaactcaaaaaaagctaaaaaaaatttaaaaacaaacaaaacaagcatttctttttttcacacagtttctgagggttggcaatcagggaacagcttagatgggtagttctggctcaggatctctcatgaggttgcagtcaagatgtcagcaggacagatgtttaggactggaagcttgactaaagctgagacatctgcttccaagaaggctcgttcacatgctgttggctagagaggcctcagttccttgttggctgttggcaggaggcctcagtttcccacagcatgggcctccccatcgggccattcacaacatggcagctaactattctcagagtgagtaatccaaggttgggggtagtgaggggaaggaggtggagccacatttgtattataaataacctatcctaagaaatgatccatcacttctgttacattctattggttccacagataaacctcaatacagtgtgtatggggattacaccatggtgtaaatatcgggatgccgggatcattgggggccatcttggaagctggctacatataaaataaatccagttcccattataccagcataggggaaagtagaagtctttcttacacatttttaacctccttatgtttactatttttcttatcccctaactgtaggctatattctatggctacaagagacatgagcagattacagagctccacacccagtcttggaaagaaaagtaactactactaagtagcagcaacttttaagagaaaagaatagagttcctggtgcttgtggcaagaagcaggaggaccttgaagccaatctgggcttgagaaagtggttcattcccccaaatacttcactcaatgatctacctaaatgtctgccgtctgccctcctttcccaccaatttccagtcaggcagcaatagccaacagcaatattaatagtaaaattaatagcagtagtaccagcaccaatgctaagcattttgcctttgttatctcaattactcctcacaacaaacctctgagatagctgtcattattccttacactctagactttgtttcttggtagtcatactctggtcttacactatccagtgtaataaaaactttttttttttttttaataacacctggctccctcttgccctacacggttctgctactccttcgacacggaaaaattctgtcttgtcctgcctgtcatctcttccacttcagttaggccttaaagcttcctcttagctaccatgttcccaatatctactatcaaacctcactaaaaagaatcaccagattattttgatccctgtaaattcccagttgctaggctctcccaatactacaaccgcctaatatagacttttccaattccttaggacacactgacctgtcaagcctacctcaccagctaatctccaaaacttggccctacttcagctactcatttaaaaatattattcacagcatgtatcttcgtaatttatatttgctgtagcttactgctaaaatgagttccttttcccgggggacctataattaatgatcagggagaaagggccaaaatataccatactggtaaatattatggtaccccagaaaccagtatactcccgttggttatctgttgaataatgactgaaaagtataaagtaatgattataaatactaactcagaaaattatcagagggcataatccaaagaatgttatttacaaataaaaagaaatagatgacagtagacacatataagcaatccacaaaaggcaaaacacgaaagaacaaaaaatatttaaatattatagaaacacaaaataaaataccaccttttgtcagacagataagcaaagactgaaattttgtcaaggaagtaaggaaacaggtagatacacttctggcagatataattttgtctttttgggagctatacaccaaatatctttaaaatccacatacatctttgactagtatttccatttctaataattaattctaagaaaataattggacaaagagatatacatttaaaaaatttactatggcactaactacaatataaaaatctgtccaacaataagggcttggttaaattttagtacatccaaactaagaattattattaaatcacttcaaaacattacatattgtataatcccagtttttaaaaagtaacatatattcacataaaaacatacctgcatagaaaaaaaatctagaagtatacaccccaaaatgttaccagtgattatctctgtaatagaagtggaattttttgtgattttttttgtttgtttttcagggtttgtttttttttttttttgcttatcacacctaattttctacagtaagcataagttgcacatggataataacacacattcttaaaaggcaaaaacaacaactatgatcacaatttaaaggcagaaaagtgctattatcttaacagaacatggaacatccatgttctatgataataataaagttaggcaaagttaatatcaaataacctgatattcaatagcctagtttttaattagttttagtaacacatatggaagaatctgttatgaataaaaaaccatgtaggccgggcacggtggctcacgcctgtaatcccagcactttgaaaggccaaggcaggcagaccacgaggtcagaagttcgagaccagcctgaccaacatggtgaaactccatctctactaagaatacaaaaattagccgggcgtggtggcatgcgcttgtgatcccagctactcaggaggctgaaacagaagaattgcttgaattcggaaggcggaggatgcagtgagccaagatcatgccactgcactccagcatgggcaacagagtgagactccatctcaaaaaataaaaaataaaaaagcatctaattcaggtattttaagaaaacaaaagccttcccaaataaaaatgtagtactaatcctagagacaacgttgaaaatcacgtagtaaaaatctcaactctttcaagctgagaatcaacttaaatcccctttgcatgcctagggtctcattctgttacccaggctggagtgcagtggtatgatcacagttcactgcagcctcaacctcccaggctcaagagatcctccaccccagcctcccaagtagctgagactacaggcatgtgtcaccatatctaactttttttattttttgtagagacagggtcctactatgttgcccaagctggtctcaaaatcctgggctcaagcaatcctcctgcttcagcctcccaaagtgctgggattacaggcatgggccaccacactgggcccctttacacatttaccttgagaaccctcactgttatgagaaagtggttgcccagaaagtaagattcaaaaatcactcatgaatttaagaattcaactctatgtttagctgaagagagtcttcatctcagacttgaacagtttgggggatgacagttatagtcagtaacaagaagggggggtctcttaaattgttctaggaatacacttctgttaagattgagcatcctaaatccaaaaatctgaaatccaaaatctccaagatttcaaacttcttttgtaccaacataatgctcaaaggaaatgctcattggagcattttggattttcgatttttggattagggatgctcaacctgtaggcaaaattccaaaatctaaaaaaatctgaaatccaaaacacttccagtgccaagcattttggataaggaatactcaacctgtacaatttaagtatgtatatctccaggcactgtgtacgatttctagccaacatccagggaattgcttgtggccatgtagagaattgcctaggaactgtttgcaatgcctgattcaacatgacctgcaacatagccagtcagtaaatcctcattaggactaatccataaactataattttcaatgaagttggctagcataaaatggtcatttccaaatgtctgtggcagaagatgaaaaattattttaattgtaaccaaataattaatggcaggtatccatagaaagttatttagtggcaacttcacagctataacagtttgcaaataaggtctcataatgcttccactgggatttgagagcagctgtgaggaaacaggaagcactaagcacaggacagcactacgatttctttaaattattagtaatgtttttgattaaagtaatttttgttgcactagggaagtttctagtacaggagaaaactaaataataactttacatgagggagagttagttgcatttgtgtaacacaagcagcatataacaccaaaactgacaacataattacgtggttattgttgaaaaataaatatctccttgctttagtgacaactctagcaccattcatatattcatacacccaacaaataaatgtatgaaaactatttacattgtttattctaggacctggaaatataagagtaaacaagaaaagtcactgtcttcatgaaacaaactgtctaacaagggagacagatgttacaacaaataattacatatttgactataactacaaatgtcatgttattaaactaaagagcaaggtgctataacagcatatagcaggactgcagtcaagcaagccaaacccaggggtggggaagagaggtccagcagaggaaatctgtgcaaatccctgtagccagaacaaccttacccaatctaggaactgaaacggtccagtaaaactgaagcactgagattatttctagggcacacattaagtctaagatgtataaagacatccaagagatcaaggtggtaaatgctacatgagtttggagctcagaaaaaaaaggtctagaccaggtataaacttagaagtcattagcttagagatggcatgggatgcacaggaactggaaatttctttggcaaggtgagcaggactatatgtcggaaggcagggggtcaagattactttctttttttggaacgcatctcgctctgtagcccaggctggagtgcagtggtgtgatctcagctcactgcaacctccgtctgctgggttcaagcaactcttctgcctcagcctcccaagtagctgggactacaggtgtgcaccaccatgactggctgatttttttgtatttttagtaaagatggggtttcaccatgttggccatgctggtcttgatctcctgatctcaggtgatctacctgccttcgtctcccaaagtgctgggattacaggcgtgagcgaccacgcctggccaagattacttttgttttttttttgagacagtctcactctttttgcccagggtggagtgcaatggcacgatcttggctcaccgcaacctccgcctcccgggttcaagtgattctcctgcctcagcctcccgagtagctgggattacaggcacgcaccaccatgcctggctaattttgtattttttagtagagacggggtttccccatgttggccaggctggtctcggactcccgacctcaggtgatctgcccgccttggcctcccaaagtgctgggattacaggtgtgagccaccgtgcccagtcgattactttcttaatcacaggggaaaagaaaaaaagtttaattacttctctgttgatttgcaatcaaaagaaataaaagtattttgtttctttccttttttttttttttgtttttaagagacagggtcttactacgttacccagtctggctcaaactcctgggctcaagagatcctcccacctcacctcagaaagtgctgggactacaggtttgagccacccagcctggccaaaagtattttctaacactatagttatgatacaatgttctatttgatcgggaaaggtaaaattaaatgtataaagttcttggagaaacgtcaagaactaagaaaagcacttctttcagtgagtctaaagtattaaatgctgtagtttatcagggcacttccttctagtgtttttcagtgccctggaaagtgaactttaaaaaaaaaaaaaaaacagatacaactacttcacaagatttgtcactaaaaatgctttgagtctgcagaactgccacctactgaagctgtatcatgatcataagcattctgaacacattaacaagtcctaaagggatgtgacatcaagaagaacagacaaaccttctgccttgcacaaccagaagttatcaactttcagaagatcattctaatccttaaacaacctgccctacacagcctccaatgatgactatacagtaggtaactgctttaaaaagtgatgagtcaggttacagttatagaaaagaaaagctgagttaaaatgttccacaatttacagccaaagcaccatgtaagcatgaaaaatgccttaacacaaactcacctgatttatttgaagcatgttaagacaatattgaccaaactgctgtatccctcacggctccaaaaactggaaaacgaaaatgaagaaataaagttcaacttagctgataacctcaatgactggtattttaaacacatgcccttgatcaaaatcaaatataaaatgtaatttatccagatctccatagaactttctatgatgataaaaatgttctgtacttgcactgtccaatctggaagtcattagccacatgtggctactgagcacttgaaatgtggctagagcaatcaagaaaataatatttaattttctttcatgttcacttgaataactacgtcactagtagccaccatactggacagtacagatctgaacaaagctccttctgcttctagacttctaagacaatcccaacaaaagtgaagctgttaaaaataaatctgagagtttcaggttaatatttaatgtatacttccctttttgcagtcctgttttaaacagctttgttcccatcttctatacgataaattaatcctaaagaagatgcaacaccacaagtattctcttagatggtatggaaaagagcatatagtacaattatcttgctgaatagtttctttttctctgtcattttgtctgttatcatcagtataaaaatagtatgtatattaaaatttcaggctgggcgtggtaatcccagcattttgggaggccaaggtgggtggatcatttgagttcaggagttcgggaccagcctggccaacatggtgaaaaccctgcctctaccaaaaatacaaaaattagccaggcatggtggcgcgtgcctgtaatctcagctactcaggaggctgaggcaggagaattgcttgaacccaggaggcagaggttgcagtgagccgagattgcgccattgcactccagcctaggcgacagagcgagactccatctcaaaaaaaaaaaaaaaaaaaattttaatttgaaaacagatgccaatgaagggcaggaaagtccaaattacaaataaataaatcatgggatcttgtaatgaaaaaaagtttatataaaatataaattatatacagacctctcccctaaaaattatctaaagcaacaacacaattgtgatacacagcaaaaggcctatatctaatcacctgtatagaaactgttatgctgctaaattttaatattgaactttcccctggaagcaaacgttttgtaagtacacacatacatacacaaacacacacccatatttggctaccattttttcaagatgacaaactagagtccattcaaaatgactttgaaaactttaatatttttcttacaatagtgtcctcagcatctgcatcaatttttatttattttctaattactgtcacatttcctatgagaacgggatgctgtataaagagcacacggcctggatattggtgaatttgagttttagtcaaagttcttcagattaccttctgagccttggttcaaattactttgtgtatctttgagttcttctttttctgtcttcttttttttcttcaatctttaaaaagtaagctaaagtccttgtggtaggcagcctctaacaaatagaatatagcagaaataatgagataccacttccaagattaggttataaaaattcttaggtgtcaccttctctcactcatttgctcagagggaggcagatgccaaactgtggtgccctttggagaggcccatatggcaaagaactgagaaaagcctctggccaacagccagcaacaattgatttcttcagtccaagagccccaggaaactgaaccctgcaagagccacatgaatgagttcagaaacagatcttccaccagtagagcttccagatgtgactgcaaccccaactgacagcttgactaccacctcttttatgagccacaggcacccagctaagctgcacccagatttctaacccacagaaactgtaagataatgtttgttgtcttaagtccttaaattctggtgcaatgtgctatgcaacaataaataagactatcctgtccaactctataattcaatattcccatggtgctttaggtattaattaatatttggataggcaaaaaaataaaataaaatccctgttcaacatgagcaaatgagtaacattagaacttcaaagtggcaaattataaaacttaaacatttatattttcaattcaaaaaatgagattattcacaagtgtagcattagtcacatggtgttaaaatacacccgctttcaataggaatggagtatctcattaaaaaaatacactagctataacttaaaatacaaacacaaccaatcatctttttttttaactgaaaacagttcatttaaaaagtaaagtgtgaataaccactaaagcatctcagtgacttagtgtcccttgctttctagaatttatcattactggtcgggtgtagtggctcacgcttgtaactcagcactccgggaggccgaggtggggggatcacctgaggtcaggagttcaagaccagcctggccaacatggtgaaaccctgtctctactaaaaatacaaaaattagctgggcatagtaacacatgcctgtaatcccagctactcgggaggctgaggcagaagaaataaatgcttgaacccaggaggccaaggttgcagtgagccaagatcatgccactgcactccagtccaggtgacagagcaagacttcatctcagaaaaaaaaaaaaaaaaaggccaggcgcagtggctcacgcctgtaatcccagcactttgggaggcagaggcgggcggatcatgaggtcaggagatcgagaccatcctggctaacacagtgaaaccccgcctctactaaaaatacaaaatattagccgggcgtggtggcgggcgcctgtagtcccagctactcgggaggctgaggcaggagaatggcgtgaacccgggaggcggagcttgcagtgagccaagatcgcgccactgcactccagcctgggcgacagagcaagactccgtctcaaaaaaaaaaaaattaacattattaagcattcaccaactttgaaaaactccactttgtctttattagtatacgttgctaaagttacaaatgcttatctacagatctctatgtatttcttcaatattagaggctgataacactggtggctgattccaagaagcaagcagagtaagatattggggtacctttttgaaagttctaacctttttttttttctttttttttgagacggagtcttgccctgtcacccagagtggagtgcaacagctcaatctcagctcactgcaacctccacctaccaggctcaagtgattctcctgcctcagactccccagtagctggggatacaggtacacaccaccatgcctggctaatttttgtattttttgtagagacggggtttcaccatgttggccaggctggtctcgaactcctggcctcgggtgatccatctgcctcggcctcccaaagtgccaagattacaggcgtgagccaccacgcccggcccgaaacttctagtcttctgacacggaaaagatattccatgaagtaacaaaaaataaaactttatgaacataaaattaaccatacgatttaaatattctgtaagccttttctttacaatataaagagctgtagaaattaaaacacatgaaactaatgtctataacagcactctgtaattggctaacattctgaaaattatacttttttaagcaaaccagttattttagatttacatcaatttaaaaattgtagtttgtaattataccatggacaattcagaatgttcacagtggcacgtctttaagactctgtttctactttaaagacacgcccagtctactgtcacatattttaaacaatttgctaaaatatcaagacatatcaataaaatgcagagcagttttatactacctttggtttcataaaatccacctcctcagctgggtgtggtggctcacgcctgtaatcccagcacttttggagtctgaggcggacggatcacctgaggtcaggagttcgagactagcctggcgaacacggcaaaatcgtctctactaaaaatacaaaaattagccaggcatggaggcacgcacctgtagtccaggtactcaggaggctgaggcaggtgaatcgcttgaacccaggaggcggaggctgcagtgagtggagattgcgccactgcactctagcctgggtgacagagtaagactccatctcaaaaaataaaaataattaaaaaaaaaatccacctcctctatcacaaaagtttccagctacagttgattccaattacaactaagcgcttttagagaaatgtatccatgcgtcccaaaaatgccctatctggtcaggcatatgaagacaggcaattctagattccaaactactaaatgaaaacaagcaggattatagggagacggctggggaagacgtgatgctcatgaagaatggcccaacctgtaactgcaatgtactgctgatataagtcgtactttaattatgaattacattttgcccatctgagaaattaaaagctgcacagaaatctatataatccccaataattaaactgctttataaaacggcactgttactaaatatgtataaattttttatatcagcacccatcctacagttgataggcaattctcacttaaatgtcttatttgacaacatgaaaagcaaaaaaaatttactatctctactcttagactacaaactgctacaaaactatcaattcaatgcttattactctaaaaaagatatacggtcctttaaagagctttttaaaatgtttttcattttgatttttcaaagtgggtacccaaaaacactgcttttatgtaaggaaaacagaagtcttacgccacaaactattctagtggaaaactctaaataacacaggccagaaaaaaaaaaaaggaaactaacatttttcagacaccaattgtatacgctaggtgccacattttgccatttttacatcaactcatttaatcctcatcatcttgggatgtaggcattatctccatttttctagaggttgggttatttgcctacagtcacattgctaggtttagaacggttcattctggcccaaagtcgtcttttcttcactatacaccaaattaaaaaagacttgccttctttttaatttttttttttttttttttttttgagacggagttccactcttgctgcccaggctggagtgcaatgggcaccatgtcggctcaccgcaagatccgcctcctggtttcaaatgattctcctgcctcagcctcctgagtagctgcgattacaggcatgcgccaccacggccggctaattttacatttttagtagagacggggtttctccatgttcgtcaggctggtctcgaacccccaaccctcaggtgattcacccacctcggcctcccaaagtgctgggattacaagcatgagccaccatgcccggacatttttttttttttttgagactgagtctcactctgtcacccaggctggagtgcaatggcgccatctcagctcactgcaacctctgcctcccgggttcaagcgattctcctgcctcagcctcccgagtagctgggattacaggcgcgcaccaccacacccagctaatttttgtatttttagtagagacggggtttcaccatgttggccaggctggtctcgaactcctgacctcctgatccacctgcctcggcctcccaaagtgctgggattacaggcatgagccaccccacctggccaattttttttattttctatgatcagcttggtgaaaaataaaagatttgccttcttataatttttcctggaacaaagtcaagggcttgacctctaggacaacataatggcaaagctcctatatagaacttggggaggattatttaaaatcaaacgatgcacacataaataaaaatgataattattactgattctagacatctagtattttgtgtacctataagaggcacaaatatatctatatgtgaataatcatactgtgcgtgtctcaaactatgcagtctaagagaattcaattttgcagtatctagagttttccctctttattatgatctgtacctataaatgatcagattcccagcactgaacgtgcacaaaacaagataataataggaataaagagaagggtaggcacaaaggaaaaaaaaaaaaaaacctaccatatcttctagaacctaaacaggaaaaccgctctgcctcgatttctggattgtttgtatatttaaaagcttgatgactatcttagattttttttatattcatactatttgttgaaaagcaaaccaagccactcttcctagcacttcattccagacaagccaagtaagctaaaatgtaaaatttgcatggttttccaagctcaagtatttaggagttaaggatcacaatgtatgtaacttacccttaaatggtccaggggaaaaatattttgtgtgtgatagagagcaaataataaatacataaaatgttaacaggtgaatctgaataaaggttacaaagattttctttgtattattcttattcttgccatttgtctgtaagcttgaaattatttccaaataaagttaaaatttaaaaattacacagcattttatttgaaattaacaatacatacttggattacacagcaacattcttacaaatacaaaacactggtttttatggggaaaaatgcagtaatttgtgagcaagtatgtaccatatcctaccaacttatcatcacttaggaataaatttcagactagcctaccatataataaaatatggcaatagtgacttgacttgaaaccatagcaggaaaacacaaacacaccagatagtttggcataactgcttcgcaaatttaatacaggcctgctgcaaaatgcagcaatctacaattaaagtgttatgtgatatctcttgtttgcagtaagatacaaactgaacaatgaaaatctggccatactacaaaacagagatggagagtaagtcttggttttggtagttttattaaataagatttttccaccgcagctgagttcacaacagtgtacttgaatcatctaaagaaagcaaggacggggaagaaatatcctggagaaatgttgaaatcttttctcctccaaggttactatcaccctgcctgtccatcacaattttgatttcaagtattcacgatgctggtctgaaacacaggatgcatcagaagccaagtaatgctcagcaaaagttcaccaaaattgtgaaagcaaacattaaataaaaaacgttttcaattaacagtaaaatatctttaaaggatcatctctagcctttctttctgcaggatccacccactttaaaatcctttggtaaattcccaggtctaccctaattgaatggtccctctctatctgctcaagcagttcttaaccctttggagtggggatgggggtaaggggacatcacagcaaatatggacccttaccaaagaaaattattcacaaatgcaaaattctacacacatttccaaagacttccagaatcccacggccattacccccaccgcctccctaagaatcccagagtggcgtgcttctcaatggcctctgcggagcacccccagcccccaagccacagcccccggctcgaccccgaagagactagagttcctgctctcacacagcggattccgtaactgagctttgtctcctcgcccaactcccttcaccccggcaaggtcactaccgccaactacccctttaagccgagccatcacggtaggagttcgtaacagccacagcagaacttgcctgtcataggatatattttgtcccctcggccccacctaccctccccatttcggcaagttacgtctttaccactagcccattctacagaaatagctgccgccgccaccctccggcgcgccccggccccgccgctccgcctccagcgcccccaggcccatttcccgcagaccctccccgggccgccctcccctgccctactctaggcgctccctctccctcgcagccacaccgtggctgcactcgccgtcctctcttccggccgctaccaccccggccccctagaaccccagcctcccgcgcccgcagccgcgttcctgtctccccgacctccgcacccccacttggcccggcctcctcgccttcctcccggctcctcccctcaggacacctgtgtcgtcccaccccctccaccacacacgcaccccccaccccaattccttcgcctccctgtcctccctcccccgccggtctcccctccccgctgctgccccgagagcccgatgtgggagggaaggcgcgggggaggggaggccgcgaagggggctgcttttctccgggttccccgtgctgcggaactgcagggctccccagcgccctctgccttcttcgccggcggcgcggaagtcggggtctcccggacgcccccgatgagggtatttaccttcttgccggggacactttgcagacggctccaacattggcaaacactacagagaactgaccccgctcggccgccgccggcttccacccctcgggctccccgccccccgcctccgcccgcctccgcccgcctccccggcgctccc

SEQ ID NO: 716 - DNA, 326560 bp, Homo sapiens; identical to SEQ ID NO: 715

SEQ ID NO: 717 - DNA, 326560 bp, Homo sapiens; identical to SEQ ID NO: 715

SEQ ID NO: 718 - DNA, 326560 bp, Homo sapiens; identical to SEQ ID NO: 715
